United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 56

SEQ ID NO: 833 - DNA, 2298479 bp, Homo sapiens
ctgcataacactgacatttttattagaattcatttgtaacaaatggaacttgtgtcagcaaagaactgattttcatacagacttctttcgccaccaatgtaacgaagtaagaaaataaaaagcacgcctttcattctgtaaaacatttacgcgtactactaattagaggtaattgtattttttaacaagccattttacaagttatttgttttaatttttcagtctatgcatccaaaacgagagcaaagaacacaactgttattatctttgtaaagacactccaagctgggatggcaaagccacataacggatggatagaatggatctgtagccttctgatctctgctggagtatcagggcacccataaacccaaaaggaaccaaaacccaaaaagaaaaacaaaaagggaattaaaaataaaaggacttaaagcaaaaccgaaaataaacaggaaagaaaaaaaatacgtgcattactgcagacttttttcccttcctgtttctatgttgtgttatttacatacacacaaatgaatttccgaagcagtttcttacagatgggttcaagtaatatcattattgggtgtagaatcaatagggcagtgcatagtacaaaggtatagaaagtgcaaagttccctagaggcccttccctcccctggctgtcctcgccgttttctaaccatgcaaatcatttttaaaaaagagctaaaataaagttctgtacaaatcactttttatatattttgattttttttaccattgtaactaattacaaaattatacataactacacgtacataggtaaataatagcaccgtactggttatgatgatgaaaataactggaaacttgaaagcttgtggtaatggcagataaagatggttcacctgggaaattaaaacttgaatggttgtacagaaaagcacagagtggaatgcacatcaatgacagtaagggagttagttctaggaacagctcctgaacagtaagattcccgcaatagtctccgcctcgttcgtctatggtatgcatcccattcattttcttcttctgattattgtcatctttccctttgccaaatgggcagttattgtttcagggagagaagctgctcattggccaatcattctggtgtgcagtgctccatcggattctacatgtccaacaaggcatgtctggatgatgcaatgtctgtctgaccccctttgtttaactaaaagaaaattatagcactgagtaatctggcacttggataaatctccaaaaagatacaaactaaaagaaaataatgataacagacccacatagtgcacattcttctctggttctgatgtaggttagagagtctcattctgaggtagccttctagatacttttttttagtattatatatattttcttttttttctttttctttgttttttacaaaagtgctcaaatacaatgcttgcaaatgtttggtctcttggatttcactctgctagcaatgggaaaatgtggaaaacaaaaatccttccatgcagaacatccatgaagctaaaattaaaccaaagtagtatactcataccaaaactctttaagagttccttgggtattttgaggattatttaaaatcatgtaatatgtggcaaacttatgccatcatccatggcttcctatagaaattctgttggaagaattgggggtaagatacatatatatatatagtttatttccccttttagaaaaatcctaatggaatatcaaatatattccaaagttgccaatgatatttgttactaaaataagtttggtgcagttactgcatgttccagagcggatttggaagggaatataaataaaacaagtagctttttctgatgttgatgattgattataaaaggaagaagggccctgattatccaagtgctttgggctggtacaatcactaacatccccgacttggctgaaaactaggaatgcatattattcaaagagtttttgtacatgtggtaaacagataatgctttaatagaaagtaacagatacgaacagtgaatggaaatacgaaccaaaagctaaaaagaaatgctattaaaataggcatcaattataaggcactctaaatgcaaaactaaaaccaaaacgaaacaaagtacagcacttcccaggaatgctgtatgccacaaaatgtttctgactgaacagagtaacatgaatttggctttgcccctgttacatatcataaatgcaaatttcatagcacatactatagacaatatacgattgaatacactttttttaaacaactcgatagctgatatattacaacattctcccctcctaaagggatatgcactgacctttcccacatgcacacctcttagctatttaataataatttttattgcactagagtgttagaaatattgaactttgttggaagcctgactaacaaacaaacaaaacaatttgtggatgtgattgattggttaggtgggggtagattaggtaggaaatcagggggtgaggtttgacaatcaatcactgatgtgcattcctcatttccctttaaagaaataccaatatgtcaaaaaattaagaataaatggaaagagatgtttacaatagcttttctacgtttaaaaaaactaaatcatggaagaactgactgactgataactgtatctattttttgtgtggacacactgtctatatatacatagacacccttataaaatatggatatatatgtatatatgttagcagcaactttatactttgcgcctccctgttgattccaaaaacaaaacaaaataataattatctttgattatttgaagagaatgggtactttctcaccaatcaaaactgaagtgtaaaattaatatatctgacgagactgatactgtagattgagttttgcacaaaaatgtgcaaattttcaaatgatttgatatttctacagcaagatattacagataacagttctacagcttaaaaaaacctacgatttggaaataaaaaaatgaagagttatgtaacttttttaaaattcactttatcgaatgatacattttgttaaaaaaaagtttacacagttagaaatgaagcacaggtcagcagtatctttacaatactaaaaaactaaatcaaggactttctttttaaacattccctcccctttccccctaaaatgttattatgagcagtatggtgggaaggggcgatgtcaaagcagagtccgtttcattgtgagaagccacaccagcacatatcttgtgctgaactgcagcattctggcaatttctccttgcacctttcaagcaatcctgaataagatggtggttctttgctgtgatttcttcttcccttgattttgaatccttgaggtatctgtaaataaaatccttcagatgcctcatcagtcaggattctcttcattatttttcaggttagattattaaactgtgaattcttggtccacctggaataatttgtttttaatttgttttgtgtgtaatagtcccactaagtagttgttagctagaagttaagaaggacttctcaagtgccctgtatggctcagaagagactccatggatattgaagggcctgtagtaaaaatccagaatgggtcaggggtttctacgttgcatagtggtcaaagctgcccaggtactctagtgcggcacgataggaaaactgatattgatcctgcaggagacaatgaatggggagaagcaaaagaagggaccatgagcatattttaatagaaaaataaaaatcaatattgcataacaaaataacatctatataggggcaaaatcactactttcgtcaactggtctaatccaatgaccaattgtttatagtgaacaaagaaaaagccacatggggtgttgattaactttgccaatcaatttgactaaaacgatctcccaattccaagcagtggcaggtcgagtgaacattaccttcccagacaagtgttttccaagtagtatcaaaccattaccaccaattgaacacataaacttcttacatgccttataagcagataatgatgaaaatcatcctttacaattatctgcttattcaagataactaattctcagtttaaatatttaagagaggctgatacagacacaaactgtcctgagaaaaatctgaatttacttatcttctgaactactgccaacagaatttgaatttttaaaaaattatgtttggacagtagagcttgcagtgagaatcactcacagtcatttcagctaccctttggctgtctctctcacttacatatgatgttcatatacagccagaaggtagctggtgcggcacaccaggcacacaaatccatttacacagggcactggacttccaagctttccatccctgaaaatggcttcacaggactggctgcccacatcaaaaaatacctgtaaattcagcccaattctgtgtgattgctagttgtctgttttagagaggcacacactaaaaaaaagcagtatgaagcatggcctttttcagacaacgaagaacactatcatattggaataaattgaagcattgttggagagatggaaaaatcacaatttacagctctctatagggatgaggaaaaggattttccccataaaagaaacctattttcagtggccaatcgggctgaaagtagacagatagtttctattttgcttaaatgtgcatttttctgtaataaaaatggttggtaatgcaaaataaatggtgtttactttcctatcttgtcacagtaagttgcttggctgagtgttaaggctttttaaatgtccaatttccctctgtaacccctaagacccattaagtttgtcaagctggcataatgttttgactattgcaagccaaacacttgcactactttgaaatccgtctgaaagatactgtggatgatgaattgaggaacacatataagttgtataatttggtggccttttgcagaacataaactctatcagtaatattatctttagaaatgaatgctcaatagaccagactggctatatcataaactcttattattacgagaaatatccaaatttccatattaattattggaataggaaatgaggggctaatattaatatctctaggcttatccagaatcaaaatgttttgaatggccattgttaagacatgaaatatagaagagctgatacctctgtaggcatacagagggagaatggagaagttaaatgggctgagattatattatgtactaaatattatgctttctatatatttatatatttatattataggactatgaatataacgaattttatgaaattgccattttattggtcaaaaatggtccagtagtaaaatttaacatagctcaatctaacatataatctcacataatttctatagcaacactaagacactaataatctcatcccatttaaaaagggggaaaatgaggttcaaaattattaaacagtttgatgctttccccacagtattttgtgtctggtgttgagagagtatggagtccgggaggtccaggctagcaaaacgtaggctcttgagatgcgaaaaatgcaatggattttctcacctctgtctgtaccatagctggtcgttgtgttcttaacattttgacagtctggaagatatctacaactccttcatatctcattctttccaaaacaatgcttagcgttatgaagactccagttcttccaacgcccgcgctgccacaataacaaaggcgatgttactgggtgagatgttcacagtcttggccacatttgcttgggtgtggacatacttctaccagcttccacactccgtatctctttatagccatattcaggaaaacatggtatcacattcatcaaatgattactcttgggatactgagttgtaacagcatgtgataatgaggatgaagtaattaggagtaagtctaataaaaggtcttttcaatggggatttataccattttagaaagaccaaggaaacataacaaatgaaaagaaagggtaaataacatataggtttataatattcatggagattctgaaatttacaacctgcctacttaatatttttaaagtatgaaataattcagaataaggtgaagtgaatttggcatcttcaacttttctatcacactgttcacattttgcagttacttaaaatacatatgcgatgcccataacctaaatgtatttgcctataactagtcaaatgtttacactggttttattatgagaaaagagatggtataacagggtatatacgtgattttcacttagtcttcaggagggtttatgactatcctgtaagtgtacgtacacatgaagtaaatactatgttgttttcttatttcttgagacttagaactttcaacagattctcacaggggtctctaatcttaaaaaaaaatggttaagagccattgatctctgaacttagctaccatttttacatgatcagcaactaaaaccacattagaaaggttttgagtttctctctgttgtcttcattgttttaagataactccagaatcttcacggtagcaagaaagaaaattaattcatagctcttgtgcacttaaggaggaaagcaatgggaagttcagataatgagggaaacagtgaataatctgaaaaatccctgcatttttggatcctaattaaacagcatgtgtaacacttgggcacgggctgtagaaaatagatggattcatttactggagggtgtagctgacaggcatatataaatagtgtgtccctttataaatggggtttctacagtctaaacagaaatgttaagtgaggtttgaaaatccaagcggagtcagtctttaagaagtgattgaagatgtctagcggcagtgaaaccttctgttaagatgaagcagatgaccttgaaggtcccttttaaccttgaaagtctctcttagttgtgagaaactgagatttattatctttttgttgaatgatctaggtactccagagtctatcttaccttgccagagtctatcttaccttgatttgatagctcgaatgcaacaaaaacattgggttactttctactaagtattttcaaaaaaagaacagacattggactcacaacttttcaatttactggttttatcatcttactttaataagttataaataagaaaagtggtattttcagaacattcctaaataagaggaaatatatagaagtcttctttgtgtgtgtgtgtgtgtgtgtgtgtgtatatatatatatatatatatatatatatatatatatataaaaggtatatgcatcgcaattcctttagcattatactaaaggaatattaaaattattttatgacaaaaacaatgagaacaggcacacataacacatttatgtacctatacatataaggatgcctaaagttaagaagatgtattaaattaaagatactcttttccttagagattattttagaaaagtttaaattagcatttgggcaaattatgagtaaagataaaagaaatatccaggtaattcaatcccaatatataccatctactttgtctgaatatgggtatacactgttttattgtgctatactttatggagttttgcagatactgtgtttttcacaaattgaacgtctgtgtcaatcttgcattgaacaagtatattggtgccatttttccaccagcacatacttggtttgtgtctctgtgtagcagtttggtaattcttgtaatatttcaaattttttcatactattacatctgttaaagtgatctgtgatcactgatctttgatgttactactgcaattggtttggggtgccatgaaccatgaccataagacaacaaacacttaattgacaaatgtgtgtgttatgactgcttcaccaaccagcagtttccccatctgtctttttctcctcaggcctccctattccttgagacacaacaatatcgaaattaggccagttaataaccctacaatggcctctaagtgttcaagtgaaagggagagtcgcgtgtatctaactaactttaaatcacaaactagaaataattaagcttaaagcccagatgtgctgaaagctaggcctctcgcaccaaacagcctagttgtgaatgcaaagttcctgaaggaaattaaaagtgctactccagtgaacacatgaatgataaggaagtagaacagctttactgctgatatgaagaaagttttaaaggcctgcatagaagatcaaatcatttacaacattcccttaaatcaaagcctaggccagagcaaggccctaactctcttcaattctatgaaggctgggaggtgaggaggctgcagaagaaaagtttgaagttagcacaggttggcttatgaggtttaaggaaggaagccaaccccataacataaaagtgcaaggtgaagcaataagtgctgttacagaagctgtagcaagttatccagaatatctagctaagatcattgatgaaggtggctacattaaaaaagagatcttcaatgtagacaaacatcattatattggaagaagttgtcatctaagactttgatagctacagaggaggagtcaatgcctgacttcagaacttcaaagaacaggctgactctcttgttaggggctcatgcagctggtgacattaagctgaagccaaagctcatttaccatttgaaaatcctagggctctcaagaattacactaaatatactcaagtgaaaggaagagttatacatctctcattttaagtcaaaagcttgaaaaaattaagttttagtaaggaaggcacgttgaacatcaagacaggctgaaagctcgacctcttgtaccaaatagcccagttctataaatggaacaagaaagaatggatgataagacatccgtttatagcatggttgactgaacattttaaggccactcttgagacctactgcttagaataaaagattcttttcaagataatactgctcattgacaacataccttgttacccaagagctctggtggaatgtacaaggagattaatgttctcatgcctgtgaacacaatattgattctgcagcccaatggatcaaggaggaatttcaactttaaagttttgttatttaagaactacattttataaggctatacattctatagatagatagtgatttctctgataggtctgggcaaagtaaattgaaaatttactggaagtaattcaccattctatatgccattaaaaacatttgtgattcacgggagaagatcaaattatcaacagtaacaggagtttggaagaagttgattccaatcttcatggatgactttgaggggttcaagacttcagtagaggaagaaattgcaaaaatggtggaatagcaagataactagaactagaagtggagccaggagatgggactgaactgctgcaatctcatgataaaacctgaatacatgaggagttgttccttacggatgagcaaagaaagtggcttctcaagatggaatatactcatgaagatgctgtgaacactgtggaaatgacaacaaaggatttagaatagtacataaacaaagttaatagaaaagcagcagggttgcagaggaatgactccaattttgaaagaagttctactgtgagtaaaatgctatcaaacaacattgcatggtgcagagaaggctcttgactttgtcacttagtcacttgatgtggcaaacttcattattattttcttttaagaaattgctacagccacctcacccttcagaaaccaccgcccatcgattagtcagcagccatcaaaatagaggcaagaccctcaaccagcaaaaagattaaaacttaccggaggctcagatgatgattagcatttttttttttttttaaactttaagttctggggtagatgagaaaaaagtgctggtttgttacataggtataaatgcaccagggtggtttactgcacccatcaacccatcatctacattaggtatatctcctgatgctatccctcccccaggcccccaccccctggcaggccctggtgtgtgatgttcgcttccctgcgtccacgtgttctcactattccactcccacttataagtgagaatatgcggcgtttgattttctgttcctgtgttagtttgctgagaatgatggtttccagcttcatccatgtccctgcaaaggacatgaactcatccttttttatggctgcacagtattccatggtgtatatgtgccgcattttctttatccaatctatcattgatggacatttgggttgcttacaagtctttgctattgtgaatagtgccacaataaacatatgtgtgcatgtgtctttgtagtagaatgatttacaatcctttgggtatacactcagtaatgggattgctgggtcaaatggtatttctggttctagatccttgaggaatcaccaaactgtcttccacactggtttaactaatttacacacccaccaacagtgtaaaagcattcctatttctccacatcctccccagcatctgttgtttcctgactttttaatgatcgacattctaattggtgtaagatggtatctcattgtggttttgatttgcatttctctaatgaccagtgatagtgagcattttttcatatgtttgtctgccgcatcagtgtcttcttttgagaagtgtctgttcatatccttcgcccactttttgatgaggttgttgttttcctgtaaatttgtttaagttctttgtagattctggatattagccctttgtcagatggatagatagcaaaaatttcctcccattctgtaggttgcctgttcactctgatggtagttttttatgctgtgcagaagctctttagtttaattagatcccatttgccacttttggctttagttgccattgcttttggtgttttagtcctgaagtctttgtgtatacctatgtcctgaatggtattgcctaggttttcttctaggggttttcatcattttacatcttaggtttaagtctttaatccatcttgagttaatttttgtataaggaagggatccagtctcagttttctgcatatggccagccagttttcccaacaccatttattaaatagaggagcctttccccattcttgttttccctcaggtttgtcaaagataagatgtttgcagatgtgtggtgttacttctgaggcctctgttctgttccattggtctatatctctgttttggtaccagtaccatgctgttttggttactgtagccttgtttgaagtcaggtagcatgatctctcaagccttgttctttttgcttaggattgtcttggctttgtgggctcttttttggttccatgtcaaatttaaagtagttttttcccattctgtgaagaaagtcattggtagcttgatggggatggcattgaatctataaattaccttgggcagtatggccattttcacgatattgattcttcctatccgtgagcatggaatgttcttccatttgtgtcctctcttgtttcattgaacagtggtttgtagttctccttgaagaggtccttcacattccttgttaagttggactcctaggtattttatcttttttgaagcaattgtgaatgggagttcactcgtgatttggctattattggtgtataggaatgcttgtgatttttgcacattgattttgtatcctgagactttcctgaagttgcttatcagcttaaggagattttgggatgagatgatggggttttctaaatatacaatgttgtcatgtgcaaacagagacaatttgacttccactttttctaattgaataacatttatttctttctgttgcctgactgccttggccagaacttccaatactgtgttgaataggagcagtgagagagggcatccctctcttgtgctacttttcaaagggagtgcttccagtttttgcccattctgtaggatagtggctgtgcgtttgtcataaatagctcttcttcttttgagatacgttccatcagtacctagttttttgagagttgttagcataaagggctcatgaattttgccaaaggccttttctgcatctattgagataatcatgtggtttttgtcattggctctgtgtatgtgatggattacgttcattgatttgtgtatgttgaacaagccttgcatcccagggatgaagccgacttgatcgtggtggataagctttttgatgtgctgctggattcggtttgccagtattttattgaggattttggcatcgatgttcatcagggatattggcctggaattttcttttttgttgtgtctctgccaggttttggtatcaggatgatgctggcctcataaaatgagttaggaaggagtccctctttttgtattgtttgcaatagtttcagaaggaatggtaccaattcctctttgtacctctggtagaattcgtctggtcctggactttttttggttgctaggctattaattactgcctcaatttcagaacttgttattggtctatgcagagattcaacttcttcctggtttagtcttgggagggtgtacgtctccaggaatttatccatttcttctagattttctagtttatttgcatagaggtgttgatagtattctctgatggtagtttgtatttgtgtgggatcagtggtgatttcccctttgtccttttttattgtgtctgtttgagtcttctgtcttttctatctattttgttgatcttttccaaaagccagctcctggattcattgattttttgaagggtttttcgtgtctctatctccttcagttctgtagtgttcttagttatttcttgtcttctgttagcttttgaatttgtttgctcttgttactctagttcaattgtgatgttagggtgtcgattttagatctttcctgctttctcttgtgggcatttagtgctataaatttctctctacacactgctttaaatgtgtcccagagattctggtacattgtgtctttgttctcattggcttcaaagaacatctttatttctgccttcattctgttatttacccagtagtcattcaggagcaggttgttcagcttccatgtagttgtgtggttttgagtggtttttttttttaaatcttgagttctaatttgattgcactgtggtctgagagactgtttgttatgatttctgttcttttgcatttgctgaggagtgttttacttccaatatgtggtcaatgttagaataagtgcaatttggtgctgagaagaatgtataattctgttgatttgggtggagagttctgtagatgtgtattattaggtctgcttggtccagagctgtgttcaagtcctgaatgtccttgctaatgttctatctcattgatctgtctaatattgacagtggggtgttaaagtctcccactattattgtgtgggagtctaagtctctttgtaggtctctaagaacttgctttatgaatctgcatgctcctgtagagggttcatatatatttaggatacttagctcttcttattgcattgacctctgtacgtaatgcccttctttgttggtttaaagtccgttttatcagagactaggattgtatcccctgctttgttttgctttccatttgcttggtaaatattcctccatccctttattttgagcctatgtgtgtctttgcatgtgagatgggtctcctgaatacagcacactgatgggtcttcactcctctttatccaattggccagtgtgtgtcttttaattgggggcatttagcctatttacatttaaggttaataaggttatgtgtgaatttgatcctgtcattatgatgtttgctggttatttgactattaattgatgcagtttcttcccagcatcgatggtctttacaatttggtgtgtttttgcagtggctggtaccagttgttcctttccatgtttagtgcttccttcaggagctcttgtaaggcaggcctggtggtgacaaaatctctcagcatttgcttgtctgaaaaggattttatttctccttcacttatgaagcttagtttggctggatatgaaattctgggttgaaaagtcttttctttaggaatgttgaatattggccccactgtcttctggcttgtagggttgctgtcgagagacctgctgttagtctgatgtgcttccctttgtgggcacgccgacatttgtctctggctgcccttaacattttttccttcgtttcaagcttggtgaatctgatgattcattgtgtgtcttggggttgctcttctcgaagaatatcttagtggtgttctcagtatttcctgaatttgaatgttggcctgtcttgctaggttggggaagttcttctggataatatcctgatatcctgaagagttttctccaacttggttccattctccccttcactttcaggtaaaccaatcaaagtaaatttggtgttttcatatagtcccatatttctcggaggctttgttcatttctttttactcttttctctaatcttgtcttcatgctttatttcattgagttgatcttcaatctcggacatccgttcttccacttgattgatttggctattgatacttgcgtatgcttcacgaagatcttgtgctgtgtttttcagctccatcaggtcatttatgtttttctctaaactgcttattctagttagcaattcctctaaccttttttccaggtacttagcttccttgcattaaattagtaacatggtcccttagctcggaggagtttgttattacccacgttctgaagctgacatctgtcaatttatcaaactcattctctgtcctgttttgttcccttgctggcgaggagttgtgatcctttggaggagaagaggcgtgctggtttttggaatgttcagcctttttgtgctggtttctccccatcttcgtggatttatctacctttgacctttgatgatggtgaccttcagatggggtctctgggtggacgtgctattcctttctgtctgtctgtttgttattttccttctaacaaacacccaggcctctctgctgtaggtttgctggaggtctattccagacgctgtttgcctgggtattatcagcagaggcttcagaacagcaaagattgctgcctattccttcctctggaagcttcatcccagaggagcacctgccagatgccagccagtgttctcctgtatgaggtatctgtcagcccctactgtgaggtgtcacccagtcaggatacatgggggtcagggacccacttgaggagagagtctgtcccttatcagagctcgaacactgcactgggagaaatgctgcgctcatcagagctgccaggtggggatgtttacgtctgctgaagctgtgcccacagctgccccttccgccaggtgctttgtcccagtgagatgggggttttatctgtaagtaagtctgtgattggggctgctgtctttctttcagagatgccctgcccagggaggagtaatccagagaagcagttggccttgctgagctgcagtggactcagccctgtttgaacttcctgctggctttgtttacactgtgagggtaaaacaaacagcctactctagcctcagcaatggcagatgcctctcccctcacgaagctcgaatggcccaggtggacctcagacagctgtactcgcagtgagattttcaagccagtggatcgtatcttgctgggctctgtgggagtggatcgtatcttgctgggctctgtgggggtgggacacaccaagccaggcactggagggaatctcctggtttaccagttgtgaagactgcgggagaagtgcagtatctgggccagagtgtactgttcctcgtggtacagtctctcacggcttcccttggctaggaaagggaaatcccctgaccccttgtgcttcctgggtgaggcaacgccacaccctgctttagctcaccctttgtgggctgcacccactgtccaaccagtcccaatgagatgaaatgggaaacgcagaaatcccctgccttctgtgtcaatctcactgggaacagcagaccagagctattcctattcagccatctttccagctcttgtaagtacattgttgtttgtttagacctaatgctattgcacactaaatagactatagtataaagtaaacacaacttttatatgcactgggaaaccaaaaagtatgtgtgactccctttattgtggtaatctggaactaaactcccataacgtctctgaggtatgcctgtatttgattccatgtgtcatttcctacaagctctttggttggtttgcaaaggatgtttaataactcaatagaaagtagaaagcaaatgtacatagataaaggtttgcttcttataacatgcctgagaaacaaaggatgctagaagggactttaaacctcagctaagataactgaagtccagagaaacttcattatcatagagccaaataatagaattgagattagaacacagctatcttagcccaagtctaatatttgtcctattttgagatcctgccttctatgtcgtaaagaactatagttttctttgatgtgctgaagcaaaatatattttttaataaactctctcaagagtttcaccataaaaagattagatgtcaagttgccagaaccctaaaatatattagtttaaataaaattagatgaattgcttttgttagaaggtttttgcatagcaacttccaaaaacactaaatttatggtgaatgtctgaactatttacttgctatttatttctattaacttcaatgacttgagttataaaatgctctagaaactattgaaaataattaacttgaaggtgcttcattttctgatatagcaacaattttcaagcaaattgcattttttaactgaggtaccatactaagcacttattgactggcagaacttaatattgtcattaggatttatttgatagctattcatgaggttttcacaaacagaagaaagacagttatcagtgcattgctatgaaagcaaaagcaaatatgaaatgattaacaacgaattattactaggggaggtaccaacaattcccattaaggtaaaattggtaatttggtttgtctaataggaagcaaattttttgggggataaacatttttttggggctaaacattttcctctgattattttcacttattttcactttatgaaaagaaagagaaatcaatcctgctttaagttttgtaatacattgccaagaataaaatttcaaataagcaaacttactacaaaaagtgtatacagacaatgaagaaacaccaccacttatcactgctttattcacaaatggaaacttacctgcaatggactgaaatgggtccatcttggccaaactgttcttttgttttatggacttggccgatgaagtcaataaatccttctccggactttggcactccttgctctggccagtcagtgaactggaactgccttactgttcgggactggccgtcctttagaaggaaagccacatacccggccgcaaaggaagacgccaggaggattcagcaagcatacggaccacaagaacaatcattttcatttcccgaaaacaaaaagggtagaaaaagttaggaacatgtttaaatagaaacttagttatggtttatctgctataaatattgtccacactcacatacctttaaatcctaaatttatttactcttgaaatcctaaatttatttactcttgcagtgcccagttaaaaacctggttctcgttagtagccatccacatagttcccccattaacaaatgtttctgagacccaaagtgggggttcgtaaccattcatcatgtctgcattccttccaaaatggaacatataaaatggaacatatatattccatttcaaaaatttcagaaactaattactttgtaataaatattgaaacaagcacctaggcatgtcatccagaccagagcttttgcagttgtcgcaataacttcacatctgctgtgcttgcgtatttctaccgttgtcaaatgacaaatggtgaaatttaaagtatctgacacaaacccggtagttgctgttaacctggatgccccccatgtctcagaggaataccatttctagccatggcaggggacatagcatgaaccatatgactgtgctgttaagtgggaagtaaagcatccctcaaggataccaacgactattagcaaacaaatgcccttttctgaaaaagagctctccctggctgaccacaggaattaacagtctgtggagagctttaacatagataaaccaaaaggtagaaaaaaaagccagattgaagagcagtctttcttttttagagtgattaggtaaaactgctctgactcacgaagtatatctgggttgaaaagaagacactaaggcatttctgatcttctgatcccttgtggaaatttaaggtgtttctagaagtacaagaaaagtggaagggagcctctgtttatagaagcagaaataatacattgcccatcaaccttctcccctgactcatcagcagagagaaataatccaagcttagagagaccgatctcatttctcatttgaagaggtcctactcctaaatggtctcttctcattaaagagccttcaacttgttcctccattgtttctgttaacacattatttcctcatcaaactttttttagatacacgtgtgcatgttcccaaggttctgggtaagtgaacagggactcaatcctttatcattcactcatattgagaagagagaggatctcagtgtgagatgagcactcatcacctcgcctggtggttttcacagggacatgccagattcctgactgatgttatttggggatggagataaacaggaagatgacaccaagtgtgtgggaatactgagaaatagagaaaactatttggccccataagtactttatggatggttaccatggaagcatgatttacttccctctgtttctggaaaagatttggaaagcacaggaaggagacccagaagctaggtaatacagatttattctcctctgaatgtcctggggatttcatttctgaccacagttgctttcaatagcaagaagaggtcatgtgtgcaaataccttctatttggaggagagactgcctgacttcatttaaaggttacctgtttaacaatactgtaattttcaacccagaattgcatatccagccaaattaagcttcataagcaaaggagaaataaaatcctttacagaaaagcaaatgctgagagattatgtcaccaccaggcctgccttacaagagctcctgaaggaagcactaaacatggaaaggaacaactggtaccagccactgcaaaaacataccaaattgtaaagaccatcaacgctatgaagaagctgcataattaatgggcaaaataaccagccagcatcataatgacagaatcaaatttgcatataacaatattaaccttaaatgtacatggactaaatgccccaattaaaagacacggactggccaattggataaagagtaaagacccatctcacacgcagagatacacataggctcaacataaagggatggaggaagatctaccaagcaaatggaaggcaaaaaaaaagagcaggggttgcaatcctagtctctgataaaactgatgactttaaaccaacaaagatcaaaagagacaaagaaggccattacataatggcaaagggatcaatgaacgaagaagagttaactatcctaaatatatgtgaccccaatacaggagcacccagattcataaaataaagcaagttcttagatacctacaaagagacttagactcccacacaataataataggagactttaacaccccactgtcaatattagatcaatgacacagaatattagcaaggacattcaggacttgaagtcagctctggactaagcagacctaatagacatctacagaactctccaccccaaatcaagagaatatatattctcaacaccacattgcacttattctaacattgaccacataattggaagtaaaacactcctcagcaaatgcaaaagaaagaatggaaatcataacaaacggtctctcagaccacagtgcaatcaaattagaactcaagattaaaaaaaaaaccactcaaaaccacacaactacatggaagctgaaccacctgctcctgaatgactactgggtaaataacagaatgaaggcagaaataaagatgttctttgaagccaatgagaacaaagacacaatgtaccagaatctctgggacacatttaaagcagtgtgtagagagaaatttatagcactaaatgcccacaagagaaagcaggaaagatctaaaatcgacaccctaacatcacaattgaactagagtaacaagagcaaacaaattcaaaagctaacagaagacaagaaataactaagaacactacagaactgaaggagatagacacacgaaaaacccttcaaaaaatcaatgaatccaggagctggcttttggaaaagatcaacaaaatagatagaaaagacagaagactcaaacagacacaataaaaaaggacaaaggggaaatcaccactgatcccacacaaatacaaactaccatcagagaatactatcaacacctctatgcaaataaactagaaaatctagaagaaatggataaattcctggagacgtacaccctcccaagactaaaccaggaagaagttgaatctctgcatagaccaataacaagttctgaaattgaggcagtaattaatagcctagcaaccaaaaaagtccaggaccagatgaattctaccagaggtacaaagaggagttggtaccattccttctgaaactattccaaacaatacaaaaagagggactccttcctaactcattttatgaggccagcatcatcctgataccaaaacctggcagagacacaacaaaaaagaaaattccaggccaatatccctgatgaacatcgatgccaaaatcctcagtactggcaaaccgaatccagcagcacatcaaaaagcttatccaccacgatcaagtcggcttcatccctgggatgcaaggcttgttcaacatacacaaatcaataaacataatccatcacatacacagaaccaatgacaaaaaccacatgattatctcaatagatgcagaaaaggcctttggcaaaattcaacaccactttgtgctaacaactctcaataaactaggtactgatggaacgtatctcaaaataagaagagctatttatgataaacgcacagccactgtcataacgaatgggcaaaaactggaagcattccctttgaaaactggcacaagacagggatgccctctctcaccactcctattcaacacagtattggaagttctggccagggcaatcaggcaagagaaagaagtaacgggtattcaattaggaaaagaggaagtgaaattgtctctgtttgcagatgacatgattgtatatttagaagaccccattgtctcagccccaaatctcaagctgataagaaacttcagcaaaatctcaggataaagaattaatgtgcaaaagtcacaagcactcctatataccaataacagccaaatcatgagtgaactcccattcacaattgcttcaaagagaataaaatacctaggcatgtgaaggacctcttcaaggagaactgcaaaccactgctcaaggaaataagagaggacacaaatggaagaacattccatgctcacggataggaagaatcaatatcgtgaaaatggccatactgcccaaggtaatttatagattcaatgccatccccatcaagctaccaatgactttcttcacagaatgggaaaaaactactttaaatttgacatggaaccaaaaaagagcccacaaagccaagacaatcctaagcaaaaagaacaaggcttgagagatcatgctacctgacttcaaacaaggctacagtaaccaaaacagcatggtactggtaccaaaacagagatatagaccaatggaacagaacagaggcctcagaagtaacgccacacatctgcaaacatcttatctttgacaaacctgagggaaaacaagaatggggaaaggctcctctatttaataaatggtgttgggaaaactggctggccatatgcagaaaactgagactggatcccttccttatacaaaaattaactcaagatggattaaagacttaaacctaagatgtaaaatgatgaaaacccctagaagaaaacctaggcaataccattcaggacataggtatacacaaagacttcaggactaaaacaccaaaagcaatggcaactaaagccaaaagtgacaaatgggatctaattaaactaaagagcttctgcagagcaaaaaaaaaaaaaaaaaactaccatcagagtgaacaggcaacctacagaatgggaggaaatttttgctatctatccacctgacaaagggctaatatccagaatctacaaagaacttaaacgaatttacaggaaaacaacaacctcatcaaaaagtgggcaaaggatatgaacagacacttctcagaagaagacaccgatgcggcagacaaacatatgaaaaaatgctatcactggtcattagagaaatgcaaatcaaaaccacaatgagataccatcttacaccagttagaatggcgatcattaaaaagtcaggaaacaacagatgctggggaggatgtggagaaataggaatgcttttacactgttggtgggtgtgtaaattagttaaaccactgtggaagacagtttggtgattcctcaaggatctagaaccagaaataccatttgacccagcaatcccattactgagtgtatacccaaaggattataaatcattctactataaagacacatgcacacgtatgtttattgtggcactattcacaatagcaaagacttgtaaccaacccaaatgtccatcaatgatagattggataaagaaaatgtggcacatatacactatggaatattatggtgagtgagtattccataaaaaaggatgagttcatgtcctttgcagggacatggatgaagctggaaaccatcattctcagcaaactaacacaggaacagaaaaccaaacactgcactcaaaagtgggagttgaacaatgagaacacacggacacacggaggggaacatcacacactggggcctgttgcgggtttggagtctaggggaacgatagcattaggagaaatacctaatgtagatgatgggttgatgttgcaccaaaccaccgtggcacatgtataattaaattatgtaacaaacctgcatgttctgcacatgtattcaggacttacactccaggagcacagacaaacagcaaatgtagtagctaagaaaattatacaatcacagggagactttaaaaaaaaaaaggtgagcaacttccggtttcaatcttcttttgtttattgtgatcagatttaagttgtgcatgtgtggaataggaaaggtgtctctgccattggtggggcctggtgccttttctttatcaccaggaatagttggtgagtttactcaaaatgcactttctattttcactcacatacctagcttcaaattctgaaagagcactattttttttttttttaaacggtggggcaggttacactcaagacctagagatttaactgctgccttgaatactgtcaccttcagaatagttaatataactttctgggattaacaggtctgtcacctaggccaaccctcctgctaaccaatttctctttcacttaaggtcaacagccagggccaggctttggggattagcagacaatctccaaacctaagtttggagaaagctgctttccagaaaaaacaatggatcaactaaatagctttaccctggagttttattcaacccacccactgtgacagttccaaacacaaggcaggtctttgaactgacctggtctcccttaagatgtgtttgtaatcatgggttgaaagtggccaaaggcgaagatatcagagtttatgcatagaacatcttacatcagggctgaaccttggactcaacaatccagataagaaatgcaggatgaaaattagccaacaagggtcatgggagcacagctctcatggacagacacattagcacactgaggaataagccatgccaggaatcaaattagaatgtgcaaagcttgtcagatttttctaaagaatgccatttgctctgcggttttaaaatcataccaaattaacctctgggtccatatgacctaaagggctttgcaaaacaacaacatatttagagcctcaagtaatgaagaagtcaaaaaagctccaaagagcatgagctgagaaggtgaatgtaagcacagccaaccaatcagtaaacacttcccagcacgaacactcaccaagtgcatccccaaggttgagctgccagatgttatgtttgaatgaaagccaaactaaggtttgtgagaaagcttgccagacagaggaaaagttactcttacatattaaacataaaaaaaaacgttctccagaatgaatgatttctctttgggacaacagtcaagtggcaagtgcttctcccagagagagagagagagaggtatcttagactacttttcagctaatggttaagagttgaagactgtgccaacttaccctggcatctgtgaccttgaattcccttaggatatactgtggcatgttgtactcagccatgggatctacaacaaagtactggtatcttgcagaccgttctgctggccagtattggtgacatttctcctaaaaggagagaagattaatgttaaactatgcaaagtataaagaacattctgtatattatctatctatctatctaatctatctaatttccttatcccattaataaaatttcaaaattcaaggcaattccaattgcatatgactcatttcctcttagaaaccatgagctcccttcatagggaaaccctttggttcagtatttgcctatggcatccagcacggtctctggcagatagtagctgcttaatatacacgagttgaattgagaattgaatactttcatagggtaagcatcttcatacctacaagttatccaaataattacatcagtccttggacaatgctggccatgacaataacacattgcaccaccacagcatacttgcaccactatggtttggaatgaagagaaccatcagtatggacatagaaagaaacctccgaattgatttgttccaatcttacttgtcaaggaaacgaggggcccagtccattttaatgacttggctaaaccctgcagagtcattggccaaatcagagtaagtcagttactttcctcgtctgatattctttttgttctctccgggggctctacaagttgggctttagctgcacttctatttaatttacacaaagaagacagaaagaaaatatctgaagcaaatacgaaataatgcttacatcaagtcaatctaagaggtatctctaaataatattaggtcatagtggtagagcagtattaatagtagaaaccttaagtatttctaatactattttatgtgtatttcaaaaaaaaacaaaccacttttttcaaaagtggatctgggattaccaggttatatccttagaaaaactatgttgctttccaacactttattcaatgggagtgaaaggtaggcaagtaagaatttgcctcaggaagaaaagaaagtcaagttccttcataagtagaaatgatggcacatcaaactctagcctgtccagaacaaaaggcagtaagaatatgctaaaagaagtccgacataagtcaaacggggacacctgctactcatttgtctccatgcttgtgcttcactggaaacaaatcactagatctttctttaaaacacataaatttaaacacttgatgtggctttacaaatttagaaactaacaaggaatgatggtccggattatgtccagagtgcactgcatttcaaaaaaaatgatctagcacaagagttattgaaacaaagtcttcatttctccacagagtaaatgtcttatgaggagacacacaagggccacacacttactctgcccatttcacgcagcttggtgagcatcacaactatggtggaattgtgttcccagagcatccgccagaagtcttcagtggtctctgccaagggcccctgggtagcgatgtaggctttctgttgtctgaattacagagaatgaaaagaatgtgttaaagtatttagagaacatgcaaaagctcacactggatacataaacatcaacctgctaataaaaaacgaaaacatattattaatgcaattgaggtaaattcctgctaagattaaataatcaaataagagcatttaatacattttggggacttcgcaaactaaattgcttgttaatattatgatgtatgtctttatcattattatttgaattttagcgcaatgctaatagctcaatttcattgtcatacaaattacttaagaaacacttagatgtgcagcttcattttctagaaattattctcacacaatctattaaatttatgaaatatggtacaaaacagattctttattaactacttacatatccaattggcttatgaaagaagagtgcagaaggccagattaaacacttcataactactactcctaactcctatccaaaataacaaaaaaacaaataccaagggactaaatgatgacctatgcagaaagaaaatgtctttgaatggagatgaaatttattctggttattaaactagggcacatgtaaatatcaaggctttggatagtcaggggagcaaaagtagatacctgtatccatcaataaaactggcattgatgtaatcagatccttctactccacggataggctgcaggcatacccttgtggattcatatggcataatattaacaaggcgatttttgaatttattacatggaagattggcactgataaaccttgaggtgtgagcttttgagctggctagacgctgttgaataggaaaaaaaaaaaaggaaaaacccaacaaagatcattttcacctacagtttgaatgcagtgtaccccagatttcccttttagatataaatcttttgtttacttaaagtaaatgactattcaaattgtactgcttttcacatctacctaatcactctctatagcctattggatttctatatattttctgaaagtatagtctctcaagttaggagacataagggctcaagatattgttaggaagcaaagaatagaagaggaaaaggggaggaatacattttataatcatacacctgagggaaaggtcaaatgaatcttgtacttcacaaatttgaaaggttaaagtaaagccacgactcaaagacaaacccagaatgacttgctcctgaataaccacatcacatccaataccataccttaaattcgagctccattcctgtgacattctctcccgtttctatttgtgtcagcttctgaatgtaggcatacaagtttctagctggcacttcggtatttccacaagtcactgcttctaacagtgcatcatggataaagatgtattggtcttctgtttgaaccatatagttcctctgggctctcattaaagttacatggccataaatatctacagttttttcatgctttattctttctaacatggcatctatgacgatgaagcaaccagtccggccaactcccgcactatgaggaaaatagagaagaaaagcccaaataaacctatcagaaaatcaatacataataaaagtatttttattattcttattaactagaccttacatccattacttctactcaaatagctattgggatgactttgtaatactctaaagtcaaaagtattatctaggcaccataatcagaggacagggaacaaaagactgagtaaaattagtttagttttaaaatgtaaaaaatattaaatccataatcactatgttccttgatcatgcaatacaaagtgaacattatttcgaaaacttttgaagtcattatgaaaaaaatacaaacatttagtctgtccatatttagaagatagttttatatattggtccagatctggctaggctatagttcttgcaaactctctcaatctgttttcgtcccatgtacaaaacataaagattgtttttacagtctcaagctaaacctcgcatgcttcctatttatcaaacccttcaggctgaggacatttatgtgtcaagtatggttcaatccaaaatactttctcttcctgatcatgcgggtttatcaggctggtaaacatgtcatcaacaggaataggtatataataggtgtatattaccatcttaggtaacaggcaacagacagcctccttcatttgctacatgctatgtttcctgtcatctgtgtatctatgtgttcatttattgtccatccctcattgatctgtccatttcttcattcaataaacaatgaagtactctgctaagtgaaataggggatacgacataaagatgacttagatgctatctctaaagagctcagagtgtatcgaagggacataatactttatacacagctatttctaaacaagaaagaaaaaggatgtattagttttgtatatgatgtggcatttgaagtaggacttgaaggacaggaaggatgaggaattaaagatgttgtagtatgaacaaaggacggatggctttggtaatcacactgctggctctgggagctacatgtgaaattttcataggtctggcaaggcacctttgcaacgaagataccagaactccaaaacaaatgagttaatgctcaccagggtgcctgtctcaactgaaatggcagtttctgtttggtatcatagtggctgcaaggcagtaagagatcattttttttttaaacaaaataatacctttatttaactgctgaacagtgtatatcaaagctagcttgcatacaggagctctgtggtttacagactgggctaactagctgggaatttgatataaccactactttaaaataggttacttttttatgtcctatgccagagggctcctgaatactgatgccaagaatccaatcccaagtataaacccacaaattgacatgacattgatatatcatgcaaaagccttctgagacagagagtcctacaaatgatagcacataccttagcacagaccaattggcaacctgatgcaaacattaatatagagcaaagtcggcctggtggttccagttccttgagatccatgaagtctcattttatttagttggttctaaagaaacctgttagatggcgagttttccctgacattccccattcctaccctcccaggtggttttaatcatcctctgcctcagatccctggttgccctcaaatacccctttactacaattctaaccaaattatattattaatttagggcagccatccataaacaacagcatacatcttgagagcaggaactgcattaaaaaaaatatttgtgtgccctacacaaagcatgcagtaagtgctcaacagtgtttgtgaaataagtaaacaaattagtgactggcttgagatgcctgcagtaatgagcagcccgtcccggtaaggtaagcctacttaggaagcaggactcttcagaccatgcaaaatcctacatttgacaagggtttggaattatgtaaggagtacccgaggactcctctgcatagtgtttgatcaggaataaagagacaggaaaatcactttaagtagtctctttgctggtctcctgatatgccatcagattgcagttaaaggaacctaagtcagactcaacctggaaaagatttgtctttctgggtttctttcaaactccatgtttggcaggtcctgagactccaagtaacatctttcgttctttctgtgttgtctttctaaattgtcttcattgcagctgtgaatcgtttctcatggacacagttttatgcagttcttcccagtggaaaccacactgtaaaccttagaactgagccctatacatcaagtcaattctagataatggcaggactattttctcaaaatatgcatcagggaccattcaaatgtctggatgatgcatggttctatattctggcagaaagatactacagaatcttgcaaaattggtaggaataactccaactctaaacagtatcaaccttttcataatggtgattttttttttccaaaaaataagggaaaaaaatcaaatacgtgtgagtccaaatcatgaattgtgggatgaaaagaaataacagaggctatgacttgaacaaaacctattttttcccccacaattcaaaatattgttaactgcccaatcctgctattcatatggaagatagggaaggagctgacgtttggaacttaatgtgttaccttcttctaggatgaagaattcttgagggatttaaacattaaataagtgttttcgcttgaagcaagaccttgaggcttaaggtacctcttcagacatcaatggctgtgtgtccttgagaaagacattttaaccccttccttatattcccatatttcttaaatgatagtgacagttaactcttattaacgttaattttctagtgagtctaattatccagtaagtcttaaggctaaattaaaaataccaagtgttttgcaaacataatggaaaaggcagttactttctaggtacaaactccattttaacattcagtctctaaagctgacaatgagaaacaagcaatgtaatgctgggaaaattatgacagaattactttagaaacatttgagatttggcttttaaaatcttgctttcgtctactctctcaagctgctcttcctttcctctgccttctttccaataaatgtgccttatacctgaggagctttctgcgttcacatttatcatcgtggcaaatgagatggcaggcaagggccttcctaccacagtgcttgacacctaagaagcattcagtaaatgttggtttcctttccccttctctgacaacacttgggaactgccctgaagtcctacagtcatgcacgccatacctggatagcagagaagactcaaatgcaggttctgaggtgttaaaatttagcaccctgttcccagcacccccagtgcttcacaatgctttccaccatttaggtcagcagtcattgccaaatatggtgactttcctgtagagcgctcgtctgtgatatttcattggcagcatttgactatccctaatgcaggttcctagaaaagctttctatccttggttttaaggacactagtcaagggagtatgggaaacatcagatactcccttggggttaatggtagcaagggtggagattgtgtcattactccagacacaaaataatccaaaacaggtagtacacgaaatcagcccaaaataattgtatcatgatcctgtatcacggttccattgattctgtaacagggtagaattcctaccacgtttgaaatcgaaatcaaagatgaactctaaatgtcatcttcagaaatctactggcatccgttcagactgtgcctcagtatgtttcgttttgttttttttatttgactccagtgctaattctctacctgcctctctggattcttccatctgtatcaatttcacggattacatatctctgccagtccccaaaatgtagataatgctccaaaagttctgtccttctttctctcagtagtagtctccaaaggattcctaaagtgatgcctttctttttcagcacaagtggagatctatatttcaaactgtcttcaagtttatcaaaaataaagattctaagcttaatcagtatcttctcctttcaaatctgctcctcccactctcaggctctccttgacactcaggtttaaaactgaaaaatcatcttagactctttttgcctcttaccctgcaaaataataaattataaattgttatgtattcaaactccacgattatcttcaactccccatcagtggtgtgctagagctagcaaaagccaatccttacattttcagggattatttgctgaaataaatatattaaaaataaaggtaatatataaaactcattgtttcttaattgtttcaaattattttatgctcttgaggtgaaaacatcatatagagtagtccccttttatctgtggttttgactttctgcaatctcagttatttgcggttaaccacggtctgaaaatattaaatggaaaattccagaaataagttttcaatgacatacttttctgaaaagtgtggtgaaatctcaagccctccctttccatccagcccagggtgtgaatcaatccctttgtccagtgtatccatgctatacaggctgcctgcctgttagtcacttagtagccatctcggttatccgatggactgccctggtattgtagtgtttgtcttcaactaacccttattttacttgatggccccaaagtgcaagagtagtgatctgggcaatttggatatgccaaaaagcagctgcaaagtgcttcctttaagtgaaaaggtgaaagttttcaataaggaaagaaagagaaatcgtatgctgaggttgctaagatctatggtaagaatcaatcctctatatgtacaattgtgaagaaggaaaaagaaattcatgattgttctgctgttgcacctcaaactgcaaaagctacggccacagtatgtgataagcacttagttaagatgaaaaaggcattaaattttgggtgaaatacatgaacagaaacatgccatgactgatggcaagtgagcttggtactctctggggactcaggcatccactggggatgttggatcatatcccctgcggatagagggggactacactaataatgtgctggtgatcgtctctctctagtgacctcatgtttgtagcttgaaatcatccatgggaatatttacaccaaagaaatcaggaaatactactttttttctccccagagagcaggtttttacatatttaccagcacatatgactatgctaaagcatccattcccaccatccagggacaaagaggaagagttcctaactttgttcttccatccatatttgttgtattttcatgactctgtcgcctactattccacaaacatttactgagtgcctaccatgtgctgagacatcgaagaaggaatgagcagaacaaacgtgatctttcctgtcggagcttacagtttagtgggggaatctgacattaaataatcacatgaataaacatctaattacaaatctcaagcggcgctgtgaggcaaatgtgaaggatgctggtagagcacctttgaggaagtgccattgaaactgaaatctgttatgggctgaattgtgtttttcttctcaaaattcatatgttgaaacgctaacccccagtgtgactgtattggacacagggcctttagggaggtaattaaggttacatgaagtcacaaggtgggagctttaatcagataggatggatgtccttgtaagaggaagagacaccagagatctttttctctatgcatacacagaggaaaggccgtgtgacggcacagtgagaaagtagtcatctaaaagccaggaagagaggcctctcctgaaaccaactctgccagcaccttcatcttggacttccagcatcctgaatggtgagaaagtaagtttctgttgtttgagccactcagttcggagtattttgttatggaagccccagcagactaacgcaatacctaaaggtcaagtaactgtttgctaaataaagagggtggaaaagcttttgaaaagatatcctaaaaaaaagtgctagaatagacaacatagcacatttgaataactaacagaaagccatcggctgaaaggcagtgagggaaaaagagggcatgttccacatagttattttccattttagggactggctataacatttttattaaacttataaccacatcagcagcatttatttagaataattctgcctcacatgtttcacagtttatctttctgacatggctcatctattcttgagtttattttgatgcatctattggttggctggaatatgtctttgaataatgctttatataagatatgcatggatgccactttttctgatgccttatatatctgagaaaccctttgtgggtttctttttttctttacatatgaccaacaacttggttttgtgcaggattactgggctccaatattatctcttcaaactctaaatacattgcttcacggtctttgttgtcctttgacaaagtcataggccagtctggtttctggtcttttaatagtaatttttgccccaagtaattgggggttgtttctttaacttggaggttcaaaaatttcatctagatatgctttaggcattgatctcactgttaaaaccgcagggccctcaggtaatattttcattacaagattcttggctgttcctcagcactagttcaaattaaacatgttttatgctttcccacctctgggcgtttgtgacgctggaccttctacctccttctcatctgttgacatgtactttccttcaagattcacctcaactgctgcaccctgaatcaacatttccttttgatttattcctccttggactcttttgacaatttataactattttttcagcaactgccttactttagttttgttttctggttattatccttatgccagttggcgctctcctccagggaaaagacaacagcttcgttgtctctactgtttggcaatttccatgccagggaaattgaaggtgctcaactcgagtgacaaaatttataaaaaaaaaaaatttaaaaaactttaaaaataggaagccctctcccagatcaataacacataggggaacatttccccgaagcccccagcatgggaaaattcctttgatacatgtttacaaagataaagtaatgcttataatttgatgagatgcaaacaacctgtgcttatgcttcactccaattgctgagaaataacaaacctccggcacttatttttccttaagaaattgaatgttgaaaattcagagcttttaaaagtatcccagcctacttttgtttgaatttccaagttcccacagcagcatatatttattttgtttccttctccaatttactctttttttgttcacccatcagtatctgagtgcagtgcacctctcaaaatgaaggattgtacttctaaaagcaaatgcatttttctttgatcctgaaaaactcagctctccattgcagtgataatgacggaaccctatttagtgctgtttgtttttcatcatttcaacagccttcaacttgaaacatgataagaacagcaaaactgataaaccacccttatttttatctgttttctgtcagagtagttgccaagcactgagacagatttttctaaatatctttttaaaaaaggagtgcataaccctgtgcttcaggctgaggccagcacaatttagtacatttattatgttatgttacagaaaattccagcaaaaagagaacggcaagtttaaatggagtctagcattatgttggtctctgttatccctaaagtaaaatcaactttttattttccggtgaggacaactattccactaatgagaatcagaacacaaactctatatttgtttgacttcagcagcaaaccaaattattgctaaactttagtggttttttttttttttttaaatttcagtaagtgatagacgttccagtgtttacaagctgaaagactatgcaatccattaaacaagtatgcctactaggaaattgttattacttcaatattatcattcatccagttacaacatttgttttcaatttctaaaaacatgattgagttagtcccacgagttgaaacgggcttaatgtcccgtgatgtgatacagtagtaatgtgcaaaaagaaaaaattaagaggcatacagggactgttttatgctaaagtcattctggagatgtgtttaaaagttggcttttctgattaatgtggtggagttttaatgctgaccctttcctggtacttcactgatctggcaaagaaagacaatagaattaggatatttcacacatcatttagttgggtgccaagacagtaaaatatggactaaaaaaatcattgtgagcattttgtacatatgtcagcttataatttgattggatatagttcacctatcataatggtatatgaactacaagtatttgacatctatgagaaaagattgagttttacgactcaggtttataagattaattaggtgactcttttaataaaactgtgatgtgactctgatgaggctgccattgtgaaaaccttctttcattctttgataaaaatcaacatttaactttataagcagatactgggcatctctacgatatttggggttcactacaaaaaacagacccacagataggttagtttcttctagcatctcttttacctaggataactagagaaattatattaatttctttgacaaaatattcagctgtctaacttttatatattacaaaattaaaatgaaaaaaaattgaacaaattgtcattgatacgcagtcaaatttgtccatgctattcaacatacactatatccctatactaattaatatatagtagttatagcagttttaaggggtagttttgcaatcttcattaaaatttcaaatgcacatactctttgacccagcacctccaactctagaaatctagcacggaggtctatctacacatatgcacaaagagagtagaaagagattttattgtagcattgttgatgtagcaagttaacttagtaaaacaatcatggctagggaactagttgaataaactatggtatatcaataccatggatgtgatgtagcagttaaaaagaatgaagcgaatccatgtattgaccctctccaaaatagcatctaagacattgtcaagcccacttaaatatattgcagaacaatatatataacataacaccacttacattgttttaaaagtccattcaggattacatatctctatttgtacacatgttaatgcacaaaacatggtctgaaaagatacacaaatcagaatagttctgagaaggatcggtaatggtggcagtacagataaactttcactttagttgaagtatttttttgtagcttttttttttaacaaggataacataataatctaataatggaattaagaagaaatataaagcaatgggtaaaaagttactataataaatatcataattacagttcaataaagagttgaggctccaaagacacagagagaaaagatggaacctaattaactctagctcaggaatactgccttgctcagtgatggactgtcagaagtctgggtgatgttggcagctcctgtgtagcccagacttagtcctgccatctggtgctggcttttaaagagtggatatcagaaagtaaggggatataggagtcattgtagagaggagactgcttggcaaagagtaaaaaaaaaaaaaaaaaaaaaaaaaaaaaatctagagttagggagatgacccagagccatgatcactccagaaaggtaaaatgtagtacacttgagtggtgtcttctgaggataaaggaagttcacatttcatcaacagagaaggggcagaaactaagcacaaagttcccaaactgcctgataaggatccttgtatagaatactgaaagatcagggatgagctaccaggttatatccctttgggtgttttatttttccatgctgggtgaaaaggtaatttcctaaaaaaccaaaactccgtctcgagaaagaaaaaaaaaatccacatgggcctaatctgattttttttttttcaaatatgtagactcaaactaaaatcttccaaagacttctgcatgatcttggctttgtcccaatattatctgctgaacacactccctattattcttaaaatgtgattctcatgataaattagaaggctaatgtgttcgcgtaaagaacacctgaatatgccgcagcaggtctcattttacagatggatagaacaggccattaggcatggatagagcagactcagctggctctgataattggtagttgacttgaatctgaatagaggtcaatcaaatgatgctacggaagtttagagaactatatcattcacacagagattttccttgtaaaccataccagctcactccgtattctaaattctgtttagagtgatacaaaattgcccactttttgaaagaggagacaaccatttaccaggcctgccaagtaaagctgcgtgggttgtatactgctcaacccaaaggaagttacaatcacatggactacgtacaacgtgtgcaacctgctcagtccacacagcaggcttgtcattagaaatataaatgctattactcctgattcaggttaagcaagattcaaagagaggagccactggaaggtacttggagggcatttgaactttagcaactttgattagtttgtaaggcatatcattttcccacacagacaagattttactatgtacacaaatgccaggagttttttggtttttctttttaaaaaatgctattattgcccaggcatggtggctcatgcctgtaatcccagcgctttgggaggctgaggcggacggatcacgaagttaagagattgagaccatcctggccaacatggtgaaaccccgtctctactaaaactacaaaaattagctgggcgtggtggcacatgcctgcagtcccagctactagggaggctgagacaggagaatcgcttgaacccagaaggtggaggctgcagtgagccgagatcacaccactgcactccagcctggcgacagaacaagactccgtctcaaaaaataaataaataaaagaaaaaggctattatcgttatttaaatggtattgtccaatagtttggaaggctctaaatctgtggttccttgtttcattttgtccttttgtttgactcctgcaagcttttataaggcagtgagaatctcactctcaatacaatcagtttatgattgtttgcaacaccctagcaacctccagcaggcctttgtgttggttttgtagaggcctgttatggcttctgatccggcttcttaaactcatgggtttctgaattatgaatcagtatgcctatttatttatttatttatgaatgtatgaatgaatgaatgaatgaatgagatggagtctcactctgctgcccaggaggctggagtgtgctggtgtgatctcggctcatcgtaaactccgtttcctgggttcaagtgattctcctgcctcagcctcctgagtagctgggattactggcacacgccactacacccggctcattttccttatatttagtagagatggggtttcactatgttggccaggctggtctcgaactcctgacttcaggtgatctgcccgcctcagccccccaaagtggtgggattacaggcatgagccactgcacccagccagtactgcccattgcctcttctaacccttttgcctactcacattcgtatacatatacaaatttgagactccttctcaaaaaaaaatatatgtatatatgtatatatgtatatatgtatatatgtgtatatatgtatatatgtatatatgtgtatatatgtatatatgtatatatgtgtatatatgtatatatatgtgtgtgtacatatatatatatatatatatatatatgtttttttttttttgagaaggagtctcactctgttgccaggctggagtgcagtggtgcgatctcagctcactgcaacctccacctcccaggttcaagcaatcatattttttaaatatgtcttttatttattacataataaattgaaatttttaataccttatttatatttatccaaaacttagaagtttaagatcattgctaagtactccttattctttttttcactttttcataacttttctattgtaattataaggtgctagaatccatagttcatcaatgcaaaatgtaaaatgggattcacttccacaaagtcaaacacaagaagtaacagcaaaataaacagaaaaactttatgtaacacattcatccaatgaaataactatctaccatgactggtaatggttgtcctacaagatggacgaaaatttcatgaaataacaccaatacgaaaaatttaaataatagtaatgtttctacttttcaattataaatggctatccacataactgaattttcttctaatctgcttcaagacttaaagaattttctttttctttcctgtactaatcattgaacctcagtttctaataaattttggagcatctgggcctttgaactccttgaataaaggtactgttaaaatactaaggttttcctgtttgttggttggtttgactcaagtagttgcatatatttacaggcttaagaatttgatgaagatcacgtggctgtcactagggagctaagacttgggtccacgtctccccttccaccagactctcacttccaccaatgggagttttactatgaacagatgacagttttccttggagctccccagatggacccaaggtccacgattctatcaatcaatttaggctgtaagaatgttggtccaagagagaaatgctgttcctgtaattgtcttttattcatgaaacattagctctcccactctactgcactactgaaaaataaatgaattaagtggtttttaaagcactgccaaaataggtctttgtgaacctggtgatatagtttggatatgtgtaccctccaaatctcatgttgagatatgatcctcaatggtggaagtggagcctggtgggaagtgtttggagcatgggaggtggatcgttcatgaaggcttggtgccctcacggtggtaatgagggatattgagtttacatgagaactgattgtttaaaatagtgcggcacctctcctgtctctctcttgctcccttttgccatctgatacactggctccccttttgccttccaccaaacttcctggggccctcaacagaagcaaatgccagtatcacgcttgctgtactgcctgccagaacaggttgtaggccaaataaacctcttttcttcagactaacatacctggttatgtatcagctagttacatttatgtcagctctatctcttttagaatattttggtctatggttgaccttttagttcgagtggtatgcatacatactgacgaataaataagagctagtattaagtgtatttagaataacctactggtcatgtttaaggatgacagtagagaggacagggtttgcctctcatgcagaataatactagaagatgggaaacagttaagagactgtgacaccaaagagctgaaggttaatattcaataattcaactcaatggatgcaaaatgggagattcctcttctatgtatcaatcgccatgcagtgtaccccaggcatatatacattatatgttcaagtagtctgaacatgctgctagggactgtgagagcacggagacctgggctctgtcccagaggttcttattcagtaagtctggggtgggaccaaagattgtgcatttccaacaagttctaaagccatgctgatatggctggtcgctgggccacactttgggtaatgaggatacaggcacattgctaacatttttatatgtaaatacagacaaaaaggtgcacagaatacactcataataatgtacatatgtgtgtgtttacatacatacacataaatttaaaaaaatcaaaatctctcattcataaggattttttgtccttagcaatgtaaagttcaatggaaaggagagaccgcaaagggctgctttcaaaaacgcaaagtttgcttttcattttttttaagaccaaatactttactatctccagatacctgaaaatatatggaattatcttgtaataaaactcagatgcccaaagcccaccttttgagttttctttgcaagaaacaaccccaaatgcgagcaaatcagataccatgtaataagacctaaaagtatttttccaaagacagaaagaaaaatatctaagcaatagaacccagattggaaagacaccaaacaaagataacagaactatttttaagcctcattttatgaccaaggggcacagcaaaatagtttgaaatagaaagttttcatgctgattacatgaaatcaaaatacacactgttcaaaggcagccaacattattattttttaaatgcagtctagttcatgcaataagtttcagtgttctttcagtctgggaacatttcaaaatacattgcaggtacagctgggaaaactcagtgatacccctgtccagatctcagctattaggttataaaaatattttcacatttcctgcagatgtctagattcctttctttggtagtaattttaattcagacctcattattgacagctgtttgttctgatagaacttaattgctcttctaccagactcagctgcaggcaggctgatttcctttccttatagagtatattacatataaacacaggcaggaaaaaaataaccaattaactaaatacgtgtgcataaaatgattcattgagagctctgatcaagtaatgtatccaactgcaacataggtcaaaggaaattacagcacttatagtttacagtattaaatataattatatagaaatactcaaaagcactaaaatatatagatgatgagtggcagcatctgaaaatctacttttatcaaagaaatttataaaattactatatttgagtaactggaagggtatttattctgctgacggattaactcatggatatctattttacataagctatacgctacaaagaacctgagatgccttccataactgacaaagtcatgaggaacccagcatgctgtgggatcacactgcaatgccaacaattcttcttcgaagggcagagtttctggggacacaccaactcttttcctcattctccagtcactgctgtggatgagctgcttttcctaactttaccagaaaatgaatacaaattctttgaagttaaagctattccctctgtttgaagacaatgcctcattttagcagctcaccaagagatgcaggaatagcttggcaattttcattctatcaaatgccttggcagcctcactcatggagtctaggcctatttggagaccccaagctgccttccttactggactggaacccctgaagagggataaaccgagggctgaattcatcaaagaacatataagcagcaaatatactgcatttgagacaagcaatagttccttttattggctctgtctgttttggaaatggagagaatgtggtgagcagggaagaacaaactgctccttagtaaggaacccactcaaggaaaatgaagtttttttcttaatactagggacgctatatggtgcatcccttttcggggccaataaatgcttctctttgcagacttaatctacctcatatagggaggaagatattgggaataggatgcttattaccctgataattctcagggatgcagcatacatttccattaatactaggcataatgctaattacaatgcaagccccacactcaacatttacaaaccctgacaaaatgaatgtaagtatcctacagggtttggtatccacaaaatctggtcaatagcctactcccagtccctccctttcccctaagtaacaaaggaaaccaatacttcttggtctttgagagtaattctactaagtcccgtattttttagtctatacatacagatcattatacccttcagattcttgcatggtatgactcctggcatcgttttggattgtgacacttctactctaatgctcactttatttagtgtctgtttcacacatggcatagttctaagggaggatgcaatgtgacctcatagacaccatctccaaccacgtatctctaacggttgaaagttacagcctggggaagaaattcagttttggctcatggaattaaagacttactacactttaaaattccccccatcatttttttttttcttgaaggttcacttcttactggttaaaatagtttaaacataatttaaagtcctgactgagttgatgatactgactattttgttttcaattaagcataacagagcaaatggtctttgatgtgatgtactcattttatgaaagaaccaggctggcaaacaaaaattttatggaatttagagatactaactctggctcttccacctgcagcttgtatcttaaatacatcatttatttattcttccagagcctctgttttctcacctgtaaaatgtaaacctatttcctaagttttctatgatactgtcagcaaaatacattttaaataatagcttcttgatcaatgttaatttcagtactcttttttctatgaattgaggacctagaattgaatattttaattcagttagcctaaccacagagtagatatgcaaccttcctattcttgcatagtttattagacttctactaataaattttatgaaaccaatatttaactttattttctggtttaaatcctctcaggaaaaaaaaatgtaatataaaattgaatcagatttcttgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgtgaacctgggaggcggagcttgcagtgagccgagattgcaccactgcactcccacctgggccacagagcgagactccgtctcaaaaaaaaaaaaaaacaaaaaaaaaaaaaaacaaaaaaaaattgaatcagattttagattcggcagggatcttagagatctggtggttctcaaagtgcggccccatgaccagcagcatcagcagcatgtaggaaactgttagaaatgcaatttttcaggccccaccccaacctagagaatcagaaactcaaggggtggggtcaagcagtttgaattttattatttcattatttttgagactgagcctcgctctgttgcccaggctggagtgcagtggtacaatctcagctcactgcaacttccacctcccaggttcaagcaattctcttgcttcaggctcccgagtagctggaattacagacatatgccagcaaatttataaaataattataaattttatagttttagtagagacagggtttcactgtattgcccaggctggtctggaattcctggtctcaagtactccacctgcctcagcctcccaaagtgccaggattataggcgtgagccaccccacccggccagctatttgaatttttaaaagcccctaggtgattctggtgcttgctaaagtttctgagccacccatcaagccattctcttgcattttacaggtggagagactcaggaacagagactaaaataaaatctctgtatttcagttgcattgctttgtttgtgtcaaagttctgttttcctccccttatctcaagtaccacttagtgtttgttccatcatttcttcctttccttaggcatatggctatcaatatgcatggtcttatctgacttccatttaaccaatttaactcaagctttccttttcctccaaaaagctcctcccattgcttactgcactaggtcagctcaatgtttgttaggaggctactctccaggttgtctgtggctctagaatgtttgtggtgtcatcatgtttattccaaaaataatcagtcatttcatttaagtaatgtaattcttagataaaatgacgagatatagttacaaaataaatgagttgtttctgtaaaaaccaagttaattactttggaaagatagacgtaaaagtaatttgtgtcccgtcatagccaataaagtaccattgaattaggtaagggtgacacaactgcaggtaaatggaaaaatatttataaacatctagatggattctaaagttgcttaactttagaaacaaactactgtttgctgttgatattaaaaacactaaatctgctaatcattggtcatactcaaataagagttcttagtcccaaattttaaaaactggtgaatctaatatacagttatgcatttgaggttaatgtcaactgtatacatacattttagggttctttgcttcacttgaggttttgtctaaatgatcaagtctaaactgaacatatagatcaaggttccttctgaatggtcttgattgctttagatctcttcatatatgatgattaagctttttgaaggagataccatactctataacccacagttttgcacagtgaagttgtaataaatatttactggttatatttatatatacattttattgaatgttgctaattgattagccaattacacttagtagttcatcatctcgttttattactgtgagccaaattatccaggctatgaaacatttcttttatgatagcacttcctggagtccttagagaaattccaaggggggacaaatagttctataaatttcctcttgaaggctcacaatgcattaggctgagaaaccctgctgtaaagaaaccagttaaacttacttttacccatacttatttgactacagaaattcacccccctgcatcaattaataatccatgattcaatgtgcacatatattgatgaggtatcccaaattttctaagtgattttcattcttatgttcaaacctttttttctgtttctgtagattttctcatacttcttataacccagaataggtgtgaattatgtatgccaattatgaatgcgtcagattaaatggtcaacatacggatttgtaaaacttagattggtaaaactgctatttttttctattttcttctttcttctcaatgaagtagcagaacattttaaatctagctctgctttcacagattaaaagaaaaattttagcaggggaatgtgaaacttagaatgtcaaataacaggcagtggtggaggctttgatgaactgagcctaattaaaagtaaaggtgctgagtgaaaattttaaaagactgcaagccaaatgttgctaaggacaatttggggtacaagctttccaaagagggaggtggttttaatactctgtaatcattttgaaacttcatgctataaaagacttcagatgtagaaaagcagtctaggtatcagattataacagcataggacacctagtctaggagcactcaacctggagtcgagaaagcagtaataaatgccctttacactacctctgtccatggaaattgaatatttacctgagataaggttgcccaggctattaaaatctcagatgttgaatggcagttatgtaatgagtttctttgaaaaacagaaaatgaattgccatttaacaaacactgcctggaatgttgataattgaagctgtgtgatgcgtgcttgggggttcattatacattctctccactttggggtatgtttgaaaatgaccaaactaaaaaaaattctgaaaaaacagcctcctttgttcccgcttaaggtaaagcactttctaagtgtacagaagtcccccacagggcagaaataacaaagaggatcgtgttcagacccactcaccttcttccaatagctaggactggactattggtttcttaagccatagccaaactgtgatatggtgaagctttagcagaaaaccatgtgacttgatgagattgcccatgcagaaatgcaggcaaagaattcagcaagaggtatgtagaccaccttgggaatttgtacctttgtacagtatgcaggccacaaagcttcactctaaaaatgacttacatgtagaattattatctcagattttaaagatgtgtttattcctaagcctttagaaaatataaacacaacaacaaaggcatacatacctatctcttgtaactggactacattcacagagctccttactaaattctggaagaggttttgctaagcttgtagctttactattgtaccctacaaaccaataagtttgagtttaattgaaccaagatagcaaatggatttcagactatagtacctcagagaaaatagtctgaaaccaggtcaatcattttcagacacacgaaagagggatgaaatattaaccatagattgtagaggaggatttttgtggtttgtaacatgattggttatggtttttcaaatctaagtagcaagcatgagtccagactgagaaagcctctgcccaattgattagaattggagttggttcaggttgacaaagtgagagtttaggatgtgaagaatgactgaccacctataaaccaaaatttggactgaagttgtttcttcaaagaaacagatttctagaaaaccaatcaccatcatcataatcatcatcagagtaaacaagcatttaatctatctgattttatccagttttcctctgagaagatgccattggcaaatgaccagactgttctctacctttctacagagctataacttcagtcaagtgagtgacttgcacaagatcatacagttttatccaatatctcttatttttctacatttctacaattatcatttttttgatcctgaaagctaagtatgtagtgaaagtcatggaattcagagttgtttttattaagacacacttaaaatgaagatttaaagatccaggagcttgatttatcagtttaacattttaaaattgcctactatatatgcaattgcctactgctttaggaagtatttgatttttactagggtttttgagcatgtgtaaaacatagattatatctggagaccattcgtggtctctgtttgtccatacaaaaatccaacaaccctagctcttgataaaatttggaggcttaccattgtgaccatttgaggttgcatcttatatacatttatcttctgcattcatttacagtattcactcttagcttggaggacagtataatttaaaaaacccagcatcttcaaataatctgtatttagacaacacataggtcaaatctcaatataagctctgcttcagtgacaaggaggagccttaccgcagtgaagggaaaaatcacagaaaaaggcactccaattcacaactcttctatacacatctaggggtagttagggattcaagaggaaaaagcaaatcaaccaggtgaaaatggcaacaacaacaaaaaagatcaggtggctgttctgaaaaaaattaaaaggccctttttcctcctctcttacctattttatagattgaccaaaaaaccctcagtttgggttgtacttgggggttttgctcttctcatccagtcctgtgaaggaaattcacattgcacttaactgggtgatcagaatagagcagtgagaaagaaattaataagcctttgcaggctgaccaatgtcctattggggctcaaaagtttgatgggataacttggaaggtccagcaacttaggagagtttgaagacagacagcccccacccccagctatgttttgtatccaaaaagaaatttttgctagctgaattcatcatcatttactttgtcctcagcacagagactgcttgcatatgcaagcttttatttcaaaagggattctcttctgattttggtgtcactttatacatttctgtaacaagaaattctctcggcagctgtacttatgttagaaacacaaatgtaccttattaatgccagttatcaaggcaaagggtttgaaaatacttgctaaacatttgtttatttatatacaatatttcagagttttacacagctaaatactggcatataacaaacactgtgagtgtgtgaaagaaatataaatgattccagcagatggcatggtcagaagcaaagggtttgcaagtgcaagaaatagcacaaatccaaattgagaaatctgaatggctgtaattgtaacacatctacaatggaatcaagaaggtcatttacattacgttaagaaatacagaagcagagtcttatataagcgtgttacacaaaatggagatttggcacatgggttatcattggacagtgtaccacacacagtttttatttcggttccagcagaaaaacaatattgacaaatttctttctctctttgcttcctactttatcgaatagaagaggtaacaatagcatctgctgcagctggctggagcctgagatgaggaaattgtagctgatgggcctcccaagcatatcgacactaaaaagctcatgctacagccacggcacagccaggctagcactccaacgggagcggcagatacacaaggcagccactgtgaaccagagcagggcctgccaagacagcatgtcaagtaatttttagtggcctgaagtggtttccaccatcacagctccaggcactgccgcaaggcaggacaagtttatctatctctgacatcttctccatctccctttggcatcgctctacgattttctgctgcggtagcctcactgaccaaattggtacccagtgcattcagggtgctccctggctacccatcagcctttcttcccattattcatgggcttgaagatctgggatgcttaattgggtctaatgtgtcaaaattacctactccaatcatcttggtgtcaaacataacacttcctctcaatatacaggtgctttctggttattttcctaatgcatctagaaaatgttaagggaccctttaatcaaattgatttgaacaaaattttaaggaccatactgcagtggaaaacatactagacccgcagtctgaagacttgagtccagcagaagcctatgggaaagctgtcaacctcattggcctaattttgttttctcaactcaactctgaaatttaaaaaaaaaattaaaaaaagagaaggctgcaggaggggaagtggtctgagagtctggaaatgtcccttccacggctatgattcactgtgaatgaatcatagtcctgtttctgagttcaaaaagaggcccactagccccagtaaatcttgaattacaggaagatgtaaagaaaatatttttgagttaggatgtaaggagagttaagagcacaagtttctcctacccacaagctaatattttaccagaagtaatcaggtagcagttatgaaatgcatttttgagaatggacttttttcctactttcttacctatttcacatactattcataaaccctgtattttggggtcagcttagggggcttggctcctctcatcgagcctggggagggaaattcacattgtatttagccaggctgatgagcatggagagcagagttccaccaatccagtaaataaggttcagcaatgtggcactcagaggtagaataaatgaggtcataaatgagttgttgttttcccatccaaaggtggagtatgcttccccattccttgaatctggaatggcccctgacttgttttaaaccaaggaatgcagcaaaagcaattgtctcaaaaggccttgtagcttcccctttgatgtcctcagaaccctgagcccactggaccaggatgaaaagccttggggagaaagagagaccccatttggctttcccagcccttcaagctgactgagaaaaagagctcaggagagataggcagaagatccatgtcctgccccaagtcaacccacagacttgcgagaaaaaacaaattactgtggttttaagccacagtgttttgggttggtatttgtaggtagcaatgctaactgacagacataccctccgttctgccaactcctgtggcacacaggtgtaccagaaacagaaatacggttatagtattttaaaatatgattcaatgctcaacaccaaaacaaatgaacaaaaacagagagaaaagaaatattctcaaaataatcataattctcatcatcctctccctttcagacattaaatgaaatttgagcaagagcaagtggctgtttaccattggaatggaagagccacagttaatcctgactcattttatctagttctttttttaatatactagagatatgacaaaccatacactcagcaagcaccactgtgcactggtgaaacacttaactgctgcctctcccttgatgaactgcaatgtagagaagaattttggggggaagtggaagaggtattgagggaggtgagatgggaagagacagaaaaagcaagactgctcatgtcccttggaagaaagtagacaaaaacaaaaaatgaaaaatatttaagtttttcataagcaactcatctttggtaaatttctgtgatttaaaaataagtgtgctgtcccagaaatctgaaccctcaaaaatcaaagggcaaagaatttcaggaacctgcaagcttgaggaggcagtctgacattatgactcactttctttccattcatctcatctgttatctttggcctccattaaacaatgagaaagggacagtcactaagtcatatgccacttgagggcactcctggggcttattgtttggaactgccaaaatgctggacgtcataccaagtgtgaatacgaagcaatgtgactaatatcatagcacaaaagactagcatttatcaactccaaagagcatggcccttaaaactagccactttgagaggacaaagatttaatgcaacgctgccatggtgcaaaaatatttttggaactccttcttggcagtagagttaaacgcctacggcctgttcttttgaatccagtaatggtggcacatctttgtccttgaaagtggatttatttatttatttttctagtgccaagagatacctggagccaagcgtatggtttgtatggttggtgaccaaggtaagaaacactattagatttcttttcaagtaatgagcctagttctctgtatgctttaaaaggttataattaaagtaagtctcacaaagaagttctccaaatatttaaaataagagttgcattcaaataagcattttttttttaagttagaagctttgaggtgggttatcgtttggacccaataattctgccaaaattaaaaattagttttattaccataagcagtggttttcatgtaggggcgattttatatccaaggggacatttggctatgcctaggacatgtttttattgtaacaatgtgggggaagggaggtgagggtggtgagcaaagcccaaggacgctgctaagcatcctataatgtataggacggctctcatagccaaaattctacgatctaaaatgtccaaactgctgaggttaagaaaccctgcttatagaaacaattggttctaataagcaaagcatttattttagtgcaatgatataattataacagtacttaacacatttttccgtgttaaatattccagttgccacccatcttctatgttaatgtatacatgcacatgttttctactcttctgaatcaacaattacgtagaactcaaactcacagtccagaaaatataatagtattctttgtggacattaacagagtcaatttaaataactgtgaggtaaaacaataatttttaaaagtcagtaactgtaaacatttgttgacttctttctatgtaacaggctaatgaatcactttacacggctcttatttaatctttaaaaccaatactatgaaagaaataccactattatccccacgttactgatcaggaaattgagtcttagaaagattgtttaatgtgctcgaggtcacagatgcagtaaatagtacagctaagatttgaactctgtttgttagaacaatttcaattgcagagttttcactaccatacaatgctggcccctaagagcagctctatgtgctaggagccatctcatttgtaggttagggacagttctacccccatttgtaggatacacattgagcaaaatggaaaatggcagtataatatacacatagatcagaaagggggttctccttctgattccgcttactagttaagtacgttttcttcagcaaatcacttaacttctcagggtctcaatttccttagctggcgagtgaggaaagtaataatgcacatctgccactcttatcataaacatcaaataaaataagtgatggggagatgctctgtaaacagtcacttacaacacaaaagtgagttggttgctattcttaggcacgaaatgggaacaggattggtgataggttctcagttgcccttgaaggaaccttcatcaaatagacctgatatatgattttgaagttagatagtattgtattactattggcctcacctctcttccactgcatttatatctattatgcttcttttcaaataaattctgcatttcatcaggcagccagaatgctcttcctagcacctcaacttctccattttgagttttacactttatacctactggggacactatgcaattccttttaatgcttttttttttttttttttggttccattacttttaaactattttggcagaaggaagatatttttctatcataggactgtgccatcaacagactgaagacccagcctcctgtttttaacactatgttgtttcataaactacgcatttgcttcttatacagaattattggtgtatgaaaacagaatctggcataatgggttccacatggcataattatttttccttaccttaaaatgtttccataaataaggacataatttgtacactccacccattcttatcgagatgttggcatttttaacaatcctacctttcatctacagaaggctagcatctcctattccgtaatttacacataaagataaaccccaggtttaaggaaaacatgggtctatggttcacgtttgtcagcatctcaaaactatcacatgctttggcaatacttgtggtctttgatctgaagagacatttgaatggaacattagaagaaataaaaatggaatttagaatgaatggttaaaaatgtattaaacaattttccacagcactcttagcttctttggatcacaaggtcttttgtttttatgctcttatgcaatgctttccaaaatctttcttttgactttgaaaaggccattttcatcactattgggttgggcttaggggtacatggttatgctatgaatatggcctacatagtttcctggttgtgcttccatatgcaaagtcaaaaagtattatgaagattggaacttaggagtttttacaaccccaaactggcatctgattttttactgggccattttagtggcctgttggtgcttctaggaccttattgctctctatgtggtatgcagtccctattccttccagttctgaagagtggtttgattctatgattgtgatagatttaagtgatactcaggaagcttattttattttccttgagactgtttcacttagaagatcaattcaggagttgtgatctatccccttttcaatttttttcataaataaatgtttctcttatgaatagaaagtcttccttttgtcttaaaaagagttaatgtgacataagatttagtatcatgggtcaaggttttataactgattcactgaaattacagctttttcccaatgtattcattctagtatcatgggtcaaggttttataactgattcactgaaattacagctttttcccaatgtattcattcctaacaaatgcaaatacttagagcaaatcagttgtcatgtccctctggtactagaatatagtctttatagaatatgtggtttagaataaagccacaaattattctataaaacaacataaggaacaaggctcaaaagtggaacaaaacggccttagtttctaagtggaagactaagacgatataggaaaatgtaatccatgacctcttaagaaaatctcagtttaataaatagaaagttctgccccaaaatcacattttataaataagataaaaacaatactatatgtctctattcatgcactgcacatatatatatacacacacacacacacacacacacacacacatatatatatatgtgctgtgaagagataatggcaaatatctgacaacctttacacatgtgcagtaaagagctaagtataagggactaggtggtctctgcaatacgaagagtaagaactggatataatgatgggtaaacaggccatggactttgaaatcaggatgaaatgtatatgctgtatgaccttgaacaaatcacttattacctccctgtgcggaatgctctttgcaagcaaaatatactattttctggattaaatgactgctcagtaatacttggaaaacagtaatggctccatgattggtagctattgtgattatttatgttccagtgattaaagaatggaaaagactcacatgctagcaattgcctttgatttagaaagagtgaaagaaaggccagaatatagcaatgtggtatggaatcagaaaggaaggagtggctcattctgaccaggtcaccagggaaggcttgacagagaaatcagagaaatgcccccaaagggacagcagaaaggggagctaaaaaccatcatgggacctaaagtctggagaatctgcctgatttatagggccatgcaacatggggaacataatggccttgccaccactagtagtatgagctcaggcaagcaagctgatcttacctggcctctgctgttttttcttctgtgaaatgggagactaaaattactccttgtaaattaccacgggaagcgaaaagcagtaacacatataaagcacttatgacagggcctcttcagttggcaagaaagattatttgatgttgaataagtgctcaactatcctgaactattagtattgctacaaaatggggagctatgtctaaatttaatcatggaatagatggtatgtgggaaagaacatgaaatgtagagtggtagaaaaaggaactcagaaatagttataagtaaggcaaaggcaatttaaaaagtaagctctcataaagaaataccccaatataaagggaaaaaaatatagtctctaaggtgaaaacacaaaccaaaaaaatcagtccagccttgaaactcttactatttttgtaaaaattactaaaatgccatatgtaattcaacaaacttggacaagcaattattgagtgcttactaaggtgtaagagctgggggtaaaaatgtacataagccatgactcatgccttctgagatctcaaggtacgtatgatctgcacacatatagctaaacttgcacagtgtgaacctattctatgagaatttacagaatatttaattcttcctgtgggaagataaatggggaataagcttaaaatgtttctccagagttacaactcaaatgtctacaagataaagcaatgtcataaatgtgtgtaaaacaatagggagtgggaagggtttgcaaaactggatagtgcattccagcttaaagaaattcatgctcaaattttaaaaaaattatcgtgtatatcaacaaaactatctgaagccagtttgcaacctctgcaatacaaatagaaaatgctatttaagttggattatgcatcaaggttgaacaccatcaggtagagaaggggaattgttgaaattctagaccagataaatatctttggctgagatccagagatgaagatatttggaatgtgtagctatcagaagatggcccaaggagtcaacaatgaggtgcgaagggtgagatcagcctaaattacaaaggggcatgaatgcaatgataagcagttcacacctcatcttgaaggcatcaaggacaatggcattaagttcctttaacagcatcattttaagagttgaaaggtttctcaggtctttatacaaacagatgtattattataaatgatcctctctaacacatagcatcaacatgttctctctcactgagaaaagtctcatgggattgccatagtagaaaatatgtacatttgaaaaaatccattcatttaatgatttggatgtttataaacatctgttatttaataaaatggatggctcaggttacgtagatgatatccaaattcatgttgaatttttcttctcagagttctaaatatacacacagcttttaaaaggtactcagtaatgaataattattaataatttaaaattactgcatacttctatatgccatgcactgtctcaagtgctttatatgtatctattttatgtcatcttacttaatttttataaaattctcattgctatagcgttatcccattttacaggtgaagaaacagagattaaataatttgtccaaaggcatacagccagtaagtaaacaagctgacattttacttaggcagtctatctctccagagtgtgtactctcaatgttgagattctatgctctgtatgaactgatagataactagagttggcctttccttgcttgcctgtttgaactagaccttctttcttttagaaatctggtagactctgtcctccttgaccttccaaggccttgtctgcgcttgttgcactaggctatccctaaaattcttttttgttgttgattgttagaatttcttttacttaatggctcatttttgtcttagtccaattacagcacagaatcattggaggaccataatttcctttttctgtactgcaccgccagcctgaccttttttgggctactacctgacttctttgaaacctcctccattctcacaggatatattgggcagaaggcttggatctactttgtcactacttctttaatatagaaaaaaagtttagtacataataaaagaaatcacaacacaaaatacagtattcaccttccagactattttttgtgattatgtgtaacatgatcatgattaaccgtgatcagtatccctttgtaacatggctattgtggctttttgcatagtttctttctgctcagaaatggtttctaaactagcatttctgggatgctacacggataactgtcatttaagaatgactttaatctgctgctttgtcacaaaacattatactgtcaagttttaacttggcttgtattcaactcaaggattcaagataacatggatgttgacgatgttgacatgaccctcctaaataaagaggccaaaacttcttaccagacatgtaaaattacctatgggtaattatttcacagagctcagtttatgcagttcctttccctcattgtttcgaagttgctaacaaatttcttccaccaatatacctactcttctgttgtttgtttcaataagcagcttctccagagcctcaggcacagcacttccaaatgtcagcagctattagctcagcacattcatctttgtttccttatttctcctgagtagcctgtctctctcagaggtgagtccaggtggcttaacataacatggatgcgggtgtgtgtgtgtgtgtgtgtgtgtgtgtgtgtgtgtgtgtgtgtattttctcaaaataaggcattacagctatttaatcttatctctcatatttgctatttgcttgcaaacatttttgtatctgtcacggtgcctagcatgaaacccataccttgcttataatctacagagggtgaaatgcattttaaaaattatgtatgtatgtatgtatgtatgtatgtatgtatgtatgtatgtgtatgtgtctgtctgtctatctatctatctatctatctatctatctatctatctatctatctatctacctacctacctatctcagttttctagtgcctccactttaatttacggaaatgggaagaacatttggagaaagcacagattctgtattttgaaatgcaatgtgaaaaaaatcatcatgctgtttttcagtgaaaactcccaaattatgtgtctctaatttttgttcccattattttaaacatataattacacacgtgtctgtgtgtgtgtgtgtgtgtgtgtgtgtgtgtgtgtgtgtaccgtatttttgccattaggcatataagggcaacatttcttctgctagaccaaattttctgtttctctatcctttggccaaactctatctgaaaacaattcatgtgtttcatgtgtgatttttataatcaaggtcagatctgaccaagcagaggcaccatataatcaggtacattggctctttgaggcctgcaaagaactgtgagcatacagactgatcaaactagcacctgaattaaaaccaaaaggcaggagaaccagaagtctactttcatgatgtaaaaccacttgctcaaattaaaaataatttttaatgttttacaatcatgcagaaaactgcaactggagtggccagtcctcaaaggaccctgtcttggatgtagggaaacaagaatctagataagacttgaggccgattacgccatcaccttcttagttatcagtacttgaagcaaactttgtagcctctcacttctcttgacacgacataattctcttaacccaacatactgttgttatgaacatcaaacaaaataaagcataggggagtgctttgaaattagtaaaatactctccataaatacaaggtaatgttattactagtttttatctaggaaaacatttgctggaaaagagaaactttatcctgtttggaacttgccagctcattgtttaacaatgagcattgtagcatggtttggctaggtgaatttcactgcttttattctgatcagcccgttgaccccatttctaaaaaactagctccttttctagggtctactgtattatatttatattatagtataatatggggtatgaaagagagtgatggtattaagtcacgatagaagtgatttacgatagatgctttcttgggtttttcctatactcccagacttctattttacttatctgtggaagaagcaatattttctcatatttgaatttctcaggttataaagaactatcatgaaattatatgcactatacatttatatagtaataaatagactctgaccagatagcttgagtagtctgctaataatgatacttaagaggcactcaaacaactggaagaaatcagcttaatatttaaaaatctataaacatttatatatatcgcaatctgagtggtgatgtagctgttagagttaagcaaaaaatacaaactatacatttcgagagaaatacaacttattacctttgagtacataaaacgacttcttccaaattatagaacttgtatatattctattaaatacatttttaaaaatcaaattagtgatttgtcatgagacttgatattactaatgtacagaaggcatctttaagcaataagatagtctccctaaagcttgtatgatatattattattttgttcagtaatttttttcccctataaatagtaaaaaggttgtatcagtccagcccacaagaacttgtcaaacaatacaaatttgtttttaagaatattcccccacatattattttttgttttacatatttatagccatgtgcccacttaattttgtgtttatttatttctcttcactgggaaaagacaatagcagtggaccatagctacctactatctccaggggaaatatgcatctatgtcaaatccatcctattgatgttagcataggcctcatttgaccaaaagagagctgtattatttatgaagacatttactattccagaatgtcaagaagttgcagaaacatccaatgagagtcaatttagctttctgtttcctgactgcaagtgaacaaacgcttcttacctgcagtgcacaaccatcggaccagcatcgggagggttacaggttttgactctacgtaagaaagctagaaaaggtgtagggtgttctggaacaccatgatcaggccaggcggtgaactggaattgtctcacttctctcttctcacttgaaccattctgtgaaataggaatatcagctgaaattctgttttccaagcctcaggtggtaatgatgaataacagggaagaggtaatgctaaaatgtgctattttaattcctttctaccaccctgtagcctttgggaagacacactctttggaaatagaaaccccaagctatttgtaaatgacaaatatttgcgcaggaagacaaaattcttaggtgagaagcattatatttttcaggtttaactaccaggagagctcctatcacattttacaggaagagctagttcttcttcatctactcttcattggctgaaactttcatttggagcaagagttttatatttactgataaatcgccagacaagaagaaaaatggctgagtgataatggaagatctatttcattcttcactgttgccattgagatcaagatttaagtaaagccttaagagatttcatttctcaaaagaagctttctttaaacaatagagaagggaaagggaggagaaaaagatgaaaagcaaaccttgtaaagtgcaaatgttcgaacacaatatgtggccagctccacagtatcaagcagcgttacttgaacgagtccgtgggtttctgtgcctctgctaggccaatactggtcacacttcacctacaagaaacaagtgacacattcagggcaaatgctcatcaatttctctattaactttgctttgagttgctgttgaaggaaaacagcttttctgcacttcattttatgttgatctttttctggcatgcatttttgttatcccaatatatgtaaattactgctctgatgccaatataaaccacatttttcaaactggtaggaatactaaacagtaacagattcaattttcctggagaaaaataagttgcagattgttgctgggtaaaatacagagagagggatttgaaacttcagtgagcttgaagagaaaacaaatttgtcctgggatagacgttatgaatcacatcgggaggatgacactttgtcatttaaactacatggtaagatagtgttacttcatcaagatttaaaaagcacaacttccaaatatgcttgtttaaagaaaagtagaaataattggaaaatctatcaaagtataataaacaacataagcatgtgctttttttttgaacacaagataaatgttatttgtatccaaagcaaattaaacctataatgtctgcaggaaaaagagttgtctgttccttaaaaagagtctcagagggtcacacactaacagtgcaaagtttaaataatttaaaattcatccaagatgaataatctacaatttctatgtgaagtggaacaaaagcacataaaaagttttcagcctaattagtttaacacacaacaaagaataattccaagtctgcagtaaacctcaaattcactgaatgagtctgttgggcattaaaaagtataatgaaaagtaacaaacacagcacaatatttttggagtaaggccatagatctgactatatttaccctttctatctcagacttttttttaatgggactaattcttaagagaacccaactgaaatacatttctctaggtaaagaaagctcctagcagtattttacaatagggaatacacctttctatttgaaaaagaacagaaaatcacaatctttggatttaaacaaaggcaataaagcattattattagagacactagaattttttgggtccagcaaatagaattattacataatgatttgcttttatgtttaatatgagtatttgtaacattctgtgaataatactgtaattttctctttcacagagatagcatttgctcctctgagaattcaggctctttccatgaaactattggcccttctaagaaagggagaagttttatcctgtacagaatttcccagacaagacaaaaaagaaaagcactttatagctatacagtaagctagatattaaattcacaaggtttgattcctatgccttgatttcaactttgagaccacacaaacatcatctttttgatgaaaacaaacaaaaattgtccacagtaagacaaaaattttgccttaataagatgtaaagaatattttgtgtgtttcctagttgtacaaaatagccttctgtgttttttatttctatcatttgccctgactcaaagagataacaacatagggaaatgataattcttgaaggagaatactgacgtagagtgaccaggcatgggcatctctatatgttctttcaccataagctaaaacccaggtcacagatgacatatttagcaaaagctaccatctgaatagaaccaacactacttcagcagtcatgatatagatgagaaaaaaaaaattaacaaaaattatgccaaaggctttgttttaaaccatgaaatagatgtcaggtggatgtctcccagcagaggacaagaggaactctggaggcctcatattgtaatattcaagaagatgccaacaatgggttgagttgaagattcaagagagaaactcaaattcatcatttaacagtctcagctggagagcaaccctttcggtttaaaataaactaatgaaatccctaaggacaaatatcactatgatatgcacaaaaacagcacattaatgcaacaaaatgatctatacagccagttcaatgcactgaaccaaattcaatataattatattttaaaactgggactcgattacatttagaccttctagtgaggtaagaaaaggagatgaaggaaagaatgagaaggcaaccttcatacaacttttggaaaaatgactctccatctacaaatcttctccattcctaagatgcaggaagaactaaaattatactaatccttacatttctagtaataagtttcaaactgcaactattattggcttagactctgacccctttagaaaaaaaataccaggaagcattactgtaaggagtaaacgctgtgaaaatttctagctaaaagaagaaaaaagttgcttttgaacaatgcatttttagtatttaccaaaagaaaaataaacatttcaaactcaactgcaaaaatcagaggcaattttttaaagcggatatgtctaaatattaccattttctctcaggaaatatttctcaaaaggaccttatgaaaaataaatatcctaacgtatgtggaaatgcacacacatggcctcagcagtgggattagaagcttttcctgagcttatctgaatagtgacagcaatacatttttccctttgctggtaagcacctcagtacttcctttctcgatctcattctctgagtagcctgcacaccttcatctgattttggagggctgaatttaagggcttagagttactgacaaatattattttaagtctccttttttgccatatgctaaacatatgatttctgatttcagcattagggagcaagtatgaaatgtagtgagaaagaaaaaggagaacaatagagatattttttctttcctcattagccagtataaatgaactatctccattttcctctcttaaaatgttttcctttgacaactttccttcccctactcggtcttcttaagagaaaatatcataaggtatttctagagagagttactatttgttaggcttcacacataaagctgattgtgagatgagaaatgaaggcagctccctttgagtacataagaactagaaggcaggagctactgaatacgaatacggttttttgcctttttctatttgatttagaatggatacaagcggcctctaggactgattcatggaaggtcaggcagagtctccctggatgcctggaaaattgtttctctgtttccaggaccaaagtctggccgcctcatctgtgaaatgggaacagtgtctccagcattacagagctattgtggggattgaagtgatgcccctaaaacacttaacccaaatggctggcacaaacaggcattcaacaaacactagctatcattggttatcagtttgatgacattctggatttttgtgtgtggggggttgttgttataaattacctaaatcagtctaaatgtgaaaaaaaagaacatgttattaatttcagcagatactgatttaggattttctaggtgcaaagcaaggtgttagcagttgtggggcatcaaggtgacataagacccagtccctgccctcaatccattagccttactgactaagtggggtgtttctaaacctccttgttcttcaaataggtggttctgagattccaaacaattctcttcatctatgtgggccccaatgtcttctgaaaagagtatgtgttcaactcagaggtggaaaagaagaacagcagaacttgtcactcaggctgtggtttagaaacatcacccagtaactttacttgaagcttaaactgagacagttcagatttttggctaaatttgcgggaggcatttcttttcattatcacaaagttattacccttaagtggagctttcatttttctataattacggaaagaacagggtgaccattgctaaatttatgcaatggaattaatttattttacctttttcatgacaaactatcaaaatcaagttgatggaataataaaacatatttaaatttatttttaaaactcttgtcattgcaaatatctggtaggagctgatccattaggtctgctgaacatgctttgggagaagggctctcgttctaggctatttttactcccatatggcttaccttgggagtgctcagcatattgtaggcacttaatgagcggtagccaactttataatcaattaactagattggcttatttttaaattgtctaccactttctgaaaacaaaacctcctcatctcaatttaataaagacttactgagcatggcaacatggcaaggcatcagaattccaactgtaacaaactgataccttgaaagggttctagcattgctaatccaaaacgtatttgccacgagattatttagccaaagaaggacttagaagaggcaataaatgatacgtgggataccataactattgctaaaagtgactctaaattcgtacctagtaagtttgggcagagtggttgttcaagcattagtatcctgtaaggaatggacaaacaggctaacattagataacacaagtcacagttatttttgggagtaaggaaatgttggtacccttttgtcaatacccatttaatgagggagactataataaaggaaagttttagataaatttcattaattttagtgggcagaaaaaataaatgctgaactatttatttctacaggttatagtaactattctggaaatttttaagaccagattgaatacttgattttccacgataaggacagagagcatctcagtgattctcttttaacaacagtgtagttctctgcactcaatcaatatttggctatatctattcccaactggcagtcagtctggtttgtgtattcccccattttattatatctttactaatcactatttagtggaggacaaagaggcactacaatatttgaaatgagagtgatattaaagcatttgaccaccagtgcagcttttcatatatacagccataaagttgaaaaatattattctcaaaataaaccaaattacatgtcataaaattgcctaccagttcattgaaccattcgcacactttctaaactgcttattaactttaaaaaagttattcccttttgtttgatgtgtctgccagaagttgacatagggagctgccgtaaacttttccaatgacttcccccattaaactgaaagtcattaagtctcaagtttctggcactttgtcctaaccagagcagaactgtgtgaggtgcctctttctcgtggccaagtagcactttgatatcagctcttcccacatgaggtgggtcctcagagtatccacctcagacctaatcactcctgaggatcacctgggtgccccacatagccctacagccacctctgcttctgccttggtctgcccagcagttgcctttgactccagtgtcacctcttccaaacagtatcattagatgactcaatgtttcaataaaaatataatttataggtaccagccagcatcaatgcagttcaatattttaacaaccagtacaactatgttgggtatttaccagttgaacatcagcctttccagacattctgctgataaagaacagagaaaaaccaaacattggaccctaaacactagtaaacagagattaacacatacttctgaaaactttagaaatgagacctaatccagcacaggagaaccacagacatgaatgcagagaatgagagaggctttgtacaaagtcatcaggagcaaagttgcatctcctcctcccattccagctctttactcaggtcatcaggactctaactggctttaagaggaatgctttgagccagaatctgtcagctgcctttctaagtagagcaggtggggtggggaaagaaggtagataatccagaaagctaacaaacagcaagaaattggtgggattctttctcttttatctgacgctgtgtctgctgacaagagaaaaccaaaagtgtagaactttctagataaggaccccaacatcctttagattgccaacatgagcatcattctttttgttgccagcgtcctatttacattaagtatccaccactttcaaaaacaatcccatacatcatgcagactccaaaggcaatgtttgtgctgctggtcctaaagttgcttaaggaaaaaagcagtttctgttgccctagataggcagcactttaggctgcagtttgagaaattaaatgttcacggcctttggcgcttccagttccatttggaaaaggacacaaacctggcatttggaaagcatttgctctccattaaacttaccgaaccttgacaaaccagaagggccaagaattagtctgccactggccaaggctggactttccaaaactgataacagcaatgaaaacaatagcactgccatttataatcttcaatgggattctgtcaaattttaacccaaaaggatctcacaatctgaaaagaatctcaagctttgttttataggaaaagaagaaaatgtttgagcacaatctctttttctactgcttcatgctcagaattgcccttttagccatagaacaaaatgtgaatgtctccacctcaccttcactttgtgctagggtaagtttactaaggtgacattcaaggactggggaagacataggaggaggagtgagtggtcattaggtcagaagtgttccaccagccaaatgtcaagttccctaaactgttaacaaagtgaagttaacaccagcccagtctctttggccctgacagcatctaacctgcattcattagcacaaaccacaaaatttagtagggcaggaattttcccattctttggcctaagatagaactcaagtcacgatgcacaaaacatttgatctgctttactaatatatggcatcatctggtttgtatgattccctatttggaaacagaaaatgggacttaagatagcttggaaaccaagaattaggattcttcatttctagccctatattttcactactaattggcacagcccacattggattacaataaaaatcatgactgatttgttaagtgtcaaaatttcactccccatctccaacatttataacgctaagtacatttacaaacagctctttaagtgaatcaacccccactataaagcttgcaagacaagataaacattgagtctctactatgggcaaggaatgaaggcaagctggtgaggtgaagtaaaagtcagatatattctaaccctgactaagcctttcaactgctaatactaatcagggttactcaagaattttctaagcatgaggttgatgcattctctctgtgttctgtatttcaagatgggagacagagtaggagagaaacagtcaagagaagatagatgaagggaaaaaggtgaacactcacacactaaataataatttaatatacacttacttaaaaaagcagatgaatcctacctcggagatgccaattctgcaagcaaggctgccaatcatgtgccccagtcatcaaaaataatatccttggagtggaaatcccagctgtatacattttactttccctacaaaatgcttcattttttccaaacagtttcctccttccatgtggttgcccagaccaattcgtgtgcttattggcatgttatgaaacatggaaacaattagaaaccacattctagggaactagaatgacttgctacagaatcaatgaactacgcaaaacttgagaggatttggcaataaagatggaaactagggaaaaaaaaccactaacagtatttcatattacacagtacattctacaacagctttaaactgatctgtgtgtttcagcagaactcatgctttcccttcaaaatctccagcttctatcattgtttttttgtttttgttttgagatggagtttcactcttgttgcccaggctggagtacaatggtgcaatcttggcccaccacaacctctgtctcccgggtcaagcgattctcctgcctccgcctcctgagtagctgggattacaggcgtgtgccattatacctggccaattttgtatttttagtagagatggggtttttccttgttggtcacgctggtctcgaactcctgacctcaggtgatctgcccgccttggcctctcaaaacgctgagattacaggcgtgagccaccgcacctggcccgttgtctttgtatttctttatataccctaatgaaactcatatgaaatattcaacttatacttttccttcagggttgatagctgaatgtatacaccaggcaaagagtcttctcagttaagattggaattctttaaaggccacatttgaagggaagtaatagcatttgaaaatcaaagaactcatgttttcaaataatcaacttaagtcctaagtcatagttcacacttataagggtttctttagccatgcaaacactaagaatgatcagttctcaaaacagatgctagtgaaacttctaatacctgctaaggaatccagaagccttttgtctcagtgagctgttctaactcaccaaaggtattaatacaagcgctgttgataaacctcagacctgagcgacagcttaagagtgagccagccaggcacgggctggctcaagcctgcagtccaaacactttggggggccaaggtggaaggactgcttcaggccaggagtttgagaccagcctgggcaaaaaagtgagactctgtctctacaaaatctaaaaattagctgggggtgggtgctgtgcacctgtagtccctgctgttcaggcaggattgcttgagcccagaaatgttagattacagtgaactatgaccacaccactgcactgcagcctggacaacagagtaagactctgtctctaaaagaaaaacaaaaacgagtgaaccaggctgtggcaaaacagaacgcttgaaaagagagatgggctctaaggcaggacaatttcgtagcaccataaaataaccaaaaaaggggagaggggatgtaaaactgaacaataaggaaacgtatcttcagtggcacttatcactacatgtaacccatgtctatatcacttatgattttcatgttgtattatagtcaatgtagcagccggaatgttctattttggtctgttccccggctgatctctattctggagatcctgtcctgggggagagcaagtaggaaagaatcccatggtctgagctcctctctcctcttgaataaaatgcatgggtgtgccacactgggaaacgtgggcataattaaccatgttcagggacatggagaggttggtcaggattcatcgtcaaccatagagaaataaactcttttcatttgggaacacagagtgaattatttggaggctatcttttggggaaactgaagttgtcactgtaaagcccccaacttctttaccaaacaataccatttgagactcactgagccaccttgccacatcctttatctcagtcaatacccacaataacccttccgcataatccaaaaaaggaaaaatgagaatttgaggagtcaagtaaacttgctcattgtcacacagctagtagaggctagagttggtatttgaactcagacatctgactgcaaagtgccctacttggaactgtcccatagctgtcctctctcatggtggtatccccatgcagtcctgcgtaatatcaagctatcttctcttctctttccttttctcccctcttccctgctgcaaatctatggtcagtggcagtctagcatacttctaattcacagcagcatttacaagacgcacacatattttcttcatgtaccataggaatgaatattattttaagaacctgagccttaatctaaataatgacatttcaagcttcagctcttggagaggtaatttgtttacgttacctggactacctccctttatgaggaagactggtgccacttcccttcatagggccaggctagttccaatgtctgctttgaagttggctgctgggaattgaaaattcactgagtcccaaggtcagcccacagaacccaccacgttcctgaagtctggagctatagatttcactaacaactcacccctagttataacattgtttttatagtgaaagccaattccagctcttgtttgggaatccaggaatgccttctcctttcttcccgctactttaggtaaaagagcaactggatagggaaagggtgagatgggaatgatgggagggaggaagacggaagagcagatgaaataatatgaggctccagtgctttgttaaatctctccaggacatgtggtcatttagtcccaagtgttctggactggagaacaaaggacttttgggccttggggtccagggctcatgtgtattgtcagattggtggtggctgagactccccaaatgcctattggcttatgcaggtcatcacaaatctgggtacaggctgaaccaccacagaataaaaatcacaagacagcattttaattggcttccttaggccatttaacaaaggagaaagctaacttgcaagagcaaagagtaattaatgaagggagcaaacagaggttcatttagtaacttccaaataagttcctctggctgaggggagttgggggagaaggtagcctgcaacagaaagataaactgtaggtatttaagtcacaatgccttccgccaagaactgctcattaccatcagatgttgcagtggcagtggggccagttagaactaactttattattagaagcaattagggagaaaaggggcagaatttcatttggttatttcaaaacaagtttctgtgcacagtttaatgaaggcctgcagtgtcaagataaaatgtgtgttttactgaaaacagcttttgcaaatgactgcttgttaccagcagttatctccaggcagaacagactgggtaggttggatttacatgcatgccgtaatataatagttcagctgtctcagtttcacagaagtgtcaacaggcagtatggcttgatggtgaagcacgtgtgttctggagccagactgtctgtcttcaattcctatccctgaccttggtagctgaatgaccttgggcaaagcttctgtaatgttctgggccccagtatactcatatgtaaactggaggtcacagtagtgtttcttgtaaagggctgttatgaaatatcaatgcacctaatatgttagacattattatagttatgaactattatatccaagatcacttgggaggggagttgtttttaaagaaactgcttgatatataggagttaccttaagtacaaatcagtaacaaatccatttacatcttttgaattgggtttgcatgtaaagtatggcagatatttgtcttcagtgtcatttttatcttaattcccattttagacaatatttcaacatctctatacaattcagatgttttgaaaagatctaattgctttttagttttgctaaaccaaccatttatcactgcttttgatttcccacctttgaggttacagttgtggctttttaatatgtttctgtctgagcttttcccttataaatctcttgggcagcttttaaattgtccctcatatacacgcccaggcttagagaaacttccatgtgttgagcttagaagaacatttacagaacctcaactttcacacagtaaatggggaatcaggctttcttccttctaaatatcctttttgagactactataaccacagtaaaagaggcctctcacttgtggtttcaaattctgtcttgaatgtccctattcttcaatgaaagtatctgctgtcttcaatgaagtttcagagatcccatcattaatttctcaaggttaaaggttgattttcttcagatgctacaaaatgtacacatgtactcaggaatatggtatactgcttacccattattttttagtccttcaaaccaacagcatttaactaatgtgccatgcaccataatattggacccatacgatgaataaaactcttttcttggaccttaccaagctatgactccattattaaaatctactcattttggagaagtttaaactagcaaaacgccctctatgcatttatgttttctcagccgtgtattcagccacatcatttttccagctgccctgacttaatttatactaatgtgaataatttaagcaaaagcctctttcacagaacttaagtcttatgctgcagattttaagaaagaaaaagttgaaaatagtggaagtacatattggtgggattctccccaaagcccgtaggttcttgttcaatggtgtttttgaaagaggttcaagcaaatatttattttctctaatcaagttgtctattcctgtgaatattccttttttttttttttttttttactttttagcaaccacacacatcataacatgggagaatttcttttgtgaaaacacccagaggagttttaaagaatggtttaattagagttgttgatgcccattcataattagtatctgttagaaagataagccttagggaaaggttagattctgaacagaataaaatatgcaacatagggactctgagggaaaatttttaaaaggaaagaggtggatacttattcttacccttgatctttcttctagttttgtcatcatgacaactgtggcactccgttgttcccatatcattctccaaaagtccccaaatgtttcggggagagatccctgtgttgcaatataggcattttgcttcctatacccatctatgtagttggcattcacatagtcacttcctgggatccctggaaaacaaggagtgttattcaaccaggtgagcacatcacaagaggaaacagcctgggacatgacctaatggcagtgctatcttactgttccacctcacactagagaagtcacaatatattgaaggtcgggtttcaagcaagattaaaaacaggtcctattagaaccgtcatgttaaaaaaaagtatgcaaaaaagtgtcaggtctttataatacgacaaagaaaaaatacaatagatggtccatagaatgccttttccttcactggttgttggttttctctgttgcactggcaaaaaaaatagtttccaaagaacaataaacaatctggtaacattcctcacccatgtgcttcccaggcaaaaactagataaaagaatgcctgagtctgaaaatacaaaatagagtggaacacaccataataatgaaaaattctttgtagatttagttaacaggaaactcatatataaactcatttaatatttacaacaactctgcagtaagtcctgttatgagtcctgtcaggagaaaactgaggtgcaaagaagttaaagaaacttgagcaagttgctcaagttggtggaatcaggtttaatcctaggctactcgtatgtgtcttgacctctgtaaagtattgcttctcatttaaaactcgtgatttgttgtaagcagcacatgaacctcctggattaggacagctgccccctaattggatgtccatcttctacttttgtcctctccagtttgttctccatctaacatgagagcagttttaagaaatttatttcagacactgtaacttcttcaaacccaacaatggcttccccttatacttcaaataaaatccaaactctgaacatcgcttacaaagctctgcaacttcccaaactcatctcattccactcacctccttgcctttaaaactctagacactggtctgcttcaattattagaaaacatttatttccctccttagctcaatccacatcctagaatatactctgtctccttcccatcataaaacacccagccgccatcccagaaggcctgccctggagtaccctgagacatcagaactcccttgacagccctttatactactgattaaggttgtaattatatatttacttgtctgttaagttgctttattgcctattttgaccatgtctcttttattcacctttgctaccctaatgacaaaagagtaaataattttccccagttccaacatgtaatcagtagcagagatgtaatttaatgtagatattgtgatttaaagcctagttttccatcagcacatgcctttaagagagacagaggcaaatttgagcttcttccaagaagaggagccacagtgattaagggaatgaaagctactccataagagaaagaatgcatattatagcctagcaaaggaaatggtaggaattgggataagagctgcctgtgagaagaagagaggtttagatttactctgttgagttccaagttttaaattctgaaagatttaactacagaaacatgaatttcatctcaaatacaataaagcattttcaaatggtcagaatcaaaaagggagttaagtttccttggaaggtcatgagttggctatctgtaggggagaacaagcactttataggaatgtcagcatgatatgggaaggtacactagaacttgtgcatgatcccttctaccctgggaaatatgaatcttggaattacggggtaaccattttttttttctttataatgaaacatatgttcccaagctcaaattgttatatttcactgattgccacttgcaatgactttgactgcttttctgattccggttgtaaagttgatcctctcaagaaaggtaatgaaaatcagatggaaactactgcactctgagatgaacacacggatatggaataccaccagcattagttgaaaagccttttgagcaaaacttgaaatgcatggttggctgtaacattattcatctattacagctactcaagaagcagttggggttttggcagctctttgttgataaagatcctattcctccccaacaccagattactgtagattcaaatgacggtttaaataaaattctcaggttacaaacactgggacgtgcacacatcttacatatccataggatttggttctgagtcaagaatgaatccatctaacaggaaaaacctactttcaaaactttaatttagcagttagcaacattaaagaattgataaaaaggattctggctaagggcctcactcagctgccaatatacagaaaacttttttctaagaaaactcagaatggagaaatctgggctaaatgactcagaagattcatcacctgggccctgtgccacctccccccttatcaaggaaagcaaatgtgtctgaacaatgcatctgaggatggaggagatgcacaggagaatcattcctaaagacagggaatcagacccatccaaccctctttgggtaaaaatgttaatcagttattatgtaatgaattggggttttttgcatactgcccaagtttgaataataaattctttttgtttaacaaggagggggtaggctgctactgaataatgattgcacttcccaggataagaatacaaaaatgttgcctgaagactactaggcaccaggaatcaatactatcactaaatgctttaagaatttaggaattgggcaaagtgtagtaattcatgcctataatcccaacattttgagaggctgaggcaggaggatcacttgagcccaggagtctgagccagtctgagcaacatggtgagaccctgtctctacaaaaaaataaaaataaaaaattaggctggcatggtggctcatgcctgtaattccgacactttggggaggctgaggcaggaagatttattgagaatagcacatgacaagtctgggcaacatggcaaagagaccctgtctctacaaaacactaaaaacttggctggatatggtcatgcacgcctgtagtcccagctacctgggagcctgaggtaggaggatcatttgagtccaggaagtcaaggctgcagtgagccataattgcaccaccacacttcattcctgggcgacagagcaagactctgtctcaataaaagataaataattaatattctgaaaaatacgtaattgaaaacaaaatggaatacctggtagagcaaattattaagccaatgctttatgtcctgaaaataatgctaagattcctcttatagtttgatacctatttgtaagaaggtagtacatggaatgaaagcctccttctggcaaatctctttacgcgctctggtgaaaagacatttcaggtaagttctctctcacagatcctctgcaaatgtggagataagagagatggctatgttctccagaagctctaagatctaatgagtcctgtattcataaaacccaatataacacactgtgcagaaagatgaaggagaaaaaattttagaaaggatggtggtgtgtcctaaaaatattaaccccagattggaagctaaagttaatcagcagtccatttcaagtagatgagactctggtttttaatgtgacatatttagaaagacttttcaaccaacactgtgaaaataaacaatatgctgctttccaaatgttttggtgccatgaaatgcttcttcagtagttcttgattaggatgtttctgctgggaggctggatctaacattcttccactttttggggggtgactttctctaagtagtgcatatttatttaattttcaattccctgccttttccaaaaaatgatttgcttctgctaatgcaacattaatcagagtgcacttctaatccaagagaagtgtgtgagaattaacttaattcctttggggttatgaaggatggaaatgtaacttgaaatgtagtactgaaagagtatagaattactataaattaggtgattgcttttcattcttggagtcaaggagaccttcctccaatactagaataacagtgcttgatttgttttttgggtttcctgtttgtttgttttttggttggcgaaggagctattaaaacaggaggaacatgacaaagatgtttgccttctgctcctcataagcaaaattttagaacacattggccctgctgcaggaactctcttggagtcagttggtcttagtgtctttgttcaagaacagcttacctctaagactggttctttcctaggagtccatggctctactgcatttataaaactgagtgggttttcatgatttctcatgcattgtttcatgtgcattctctaattaataacagtgatgtcaatagttgtaaccccataaataattgtttagccttctaatcttacacatgagaaacctaaggctagaccctctaacttcatattataccaatatgctccattcctgggttaaagtgtatttcctcagttaatgaactgttctttcttgtggcatttaaaaatattacttacatgctttatactgggtctttgtgttctgggctaactaaacctggctgttaatgcaagcctgtaaagccgacagagattgtgatgaggtgaatgattggtagagctgtgcttctgttgtttttcatgcacaacaagccatagcaaacagctatttgaacagaattaggcacgttttaggctctcattttatttgctgttgattgctagttacagttttcagtggaaaaatgagcctggatacagactttgaataatggggtcatgtggattttttaaaaccaccaagaagaaaaaaaaaagcaaacaaacacccaacttgctatggatttgatttttggggccagaagataattcgatttgaaaagatgtctcttgttgaaggggtgtttacaatgatgaggggtttataataaagccttaagtcctgatattaagtgaaaaagcaggatgcaaaataatacatgaattattttgtgaaatcaagtaatcctaaggggaaggatcataattttgcatcacattacactgtaggtaaagtcacgtgtgcattttaaagtcttgggacaatagcaagcacttgctaagaatttagagaaactgaccaggaaacctggactcctgtctagggctgctggtagtttactctgtgatctttggccagttactcaacttgcccagaactgtaattgtttatttgctaaacaagatgtgttggacaaactgatgccctccagttcttttgagttctaaaataaggtgtctgtctgtgctattcttaaccttcttggactcagacatctctgtgaagttattttaagataaatagaggctttgtgtctctcagattaggtaggaacgcactctgatgctctttcaagctgattcctattgcttctacctttgatgtgctgagatgagatttttcactgaggctgctacttcacatcttgattggaacctgatggggcaaaaaataaacaaaaagcaagaggaagtagtggtactaggtggtctgtccatggaaagaagctctccttggactttagcgggtgataataactaagaggcagtcttggagggaaggcagaatcccaccgtggctccagtggatgcggctgcactacagagatggagatggatgttcagctgagcgtcttaccctgctccaactcacaatttggcttcaaatcccaggtacttttattttctttaagttctataaatccctaatgaagtaaggactgtgtcaaaaagaaattgctttttggcaaacaagtttgttctttgttgtaagacagaagtactcaagacccgacagagcacaaaagctacctttcatttgttaatgtcccctcctctactccaacgcacaaacgaaaaagcataacactatattgctgttaatataggttaagacctagattgcaattttacaacaatgtggcaaaaatgtttactttgcagtctccagaaaaactagaaaacaggaaataggaaagcaaaatctaataaacatttacaagcaaattgattaaattctaaaggacacaggcctttcccccgacccttcacctgttcaatgacagccacacgtggctgcatcagacctggtgacatgaaggattctttctgcaacataccaaataaagcaaacatttattgcaaagacacagtctattgtttgccagggtatcccctggtatagctgcagtctttccaagtttctacaaaacacatagaatttttttttttaaaagcatgcctgttctgtgggcatcgtagctcaaccccacagtgagctaatggagaaacagatgatattcagagtatttgaacccaacctgcaactcctcattaatgtatgtcttcctctacttgattttccatacccccacactgctgaggaggctgagttttgagaatggacacaggaaagtagacggctgattgaactatctttgaatacattgcaagatcagcaacatgagttggggaattaccagcacctgtgatagaggggcgtgctttttggttagacagcaacttgccttaaaatacagtagaccttaggccactgaagcttaactttcagccacatcatggagttgtggtccaattagctttatactaataaggaggcaattattatagaggttcatcaagcaatgaagtagtcaacaatcaagcatgagacatgactacagaagctctatgtgtaggaaacactcagatgctcagtctcctcatcactaatatgaatatcataatcaaaaagtcctggaaccaacacctctgtgagaattaaatgaatcaatacatctgaaatttccaaaatgtcatatggattttagttactattatgattgacgtaaaaatggaaaaagtctgcttattcttaatgccctcctgataaaaagtaattccaaatctggaaggcccctttctagcttctactttaagaaaaactatcagacaggataaaaataattcttttacaatttcccagcaatctgctacctgtatctatattctaaaaacagaaccatagatgatgtaggtttatctacggcctcagagtaatgaagtgtagattcattagagtaagctgcatagatgtacaattaaaaaaaacaaaaaagctccaatgaactgaagacaatagagataaaaataaactcactcccagagctttctgattttactcttcgattagctttctgagaacaagagtaaagcaaaaaacaacacagccagccagcccttaaaaatgctttttctcttttccgggtaagaaacatcagcaggtatagtctaaggtaggagctagggaataacagatataacagcacttgcttggctacatgtaagagaaagatgccatttacacagctctaattagacagctcttagaaagactgcaagcaacctgtgaaactgctccaggtttcccaggctaagtgctatctacctttctatttaaaagaaattaagctataaaaatttgtctattcactgctactcaaaaaaaggaagtgcttttatgtatttttttaaaaagtaccacgaaataaaatgattaaacttcatcacagttgcaaacgattaacttgaaaatagaaaaactgaaaatgctgcagaaaccatgttatcagcctaaatcaatgatttatgctctgaagagtgtgagaaaaatgaactcaacaaataattggacaggatttattgtttttaaatgagttttttaagggatgggatatacattctaacaaatttcctttagtaccttaaatagaatttcaagagcaaggtaaaacaaacatgaggtgccaacaaactattcactagtgactgggaaagagagggagagaaatccggagggagaaaaagggatcatatttattgaggtaatatgggaaggagcacacagcaactatcaaaggacttctttattgggtgaaataattgtaattgttttgatgttagaacttcacatggaacatttatattcactataactaacattccattagaaaatgttggatagactgtattaacatattttcctaggtttttttggttttgttttacttattgaaaatacatccagttaccagatatgccccttgcccaaaaaaagaaaagaaaaagatattttacagcatgggtacaatgtgaaattggagaatacgttagcatgtgctcacagctgtttcaaatgaattgctatagacttacccacagaacactctgcagaagagaggctaagacacaactgaaacctagagcactagtgtggtggcaaatggtggataacattacagaaggaatagcagtagtttcttgtctttatttatttatttttaactggatttatcttagaggtggtgattccatgtgagcagctttctcatcttaaaggtgctaaattgcccatctcacaaataatcaagttattgtaacatcatctatattatttatgcttggatttttttgaattgctcctgttttgcaaatcaaacagcagatgatatatatttgaatttccatttaaaagaatagattcttgcccctgttgaaatctgtaatgctcttatgggtctggtttccatttatcaagcaccagtgttttcttttgcattacagagtacttcaaatatatgcagctttctcatttggatattagtttttccatagatcacatatcaaagaaattttgtctgcacttaaaagggcctatctgtagtagtaataaaatgcataacactaaagataatcttaacaattcccaatatttattatgtattttcttggtgccaggcactcttctaggtgctttacatatgttagtttatttaatcctcctagtaattgtaggaagtaggtactattaataatcccattatacagatgaggaaagcaaggctcagcaacttgtccgagcaagctctgcagaagcaagcagagcttcggatgcgttatcaggaaagaggttcctgagcagcatataggccctcctaagaaggtacttacttttacttattaaagagatgaagtgaataaatatatttatgttttggaactttaaatatatgaccctttctgtaagaaaaaaataacacactgctctgatcagaatgtgttcccgtaaattcatatgttaaacctaatcaccactgtgatagtactgagaggtgaggtcttaggaaatgcttaagtcatcagggcagagccctcatgggtgggattaggatccttataaaaaagcttgaaagattaagtttgccctttttctatcgttttggccatgtaaggacacagcattctttccctcaggggatgcagcaaaacagagcaccatcttggaagtggacagactgggccctcaccagaaagcaaggctgctggcaccttgatcttagacttcccagactctagaactacgaggaataaatttgtatggtttataaattacccagtctgtggtattttgttatagcagcacaaatggactaagacatggatccctattttactaagctttttaaaaaaaatcagattaataagcactagtgttaaagaatgcatattacatactaggtttattcttcatcacttctaaccctctcatggataaaaccatttaaatctgttttggtgagagtcacatagtagccaataatcctatttagaataagcccactaagctttttttttttttttttccttgaagaagctaatcatctcatactgtctaagatttaatatttatttgcctacttatcttttgatctcaggatttagaatcaatgttcagaattctggagatggtagagatggtcttacacatccttgttttataagaaaacaacgaaagactctaagtcataggttcttcctaaactggagaatgggcttgcaaagagattgtatatgcatgaactttctgaaattagtgtacaaataaagtatgtaagtgctctatgttttcaagtggggtttaaatgttcgtgaaattatcaaaaggatccagcttccccaaagagtgaatgttaactgcattaagtgaaatgctcaaggtcacattgttgtttaaactgaaatttagttttcagttttctgtctctttattcagtatatttcccaatataccttaaaacgtgagattaaacaaacaaaaaaacacacctgaaaatcatttctgtgtcatttattctttggaaaaattcattttgacttggagtctaagaacacaactgaagatctctagttctaagatttctatcctaagtgtttcaaaatgtgtatttgaaaattcttacacaatcttcccagccaaaaaggcatcagttttgaattaggtttgatgtacacaggcagggctattatgatttcaaaagccgctctgggcctgcgtagactaatgggaagaacagctgccttgagactgacatatattagtattttgaatttgtcacttattagctattgatcatacttaagtttgctgactttttaaatgcttccatttcctcatctgtaaattcagatcatgacaactagcttttggggttgggcctccataacatggtgctcggcatgtaatagataaccagataatcatatctattataatgtcttgtctttgttgttgaattgaaaagcagaattttaattttgctttatatttagacttggctaacacttttctaaaaatccatgtcaatagggcttttaaaacaaaatgttaattataatcctactaatggaaacagtactggcagcagtgaagattaattatactttagaacaacaacctcttttttatccacaactgcaataattaatttttgctaattagaaggcattataataaataacctgccactaattgataccccttggtcaacaagaaattaaagatacatacaacaatatttaaggtaagcagatcacctgtattatcattaggtttacatgtacttgacatttgttctgcaatcttatgactctggtccacctgaatgatgcatttgatgattcccatattgtgtccttgcctcaggttagtcatgccataaaataggaaatgagataggaaataggaaatgaagttctaaaacctaatatttatgttatccataaggctaatgccaaaagataaaatagatttttaggcaaaaagataagactgagcttttccacccatgctaagtgacttcagacactgtcacatcctgcaccggtaggaaagtgttatgagtgatgtgggaaagtggaagacccagaccaggaatcagaagagctggattctagcaagttatattatttatattctgtgtgactgtgtgactctgggccaatcctgtctgagcttcagttttctcatctataaatgtgaatacctatatatctagtaaaatactcacactgccgcttcactagactgttgtgtacagccaataaaacaacggataaggaaactacatagagataactcttagaagtcagaaatgaaagagattaccactaagaaaactgatattcagagaagtcaaggtcacctagctagttagtgacccaacctcagatttccttgttcttcatcttttggtttgtccattttcttttcctcataaaaacatactttctgaacaactttggattctacaagtttaggcataatattatatattctgtttatgcacatccaagtattagcttccaatatccaagtattagcttccatttggtctttatttgaaaatatttaccttttctttttttttttttccagatggggtctggttctgttgcccaagctggagtgcagtgggacaatctcagctcactgcaaactccacctcccaggctcaagcaaccctcccacctcagcctcctgagtagctgggactacaggcacgtaccatcatactagcgagttttttgtagaaaatatttatcttaactcattacaataaatcctattgccctcttcttcaggaattactattttctcttaagaactgcttaaacatagaggggatgccaatggtaattggatttgtcaaaaattcaattctgtttccatactgcttaccctataattaaacaattgaaaccattttgtaattaggactcttttgaatttattctgcatttttcctagcctaaataaaatgactgtgatttggaaagatgtcaccaagtgtcactattttcaaaaagttcaataagcacattactgcccacacacaattcctgattcttttaatttttccctgttattctctcagtggaagtaggatatacacttgctctactaaacaaatataaagacaacatcaatcactgcggccacttccagtttttgttgttctaatgtctgtcagatcactttgcaaaataatgtaaggagtaactagcaccactgagagaatagaacaaaaacacccaaattaaaactctcaaccaaagtcacttaagttagtaacattggttggaacacaaaacaagcacattaagttttataaattgtgcatgaagtcacttaatatttcagtatactaaaagctggccctgtattatcaaagctgtctttagaggagaagcctcagttagtggttctgtggttccagttgccagtattttctcttctgtgtttaagatacaggatgattgactgccctcaagaatacctgctggttagcgcttagtttaagataaaatgctgttcacggttgtaatttagatgaaagctctctatagctcatgaacttcaattaaatgcttctaaccttttgcataacacttaacatgttaggtcagctctagatttagggtgtatttgtgaacacagcactataaaaagacaggttttcgtgtgattcaagtgcttttgcttttataatataaaaccagcataggaacgaaatgtgcatagttttcaaccatcagaataaagatacaaggaggtatagtttttatccctcaacatactttaaagatgtggaaaataacaggttaagaaaaataatgacaaagtgagcaaaagtacagcgaagtggtagttattgaatgacctaattcttagtggaaacaatgctacaatagagcagaggcagactgacaagttccccaggcgagaccatgccaaatagattctcaacttacattcatttattttatttcaataatttaccttgcttttgctaatggaaaaaagatttctctctgctatttgtgactcagtttagtttttcatttattatggagatgatttaagagacttgagaccccccacaaaaaaacctgtattttttcacactttaaaatggaaaacatagagataaatgtaaggtaatcatccacatatgttaattacagtttttaaacagaatttgaaaagaagcgattacccatttgacattattatgcctgatctagtattggtaaaattttaataaatttaaataattgttttcagtgtggaaaaaggctaactcttgaacacttagtatctgtgggtgcctagaaaagggattatagtattttccaccatccaaagtaaatttattatgagaattttacaaaatatatctatgcaaaacaatgccatgttgaggtaaggagggccacaggtataggattgttcaaatgctgaaagatagtttttcttcccaaaaaaactggaaacaaatgtattaatggcctatggtgcctactgagaaagcttttaaacagtttcactttcaaataaattttggacgttgaggaagcaggtaggagatgtggtcagagttataaaataaagcggtggtcagcagagattttggaagcagaaaacagggacaggtactcgaacaactacagatgaacatctttcaactataaagtccttaaaataactgggtctgaagctactataatttatttgttttctaaaatatcttcaagaatgtaaacagtgaaccttcaagtatgaagaggccataaaactcttctgggcactaatgagggtgaacatggcatgtgccaagggtgacccaggttgactgttagaggcacagatttaagtggcctcctaaactattttctaaggactttccaatccaatgtgctcctgtagccagagtaactaatgaaatactgtgtgttgaagatgaacttctagttgttttaatatgccacacaaaagggatttatcattggaaaaatgatccgtcatgaatccttaatgaagctggatagagttgaggagcaaccctcatcttttaggaacaatcatgccctctggaacacactccttactgcaattctaagaggcagattaccaagcagtccacaaattagataaattagacatttccaacatacttaatttatattaaccaccacattatcaactttgaaattttagacagtccccagtggatatccagatttatttacaagcaaacaatcccctctccccttttaaaataaccatttagtttatgggcctcttctgacaatcacctgttcattcataacaaccaaaacccatcactaaaatgggcaacctcaattcgcttcccatataaaacatcaactacattatcaaatctttagggtaaaggcaagaaggtaatgagagatgcacttctgtcatatggtgtcagggatattgtggcctatgtataatttatttgtgtgagaaagaaaaagtaggaaaaagctatgtttgaatcttaattactttctttttttctttgagatggagtctcactctgttgcccaggctggggctggagtacagtgacacgatctcggctcactgcaactcccgcctcctgggttcaagtgattctcctgcctcagcgtcctgagtagctgggattacaggcgcccaccaccatgcccggctagtttttgtattctcagtagagatgggttttcagcatgttggccaggctggtctcgaactcctgacctcaggcgatccacccgcctcagcctcccaaagtgctgggattacaggcgtgagccaccatgcacagccatcttaattactttcagagatggttaataacctcactaaaacaatattctcatgcacatactcaaatccatgaaaataaaggtatcagtgatgtctgcatttccttaccttctatagctgataggagaacccgggaatgatcatatgcgattacattcgcgtatctattctttggtttgtttacttccaagtttgaatgttcccaagtgaactgctggccagggtcaattgactttaaaaggaaaacaacacatatacacaaaatcaatactgaaaaccaccagattataggcatttatcacatgtaataaacatgatttaaaaggaaaattctgaagccatacttcatcaagatgatcctaactgtgaagctgaacactaatgtaaccagcataacaaaaaatggttaatcactgcagaaacagtgatagtcaccaacattgattcaaatgaaaaaagaaatcaatacagatgttctgttaatattggaaaggcaggttcttaattttacttttccatttccctctctgctgctgtagtttacaagtcatcttggttcaatattccttccggttctgtaaaccttattttatattgattattcttccctattctttcctatctggacctaagctgagtctttaagttaactggtctttcactggcttcaatggacacaggctttactgttcattctttatctacatgttcacaacttaatggcaacttaaggttttgtctgtttctctgtaacacactaagaccaatattacaaggcaaattgtacaatttaaatagttaacacgaacagtaaagaagggaggtcagttaatttaatactcagatgaataagatacaacccaatgcatataaattgtttttctatttatcattatatattttctatttattattatgtgttattatgtttatagtttgctttttattcttgattttaacattagtttttttttctgattttatccctttctttgatggtacatttcaaccaaattattcaacaatctaaaataaacatcaaacaggtatataaagtatgtaatttaaaaatatttaagtagaatcatcatttcaagaccaaattcaggtttgatcataaaactctaggggacttcatttcctgaaacgttatggaaatcaaaatactttttctttcatcataggctactgataacatttaagatttataatttcattgttatatggaaacacaagttcattaatgacacaaacatgattttaaacgatcaaaatcaagttttcaagaatgataaaacaggtttatacccaggtaatttttttaaaatatactctattatgttaacataatttttagcagttatttttgatgccgggtatttttcatgcctttatgtgtatatgtagaagttgggagtaaaacatacccccaacagcatcaaaatactaaagatgtgcacactttctgtcaaaaggcacagaatttatcacaacagtaaaactcacaagtgtcaaaagtcaagtctgttagtagtcttgaatagcctccaagcattctaaaattctcagcagtacagattccagcctctaatttactaaggattattaaactgttttcctttcttagcctgtgttaatctatatacaaaatagtcaatcaatgagcagtattcaggaaaatattaataattatccataccttagagtctgaaaactaatataattaagggactttctagtttgctcttccagggaaatttttcatctcccttgcagaaattaattatctccaagcatgctatgagccgaaggtattgaagcattcagatgtcctggtggaagccttcaagtcaaccttgaaccatgtccacacagaacagctccactcagtgatgagggcctgccttaaaaatctctcaaatttgcaatctcattgctacttcctacatccggaacattggtatctgttgtctgattgaaatcccttctctaatctcttattccaatccactcttcatactgctgccaaagttgtctttctaaagcatagctctggacaggttggctgcctgtttaataacttccactggctctgtgtgacctacagcctaaattctaaattcctacctatgcagctttcgtcatctttgcatctacactacacctggctcagtaaatggtccaacagatgttatttaagcaaatgaacagaattgatgaataaatgtttttgagaaaagttcataaagagaaatcatagagtaattcctctatataacatgagagttagagaacaaattatggaaacttcattgtacagtataccacaattatcatacttaacacccattatcatatggcttagtgattaagtatgtgatcatggaattataactaccactgctattccactttatactgatgaacattattggatacataagcttcttacacatcatttaaacatcccaagaagctactaagctcactggtatacgtacagtgctccctctgatatccttgttttacttagactaagatcacccacagatgtataagatggcatgcatttacttatagcaatgaaattgcatctattaactgaaacaaactgttaactcatgtccatttccactcttgccacatgttttcagccttctgtaggacttacttgatacctacattgaagactttaaaaacgagtaacagaaacatgagttgtgtgccacctatgttagataatacgcttaggttcaaagtgtggcccatgagatgaagaccaacaaataacaggataattataaaaatacgtgctaggtcattatgctttatatgaagaattatgcttgattttcacaattgttacaaggtaggtattgtttttttccatttggcaggtgagaaaactgaagtaaagaaagattaatttaattattcttactgagggcctacttcgtgacaggctctgtgctacttggtacttaagtaatttggctaagctcacacagctagattcatacagttaccctcaaaccaggtctgtgtgattccaaagctcaactgataattaacagctggtaacgactaagccatgatactacttaactatccagaatgccactgcaaaaggaagaagcccaacttaagaaacacacctacacatcactatcctttatttcaccaatccaaatgatatttcttcccaacttatcagcctgtgtcattctggggcaattacataagaaatcaagttttaaaaatgaggttggcttcacatggatgataaaacagatgggatgcagcttacgtttatactcgttttacacggatcaaacaaacattgattaaataatgctgacttgtctttgtgcaacacagcactcatccatctgtatctatctgtctgactgaacgtttaacaaaacacaacacgggtcattatttttggagcttgtcagaatgctgacagcagtaaactcagtaaagaataacaactgaaagttggtgaggtatactaagatctttcatatttcaaaaaatacataaaactggttgaggaaaatcaaatttcagttatccatattactaagacaaagagatcatgaatgagtaagaccctaattgctggtgacagacacagttgctttgcctctctgttctcaggcttctcttgctgctgtcctcttaaggaagagtgagatggccaaaatgaagaaagagcaatgtagaccctgaggaatgtaaaagttgactttcacttcaaccctgtattttcggtcagtccaccctgaccatgcatcttttttactataaagctaagctgaggttacccaaatattaattattcaaaacaatttgaaataagcacctttgttcttaatggactcaattccttcttttgggtctgctgctgttagtgtttggttttcctgagcttgactcctagatatgtctactcaactctgtccacccaaataatcttccatgggatacccttgccttcccagcactcaatctgaagttttaccttcccaagctgaaatcctggccaggctttcttcagtctccgttgtggagaattttgcaagttagaaataaagcaagctagatttatttaagtaaaagttgattaatacacttttatacatgatacgaaatacataaattatcacagaattcacaaaaatgctacttcgtcgtattttttgtgtctccagccaatcaaaaagcctcttgaaagacagatattggatgaaccccatatagcgtctaaagttttaccaagatgccgcaccattttacattgcttccctgcctgcacactgggcacttgactcctcctccccaccgcagcttttgactaaacctttctaacgctaacaacagatcttcaactcaaaggctttgcttactcagaaaaaatgacccaatagaagaaaaaatcctattgtgagtgatttaaagaacaacgggaaagtctcaagcagatacttgctaatataaaacactttgcatttatttagtctttaacttgatggtctgaaagttctaatcctttttatttgatcaactagaagtttatctcaaactaggtaactgaaaaaataagctatagcagatggattagaggtttgcattgtattctcgacaaaaactcagaattaaaatataaatatatccaatagttgtaactaatacttagataacatttactatgttttctttgtgctttgtacatactaactcatttatcttcacaaagaccctagaagtagttgccattatgattacagttatgtagatgaggaaactgaggtatagataagacaaataactttctcagggtcaaacagctagcagggagagaggccaggctgggggtccacatattctggccctggaggctgagggcccagccaccataagatgctttctctctagttaagctggagaagattccttgaaggtttcacacttgcctttcaactattctcttgaaacacaacgcacagaaggttgggaacaatctgtgtagtactgctgaactctatttgtaattctaaactccaaacaagagagtgatcatcaatttgcacatcagattacagtcaccaagtaaaattatatcctgatatgggagtaacctttttcaataatgctgaagtcattatcttaaagcaaagtcctttaatcattctgcaaaattcaacctttttacccagaagaaaaatataattcaaatgtgcaaaacaccatacaatactagttgctctgtgtttcactttccctcatcccgccaagagaaaaacctcaaaatattccctttagaaactcatcaaagagaaaccacaaaaaaagatcatcctgtttttgtgtgtttttaaaacaactaacaaaaatttaattatatagaaggaatagaccagttacttcactcgtcaaaccatgggtcagactaaccattctttttacagggaattgaactttcaatgaccttaacttccaaagaaacagtatcttttcacatatctccccttcagtaggctcatttggttcttagtgtggttggctctgagatattctcaagtcctttctgaggtttagaagagcaatctaccattcactgtgtattctgcaattatgccttttaaaattctcattcattgtctctctcttctctgtttgaaaatggtaaattaatatatgcccatttggaaaagaccacgtttgcatagatgggaagggctatattttgcacaattagtaaaagcctgcaattggcataatgaatactttcttcaaagagaagagcatgagttcagttgaatcctatgatgttttagaaactgaaatgtgaggaaggagtggaaagtccagtggtgaacaaaatctggaagtcagagaacagggtgttagctttctggctgcccctggttagctctggccggtcaggtaacttgggtctgtttgctctgtgttcccttttcctcttaatgtcaacctagtgtcaggtgtgtgtcctcattttctcttatctctctttgtccaattagttatcaaatcttactgagtctctctctgtaagagcacctctgatccaggccaacattagagtgtgaaggattgaaataaagatttttcaagactctcagtattaacaaatgaatggatgtgggagtgccccacctttagtagtagaaaaggcatagaaaatgtataaatataccacactcattgaagtcatcaaaaagtgtttcagtcacatatttttgtacacagttaaaattctggcttcagataagtgataaaatgcatcagctttacctgttgtctaatggttgcatttgaaattttgactctaacatactatataacaaatacgtatagaaaattacttaaagtaataatatatattattagaactgacatgcagggaacaaaaaggataaactatgctcatagtaaatcattcatccatggcaagtgagtaaatatctgaggtaaacttttgataaacaatttattctaaattatatcatagtactaaagatgaattagtttatttcactgaggaaaccattgattcccagaagtatattagaattatcttaatctaacgtggattaaaaatgatgaaaaacaacaacaaaaccaaaaatacttaattcttttttttaactcagtaggccaacatgaggtactctctagaattcagataaagtgttttactattttagtgtgtgactgtagaaaagattatttttgagagatcgttccaaataagaatccaaaaaagaacatacaactttaagattaaagatttaaataactagattttttactatatacttttttaaaattttttatttatcttttatttttatttttattttttttgtggcagggtcatgcctgtccaggctgaagtgcaatggcgtgatcttggctcactgcaacctctgcctcccgggttcaagcaattctcctgcctcagcctcccaagtagctgggattacaggcatgtgtcaccatgcctggctaacttttgtatttttagtagaggcagggtttcgccatgttggccaggctagtctcgaactcatgaccttaagtgatccacctgccttggcttcccaaagtgttgaggttacaggcgtgagtcactacacccaacactatacatggctttttaatatgccaaacattttcctgaatattactaaatgcagaagaaagacatttctagtttccaaagacaatgtgctagaggaataagatcagcgatatgtgttaatcctaatgttttcatttttagctatttatctcctacatcagataaggtgaataataagaaagagatggacagatttataggtgatgttctttttttatttcttcacatctttgaattctatatagttgatgttcttaagaatagaatgtgtcattggaaatcactttacaaatacaattcacagattagaatttctgatgttatttgaaaaagcaaagagtattaaagaatttccaggcagtttggggcaagcaaatgtattagaaagttattaaactgctttgtttaaatagacaatgttgactgaattggtaaaatgtaattacgatgacttataagaagaagtcacttgatctgcaaatcacttataaagtatgatatttaataattaaagaggatcctggtgaggtggcatgtgcctgtaatcccacctactctactcaggatgctgaggcaggaagacttcttgagccctggagtttgagtccagcctgggcaacacagcaagacccaatctcattaaacaaaatattaaaataggttatgcacacctagaaacattaaagagtatggcaacattaaagagaatattattgagtataggtaacagacaaaattatctagcaaatacaatcaatgtgcagcattaaacactaatttacggtgttagtaaattagtgttttagtaaattaggaagaattaattcacagctgcatcctttcttttccatggataacaaggtcccagtttttgccaccaaattaactagatgaatgcattaattcctcactgctctttgaaaatgctgacacatctgtatagatcccaaagtattaagcgaaaagtacctgatgcacagttattactaaaagaatgctagatgttttgccttctcttgcctctaccctgtgacttgtataagaacatccctgatagaagactatcttagcctccaaggaatatctgcattctccttgatgctaacggtgccttttttgatactgaagtataaaactgaggcaactgctcaatttaacaaataaatctatttctgctctcctacttactatataacatgcccatctatgtaatttgcaaactgatttacttttccggcagagacaacaaaaaagagcacagctgcatatggttctcactttttgcatttcatataatagaaacttgaccactcagaaaactcagtacataagtagattcaaaagaaaaaacaaattatgaatgaatagcttggtttcacaattgttgtgcgactgatattacaacatcatttaagaaacactataaggaaaattgttaagataaatcatcttcatttttaaaagtcggattagttgagcttaagtgataacagtaattcttttaatcaaatatgaaaatgtctagcctaattttaaacatacgatttttcttcctattatttttactttgcatcctaaacatagatgtattttaggctttcatcattgctttgcttgtcatttaacagaaagtttctttattaagtctttgtttctttttccatatttagtttcagatgcaggtggagggaacagatgaatttctaaattgaaacataaattaacttttgttaatgttcagtcaatgcatttcaaatctcattttctgattcagaaagagataaaaattctacatccaaaatgaaataagaaagagtaatgttttctcccagtctttgtcggaactcagaaaatcccaaataatcacttaaaaaactcttgtaccccatttcataccaaatgtatttagtacaactatctcactaaaaaacatgactatccacatgtgccttttgggcacagtatatataccaacaaccccttgccattaataccattagtgcttgcaggtaaggtagcaatacaccatactaaatataggcttctaatcaaagaagtcacacaggatgatcattaatacttatatccatggtgctcaggtgtcttagaaagtatttacaatctaaagtgtcagtatatttgtctcttacatgtgataaaactagaaaggctagaacaaattaacacaatctagaattttagagtttagtatctttctaaactaaaagattactctcaaagattagtatttttaaatgtatattagttttacattgtaaaattagggactcttctaagttaaatattagaaaaaaaatcagtacattgatgatcttatgtattagacctctggaaaaaatggaatcacttgagaacactgctatggggttgtgatttatctgatgttgtatattttgtatttagcatacagtgaattttaaaatgtatttgtggaatgaatagctaagatacattacaggtaggatacacagcaacaattacttttaccctagtaccttagaactagttaaataaatttctcagccaaaggtgtgatgatgaaacaaatatatattggaatagaccagagatataaaaaaaaaaatttaaataaacagaatggctcccagctcacaagtggctacaacccaattcataaaagccatctttgactttttgtgcatctgaaattcattctaagctatcacctgtgacagccttttgtactgtgttttccaatttttacatatgtacttaatatttggaagtaacacataatggctacttgccaatgacagttctgtataaactgtattacccaattttctgcacagcagtatgggtttatacaattagttggctattttaatacaatagtttttttcatttttttggtttgtttgaacagttgtgctccccaaagatctcaaggccacttatgttgggagttatagggagaatggaaggaatgtgatcagatggaaggataaatattccagaatggagctctacaataggctgagtttgagttaggtagtccctacatcccagtttacacctactgtcccagcgtagttattaataggaccctttctcactctcaaagtatcccagtttaggcaagaaattacatggccaccccaaggtagagctggttctacctaacttcctcatattcacatctatatctaggcaagcttcatgacagtgtcataaccatcagtcaggcatgtacatgtacggggagggaaggcgtgcaggggagcaggagagagggagggagggagggagagagggatggggagggagggggagagagagggagggggagagagagagagagagagagagagagagagagagagagagagacagacagacagggggcagtctctgctaaaaagtaagtacacttacaaactatcacatggataggtgggtgggaaaaagtaaagagaaatttctgcagtgcaatacctatctccaattatctaacactattgatgcagcaatgagatactgaatccagaatgagagaaggtagctgaccttaccatgattcacccttgttcaccttaactatggtgctgcacacaagagagaaaaaggaagaaagcagagaatgtgtttctcagcacacatttactgtgctctctaacaaaccaacaatttagccctttctgataattgctttttcctccttctaagacagcattggagatggaaggaatgtgcagtacataagctggctggatatgtattcaattgtgattggatatgtattcaattatgatcaaagtaaacgaactaattttacaaactgataattcattctatagacatgatttttaatcttgtatatcacctataatattttataatatttaaggctgtgattggaatattaaatgtaattatgtcataatttcttttttaatttttaatgctttggaagtaaaaccatagacctattgtttgagtattacacaattcaaccatgatacgtgtctccaaatgtaatataatctaaacagtaaaacataaattaacatgtcctttaaaaatctgtgtattaacatatctaaaaaaatgctgtgtcagttagtaggagagaaagcaagccacagacatgcagacaatggagggccagggaggacgatgaccatgaaaatctggtcctctcagaatgacggtagcatttagacgtcacagcttcattacatggccaccaagaccacacaactaatgcaagtgaggtttccagaaaacagatctctctcaagttttagaactaagaagcaagttgtaaagtgaccatatcaaggtattctcaaggtctggaagcctgtcttgggatcactttgccttctctacctggctcaattcaccccactgtgaagtcagtctttgattcatccatttcctggtgttagacttcagatactaaactctgtcagaaagccttaaaagtgaaaaaaaatatttcccctgaacacatgtatacaatcatttaaaataactttgaaaagcttggaaatagccttaatataatagtagattatatgaaaaagtgtgaagctattaaaattgttatgcatctagtgacgtggaaagataaacttttactgttaaagaaaaaacatgaaacagtacttttgttaaaatatatacatatgtatacacatgcactgcatacatacatgaatacacacacatataaaaacctagaatgttatacaccaatgctatcagcagttatctctgagctgtgataaatgacaattattttatttccttatgtttactatccatgttctttaatttttccatttatgaacattgaactactttccaggaagagggaaaaaagagagttgcagaatacttttcacaactgcacatgtgacttcctcttgtcatgtcagaggcagaaggagcagactgtaggactcaacactctggaggggattttgtgaaatccatagaaaatttttcagctggcttttggggtccatgaaggtaacttcagtgtagatttatgaccaggaaagaatactgaagggccaacacaagactagactgtcttactctaaactcaccaaaggatggtagtgagaaataatcaggttaaattacttctgattttgaggattatgatgacaatgaggggtggattatcactacttacagaatctcatgtaattcttaaaacaaatttagaggtatcttagatattgttatctccatattacagataaagaaattgaggcatagaagggttaagatactttccatgagtcactcttggtggtccataaattaggagaactgggatgtaaatgcagagattcctgactttgaagacagagctcttaactactacactctaatagatacgtaaattataaatttattatcatggagcataattccttatttaaaaactgtggacagtaaggaaaatagattaaacaccagatacctctgccaattttggcttaatgatgcattcatcccacagttgttattgccaaaattttttgataatgaaagacaagccacagctttctataatatatcgttagattctaacatgactcctatcaaatccaaaagagtgggaagttaagtataatctttactttaataattgggaacaaaaagacacatctcaagttctccctggtttctacacacccaacagtgctgccccaaaaccctcacacaccataaattctgcgggaaaagagagaaagctgatgcacattcattccttagaactgaatagccataatgcagcaaagggtagagctgtattggcagaaactactaagaatggtgagagaccaataactcatgaaaaacaagtctacactaacagttttaatgactattctaatggtttaatggatagcactttaataggatttctagtagaatctgaaagcttctgaaagcttgtcttcaataaatctgtcattaacaaagaactgcattgcttaactacataaccatagtttactgagtctgaacacagaaaaagtatagcagttgtcatcctgtattaccatcaccttttcaagtattctattaactactgtgagagagacagctacaagatcaaaatgtaggctgccagtgaaagaggcatatttatactaaggggatgcagtagacattaaataaaatacaacagaaagctcacaattatagcttgtgtccaaagaaaaagctgaaacagtaactgtaatccaaatacacagatatactaacaatgaaatttcaaaaactagctttagttctctttgaaagagtattaaatgttttggggtgatttgtttttgaatgcctattgcactctgtgtctacatttgacttattttgtattatgttgcttcctgtactgatttaatgttctttaaagtcaggaattgccatgttgtggtgctcagggtacataccaactcaatataaatattggattggctataatcagtcctagtgaataattttaaattccagcctttggctctgttttcctctgtccatgtctgaggttctcatttctgacttttttgcactggaatatttcttgcttggagagcactttcttatccttttcttttttttttgcttctaaattctaccttcctttcaacaaggttcagcttaaatcccactctcccaattcattactgcctggagctttctcttacatgcttccatgtgtgccactatcatgtgttacagactggagcatccatttggcaactagctacgtttagccttgtagcatttcttcttgtaaagttgtttgaattcattaccataacttatcttttcatttgacaattctttatttccccaactctatagtaagtttctcaatggaaatactgtctggtatatatctgtgtagtctagaaaatggctagcccagtgcatgtaaaatgtatgtaaaatacatttttttttttttgtaattttaatcatttcttgtctcaatttctgtgaaagtctttcaaggttgggaaacttatttctttcggaattacacgtagtcttatatataccaggatcacaaacctgaggataacagactgatgcattcttcgagtatgttctatcaatgctgatagctgtaaattcatagactttacagcaattatactgattatcaaaattactgaaaataacccattggctaagctatgaaccattcaagttgtacaacttgaacaaggcctagagtatactggaagaataaaaataccttctcagatccaatagtaggcaaatttgagtaaatatacccatgctaggagatttatatatgtctgtctggtgataatgtccttgtaaaaatggctccttcattcaaaatcaaaagcattatcacttgaggcaggagttcgagactggcctcagcaacatagtgagacatcgtttctaaaaaattttaaaaactcatcacaaaagatggtaatgcacacctgtagtcccagctacttgggagcctgaggcaggagaatagtttgagcccaggagttcaatgtcgcagtgagctgagatgagatcatctcactgcactccagtctgggagacaaagcatgacccactctccaaaaaattaaaaaaaaaaaaaaaagaaaagaaaaacaatattattaatcaagctattcaataaaagtaaacagaattttattctgaaaaagacaatatgtttgaggtcatttaaaacacctattgtttattaagaaaacttattaagtgatagattcagtctttacacagagtgagtcttatttactccatttcaagggtatgctttgaaaaccaaacaatatagcgaacaaaaaacaaaaagcctaaacaatttcataaataacaatatgggtaaagtaacaaacataaatggcacgctctacaagatagagcctcttttaccaatataaatattaaaatataagcaggtcatcttaaccaatgatttacaataagggaagaaaagaaaaatatctatatgattctttggcatctcatatttctttctcgggggggcatatatttcatccagctaggggaattttggatgaaattataaaacaaaatactatgcctgttaactgctcccacagcttagagaaaccctaagaagttctgccagggaagcataatagagaacaaatgctgttccctaatcttatttcacatacattcaagtaacagaatatgagaaagagaaacatgagttttccctacagcgggtccaaaaatctgagagtctgaaggattgatttttctgtttaaaaaattaggaaatactttgaaacacacattttagacagttgctaagacactaactgccctgacctactgaatttccacatctttgtatgtattgagtgtcagaaaaagaagaaatcccatcacccctcacatggtacatgtaacaaacgtagacaaaaatgccagtcccattaaccatggagtaaaactcatagctgcataccaaaatcctgacaaattctagttattgtggctttggttaagtttggataaaaacactaaaggaacccttggactcagaattcaagggcaaaatttatgcatcatttatttttgtactgcagagtctagcaaagtacctggcacattgtaagagcttagtaaatatctgttttatgagatgagctgaatataaagctggaaaattatatagacttttaaagaaggagcattcatgatcttgaaaattgtttcttaggtagctaaaatttttatttttatttatttttaaattttttgtagctaaaatttttagaattggtcttcttgttctcaaggccatttgggagaaatgagcagctttgtttcaaagttcatctgtttattctccagcgaaaattataatccttggtctgtggcatcacaattggttgctgtgggaatgattatagatcaaaaacaaaacgattatatcccttttcaagagcaaatgagtaccaagagcagatgaagacttaaggaaacaaagatgttcttttcatgcaaatatttttacaatacaactgtggagagataaatactgaagctggtagtctttatgaaatttataggcagatttttagctttggggaaagacagctccctttgccctcagagttagctttgagacatgaatactacagatcatttttctttttttttttttttaaaaaaagaaaatataaagacactgagagcgtaggaaaagtgagttctgtgatcagtattcccctgttgttttatttcaggcagaagaatgtcttcctcatctgtgtacaggatcactgtcagggagcttgatgtcctgcactgtcctggcaatatgttgcccaagggaggtccaccaaggaaagccaaaggtgaattctccacctagaaagaggaccatgcccataaagttgctgttcctccgtctccaaaagacttctgctgcagcacagtagtagttaagagttataacctaatgaagcatgcttattcatgacttgataaatgatatctctctatatatcatgtgactatgcttggaaagtgggagatgcaaagagcaaactagactcctccttctttctctcttttgcaggagatgcagagaaaaccaacctcctccctctttctctcattccttccttctctccctctctcttctttctggcttttctcttccttctttctttccttttctttttcttttctttcttcttctctcttctcttctcttctctctctctctctctttctttctttctctcaacttatgcatgtattaattccagaaaattttaccatgctagtcacaggaatatcctgataaacgagacaccatgaagaagctttcataatagcagaagacacaaaagtaaaactgaagaccctgtaatcccttgcaatgccatggattcaacacagcaaacagcgaatcaaatctgccatatacacagtgacaggcacctgtatcaccctaatcttggccttgtactcaagcctcaagctggagtttggcccaaattgacaatggcattttcaaacaactcctcagtgcccttagtttccctccatcaaatgtttaaaagcaatacaaacaaaagaaacacaaatattcaccaaaggtagaaaaaaaagcccagtggtcttcttgattctttataatatacccacttaatatttaaatataaagtacattcactgaactttttttttttaaatggtgaatttgcccgggcgtgatggctcacacctgtaatcccagcactttgggagaccaaggcaggtggatagcctgagcccagtagttcgagaccaacctgtgcaacatggcgaaacctcatctctacaaaaaatgaaaagttagccagtggggtggtgtgtgtttgtaatctcagttacttgggaggctgagatgggaggatcatctgagcctgtggaggcagaggctgccgtgaaccctgatggtgccactgcacttcagcctgggtgaaagagagagaccctgtctccaaaaaaaaaaaaaaaaaaaaaaaaaaaaggtaaattttatatgtgaactatattgcaataataaaatgatgaagaaaaacatataaaatatatcacacaagtttatttctccctaaaactgccttatttcttcccataagtaaaattcctactttatcacaatccttgtaatgtttataatttgggttctcacatagaaaaacaaacatccttaacgtttcaagttaacatgactttaggaggtaatatgatggttgtttatttttcagaaaacatttttatgtgtttgtttttatctagggagtctacttagaaaatgtcatctattgcataatgttagatgtaaacttgcagagacttcagccacgtcacttaactgccctgaaaatgtcttctctacagtaaaataacagcagtgaacgaggttagaagattctagaaatcctcaaatataacttcacagtagaaactttgtgacactgaatttaaacttaaacctctaaaattttatgaaggattttttaaagataataggatgatttcttgagctgtgacaacaaggatcaatacagaaggaatagaaaaagaacaaaaatggaaatcaatgcccagttgcacggcaacatccaccaactctaacacttagactgaaaatttttattctccttgtgtctcaacagatgacaaggaggtcaattaattactggtagtgggtggtaaaatcttctaccttcccttatgcagcaccctaactgctcttaataaaaagggaggcagcatttcattgttcattaactatactaattatagcttctcaatcactgcagccacataggcactcctgagttgtagaacggcaatagaagagactcgacctaagcctgcagggatgggagtaggggaaacacagcattgagaaaacaaaaagggaaacctgacatcagaatctgaacgttattacatttacattaaatcatgtttcataataaccagagaaacagaatttcagcaagagagaaagaatctaaaaagatcgtccagtccaatcacctaaattatgtttgagcttctgcctcgtcaatccggctcaataagttatatgccacctgacatactgttcattttaacagaactaaaagctggagcaaaagcaaacaaaacaataataacaataaattcttaagctaatggaaataaatgtaggtaggcagtggttttgtatcctcctgccatcttgaaatacggcaagcatcttctgattgtacagtaacagctcctatcttttcaaatcatttagcagcttttgtatgaaattaagttgcagaaacatgaaaggattttgcatatatgaaaaggtgtttttagaatcttaaaggtgaatattactatgtatcatattaaaagacttataaatcataatttattgtggtgagcaagtttccccttcttcattggtcttatctaaatgaaactggaatctgactcgtgatatgtagtgagaagggcaccttgccagtataggtctcacttttttttaatcttcagggttagacaagtaggtagactctggtctataactgacaatgtcaaaacaagaaacaagtcaataccaactatcccctgtgagagttaaggctgagtctttacacctttaaatcccatcaaccatctgctttttttttccttgattttatttacctagatcaagatcagaagtcaaaggcagtcactataatataggtagttatagaatcaatctgatgaattatttctagcccaactaatcaaatatatttttctgtttgacaagcttaggatggaatgctatttgtttcagatataaactataatcctttcatcatcttcaaacttgctaatttttaataaaaattaaacaagagcatgaagcgggtggctgggtataaaggttcctatccaaatcatttaaaactaagtcgttttgttgttgttgatagactgtctctgatgttgaaaagcaaaaataaaatataattataacaaaaagaaatttgggacaataatccttccttggggtcacctgactactatgtgatcaccttaacagataagttaatgacaacaaattttccatggtgaaaactgtggtgaaaggaaatcaactctcagaggcaactatttatagtggtcagaacattacccagacctcagactacacgggttcatatcctagctttgccatttactagctgtgtgaccttgagtaagttacttaactttcatgtggttcaacataccttctgtaacatggggagactaacagtacctacctggaaggactgaatgagttaatgtttacagtaatgcattccgaagaatgtctggcacatggtaagtgctatacacatgtttgctatcaccatcatccttgtaaagcactatctagactctgaaactctatggaaagactattatgatattaaaatgtgcagtttaatactaaaaaaatgatataaaaatactctgttaaactggcagaaaataaagaaggggactgggaagaaaagggaaggaaagaggaagagaaggggaataaaagaatgagtgaagggaggagggatcatgagagaaagaacaaattaaatcaggggtgtctgtgagccactggttgaagtttagaggactgatgagtgcctgctgttaaggaaatttttttagcaagtgatatataataaagttctgattatgcttcatgcatgaacttttaagctaaagccaaatactctgattgctgcatctgtgacgatggaaagactaatgtttcccaaggcctagccaaaactgcaaattcatgtaatctcttaatgcttacatccttcactttcatctacactcccaaagcatggtggtgtgcccaacatttgttttttcaaaaagaatgacaaactgtttagccacagtagaaaaaccatgacaaataatactgccactaccattttataattttacaattaaatacataaataagtaaagtcatccctatgatgctgggttacatcaggctctaggcagccttgttccaatctcttcttgcagcattgttaaaattttccccgaaagctgttcccagcagtgacataaacatagacgtactcatttggtccctcaggtacttggagtttcaggaggaattgtaggaagtgatttccatgacttttctgaacatttttgaaatcacttggttgcagactccttcctatattgttatgacctttcaagggtgtaatcacctttcacacctcacctctcagcagcatgaccctgagctgcaatgacagtcacagaatatgttgggaacccctgagcaagccacgcttcttctcatctccatgcttttgcatgcacagatccctcagcctgggggcttgcatttctggcaaacttcagtgactctccaagtcatgggtactctgggaagactctcgtcaatattgtcccactcccaagattaacttaacaattattttttgttttgtttttttgttttttttctgtttctcctagaagactatggactcattcaggacagcttatttcttgattatttttggttctccagtaaatgttaaacagatgaaggcattcaagctactcctcttataaacaaagaaactgagatcaggagagttaaataatgtgtctaggggcattaaaactagcagagacatcaggacagtttccattcgtcagtgaaaatacctttttttgatattttaatgtggatataatttccagaaatgatattatgtacaaaatatgaaaagaactctgtagttcttcataattaccctccatccttgtcaccctttaccttcccctaattgctttcatagagctcctttttggaagaatgagaagagaatgttatagaagataaaaatcacttgagaaaaaaaagtcatgttaagtgactgacagataggtcatgcatattgaagttcacaataacaagagccacttctgttgaccaagcgcagagggcaatgggccaggtgcctaacatatattcatcttcataacagtctcatgggtagatactaatcttctcatcttaaataagagaaccaaggttctgagaggtaaagcaactggctcaggatcaagcagcgtagctactaattggcccagtcaaaatatgaaccttgttttccctgacttcaaggccctccccagcatccactatggcatccctctaagtacacacttagcattccggtgctaaaatcccaattttactttgaaataaaaatgcaactcaataaagagtgtcttttttcagtccttgctatggtctcttggaagttgaaagcttgctttggaagcagagacagagttgtttcctgagagccttgggctccacatgggagcaggtgaaaagacattttggagaatgtccagtgatggtcaagggccaattagttatagagaacttgtatgagaacaacgactgagaaaaaatgaaagttgaaattgtatgagaataaggactgggaaacagaaaacgagttatgtgagagtcccttaagacgggtaggactcccacaagaaaaaaacaaaaggctctactatgaaagatacgaagtttaatgttagtaaagaaaatgtctgaggttttttttttttttttaatgtgggtgaaagaacaaacattttaaaagtctaagtagaactaagctttggaacttgagaaattacttgcactttgagttttcacaactatagaagatcagtaagaaaaaaagactataagcgcatagacatacgccctgttttggatgcaatgtttcttctaaggtgagctgctgtgtctttgtgttctactagatttgtttataagatgccaaaagcagcccactgggaggggactctgtactttttcattttacttggtgagactggtccttaactgcagaacaaagacagcatgttctcagatggccgactggtaggccaatctttgctataaaagcggctcagggactttattcagtaggtacttttgagttaaatctgagaggtctgcattaaaatgtaatcacttctgcactgtctagagatagtaatagcctattttctgagagaaaagagcctgaaaataaggcttcactgctgatagatcaggtggggatgtcgactggaaaaagcagctctttacagcaggacactctttcttctgtttgctcctgttgttgatactagcaattttgatcacaacaaagagtttctatgaactgtaaatttagttagaaattgatccagacacacactttggttaatcacctgctgtgtgccgagcggtgagcttgttaccacgtggccaacagcataccgagaggccagacacctgaccaaaacacctgacccagagaggcttgatcacagcaaatgactggagagtaagaaagggcaacataacaagtgataattgcactggtttaaactagcaagtttccatttctttcagtcttttattcttcttcttcttattgttatgattattattattatttttttttactgacatcagcaaagccctaagggtttggcctgggataggaaatggtagggtttcattgattctaagacatacatttcctttccacattctaacatctctgaaattgatgtgcatcttaaaattgatggcatcgtgcagttataggggtgatatcttttattccttagtggtacatgcaatgatggagtatcttaaaattgatggcacctagatgagataaaataagtaatagttactaagactactgagtactggtgtcaggaaacctgataagcatgtatgtgtttgtttttaatgattgtatgaagtaagtactatgactgcttctttatatagagatgaacaaactaaaatacagagaggttcagtcatttgcttaaggtcacacagtttgagctaggggccaaactggtgacctgagccaagggcctgtatacttagcaactgtgtcataatatttattcccactgctggctcaacaagtagaaagcccggagtggcaggcagagaggtttggacccaatctgagaagcagaaaaactgccatgttcgtaaggaattgggcaaagactctcccacacccacctccaatcccagtgtattaggagattctgatctggaatagtaaatttagccattcatcttcctcaatttcatccatcccaggtacaaaaatgttgttactgctttttatttcacaaaatcgctcatttttctcattccattaccaaaccaccataatttgttctcaacttttttaaaaacaatcttttatctcttgtgactcatatgtcaaaaatacttagaaatggaggccttcccttagaaatggaagagtctattccactcttccactttgcataaaagatgaaaacagatctctgtcgtccaccacttccttccttcaagaaagtgggggaaccaccttcaagaaaaaatccagtgcattcgaagttggccaaaaaaaattgtgtgtgtgtgtatgtgtgtgtgtttggtttcttgtttttgtttgtatgattcttgaatacatgtcccccctcatgagcttacacataaattataaactaatagaaagcagatatgacagtagttttgcattataagtgctcagaggtttacaaaacctaataatgatgactgttttactaatgatggttctgcgcctgtgaatacactgtggcacatgtggtcaaatataccaagagtcttttccaagggaaaatagaaatgttttcttttgtggtcattgcttagatgacagacaatttttgtcccctctgcggagaaatacaatgtttactatcaggagtgaacaaattatctatggagaaaagcaatgcgtccttagcatgtcatagagaaccactgggttttcccaggaatagtcatgcaatggaaattggtaactatgacattttcacagaaattttaaatatcaatattttgatctagtttgatactaaggtttctgaactctatcatcagggcatagtaagaaataaagtgtgaaacatttaagtgtttatatcaggtaagttaaggtgcagtgaagaagaacaaaacaagatgaatttgtgacctggttttaccacacatagtaggtgtgtgaccttgggtaagtcacttctttctcagtcttatgctccttacctctatgatgggagagtgaaaccacatgatctctgtggtttagacagctctaaatattaaaaaacatgacctaagcaatgtttttaatgtctctatacgtctcaacactgtcttgatgtatttcattattcatcaaggaaatatatttttcctttatctgtcttactgagtgatgggaagattttaacttactctacaaaggtgtaatacatattgttataaaaacagaaggacagggctctgatatctgaaatatttcatataaaagggtcattatcatcatcacagacaggagatgtgagagtgctgccatgagaacaggaagaaactcagcacatgtgggtgctgaatggtgggagacatgtgagcactgagactggagacagtccacatccagagacggcagcaaatgtgttgggactgggctttgtgatgagaacaaaacagatcaaagaggccttcttcagggaacacttctgtgaaccacagagtttcttgtccctctccaatggcaacagaaagattgctccgagttaatacatagctttaaggtaatactactaacagagctagtgctgactaacttgaaactagatgtctgatgactgttcatctctgtgtaactaccatgacaggatggactgtggtccaaaatgtgacttgtaagtgagctgacaggaactcagaaaaaatgctgttgttgtaactacttaaaaaggggttattatctcaacccacaccacaaaatgtataacatctagaatgtacctgaagtagagtatgtgatttgggacagtatttctattagaaaactgtaccttgaggaccacattgggaactagttttacattttctctaactttatagcttttcttgatagtgaccactgggatgcccattaattttttttattttttttttactttttttcagacagggtctccctctgtcacccaggctgcagtgcagtgacatgatctcagctcactgcagactcaaccccttgggggtcaggtgatcctcccacctcagcctcctgagtagctgggactacaggtgcatgccaccacgacaggctaattttttttttttttgtagttttgcagagacagtttcaccatgttgcctaggctggtctcaaactcctggactcaagcgatctgcccgcagcgtcctcccaaagtgctgggattacaggtgtgagccactgtgcccagctgggatgacaatttattacacaaagacatcatcaatatcttttaaaatgtagattctgaatcagtagcagtggggtagtacctataattctacatttctaacaagttcccaggtgacgccaatgctgctggtctgtagtccacactgactatgagactaccagaacgttcatttctcatgtgcctttcccttgataaaatgcacttcactcctcttcctagttccactaagagtgccatcttctcttcaatacctttctcaattctccagatcattatgacctttactgaatcccaataacattccagcacttaagattacctccttggtgtaattctcgtttgattgtatatacttgtctttgacaactacaaactccagaagtacaggtttcttacaacttctatattttctcagcactgagcacaatgcttttctgtagtactgtagtggataattattagttcctcctcccagctcacaagcctccttacacagaaacttcgctctcccccatctaagatctgtatgagtggactgttagcagttacgtcccaatgtgtgtcaccacaacaaacagtcaattagatagagttcagagtttgctctctggcatttaaaacatgactggcaagtacaacttagtctctttatggggcctgtacgtaaatgaaaatatgattacagaccatgttttctgtgcgtgggtgagaaaaaaagaagacgctggcttgtataaggggaagaataaagccaccacagagaaagcacaaagatgaaagctccagagaagatatcaggaaattgccacagcccttcagttttagatgatagttcttaatgtgtacctttactgttagccttggccctataatacatcaaaaatgctcttctgtatttccttgagaatttctaggggctgcagttgcttacgatctatctagtctaaataagatttgtatatatatgactgtgatgatgcctactgattaaattttaaatatactagtctatatgctatctcagaaaatggtgaaatgaagactgggggtcatgttctgtaatacattaccctaaaccaatgacattcctcaaattgaagtctttggagcacctgcatcaaagtcacctgaagagctcttttaaaatgcagatttgtggataccacagctgacctattaaactagcatttctggggctgggaccaggaatttcaattttattgtgtctctgccaggttttggtatcaggatgatgctggcctcataaaatgagttagggaggagtccctctttttctattgtttgtaatagtttcagaaggaatggtatcagcttctctttgcacctctggtagaatttggctgtgaatctgtctggtcctgggctttttttggttggtacgctattaattactgcctcaatttcaaaacgtgttattggtctattcagggatttgacttcttccttggaatttcaattttaaataggcaaccaaatgatctgtaggcgccagcctaagattttgtttggcaaggtctacacaaattactctgatttaaagattcaccagcctaatatatggactttaacagccataccaactttaaggaggactttcttccctgcattccagatgccattctcaaattgagactacttaaattccagcaggacttttcagtttcatctcagaaaatggacatctaaagtgtttataaagacctgcagagatggggttacactaatttatcaagtccattcttccagctttcactaaattcactgttggagttcaacggcctttacagtacaggaagtgtctcataggatctaataatactgtgctacaatttaacctacttcctcgtattctgacctcaggatcagtgcaaacagctttcacgcctttaacctgttttagtcttagaatcagagtaaaaaaaaattagcttcgtgcatcttacaagttctgagtaaacatttactcacagtgattatgccaaaataatcaggtgtttgaaagcaatgtgagttttctttcctccattttctttgctgaaagccagtaaaaatctattcaaatttatgtagaagataataaacaatttttccccacaaaatgttgctctgagcctaaatttttatgttgaggtcttaatcctattatcacagttgaatacaacacttaaacatctccttcatgccggttaaggcacagtagagtcaattcatgcccagggagctttaatcatggatcatcatcatgaacatcagtgaagagtctatgtgggctatcaggtccacagctaagcctactggggaagctgtgcatagcagcattgccagcatgcagttcataactattttcaagaagcacttctgatctaatggctaaatgaggatcattaaagtatctttacatgtagcatttcttgaaaattccacatttaaaagaggccagttattgcattcaatagatgcaactgagattgcttgagtgatggttttatagccatgtgctgcataatgacatttcagtccacaacaaaccacaaataagagactgatccataaaactataacagatctgaagaaattcccatcacctagggatgtggtagctgtcgtaacgtcctagcacagtgcattactcctgtggttgcagagatgttggtgtaattaaacttattctgctaccagtcacataaaagtcaggcacatacaattaggtacagtacataatatttaataagtgaatatgttactagtttatgtgtttactacagtatacattttattgttattttaaaatgcactccttttattaaaataaaaagaactttaaaacagccttaggtaggtccttcaagagttatccagaagaaggcattatcatcataggagatgacagctccaggctgtcaccctgaagacattccagtggacaaaacgtgaaggcagaagacagtgatattgatgattctgactctgtgtaggcctagattaatgcatgtctttgcaacttagtttttaatcaaaaattctaaaaagttaatataatttaaatagaaaaacgcttataaaataaggatataaagaaaaaatgtttttgtatagctgtacagtgtgcttgtgttttaagctaagtgatatcaaaagagagtcaaaaagtttaaaaattttataaagtagttacagtaagctaaggttaatctactattgaaataaacttttaaaataaatttggtatagcttaagtttatagtgtttataaagtctacagtagtatacagtaacgtcctaggcctccacattcactcactactctcactgacacccagagcaactaaaagtcttgcaagctccattcatgctaagtgtcctacataggggcaccatttgtttgtttgcttgtttgtttgtttgtttgtttcactcttgtcacccaggctggagtgcaatggtgcgacccttggctcactgcaacctctgcctcccaggttcaagcgattttcctgcctcagcctcccaagtggctgggattacaggcacacgccaccacgcctggctaattttgtatttttagtagagacggggtttcaccatgttgaccaggctgatcccgaactcctgaactcaggtgatccacctgctttggcctccaaaatgctgggattacacaagtgagccactgcgcccagcctaaaaatcttttttacagtattttttaccttaccttttctttgtttaaacacacaaatagttgggtatagtaacttgctgtaaaggattgtagcctagaagcaatgggctataccatatagcttaagtgtataatagactatactatctaggtttgctatactccacgatgtttacacagtgacaaaatcacccaagaacacatttctccaaaggtatccctgtcatcaagtggtgcatgactatattattgcccatggtttaaagttatattggtggagagtgaattaacggcttactaacaggtcgagctatcatatttccgtaatttgtaacccattacataacttataatcaaaaataaataattaaagcagggctatgaaaaaatatcacatggcaaaataataagaatcatataacaataaaaagtaggttggagtgatgaaagatttctggttcataaaaattgacataactaagagttttttatggtgccccaggtgctatttatgatttgccttattttctctaaactcactatggagccctaagccctaaattagaaactatagaaagtgttttaaaggatactgcataattttaaaggagctattctgatcaagaggaagagcaggaaagaaataagctgcgaccatttgagaaaagaagacaacgtgcaatccggtgtgaattttcctagcattgaaaatgttctcctgaatgcttggagcagaataaaggaagatataacttcaccaagaggcaaggaaacaaacaaaatctttgcatcctatcaaatatgtgacaaagatgctgcagtatgcaaactgaatgaaacgtggtctggctcttgagggtggaggtgaatgagactacagatatgttttggttttccagcacagtaacttaaaataatgaacatttgaatatttgaagattttgggaaggccatgccacaggcctcactgctctatgttctcttacatggagcttcttcttatttttgtgacccctctaagccacttgaggttgggggtcctcttagaggttactacagaatgtgacagggtagaatgttagcgctggtaggtccagtgcaactgccccaattaaggctgatacaacagataccaagaggtaacaggatgtgttaacgactcccagtaagtaaatcaatagaaaccccgatggtgaaatttgggctgcccaggtacccaataaccttttattatttggtatatctacaagattttagttgtacattttaatcttatgttaaaactggtctagaaaaaacaattatcgtccagttatcaacaatgcattaattggcttcattaagggtccttgttgctggagaataccagaaatacccagttttataactttttgattgatatataccacaatatccaaatacacacacacacacacacacacacacacacgcacgcacgtgcatacacacaggcttttaatttacctccatcaagaattcacaaagaatctttaaggattctggaattttaagatagcattcagcgcaccattccttcaaaaacaagcaactctctgaaaatacatttctatcttaatattagctctagcattaatttagattgaaggataagataatatacacatactcaataattacagagttttcatggcttataaaaccaagagtcttgagaaatgtacttaatcttcgtaatctttctttctagatgaggattcttatcacaaatcagtgtatttggcacctatttggtatgctggaaagcttatcaatttagtatattctaggaactgaaaaatcagaagacaaatactgcatgatctcatttatatgtgaaatccaaagaagtcaaactcatagcagtagataatagagtggtgattaccaatggagggctggcaaaaggggagatgttgatcagttttagctagatggcaggaataagctttagcgatctattgcacagaatggtgactataattaataataatgcataatatgtaaatatatacaattattgccaattaaaaataaaataaaaataaaaaacagaaaattcataatctcagcaagtaatattgaacaaacataaaattaactttttcaaactgtaattactatattgcttgtgcagacacttttaagttgacggttcattatacatttttatatcatatttgagtcatatttaaagggaaaagcactgatgaagttaattttcaagaatatggtcaaaaaaagagaagagtaactcttgaaattactgtaaagaataaacacagtgaattacctcatattcctgggaaaacttcaagttgtcatttgctttcaatctttcaatgtggtctgcaagttccaagatgggtattggaggatggctagccatacctattgaaaaaagcaaagaagaaacacatttgaaaacaaatgaaaatgatgctaactattccaaaatatagagaatactatagttagaaatggcctgaaaatatgtgagtagtaaagatgttttaggtgaggaagcaggcaaatagtttggttactcaaagcaggacatgctctgggaagatgaattttgtagccaaatgaaaagtcaccaagcataatctccaaactaacactcctagtgtaaaagaaagcgttattgtgctatgaatcaataaggttagctagtggaaaaaactgacagtcaggcttgatgtcaacttctgctttgagtaatgacttttatgccatttcaaactccttctcctgcactgtgtgaaatggaaattgtgtggaattaaatggtgtaaagtgaaataagaaaacagacactgagaaaggcctaaaagggaaagagtagtagcttgatagtaaacataaaatgacttatgcataatcaaggaaaactaacttgaagaatgaaggttaccagggtaaccggaatcatctgaacctgcaaaggaaatgatggtgtaaataaaataaaatagaacaaattcttcaaaaaaaaatgaaatggaaagcctgatatattttttaaaaggactaattaaaatgctgcaagtttttacagaattcactatacattgtggctagtacaatgtgactactacattaagatcgctaatatttcacaaacctgtaggtgactgacattcacatgcaaacacagacacaaagaatgacatgcaccacgactcactgacgataatcactgacggcacaatcagacaccaaactgagcttcaaaaatgtttccactagtagcagattgtagaggttggggttgcagccttctcctggacatttataaatggccacactaacaactctgtgatattttgccccaggtccccattattcaacccccagcaaacctacaatctacttcaggtgtaaacatctttgtccactaatgagaaatggattcagggaagtgagcaaatggtgaaaagacaggagggaaagagggtgaagaaagaaggaaagcagagatggggtgacacattctagttcattcagccagcggaagatatagtaatttcatagattccatgaaaaataatccactattaattttggtgactcctgtgtctttctgatgttttctcacttttcatatgatttgtcttttatttctttcctattaattttacagaagtatcatgaaagagcattgctgactcttatcttacagatataaattccagctggctacaaaaacctgaactagcatgtccccagggaagccactgaagcaggaaaagaatgagggaggagctcaaactggaagccatgtgttgacattctgctgtcactgtggctctttggaggaaggctacagaatgatggccattgagtcaacatgacatgtgactactttaagagcattttaggaattataccattgttaaaagtcacccagtaagttcctttatctcaaatgccaaattattaatggttctggtaagttaagtaaaaagctaccctgctttttgaagacaaccactttagcaagtgttgtgaattgtggtggtttagtttttatggctatgaaggtctgcttccagtcagctaaaattttagtggagagccaataaaactgaattgcttgcaagtagaaactctttgttggtgatataataatgcctttggaacaaaattttggaaccctttctgaaacttttctgtattaatgatagaactgaaataatttacattctatggaggaagtgtgagggtgacagtgatctgataattacgtgatcttatccagatgaggcacccccaacgaaaagaatggaaatgcaaaggcataggtgactttaggcttatctggaaatggaaatggactgatgtggacatcattacagtgctttcacagagaaaataatagagacaaagatgtttagaccttttcgagcggatcgtgggagagagttattatcatatatggactgagtggtggtttggctagagagggaggacacagagccaatcagggaggcgtaggggactgaattactgctcaaagctgcaaaaagtaaagccagttggagacgggaaaagtattagtataacagcagtagaagaccataataataaccaaagatgtgatcaacatatttacttgtggcatgcactggcacatggtctggaagtattatattggaagtttattaaagaaaaattcaagcagacctacattgagtcattatattccacatcagaatatatatacatatatgtatcacatgcaagatatcacagcattaaagaatcgctacataaaacttatcattggataccatattgcactccatttctaagacaagtaaaaatggcagatggatgtttcacagaaaagggaggagaatctgtgtgaatccaatggtacaggagaaagaaccctggcttagaatactggacatgggttctacttctggttttggcatctactaatagggacaaatcaccttttgtgaagcgccttgatttctttaactgttaaaataagagtatagaactagataaattcaagagccattctcttcttcataactttcattcttcccacatatagacagaacttctgaacagagaagggtctattggtgcatatgtaagggttctaaaagttatcgtaccttttctttgaagggagagagtacttactttttacaaaatggaaaactagtatgcagttgaattgtttattttttgaactatttaagtttgttgctattttctttcattagccaaaatgtatacacagtctattatgatgttatatcatatatcagaaaagaccgaatgtcggcataaaaataatcatcaagagtaaaactcctctaagttgaaactgtttagctcatatcagaaaacaatgaccaaggatctacttcaaaatattgttacacaattctgcagaaacatctccgctgcccaatattgaaaaaaaatgttatatgatataaacaaatatgttagattttgaatgaaaaggtagacactaagaaaactatgaatttgacctcactgtggtaccttttcaatgttttgtctggcaacctgaccactgctcagtctataaaccaaagtctttactacatcagattttacacatttaaattacttgatgtgctttaatttttttttttttttttttttttttttttttgcaggctgtacaccagaccaattaattcaggtctgtggatgtgggagctatatattgatatttttaaagttcctcagcactggctcttagtcctataggattcatgatggggggcctataactccatttattcctttttttcccatttagaaatcatatcaggatttatgagaatgagatgagctttctcttggtgatattcttgaatcctctctaacaccccattagcaagctttagtactcagctattattggcagcaaagaacttgaagcacagctaacaaacagggagggcttgccagtgtcatgacctcatcagttagaagctacaaatgtacaatagaaatgtattattttttttttttttgagatgtagtctcactctgttgcccaggctggagtgcagtggtgcaatctcggctcactgtaagctctacctcccgggttcaagtggttcccctgcctcagcctcctgagcagcgggattacagggacgcgccaccacacccggctaatttttatatttttagtagagatggggtttcaccatgttggtcaggctggtctcaaactcctgacctcatgatccgcctgcctcgggctcccaaagtgctgggattacaggcgtgggccgctgcgcccgacccataaatgcattttaaaggcacgcatcaaatctgttaagactttttattttgaagctatgatctccacaatatagagtcaacatgaaaaatgacagatgcggtcactgaaatctgccttaggttggaggaaaaaacaagatggctccctttaatagggtacatattggtgagactgatgtcacggtgacttccttataagaagtaaactttaaaatcatggcattttaacctgagaggcaccttagagatgacttagtccagcactttcactttatacaagaggactcaaatccagaaaagttagatgacttctctacataagcccagacagtaaataacaacatctcaacatgcagcttgggcatctttctactgtactattccgagaacggcatttgcgatcttctaaatgaagtggggggcaaagtctccacagatggaatgggctaggctggtaagataaatgactgaagagggctaagtatcatatagtcaacattttcacacacagaaaatacgctcattcccatttcctcacaatgagcaggtttccagggctggcttttgtgtctctactttgaacagagactccagaaagaacagtaattctttactatgtgaaaaacagccataagcgtgacataaatggcaactaacgctcagtctcaatgtcactcatctttagggctagtgtacacattggggggcttctgaaaagggtgaaattattcagctccaggacttgctctgccaagtgggaatgcaaggccaatcggttcagactgttcaggttttcaacagccactcaaaatccagagtatcgtgtggcatttcctcagttttcaatgttgactcaaaattttgttgaaactcagtccatgtcaaacgataagctcttttgcagaccacatacggctaactagattatggcctttgttttaaaagaacaaaaccttctttaatctgtgtgtatgtgaattagaatcaaggagtgttgggagtgacagactgcatgcttgtatccacaaggcaatggactagatactgctttgtgctggggatataaagaagtatgcttcttgcatggttcatcccctatgggttcatctacctccccttctctctaacctgatcccccattatctctaccaattagaaaaatgaagcccagaggagttaaagaactcgatcaaagtcatcattatcagcagaactgtagctacatgaggaatctgatcccataccccgtacactctcatttagcacatttcacatgacgccatgctgtctttccaaccatttaacacccctggacaagtggtgacatgtacataaagctgggtctttaagactgtttgggctctctatgcagcaagacagagatcataaaccatcctcagtttgtgaaaaagtgtcaatacagggccttaacctaggtcatctgtttcagtggtggggaagaggaaaaggggatgcaaaaacacgtctgtattttccagttatttcttgccaaaatatcctaagtttccaagaaaacatgaactaaaggtattaatttaaaatgttaaaaactggaatgctatttggcagaatatttcttagaagctaatttatggtatttttgcttttcaaaagtcctgctctgttttactaagtcagtaaggctactgaatgcttcaaatgattttattatccatagaaaaatatttatcaaacacttgctctattttcatatttttaaaccttgcattaaatgccaataggcactatataactattctgctaagtagagtttttgaagtcattaataacggtggtacatcttttacatgatttttttctgtcactatatacgtgtgtttgtaatgactcagtaacagtctcttcatgattttccttactgataaattgtgataaaggctggagaacagtttgtgcttatggaccaaagagaagctaattttttcatcaaatcaattaccacagtcttaacaaaagtagacttctatgagttaacagccagaaagagaaaattcattcattaaatatttgtcatatttttgacataatgtatgcactatttagaattccctgaatcaaatacaaatactctgctatatttgttatttgtatcacaaactaatgataaattaaagataaagagaatattgatttgtaagcttcctgatacaaccataatgacaattagatttaatttgtgactggggatcatcattaaatgaaagagtcaccaacagtgcttttctgggtaagcaatgaatggcataattaaaattcaaaatttttacttcattccaggagtttctgtccagcctgggcaacagaggaagaccccgtttctgcaacaaaaatttttttaaatgaaccgggcattgtggcacatgcctgtggtcccagctacttgggaggttgaggtgggtggattacttaagcgtggaatgttgaggctacagtaagctatgattgtgccactgcactcgagcctggacaacagagcaagatcctgcctcaaaacattttaaaaaatttttgtaaaattcaattctaatggagagtttctcaaaatacagaatttgaacaagctgtttctttatatcagaaatttcagaaaataaaacagaaaggacacatccggtattcttaacctaggtcatatgcctaaattccttactgtataaaataaaatatgaatgtatgaagaaagtatatataaaaatggatcttgttagcattgatccaattaatagtattaatagatcagaagagacagctcaagagctttttaaagcttattcagttgctgtgcagacatttctgctgctgataccactatttctgatccgttaactttttatgagtttgtttctgttttcacagcccatcaatcacctaccatccatgtatgctttagggcaaaacatattaaggtcatccactgaatgaaaatgaggtctttgtgttgtaacatctgatcatcgagttttaaatctcttttcctaaaaggtgcaagcataaacactatagttttggttttgtttgcaggtatttttgggccagggaggaggtatgaacagggacagcagacactttaatattgaatatgcaggcagaggggaaggtaatgattggtgcaccaccaatgctaccagtagcatcttctcttacaactttctttgtactgaaaagaaagtgaatttctctaagatcctcaacctctaaattttctttgctgggaaaaagaagaaaaatgaacacatattagtaatttgtttggttttcttatatatcaccatcttttaataatattatgtttattttcatcattttgcccaattctaaaggccatgggccagagggtgtcaaaccttcagtaaaggatttttacagtattttgaaaagtctgtaattgggtctctctatcaaaatggtaaatgtgcctaccctaggaccctgctatcatatttccaggtgtctgacatgcagaaatagcaatgatggtgtcaaaatatatgggctcagtaatgctcattacagtagtatctgtaatagcaaaacatgagtaataacctagcctccattaatagggaatgagttaatacattttgatatctatagaactgactaccatcattgtcattatctgttaaaaagaagacataatacactcacttgaaaaaagtccatttttatatagttaaatgtcacaacagcaaattgtgtgtgtatacatacatgacatacacacagacatccctacctactctatattatatcatttaaataactacatacacaaattaattctggaaaggtatatatgaaactctatatggcagatatttctggagacttaattggagtaatgacacaaaatattttaattttaattttaaatatgtcaaataaaaaagaaaaaaaagtggtggaatgaagagtaatttttcttctctaaaagtgcttttgttggaccgtttcccaccatataattataaaaattttcaaacgtacacaaaattaaagagtaacataatgaacacctaaatggtcacaatctatatgcaatgattgttaacaagcttattttctattttccaaaatttccccaataaacatgttgcttttgaaattaaaaagatgttctgggacggagagactaaagtaatttggaaattgtttataaaagaaagaaagagaaaactttccttgcaaatggggctaacacagttcatctttgtttaacaagcaacatatctattcacccatcctagtgcgcacccagttactgctgtctacagagatgtatggagcttaatggacatttcctttaaatgcatcttttataagtgaatattttcttcccttcttccatagatcttaaagacttgtaaaacttgatcagcagttaataattccagtaaactcctctactacgtcacctctctcttttacttattttgcccatcttattccactatctgttagaattaataagtcaaatcttagctaaatgataccttcctatatacttaagtccccattttaacttggtagttattggtgatacaactgatgttacttaaattgcctttttcacactaattctggctgaccttgtacactaataatgatttattgtttaaatcattattctcttaaatgattaggtagctcatgttgtctcaaatataacttggctatacactgccatctgaaccacaataagacagacacttacaatcaatcatgcaaaatacttacaagctgaggtgcctgctttcaattgtgaaagcatgggcttccccgacctgttcaggtgtttacatacagtgtttcacagactgacaggatattttttttcattttaaagtatactttaataatgaaagtgtacaagcacaaaaaatgataaatgttcccgtatatttgtccagacttaccatgtgaacacatcacttaagtaatagattggtcctaacactatgcagcatcctgggatcctatcagactgtttatcctgaatctagtcctattcctagaaaaactaccatttagggggagaaaaaaaatttattcaacaattccatattgtctctgatgcagcaatcggttaagtcacaattacattatgctcaataagagaaaaataaaatagtttttcagaaggggctgggttggtgattcttttttcactcatcttaatgctaaaaaagaccaagaactttgttgccactaacgaactagtgggcttcagccctgaagtacctctagctgccagcaccatcagtgacttcagaatgagaagatacagcaactccttaaggtgctctgtacagattcaagtccaagctacttctttggaaggctctcagcagtgtcagagagtgacttgattcttgtctaaaagtttgaaaatgtgctaaagcaatgttcctctccacactctccaacctcacaaggatggttatactgacaaaaaagcaggtttctctgtcttttctttgtgccttagctgagcaacggtggatggaaatctaactttttctgatccaactatgtttgtggtactgcatttaagggtacagttctttgacgtacttagattgttggaatgctatatttatatgaaatggggaatatcgggcagaattaaggaaaaaagatctgacttcttaaatctcgattctccaaaagaataaataacttagaatgtaaatcaatctttcattcacaagatgacttttttgagaaagtagaatttatagaatcactgaactaagcaatgtgctttctttaccttctgaaaggcctactgaatttcaaatcgtaatgtttgtttgctattttatcattcataacagacccatcagaagcagaaatcaatttgcctttgggaacaaattctgtactaggtactggttatataaatcacaggcatcttatttcattgaaagacattttttgaacagaaggtgtggattactaattctctacttatgtatattattaataaatattctcaagcgttataatgtttggggataagcaattatacattcatagtagatatattaaaaagccacatttcagagagtgaaatgtaaataatttaaaaacctaaaaattagcgtcatagcacctgtcatgcaacacctaatgaaggattattttatttcattatccaagaaaacccttgattcttcgtgaaaaagaggagaagaacaaccacaaaagggttactgggttaacaaccccacattctgctctcatcctattggcaagtaattatggtaattaacagccgctggctaaaatctatgcaggctgaagcaaatggtcacatctctatgaatttcatattaacagcggagtctatttcctttgtaaaatggtaaaaatgttccagacagcaggccacaacatagagcttggatggcaaataaacaatttcagcaaatcaagcttaagtgaattgcttacctgagctaaagggcataatgtactgcttcctgagtgaacagatgtgctaggaccttaggacaatttctccttttctagtctcctcctctactacagctcctctcttatctcattttgtctactacagctcctctcttatctcattttgtctactttattcccttattcatttgaggtgataagtctaactttagttaaatgacaccttcctttatactcaggtccccattttaattttgtaaagtcattggtgatacaagagatgttacaattgtaacattcattcttctttctggtatcttacctaaaatttaacagattctctctataaatggatataatattcccaaatacattgggaaaattaaattgctaatagaattcttgagtttggccatatttgcaaaattacatctgaaagtgagaagtacttgcagacagaagtctcctggttgaagacattcctattctcttacctgcagtcaccagcacctcttaatcattctctctacacagttcccattcttgctttgtgtttattcccggaaacattttctgttggtgcgagaggaggtgaggtgtagcagcactctcactggctcccttcttttgggggtacccttgcctttctgctcaaccttatactgtgtttctgcctccggtggaagaccaaggttggttccagcacaaatgacatttatgtgaaaaacagaggaaggaggggcagtggagagctagcagcaaggtactgagaaatctgatccgtttttctatttccacaacatgttgctcttttacagggtgatgaggtaagaaatgcaaggaatcatgtagcagatcatttcttcagcttttgggtcctctatacattgagtttgctaaattgaaaggaatataaattcctgggtccattattaagaagttgcctgtaggccaggagtggtggctaatgcctgtaatcccagccctttgggaggctgaggcaggtgagttgctggagcccaggagttggagcccagcttgtgcaacacggccaaactccacctccacaaaaataaaaaaaaaaattgtctggatgtggtggcgtgccccagtagtcccagctacttgggaagctgaggtagggggatcacctgatcccgggaggttgaggctgcagtgagccgtcattgtgctactgcactccagcctggacaatcgagtgagactctgtctcaaaaaacccatcaatcaaacaaacaaccaaaaacaaaaagaagttgcctataggctgaagtagttagtatccacctatttcaaaaagcgctgacccaatgaaatttactacagtaacttaattcatatcaagttgccttaataaagtactgagtaggtgactcaacaagatgcatccagagggctacgacctatcctggaagatgacacaagtttgttcaatcatcatgtacacgttcccggtgcatgatgaaataattttttttaaagtctaacctcatatgagttagaattttttttaaataccgacattatgatgcttgtatagccacactgaaaatgctaaacatttctttcaattgaagagttactagttactatgttacatctacatgtaaaagagaaaatatgctgaacataataaaccatgttcaaaataattcactgtaaaatgtgtactgtaatatatctgcagtgtatcatactgtgaatcagaacatccatatggcacaaagaaacttgtctacaatttgtgggacaacactgcaaccacattttaatcccaaagacttcttagattagcttttcactttgttcattatcataacatattaagatagggtcactcggttttatattttcagctccctctgccattcataatttgccattcatttggtataaacatgctttagttgaaaaagtcaaatagatctaggcatgaataaacaatattgtgcagaaggcccctcagtaggaatagtagtgttcctctgttgaagcacttaatgttctttattttaagaaacaagtatattttttgttatcctcagtcactttatgtttctctctagtaagaagcctgaagtgatcagtgaaatttagtataggtaatatttaaaaatatttacctcattttcctccctccctccctccctttcttccttcctctttcagagtaccataaacacaaacaaaaaggaaaatatagaacaaatctatgctttcccatgggatgaaagatgtgtacagtcatccatttactcattcattcacttgatgagaaactgaattctttccagagtggtgtcattggaaataataaaaacaataatcaaagcccataaaaatggtagatattattataaagactatagttcttccaaaatttgaaggatacccatatttctttttcttccctacccaatttccggtttgcagaaagaacttaatttcctttcagacttttgcttgggcaagtctccataatagtaaaataaaagagcaggatgaacaaaatggctcaaaataaagtgataccttcaactcttaatatcaattgagctgtacaacttctgggaaagactgtgtgtggattagatgtgtgatgcttcttacccggtgtttgaaagttaaggcgcctcagttctacagggtctgttgggtggtgtgaagggatctccttattgttcggtatgctgctttttctagagtcggactctgccctcttcctatagggggaaaatagaaatttaagaagaaaagaaaaatcaattgaaacagatagaaaagcagagaattgcacctgcactccccccacctcccaagttttcagttttacaacttttcaacccagctgacttgtgacccagttcgggttgcttttcccccctggcctaattgttctctcaggtctaaaatttttgtttaagtcaatgatctcgaagtcctcctccaactgcaggattaaataattcagcaactctgccttttggtttcaaagggatcttggtgagatacgcatggacccttattgagcaattctctcttatctactagttctatttgtgaggaacaggataggatacccctaagttgccaatactaagactgttgttaccatagagaaactacctgaccttaagctgaacagctaaatctgtcccccttagccctaagtatatataagtggtgactacagagagtagatgccgtagattttcccataaggcaggtaaacacaagtgcatttttaagatgccaagttatcctaatgcctaggataatcgggaccaggtaaaacagaactcccctttctctttcaaatgtgaaggaaaaaaaacagtgttagctcttaacagtgttaagctaactgtgattaatattttgttaatgaaaggttcacagaaagatcagagaaaaagtaatttcacctggtgggtagatcagcgctcctgataatcattcaaggtgccattgacagtgccttgttataaatgtgattcttcacacaatacattttaactttgttctaaaagctatctactagctttattagatatccccatttaagctctcattatgtaattttaacaaatttctaagcaagaaatgtcagatctgtatataagatttctttatccaataaaaaattaatcacagagtcctaactatcttcttccagtttgaattagattaaaaacccattgaatcaatagaagccattttcaaacagtgctttttttccaaatactaacgcctgcaatctctacaccacagtcacaatcctagtatctcacccctgctcaaagcaaaggcgtttttactgtgggggggaaaaggtgctgcacagtgtttaggaactttccttttctctgttcgatgtgactgtggtacagctcattagtgttgctgtggcaatggggtctcattcaatgccacccaggtcgttctatggttagccagagggctcctgttaaatagcctttcttcccatttctgctcatctgtataaaataaaactaaccagggggtgaagagaagattgatacaaaggggacgtgcacatgatttgctcaagtgcagtgcctttggcaaaacatccttaatggaatacattttcatggctaagtcctattagacatgttgctttctcggtaccttagattaacctgtctgaggatttcttctttctacctaaaggtgtcagatacagccttgggacaaaatgtgctgccaacccattccaccaatcagaggtgagcagtattctgcgacctgccaaggtactggcagctccagttctatggagtagaaaggaagaagaaaagaaaaagaaaagacaaagggctggtgaaaaagatatgaggacgaagaaaaagacaggctcataagaccatgcgaaaggaggacatgatggccagtttcagagtaggcaatgtcactgtgtctgtgctatgggtcttcgcctcaccacactaagagattccttttaccactgaagatgcaaaatcgaaatgggttaatgaaacgtcactgggtgcagccagccagtcaattccacgtgaaacatatggttggtcttctcacttcaaataataccaatggcccttctcatgttttgatcattttgcataagttggcaaggatgcatttctttactaatgtgtcaggcccaacgactaaaatttggatttttctcccttcccattgtggctctgccattcttgcaagattatggaaaccagaattagaaatatctatctgggcaagaaaactactttactcttacaggtattgtagggtaacctccttatcttctttttccctgtggctggggtgagtgacactgagctggagggtagaaaagaaaactctctaaagtaatttagcccatttctctggtgcaaggaaagttaggaattacatcttgttgcaaagatgtgagtctcagaaaactcaagacatgggactaaaattacaattcacaatttgaatgaacagggagggatgtagtgacatttaataactaacttctctttcactgtttattcaaatgaaattatttccaagacctcagactcctgaaatcctagtcaaatagaaaaccagctgcttaaatgtattttgcttagttttctttcgatgatcacaacatggataattctggctgtccacattcttatcacattatttttaaacacttattatgtgatgtgctagaatgattgttttctaacacagaaaccatttctaggaaagatgtggaagatgaagagtttggtcatcattggtaataatactaaagagttttaaaacgttgtcataaaatattaaaagacatataatggtctaaattaggcccaacatgaatgtaactagtaaccttttttcctgataaatttcagaggtctcatcattctcattttcgatttgaaaaatggaaagaataatgaatagaaacagattttaaattttgccttgctctattttttttctattaagattataaaatgttagtgcgagtttatttcttgcagtgagaactatctactatgtggaggagttatgtaggtgaaaaggaaatggaagatcacttgacattttggatctgtcagaaactgctaatactataaaagcatgtggttgtttgggatgtgggtaatacacaatacaaatgctactctggtctacggggtattttgctttcaccaggctctcatctggggggaagaaaaaaacaaagagaagttgagtgaaagatcaattcatggtcttgaaacaaagatatacagacatgtgagaagaggcttttgaaagaaacatatacttattagaaatatctaccatcaatattcaagtaaatcaatcaaaatatttgtttctgttaacattaagaatgtaatcccaactctgccactactggtatgtgtcaactacaaattttcttttcagtttatttgtgtataaaatagagggagattagaagaggatgtctaagttttggttcaactctctcattttaatagaaaaagaaagcattaagttgtaaaatatgaaaagtgttatgatgaaaggtacggagtcccactctgtcgcccaggctggagtgcagtggtgcgatctcggctcactgcaagctctgcctcccgggttcatgccattctcctgcctcagcctcccgagtagctgggattacaggcgcccgccaccatgcctggctaattttttgtattttttagtagagatgtggtttcgccgtgttagtcaggatggtctcgatctcctgaccttgtgatccacccgcctcagcctcccagagtgctgggattacaggcgtgagccaccatgcctggccgatgaaaggtagtattttaagtgagtttaaagtgttttgtcttttggctgaaaaaacaaaaacaaactattttgcacgtgtttttctgctggacaaatggatactagagatgtccacacaaagaagacaccctcatagaggtttaaagattcttatcattgaacatgaggcttgctgaccaacataaagtgattttagtgtaaataatgcagcaatagttctcaaactttagtatgcatcagcatcacctgggaaggcttgttaaaatacagcctggtgggccaatgcctagactttctgatttagtaggtctgaggcggggtccaagggtgtgtatttccgtcaagttccctggtggtgctgacgctatggctgctggtccagaggccactcaatggaaaccactggaatatggcattgggagaaaggtaggtgatcttcaagatgttttttgtagtttaattttaatcgggaatttatatatatgttacatgtgtatatttatacataagtgtatatgaatatatagatatgagttagaaagctagagggttagtttggattaatcattcaataatcacatagtgtattttagctattattattgctcttattattcaagactgggagacatggataataattttgaattggggaagagttctcactaaggcactgtcatcaatatttgcaggatgtgaaaatgctaatatcattaggtgatctgtactcaaacttgaaaactaatctttggtaaaaacaaacaaaacaaaacaaaacagtttatgagacacctcacatgtctgctctgtaaacacatcaacacacacaaatgcccattttaatcttgaccacaaacaaaactcagatattggtttgtgtactatcttttaaacttcgcctttaatctgtttttttctaatgtaaacaaaatatttattttccccagaatcatcttaatgaagttactgtgtatatgtaggctttgcccatcttccacgtgccaggtattatcttttgtgtgcagccccgccctcccctcttcaacaactctgaagtctaccagtttatttttttcttactgaacattaaaggggtttgttctctattcctcacctgtcgggtttactgctccattttaatgcagcaaaaaaaggaaaaagaaaggctaaatgttagttggccaatggtaacaaggataaccatgacaaccaagatttaagaaatagtgttcacaagcaaggacacataactgacatacattcagaagcgacagcgaatcaaaatatttatagacctctgattatgaactaaacagaggacatgaagttacatcactgaatacatagtgtgtgtgtgtgtgtgtgtgtgtgtgtgtgtgtgtgaatgccacgtgcacttttatccatcacctataaaatactgccacaattaattatatcccaggaagtgttcgacagtggagagataatttgatttttaaaaaacatgctatgagaaaactaatgtactcaatgggaatacagcatcattccataaaagaaattcgttcatttaaaataaaaagccttcaattaagaggtatgtcattcctttcatgatataaaatatctgcaaattgtattgaactatacagaaatttgcacaattgaataatacaccaaaaggtaataaggtggcagaaatgatttcttcaaacacctcttgccacatcttttttcccatgaaggattaagtgcatcttcagtttaggaaaatataatacccatcattataaatctacagagcatggcccatttatacagttgggctaatccagaaaaacattttattaccagccattgacagaacatgtattttcctagtctgtggtgctgtctgtgaacacaactagttcatgcttatagatcctttcacctgtgataatatgttgattgtgtaaataaccatattatttctgcagagtataaccttttcctgaaaacaattaatctaaaaatcttcactttgaggcaaattgcaaagttttcagtgagttcccagttgcaaaataaaggtactaagtttttcttaatgccaatgaaatatatacccaagtggctggaatatctggccctgtgagataattcaatccatctcttttcaaaaataaaaaaatccacatttaaatggtacaaacacacacatacaaagtaaatgatgaaaatgatatcaaacacattggttaattcttcttattcttaattttatagtgatttacgtagtgtgccaggttaaaaagaattctatataaatgtttccaatttgctcactttttaaaatcagtgactttatcagggaatcagttgtagaaaaatctatgcctcaggatggaaaaccatctagtgaattatcagttctatgtattaaaaggctgttttgagtattcatatgcacaaattcatagttccagataaaggtcagcctcaccatacacctgggtacatatgtggtacaaatatctaagtttgaaagctttcacaactggtaaatttaaattataggccgaggattttattgcaactcttgccagccaaaataaagttgatattgagtgatggagtcaacatgtagaaggaattgagtttgtttaatactgtttgacttgtatacatttaattattcaatatttttgtgtgccaggcactctactaggcagtagcaacacaataatgaataagacagagtccttgacctgcagtttagtggaggcaaagtgccaagaaaaggggcattgacagtaacgcagtaggttctacaacagacaagtagaaagtactttaagagctcaggaaaagtgatcctaaagcagcccgaactgctagagaggggaggagaagagaggacagaaaatgaggcaggcacccagaaaggcttgatttagtaggtagcatcctagcttacttccaaaggatgagttggagttatccaagccaaaaggagtggcaggggagtgacaggaaaggcattcctaacctagggagggcctactcagaagccagaaagcagagtcaaccagcagcttccagtatggttgggtgtggccacatatttcttcatagcatctcaaaatattctggactgcatttccttgatgagggcttggaactgtatggagggttgatacagaaagagaagactaaagacacaaagcttgcagagagccagtgttggagcaggaaaaggctggaaaaactgaagcctacatttcagtctcatctagctcatggtttccacatcctgggatggggatggaaaaatagtgtgcatgcaggctagattattaccattcaaggatgttaattttgcctgaagtgcatctcagacttctaggaccacctgatctacactttctttgattccatagtatgtaataaacactttttatccatcttgaaatgcttttccatagaggtaaggttaacagtttatttttaaatgtttattttttatataaataattcttggacagttctggaataaagtctgaaaagccttacatatgtaacagatatacagaataagaactttcaattgccttgtgaattttttgttggagtagatggacgtgcagtaccaatactattatctggtgtttaatgttttcagattatagcgcattatgattaaaaaggtctaattatctggtccacccactaactttgtaatgaagaaatgtaggctcagagtgttggcatgaatttctaccccatgcaaccagctagtcacagaactgggacttggattcgggtttcttggctcctcagtccagtacttggccgaacgttgctactatcttatctctggaatgtgtattttaagtcatgggccatataatattttttcaaaattatagtacaagaaaatttataacattaaagatataccaaatatattttaattttctgatgattcagagggtattttagggatcttaccaagccctggtgatttttttttgttactgattatcaatgtattataggtatacagattactagattaaaaacaaaagttaaatgaacagaatgccagatcaaagagtatgccatttccacatgaatagatctaataggaataagtctcaaagtctcctcagacagctgggtaaaatatacttctttatatgataaaactatctgtagctacagacctattgctaatgctagcatcttagaagcagagatatatgataaagtggattatcaatataatgtgagtcaacaacgttttattctcattctcttctcaaagcagtatttgcatatgggaagtaaaatattctgacaataataataataataatactttcaattctgagtcattaccaatgacctgtatataaactgaaaggcacctaaaaagagggaatggactatttattatgtaattaactttgctcagaatccaagctataaaagacactattcattgggtacagaagatttccttttgaactgcctcatgataatcaagaaggacattgttggttctacttgaatttcaagtcaggaatgttctttactgctgaagcaagcatttctatttcagaaatgcttcatgggccttcagatggttagctaaatatacttagcattcgaggatgtgtgcatttcccaacaattgcattagacgatgcttacataggcccacactaaaatgctactctattttaacagagtcataaaacctttaaatatgatacttctttttgtgggattaggaaaaattataagtgagttgattttttaagcacttgcagatgaaggaagaaaatagttatcttttaaaaattattagggctataatcatatttcttcaaatttacatgactgattcacaaataccatatacatctgttgcttggtatgatttaatgatagctatgtatatccaaataaaacataacttaaaaataaggcattaatttttcccatttcaaataatcacaaaatgtcatgtcatatggtctagaaatacacctgtcaacaatcccttgttttttgacctactcccatagtagtatgtgactacctaaatcaatatttcccagaaaacaattagaattataccactgctttttattattgaattctcttctggaaaaaagtgcagcgtacagacagcaaaggacaccagctcctgcttggactcaaacagggtctatgattactcacggggcaggtgtgtacctcatgcttcctgcccttatctcttacatggagagaggtaataaaatacaatgggttccttaagatacatgcttatagatacagattggaatggaagattcaaatcatcaaatgagaggagattttggctttccacacttactttttcagctattttacagcacggataattgaatgatggcagtgttcatgaaaaaaaataatgatggatatatctttcattctttataactctaaaataggataggcaatttaatgggttatggttatgaacttctttcatttgtcctttattttctcaaccctctcttaatgctggaataaaatgaaatggagccttttaaaaacaagtttttcaaaagagaagagttttgaaggagtttctttttttaagagtcaagataagaggttatgggggaaaaacgttattccagggacagaagagcaagggagtgagggtgaaaataattaatataaaccccccaaaagggagctagatgggtaggaaaaagagtgaatggaaatgagattattagattaagcatgtaagcaagaatcaaaatgaagatactctttttagattctgaaggccaaggttagggacagggagagaagctatcttgtagtagaaggatgagatcaacttcacagtagcatttcaaaatataacacaccacaaggaaaacgagaacatggattaaagttttgtgaaaatacaatttggattggaaaaaaataaaaatctatataaagggaagtaattttgaatttagtcattttaaatgtttaagaaagtatattatatgctactctttataagttcatatttatattataattatattcttaagacagaaagaatttataagaacaattactaatgtcctctatctaactgactggccagtgccctaggggaaaaaatcttattagagattagatgttagaggcagaaataaaattgaaaaagagtggcatatcagaaaaatgtgggtagacacagattatttgcatcctaactgtagtcaaagacactactcaaatcaacacatgggcataataagactgagattatattttttaaaaaaggaaaatagtaccttggcatccctttttggacacatacacgaattcaccagtgcagatgtggaataagagttagaagaaaattgggagacgattcattctccatccttctcttttttttccccttccttaatccttaatttttatctgcttttgctaaattttgagaaatagctacagggagctatctcaacacttgcgcaaattagaattatgatatgtatacaaattgcaaaatcgtgatagtgtttcaaaaaacacactgaaatcgagcaattaattatctaaaacaatcaaatgaaagcttgcatggaattatttgcttgtgaatgcactaatgcctcaattgttatgaaaagtgcttatctgcataaagcagctcagaagattggaggccagaatagatgcatgttggacaacagaagtctataccaaaactgaataagattccaaatagtacagtctttacattttgatcttactgtaatgtaaacacttttccaaaaataattgaaatggcactgaagtatttctactaaaatcaaccacctaaggacagcagaacaatgatcaagtcttcaaaaataaggcagcctccaaaattacaacagaaatattgggcaaacctaccttttataaagaagaatagcaatgacaatgcagatgataaagaccactgcaaggacaggacctacaacccagatcaagccttcttcttcatccgtgattggctgcggatccagatccattgacaccacggggtcggagtaagggctggttgcatacatcttctgaggaaaagcagagtctatttcagttataaaataatgactttctagataagtacctttaacattagaagaagcaaaaaatccaggaaatagtggatttaatgataagtgtgtgatgcaatattagcaaaacagaggggaggggagaggagaataaagaaaagaaaggatggaagatgttttgtaatacaaatttccttatagagtgaactattttataataaaatcattttgatagtacaaattacttcatagacactttttattgggctttctatatggtgtattaaatgatcctatgaagcgtaaagtaccagtaattaaccagttgcaaaatgtttaatgaacatttacattgtgccaaggcgttaggtgctgtgtgaaaatcaagagaaaaactagagttctagccctcaagccattatcatacagttaaggagaccaaagtacatatttacaatgcaaaataagtcagtatttaattaaatgtgaatatcggtagtcattagtactactgtgcttcttagtgcttggtactacttaatactactgcatattagttaggaaatggaggccaaagcatgaacaaataaagtctacaatttcaaaagagaattccacagttcaaattacagatgcgagatgtacagaattgatgatatggctttataaaatatagaatttttagaacttaaaagaattcagcagttctcacttagttttattacagttattgctcagagattggtatgtttgttctcaatagacaactgataatatactttttaagaatacagttacttggagaagaaatggactaaatatcgatgatttttatttctatgatatccgatcccatttagttctgtcctattttagcctatattaggaaaacatcttcttggctctacctgcccccttcaaggccctatcttccactttccaatccaacagaaactaatccatatccactaactgccctgcttctaccactcactcctcatctcttctcactccaaaccaccattggtcctatttttttttttttcatttgccaaatctaattgcctttatttactctttacctttctagacaatttttccagatttgccttctttaaaacttttatctctggctctctcaattttgaattaaaccagtcccatcctcatctttccaactgctcatgccctgctgagttaattatctctgactccatcctatagacaaacattctttttttaaaaaaattttttttatagagatggggtctcaccatgtttcccaggctggtctcgaactcctggtctcaaacaatcctccagccttggcctcccaaagttctgagattataggtatgagccactgtggctggccctgaacccgtattcttaagttctattctctactagcatctcttgtcctctcttatctggcaaggtcagcccaagctttaactatcaacctccatgcagaatctgtctcttcattaatgttcctaaactcagatactctatgaaatcccagatcttcatttccaatcatttctagagacccctacatatatgttcaaattagtatgagtttcttaatttttcccagatccttcttcccttcctcctcacttcccaaattctctcatcctctcagtatctaagaatggatactgattttaccttacagaaaaaaggaatagaatggaaacactgatattagctaatcagtgtcccccaggtccatctgctcttcttctagtctcatgagtgccacttttctttaggcccttacttatgtgctcctaactataccaagagcttcttccttcctctcatagtctccactgctgctagaggtatcatcctaaactgcaactataaagccttcaagaggctctctcttgattcccaaataaaacgtagataacttagcatggttctcaagggcatccacaattttactttaaacttgcttacgacacacaacacattccatcacagtgggcttcttgctactactccctaaaggctctattcttgttcctcaactccctcacaagttccacaacatttagctcctgaaattgaacaactctccaggcccccacttgaatactgcctccaatgaaaccacctctttttaattgactggcagtgatcggtcattcccctctactaaaaaaaccaaaaaagataaaaataacacagctaaatttttatttagtccttgtttttttaaatggtactcaccaaactgtattttggctttttatttgtatatatacttcattttctttggcgaaactacagactcctagaaggtagggatttatatattatttgtgtttatatgcttaaagcagctagcaatgaaccttgtacttagtgggttctcagcaaatcttggctgaataagacaaaaaatgttcatcttttcaaatggctgaaattgtcaagacatcagtatatatgctcacttttcatgattggtacatatatttaaatgttttaacctgcatctttaaaaaatttagtttatggcatctattctgaatttaagtacaatgagcttggccatcaagcaggagaacagatgttccactgaatgcttgtatactactcttctctctcattttcgtcattgtgcccaggaaagagactgactagatttgcagattttctaacgcattacaagaagataaaaactcagtatatatgtccaagcttctcagaggcagccaaaaaaaaaaaaaaaaaaaaaaaaaagatgtgtatggtatgaggattgacacaaaggacttggcaaagaactatatatctaagaaacatgattttttatataattgttttggtttatgctttacccactccattttgtaggtgatgttaaaacagtttcatagacagaactaggcaatactgtctcatttgaaattctttaccaagaacctttaagataataatcacggtccattgagatggaagtctaagcacaggttttcccaaagaacatagatttccaacccattcaagaaacagagacatatgaaaatgaaaagaaaacaaaatcataaaatgataccagcctaatgaaaaatataatttcttgtgcgtggcaataagagattaaattttggataattccaaaccagttatctgacattcttaatatgagacaaaggattaggggatagcttgtgtctttgagagggacggagaagtattttctctttgcaaattaccagtctacccttggaacattgttataaactgatatggaaatttgaggcttacacaaaggctttattactgcaaaatgactctagctggatacaagtctctcctaggcctgcaaatatttatgatatataaagaaaataaatatcatagatatttgaaagcaatgctgagaaagatgatagaataaaggggcaacttcattaacaaatttggaaaaaattcttgattctgtaattaataaacagatgacatactaaagaaaggggcagactctttatcagttgtgacacatttaaaacactagcggaagacatcagaaaccacagtgtgtagttcagtggttcagtctgcaggatcgaatgagatttctcttctttgctagattctctgatctacctcaatgctctaagtatgctttttgaaatgttcctagagctattaaaagaaatttcctctcaaatatttaaaagtcatttttgaataaaagaaaaagatgatttcttaacattccattcccttgatgttctgccttaaaaccttcaactagaaagagaaagcatatctgaacattaaaattccaggaaggccattactttgttttcaaatgacattctgagcacaaaggtaaaccaggcagagaggctgcctttgtgttttgattttccacgggggaattctttcagtcacttgaagagaggccccactgtacacactaacacctgatgtggagaaatctttgatacattgtgagctgcttctatatgggaaatgactggctcaactgggttgccacacctgtcatatttagacaccgattagaaaacgaagtttataatatgtatattaaatgttcatgtgtactgccacttcaaaattcaccccctgcctatctacaatatctctcccctttttttttttaaacattcaaagtaactgaagcataaaatgacatataagcaagatggattacataaaagaagaaaactcattatttagaataccttaggaattctctcttttattaaattattttctaactttcttggcttttcactgatacagtcactcataaatttctacaattaaagaggctgctgtatttgcctctttctagatagaccttcctcatgaatccgggtagaggcactgtggtctcacttggcagatataggagaataaatacaatcacccccaaagtcagtattttcagaaatatgccatgttgaatggccaagcttgtgagttcccattgcaatcacaggggctaatgtcaaccaggtattatgcaacagtctccttttttggacaacagtcattttgaaaggatgatggaaggagattgtaagcaatgatggttctaacaccatgatatttgtgttacatcagaaggtatcaagaaccatgtcctatcgatctggaacttcataaactagagggccacctaaatttccttcatcagagacatagtctcatttgtaatgcagtctcaaggagtatattgagcaatgttcaaagagtaggcagcctgttattacacttaataacagttcatgagaaataatgaggatggatatacccacaaatccccaaataaccacattccagtgaaaatgtataagcgtaccataggaaacagatgccatcataattaacttacagactctgcatgttccattactgctaacacaaagaagacatattcttgaccactttggagttgcttgtttgtaaatccaccataatgcttgtcatcccccagggtgaactcagtgggaaggacatcaaagtgagcggcaatatatggctttaattcaacttctctcccataacggatgcttctgcgcttcctagatatctccttaagcagcttaaggaaaaaagtgggaaacagaaaaagaactgtaaataataacccagcttattgataatttaatgagataaattaattcagaactgggaacaacccaaatgcaatttgttcacatttcatatagcacatcagcatcactaaatctcagttctctcaatatttcaaatgcttctcttcctgttaaggtagaggtaagatactggactgctctgacaaggtctaggctataaacacagggcaatgaggtcctttgctgtagctcatttcatttcctacactaatgaaattctctcaaagtgcatcataacttgtctaaggaaaaaagtcagcttgattcataaaagccttgccctgcaggagatttattaaataagtattaacctcagacaaagccatctaaatctttaaatatagccacattttagaagaggttagtgccactttagattgttttgagtaatgagataactcatatgatacaaattccctcaaatcagcagaagcagaatccaataaacaatttttaatatacacatattaaatagacattgttactcatttaccaatttctgacttgacttagctccctggttaggcaattagggtgcacttccttacactttatcatggagtcaactttttctagaattgacctctcttgggagtgtgtatatattgccagataatataggcaaggtagatgaaaattaattttagtactgccctgaagaaaacacacatgcacatgtatatacagatgcttcatgtatttctaaagaaaagagatagagtttatttctggataacctattatttttcattgactccttcattacgagaaaatcatactaacagtggttatgaacactgatttcaaagttacctttgacttctccaattaaaattggtatttcacagggtttaacaagggaaaggtctgtattagtctgggatgcctgttgatgtaagcagcagtcttttcgccattttcttgggaagaatttttattttatttattttaatatctatgtattaatagaaaagtctatgtatttgaggacaaactggaaaaaggaatgaaccttgtcttcaccttgataaacaaaattaagatacttatggaaacagtgcagcaaaactatttactagccctgtttttgtaaatagaaatgatctagtaagaaccaaagtgtgatctctacttagtagaatgagagcctggcatgatcaaggctaggcttctgtgataaaatggcttcagactgtatatatgataaacactgaattcttccattaggaatttgatcgtacgttacagtccctcctacactgggagtagtaaatgtgttcagctggttcaaaattgtatcctaaaaatgtaaaaaaccagtttttcagttacaggaaaattttggccgacattatttttcaataatatttaatttataacgtgctaaaattttctgtgaatttaagtttattgatgcaattaaaattacatgaaatgtaagctgttttaggaaaaccacggtagattgggcatcacttgtttagcaaaattggaccatcccataataaattcagttatgctgatcaattatgcaccaattggccagtaaaaacacaaggccagaaaggtagcactatcttttaatcttgttgtcaaatttagctttacttataatactgataattataacaataatagttttcatttattaagcaattactgagtgccagacactgttctagggatcctaaacatgcattagctccaatttactcctcgtaataaccctataaggatggctaatattatcctcattttataaatgaggaaactgaggcacaatagaagaaagtctcaatatataattagactcaattactgaaataaaatgaaattccatgttagagattttttcaactataatgtaatttacttaatgattacacaatatcataaggaaatataatgtttaagctctgatactctaaattgttctaactctgtgtatttatacatataatttttatgtatctgcttacatcaaggcagatgaatgtattatttcttttttcttgattcttttcatatgctaattaaaaaaaatccgataccaaatatttaatgaagtattataattgaagcatcattacacagcttattgttgatatgtagttaaggacagtagcctattacaccaagaaggaaaatgcactgcagaggtgctgaacagtttttgaagctgggtaatcaaaaacattcatcatgagttgtttatgtgactgtgtcccctcttctacttcactgatcaaaccctaccttggttttattcatactgcagatgtagttaatagtcgcaattcatccatatcattgtcattcccacaagcactttctgctagggtttctttagaagacttataggaagtaattcacaataaaatatttgagcttttgggtattcttagacccaatgcagtcattcattaaagtcaaacctggagcatcactctgcccctttaggttgctctaatctctgcaggatgcttcctgtgttacacgttaaatggttcaaatgggctcagatgacaccaaagtcagccagcatgttgcagttacaaccacaaatgaccacattattttacaacaagcctttgaagtacaatgcagtgaaaagctcatgatctattacatgacctgctctgaattaaatatcactaacattctgggagtcattctgccccaaattcattttgactatcaatgtctgctctacccagtttgaccttgacaataggagtttcagtttataaatgtatcatgtggagagcagcccggtaacaaaggataaatgaactcagaagataattttgagagtaatgctgtttggaaagcctctttcaatttcttatgggcctagatatgaggtatacgtgtggaaatccccttaggccaccattctattcaatgatatggttccaacaatttgaattataggcctttctgaaaaattacttgatcaaatacatttaagagaggaacactgctttgtcaaacctggcagtatcaagctatagataaaattactacagtgcttttattatccatggtagaaaaaaaaaaaaaaaaaaactctctgtagggatcaaaaactggatgagtaagcataaagtgaggccatagcctactttcatttgttcccctccacaatggttacaagatgtactggaggtaattccagaagatatatcaagggctttagttctttatcagaaataattttcattttccagtcaatgcatatcttatttcttccaccattaattctacaatgtggtctcaattatatcagtaagaaaagtgggaaacaacccatcccgacccaaaaattttgaattaataaaatgttctttatcaaaccattatacagattaatgcaccacaacttggatgattaaaatgaccctttgttatgggaatcagcagcggagacccacagaatttaattgcaagaaagttcaaagtcatatagccctatactttaatccattagtgttgctgtgcattttggaggttaaaacctggctacaaaagagaatcactttctattacttactaccaaacggctttacttctaaggaaagcttattagttaaaactatttgatgtcattctggcttggatctcagtgccttaaaaacttttttttaataggtagaacaattcatagattctacaagttgcctttgcattttaaattccatttcaacttaaacaggatgatgacacttctgtagttcagctgagaaccaattaaaatagtaaagaatatatcaagattaattgattagtcagttgcaagtaaaatcatgtttggcttcaaaatgcttagaaaagagcagctgatcattctgcattttcagttaaaggattactattttctgaatatcacagaataatgattttgttccttcaccatcaaaacaaaacaattaaattataacatatctaaattacttgatgacattattgaaataatgtctcattttacacagctccaatgatcatctaatcactagtgacacaaaagcataggcctaaccttgaactcatctcctcgtctgaacacgatcaaatttaattcagataaatgaagccagtgatcataaatcccgcttctagagatgacacacgtctgccaaagaaagctaacaacctttctggtcagatcacagtctcctttgtgcagacatagatatgaaataagcatcatctctctgtaatgtaggtagggaatttattcttttccttgctctgtttgtactaatttgaggtagaagaaatacctagaaataaaagattgtactacaagatgtggcctatgctataaataatcccaataaattaaaatctcatatttgccaaatgggggcgttacggttatttgccttatgaactgattgaaaacagcatcatgttaaaataacaaaggctcttctgtattttaaaatgtgaattctactcattaacttgctgtggtcctctggggatctagctcaacacttctggatcatattttcttgcctaaatagaagtatgtagtaattatgtcttgttcttcatgttatgcattacctttcaaaaatgtccttatacaagaagagtaccaattataatgcacctgctgttgcaagattttggaaatccacgttatatatttagtatttgttgtttcttattctatatattctgctttgctcacaattttgtcatttgttttctctatagttaaatgcatttttgactctgaaaacctacagaatatagaacaaggcaaacatctgataatcaacagaattctgtgagaaactggttaagaccatatcgtaggtcaaatgaactctgctgcaaattgcaacttggtgtttgtgacagcctcagcaactgttgcactaatgaaggggaccttgggatttataccaatggtgattaagtctttgctgacaattcacttcaccttccacacctctacatcatgttttacaaggagcaaggggcaaaatgttaaggccaacaaagattagacaggttgtaagctttattgcagcttaatgttttttaattaaagccaaaggatctttgttgggatccccaggggttagcatgcccatagcactgaaccatccaaccagctaggtatggagaagccagcacccagattagatcctgaaaggcctccaagggaggggggcggaaatgcagcagattaaataacgaataaaagacatggccaacaatgacacagttacctcatctaattccatttcatctggactctcccatggcttgataaatttcccgcgagatttcttcaaaggcacaattattatgtagtaacctctgcacaagaatgaatagataaaagttaggttagttgaaaggaggaaaacgtggatatacccttaaaccttccacagaccaatgaggttgaaggcaaattatggatatggggtgacttgtccatttcttacatcaatgacaaatatccacctgtttgttcaattttaaaaacaacacgggaagacatttatgtgtgattgcagtgatcttgtatggtaatatcatcatggtggactgctctttattaggtatcataaacagagcaggcatagtttgttagggccctggtgctggacacatacaaggctagaatactgcaatctaccaccacaagctgctgaaccaaatattttctatgacatgaatttataagaagatgtttttaaaaggaggatatagatgaaaaatttcactcttagcccacataaatacctagtagtgctgttgtttatacaaacctaaaatgctttttatttgaattaaaaatttttaagtaacaaaaattaggtataattgcacagagtaagatattaaaaattcccttctttttctacccatcaaattgcaaatctcgaggtaagtaccgcagaaaattggagaaaatcacgacttaagggccttcaaaacagctatcactataatgacatctatacgaaaagacaaaagtaactgaatacttacactgagaacagtcaactaaaatttaaggaatgtataaaggcacccatccacaaataggtatgggttatttgtaaagctgttttgtcacttcagtctagtatatactctgctttcatattcctgtttagggattctgctcatactgatctttagtagtaactatacaaggactttgaacatactgtttaataataacatattaatcacttcctacttctcaggtattatagtaaatgcataatctggttttgtcctcctacagagaaattctctgagcaaagcctaggtatagcctataaggctacaaggactggtcacaggcaaaaagacagatctgtagagattaaataattgccaaattaaaacagatagtaatgggacgcaaagctacatttatcttaatggtggcagtggtctgtctctttttcttatttactctatgtgtcataaagtattttctaaggactccatacacttcgtggagatttactgtgaaaatgaaaacacacacacacggacctaaacatacccccatacctttaaaagaggaggccaccacacaggacaaagaaacaagaggaaggacactcccaaccctgtgtcacactgaatcacagagaccaatcacagagaccacagaggccagcaaggcctctttctattcatctcaaagcaaaacctgtaataaactcagtaaactctctgtgattaagaactctgtttccattaagagtctagagcagagctgttcagcatggtatccactagcccctgggggccatcgggcactgccaatgtcactagcccaaactgggacgcactgtaaatgtaaaagacatattgcatttcaaagacttagcattaaaaagagtgtgaaatatctcagtaataatttttaaaataatgatacattataaaataatctggatgtattaggttaaataaaataaattattaaaattaatttcacctgctttttattttttcactgttgctactagaaaacttaaaatgtcacatgtgactttcattatatttgctggacggcactgctctagagcattctggtgaagaatatggcacttggagatatgtctggctgggagtttgggctgatctttggcttagaccccagaatctgttatatattctgaaatacgtgagtaaaaaataccaggctgtgatatggggggaaataaaccagaggtgctcagcacagtgtgtgtggcatgtagcagtaaacagataccagctgctactggctagtatgaacatcacaggccggagagacgcatctgaactatcttattcagtaagactgcatgaaattccgtgagctgcaggttaaagagcttgtcaaacttcttttcccctaatggagaattcaactcaaaccagacaactataccacaatgctttctccatggtgccctgagcaactaatcaacagatacacaggattacaccagctagccattcattttctttactacaaacaatcataatgatcaaggaggatgaggagaaggcagaggcttctctgcgtatgacagagaccaatatcttttatgttatgatccagagtaagcttccccctctcctgtcctcccaccatctgaaggatttaccgaacaagtccatcatgttaaatgagcatggaggagaatgacagaggctgcaactgagcgtacaaaatcacactgcagatgtgcttgataaacacacttgtcaaggaacctcttgcttttcactaccaacttctcaaagtcagaagagcgctacacataaagcaatgatactgcatattatcagagtgctaccattgtcctccttcagaatcttgtaaatcaaggttaagctgatgagtttcattaattttttcttctgctttcatactttgagttgccattcttgtacatgaaaaaaaaaatccattctttcttcggcagcactcccccactattcattttacttgtggctgggataagaattgaacagcctcccccacggcaattaattaacggtgcggcaagatatccacaaccttttttctccgctgatctctaaagcattcatctagggcagtcaaagtgaagcttgcttcaaagcagctcttgcacattgaaagaaatagggcagtggcaatttgaaattctgtatcatacaaagcctcacctcagtctaaatccacacatttcaactgtgctctctgcaactatagctttgtaaatatcaacttccttgccttacccgcaacctgtctctcccctgagggtactgcttcctttgcagccttctcatatggcagctgtggatctatccctcctcccctgcccatgaacctcagagtcagggtttggggtttctttcctggcttcccatcgcttcctgcaggtatttttcttccactctcttgcttttgtagtaacaaaccccttcttttttgaagttcatgcaatccagctacattatgatcttctctggctgatttttgccatctagtacctcccccagcatctcctttctctcagggaagattcttttgcggggttcatggccttcttttttctccaaactctgtcatcatcctgggtgatttcaaccttcataggtcgggcccacgtaccactgaagctctcagattcttcaattctccctttccaaagcccgtctcctccactctaccttagctgaaatctacgcttgccattctctgtgccagaatccagggagctgaacacagcttgagaaataaagcacagggcagaataatgccataaattcataatcagcaaccccagttaggccttcaacacggcctggcaatcttaccactatctagtttcctaataactgctccaattgcctagtccttccattttccacagtaacattttcactttctcctctagcctgaaaccctggacgttcaaaccaccccactagaagatggcctcatctcttatataaagagaaaatgcaaagattcagacaagaattccctcatcatctgtctaccaaagtacaagtctatctagatctgtaaacaaaccacacattttcttttggtaaagtagaagggctggccctacttttgaaggccattaactatttcttgaattgttttcaatcttctcactttcttaggaagtttaccatacattgtactccttctctctcatatatctcaacttctccttccccatttgatcccatcacttaggtttcaaccatgtacaaatatgtgtcatatagagaacaaaacaaaccacatcccactctagtcacctctctttctcccactcctgactgccaaaattctgcaaatagctgtgtgttcctgctgctcccactgcctccctttcccttcacttcccagctgactaggctttagcgcctgcctcctcactccacctcactgccattgccagggtgctcagtgatctccagggcattacatcaaaaggggagtttctggtactcttctgtccttcttgccctcttagcagaccttttaagatgttaacactctccatgaaacattctgagccctttctctgtgatattcttctgttatttctatgtatatctccttccacactaaccttatttccttagcagaatttatcatctgcggcccagctacaatggtgacactcctcaaggctctggccaagaacttctatccagaccctattttcatcctagatctcattccacctcagggcatcagttcttagctatatgcaaatgatttccagactcatatctttagccaagaatgttcttctgaattccactggtttatctgactttaagttacaaaagtacccccaatttactgtggttaaaataaaagaaataatatgcctttcaaaataaaccctccctaacattgcactacaatccatttcagtgcacaagccagaaacctaggtgttatcattgacaatctgcctttattctctccctctgtcatacttaatctattgctaagttctatcacttccaaaccctatctccagtgcacgtgcttttctccatctctactgccactcttctggcctcattccatgtcttatgcccagactgtgaccttactctctcaactctctctattgactttagccccgtctagtgcagtctctgaaattttcaattcacaatacaaaatttgttctgccatttccactttttaaaacatttcaatggatcctcatttctcttaggataaagactgaaaggtatcagaaggccagcaggatcttgcctgaatccctctgactgtgccctctcagctacagcttgataggctttcagtttcttgcatttaccctagtccagtggttccgagcctttttggcaccaaggactgattttatggaagaaaatttttccacggacagggtggggattggggggatggttttgagatgaaactgttccacctcagatcatcaggcattagattctcataaagagccggcaacctaaatccctcacatgtgcagttcacaatagggttcatgttcctgagagattctaatgccaccactgatctgacaggaggcggagctcgctccagtggtaatgctccctccccactgcttacctcctgctgtgtggtcgggttcctaacaaggttaggaattggcacccattcatggcccaggggttggagatctctgacagtccattctgtcattaaactatcgatcattctgttccacctgcctagaactttctgtcactcccacctagttaactattctctctccttaaatatctactaactgattattttctaagtgaaatcttctctgattttttttaaacctattacccccattatatggtctctatgaaccatttttaatctatacattttcttatacaacaaatttatatatttataaaaacattactaaagcagacatacatataatacccccaacatttgcttaactttgctattttatcatggaattattcttccactgtaaagaaagtgggtacaagaggtggctcttaggaattaatgcctctcctaagtcaggcagtcaaaaatatttggcggttcttctccatcagaattttcaactctcagtctcatcaagctttttctcctttcttcaaaccagcaatggcatgcccaaatagagtttctagaaaatataactccttattgcaaacgttcttttctttactggcctactcgtgacccttgttctaatctcacaggacattaagaaagataagatgattcatattggaggagtgaaatgggcagctaatatgtgccctacaaattcatatcaaccaaatcatatgagctgaaagaacttgcttgaaatgaaaaaaaaaaaaataaattgcttttggagctagctttatatatgggtaaaattaaactcaatattctgctttgcccgtctgcctcaagcctggagtttagactcaaaacagcttttcaacatagactttaactattaaagtaatagaaaaataaataacttcagaatcaatatatctggaaagcccttgactacttataaagtaagctgtgttttcccagtatattagatttaattagataagttaaatctaaccttcagagttttaattatattaagtaaagttttactgatttcatttaatatgttatcatcaaggggcccagttccccataattatatgagaaggcaagctctggtttttgtggcagtcccacttcaaattcagtcaggctttttgtgttagtgtgtattagcattctcaaacatgttatttaactgggaggtgaaaagtccgtctaggagtttaatgatgaatgtcattccttgcgtaagcctcctggctttaccgctccttaaattctcatggcaacccactgactttattgcttcatgacactaaacacacacttctgtgatctgtacccaagcacatatgcctggtcactcttagttctaaggtttgtctggggcagtcctgtttatgtctacttcttttggagttttaatcagttatcaattgacctaggaaaaaaaaaaattctattttgaccaataaacttatgggcacagaggcagggctgtggttcagaacataggctctggagccagactgcctggattcaagcctttcctctctggttttgtattgccagctggggcaagtcactgtatgttgtgtgttcctcagctataaaataaggagcaccattcctgtgaggattacatcagttaatgtgtgtaacatcctttgcaaagcacctagtatgccctctgttcgtattaaccattactagtattagctgtatgatcttggccaggacacttagtaccattggtcctcattttactcatatgtaaattagaggaagaatacctacctcacagggttattgtgagtcttaaatgaaacctaatatcctcagtaaattgcaaagtactatacaaatttaagcctttgtgagttaaagtaatttaactcacaaacacatgattaattactcttcattaggctgctaatagtggaacacaaatcttatgaagcaacactgtaagccatgcttccacaaaaatcttcttgtttaaaagaaaaagttgagaacaaattagtaagaccaaagaaattgaaaatttcatagaatacccttattctttatttcaattttttataaacataaaacggttgttataaaattaatttacattgagtaccttctggtagttttttctcctagtataatctgtgttgtgcattttttaaatacccagagtaaaattctgctctataaagtcacagaagttccctatgtcattacaacttgcttctgaacaacagtagcactgctagatctgactggcattctgctccccaaatctacttaaatagtaggtttaagcaccacagaattcctgataccagaacttgcagtatccttaaggctgttacaaaagaaatttagcctttctgtgagggaactctcctgatgtggcacacaaaaaatacaacaaccaagtatgaaagtaaagagatattaaattaattagaaatcattagacactttttcggtgttgaggagttaaggagtaggggccaagacctcctcattaacttggccagaaatgacagcatggtttctgttggtcaagaaaacaggtgtcaatcaccaaaactgcattttgcttgaaaacaaataggaagcatttttctggatagctttcatctaaataaaagttagcaacctgcccaccgttctggaatgagttctgtttcttcctcacattttttctaatagaatactgaataaaaagctacaacctttcctaatttctaaacttgccaaccacggcaagtgacacagcatggcacggagcttcttgtaatacctgaccgtgttacattaaccagtctagaaaacaggagtagtaaccttacactattatccctttaagaattccaataaatagaaatcatctaaggcttttcactacaagatttgcttttcattttccatttctttgatacttttctcactcaagtactttcctgatttagtctttcactcatttcttccccaaagtggctgtaatatatttctgagaatcttttattcattcctagaaaacaaaaaatgtccaaaatagtttgctttctttttctgctttgtaatggtctcatttctgtgatgtcaaagttttataccttttccctgactcccttttcaaatatagaagcggaaagtgcataaataaaacaaaaaaaattgaacaagctaaaaataaaaactgacaaaggtagaaaacattctgcaatattctcaactccttcagaaattggaaaatgaaactaaagtttaccaccaatggactaaaagtgccaatttccaataatagctaacacattctagcaacacaatttggtgaacagcctctaaaaggtcatttttatataaataaaagaaagtattgaaaactaaattaatagtaaatgctgaagaatatactatactattttcctctttcaactgctcttttcctgaagagacatgcatgtttttttaatggaatgaatttatagtctatcatttccctgttccttcattatttgtaactttttcacctttcttaaatctttctcacactatcagactcagattagatatgatctccttcaggaggcctcccctgacacccaaattgggctaaaacttgatatttatgttttcacaatacctggcagtactcaccccattatattcacattatctattttctgaatctattctcttactataaggtaggacttaatctcagtcatctttctattcccagaaatagtcctgacaaaacagtgtgtatagaatatatatttgttggatgccagcaggaaagtcttaagaggtagacaagtacaacgtggccaaacaacaattgctagtctttctcttgcctctacaccatcagagacgctctatcctctgagtgaacggctgtctctccactcccactcccatggcccagctaacttcctgtcactttttaagcctcagcttaaaaagcctcatttgtcactttctctaggactgctgaactaataagccggagttaggagcctcgtctacagcctcccttatctatctaattttctctactataggactctgcttcagtgaactctttgcttgtccaaattgcccaattaactatgctgtatgagaacaatgagaaaggacacactgtcgctactgaatccctgaaacattaacgttgactattagggtatgtgatcaagaaataactgatatgtctatggccttgatggttttataggtaaatacgtatccccaaactcattgagttgtatacattaaatctgcacagtttcttacatatcaattatatttcaataaagtggttttaaaaattcataaatatcctttatctgtcaagatcaattaataaacattcagaatgaatacacaaatcaaggaatataatcccgctgtcatactgaaattgcttgggataaaaattacacaaatactccattctcattttcagatttctagataatagaagaagggccgggcgccgtggctcacgcctgtaaccccagcactttgggaggctgaggggttggatcacgaggtcaggagatcgagaccaacctggctaacatggtgaaatcccatttctactaaaaatacaaaaagattagccaggcgtggtggtgggctcctgtagtcacagccgctcgagaggctgaggcaggagaatgacctgaacccagaaggcggagcttgcagtgagcagagatggcgccactgcacgccggcctgggcaacagagttagactccgtctcaaaaaaaaaaaaaaaaaaaaaaaaaaataagagtagacaaatgtgaagactttattttacactgaatttattttgggaataatgttttagaaattcttttcactgaatttattttagtaataatctttcagaaattcttttcactgattttagtaataatctttttgaaattctgtcacctagttgaaattcatcaattattttatcaaataaacaataattgaaagtgtacccaggaaaggttgttttaggatgtgtatcaggtctgaatttattaattatacctaaattacacaaattatactattttaaaacttcttatttctgattttgttttttaatacctgattttctcagccatctgctttaagttttctggagtttggggagtttttgaccactttttgaatttttctccttctagaaaatccctttgccatgctgctctggctcagttctcctgttagatttctaataatccctctctgtgtcctctactggctctcttcttcctattaacggagacctttattttagtcttttgcttcacattttcccctcattgcttcaatgattctgtcttcttccacgaaaccattgctattttgttaacaactcctaaatgcatatctataatctgttttgttttgttttgttttttgagacggagtatacctctgttgctcaggctgaagtgcagtggcacaatcttgactcactgtaatctccacctcccaggttcaagcgattctcccgcctcagtctcctgagtagctgggattacaggcatgcgccaccatgcccggctaattgttgtattttcagtagagacggggttttgccattttggtcagtctggtctcgaactcctgaccttgtgatctgcccgcctcggcctcccaaagtgctgggattacaggcatgagccaccatgcctggccatctttaatcttaataacttctctaagcccacacttctaactaggtatttcactgatatttcatattaatacacacaacgttaaactcatttacttctgaatttttttatcctttaggatgacaccatcattcattgtcatccaagctcagaactcagagccatattttactctcttgatctcatcattaaagcagctaccaataatgtatgctgtactactactctagtgtaactcatgtctacctctgcatcctacttccatcatcatcatcttcctttagaatcttgttatttgcctagagtcaactatgtgaccacctcccaataattttctctaccactatctctatggcgctcccatctatccaaattccaacaatgcatgaactatgaataaatgcctctctgcttgaccttcaaacctggcatagcaagtttcacctaaacttgagggtgtgagatagaagaaatgagaaaggatttattcttattccaaacaggtagcacaatagatgctcaacaaatatttcctaaaatggaattttattatgtattattgaaatgttatcatgccactctcctgtgtaaagagctgtaatgggttgccattgtctagaggatatagttttcacttctgggtatacccttggctcttgtatgcctccttcttccttctcttgccacttgtggccaggcgctctgggatccagccgtatggcaccactgggtgcctttagtaatgggcctatgcacttaccactccctttgcatatagtctctcttttattatttgtatgcctcctatttatcccttaagatttaagttcagaaactttattgacccattctgaattagctgctcttaagataaagcataattctatcattaacgcttactacatctgtctgtttctctgtatctctctcactctatggtaaggtctttgaagtcaggaatccatctttttttattccccggagtctaccacagtacttgtagttcatatattttggtgaaaatacttttttcttctattagttattcaaccaactagctatatgtccttggacaaacttatttaattgactggatttaattttccacttcaggcctgttggcctctatgctgtgctacattcaaaccagaaaacttgaattttctaatgtttatattttttccaatgtcatttttaactttaactttttggaatttttcctacttttaatacatcagtgtcatataccattatctaatttccccccctttttttcaaccttttagtactttgtaagacttcttcataattacaaaaatattttgccaaatattagagttaatcacctattcaccttattccataaactatgacataaaatgctttgtagtagccgggcgcggtggctcatgcctataatcctagcactttgggaggctgaggtaggtggatcacaaggtcaggagattgagaccatccaggctaacacggtgaaacccggtctctactaaaaatacaaaaaattagccagacatggcgacaggtgcctgtaatcccagctactcaggaggctgaggcaatcccagctacttgtgacgctgaggcaagggaatctcttgaacccgggaggtggaggttgcagtgagccgagatcgcgccactgcactccagcctgggtgacagggcgagactccgtctcaaaacaaaaacaaaaacaaaaacaaaaacaaacaaacaaacaaacaaacaaaaagctttgtagtaagaaccatgttctatatgtttttctgtttctcctaaataacactgtccctgcaatacagattaaaaactcactgttaaattaatgaaaatctgtgttacaatgaatactaggacacgttgtaaaagaactcggatagcaaaactgggagtctgagcagaagaatctttcactacattaagcagtatcttcttttacgacctctataattttgagatataatgttcctatttacctataattctttccttcagccctaagccttcaatcaacttactttatattctcatttgcaggtacttcaggcagttgcacagtaatcatgccatccaagttggtcttcccaatgaaggcaggcttggtacgtaatacatctggtgcagtctttgccgtgaccctgtgctgcagcccaccagcactgtttccacgatttgtcagcacaaatgaatatgatttctcaggcttcaggttgacaattaacttctgtgtggctcggccatccacttcttctaccattttcccatcatcataaagaatctaaagagataaaaccaataaaaaaaaaatctggttatcagagaggcaaaatatattttctaaaccaatgtgcactagcttttggaaaatgtatatatagtcaattctaattttaggtgatttctaagtccatgagtagtcataattctggagatcacatcaattttcctgtcatttcctactgtgtaatgataaaatgtttccaagtctatcaaaaatacacaaagatagatatatacatatatatatatagaaaataacttatcaatattagacctgtcagttgtatgtgatcttaatggaatatgtgcagaaaagctctacgtttcaacgtattatgaatattgcctattttctaaaggttttggttcctctttctaaatatacttttactttcaaaaatgtttctctatttcttatttcataaatatgtacttgctaacatctcttaatggcaagccagagtttaaaatgtgccaagaatacaggccaacaaacaaattcagaaactcccagggtattataatataaataggtagaaaccatgtaaatttcattctctggctgaaaaacaaaagcactagcttagatgtaaaaagttcaagttcaaagtagtaggtaacctacaagtgatgccagccctggatttaagctcctgctccttcttcagagtgtaaaggacacacttacaaagcaccaaactgtctcccatgtgaaagtcacaaatgaaaatagcaaggacacgtggccaaaacaaagtggtctgcttgctgtgcaaataacttacccagataaactgtcccctctacttttatctgtgatttcttacaaattagaaaacaacttactttgaaaggcatggcggagttataattctctggaatctcccaagacagcaacacggaagtcttcattactgctttgacatgaaaattttttgcaaacactgctggaaaaggaaaaacagtgtatttaaactattcttaaaacagatgacctgtcctttccaccatggaccataggggcttatgctagatgctgtctactttgatcagagagagaagtatgattttcctacctgtttagagcattcattttaataccccattctcacagagatctttcctttctctccaattcagccaactctattgtgttttccttacctgaggacattggggtgctgtcagccagacttgcttgacattctataactgaaatctaaggcatccaagacgtagtaagttttacatactttacctttttgtttttgctgaacctattaatatgaatgggctgatcagttattatagcttcaaaatactgatttccaaagactgacaatcctttaaaggaggaaggccgtaagcagacaaatcctaccttgatccacaggcagtgtcctgaactggacactgggactatatggcccgggccctttgctcgtatgagcacgtacttttacatcgtatgtggtatctggttttaagccagtgagtgtcatagtggtgtcagctggaacaataagctgctccatcgggagaagggggatgttgatatccctataaagaagggtatacttggtgataatgccatttctctctgccaggacaggtggttgccaagataactggacggaggttgaagtggtgccttctgagtgaaggttttgagggaatccagttggtacttcttctggaatggaaatctccttcaccatctcctccccaaagcccactttgtttctggctgagagcctgaagacgtatgatgctcccttgtggatgtctgtagctgtaaagtgatcttctttttcagagaactcaagagtagtaagtggctccatatccttgcggccaaattttagacggtagccctgaagaggtccaaatgtgtccaccggagggtgccactgaataagagcagtattcatctgagtgtggttaatcacaagccgaggtttccctggaactggagcacatgggatggagtggtaagaccaaccaatctgaacgttcacatttcagtcattgccaaatgagggagttccactctactggtattcccattttcttacttaccaaaacaaaacaaaacaggcaatgtttgacctacatacctttgtggaaatatgctccttgtcttactttattaaagtaggctgagatactagaatttgataatggacacaaaacagaaattatcattgaaacaacagcttaaggggatttttttgacacctgcacgttttaaaccttcacacataaaggttcatatcaaagataaattaatttgagcaaagatcagccaattagatatggctaataagaataactataatgattatttattcgttgaatatgtgcaatgtaccggcgtcacgctaagtgcattgcatatagtattcacaattggtttacattcctgactcctcactacattctcggattagttattattatctctatcttctataatgagaaaatgaggcccagagaggtagaaaactttccaaggctagcatgtaacaagtgagaaatctataaggcaaacccacctctgtctggagtcgactgcttaaatgcttaattgtgctgctatgttgcttaaaagtttaaaaaaaaaccaaactacaaaataatatcgtattgacttactatgaatttaatttgcactttctaactttactatccacatcattcatcaagttcttcatctgtaaaatgggaattatattaagagctattttatattgttcttatgaataataaatgaggaaattcatgtaaaagtcttagcatgaggttctgcattctatcaatattaaccataattattaataatctgaatattaaacttcttatggtgaaaggctagcttccaatgaatacataatttatttacctttaagttagatatgtgaaaaggtctaatctactcattcaatgtattattatgtctgtatttatttttaatggagagcaattattattggaatccacagtgaaagacattgagggatgatcatcagaataaaaactaaaccaagttaacagaaagaagaagaaaggccaagtatggtggctcatgtctataatcccagcactttgggagctgaggtgggaggactgcttgagcccaagagttcaaaaccagcggctgggtgtggtggctcacaccagtaatcccagcactttgggaagcagtggatcacctgaggttgggagtttgagaccagcctgaccaacatggagaaaccctgtctctacaaaaaacacaaaaatagccaggtgtggtggtgcatgcctgtaatcccagctactcgggaggctgaggcaggagcatcacttgaacccgggaggcagaggttgcagtgagccgagatcatgccactgcactccagcctgggcaacaagagcaaattccgtctcaaaaacaaacaaacaaacaaacaaacaaacagcttggcaacatagcaagaccttatctctacggggggaggggggaaggcatggtgtcacatgtctgtagtcttagccactcagggggctgaggtgggagaattgcttgagccaaagagtttgaggctgcagtgagctatgatcacaccattgctgtccagcctgagtgacagtgaaactgtgcctcaaaattatgaatgtgaagaaaaagaaagatggtaggaaaggaggaaagcttacagtaatgggaaacaggtgataaaaaatcataccatggggatatagatgaaggtaaaaaaatcactaaaaagattatgagacaatacatagaatattaacctcagagatggactgattagcctcttcattttgtatttcagaaagtgaaacccaagtggagatgtgctctgctctaagaaatatcattaagatatttatttccttaaccaatggagcaacagttttgtttcacatgctgggaagattcatcacatgctgatataactcagctaatctacaatgtatgaaaacaatagtttctaaagtttttagataaataattattcaacaacatgtgtgctgtgttatacatataaaacatgtgtgttgtgttgtatatataaaacatgtgtgttgtgttgtatatataaaacatgtgtgttgaaggtaggcccaggaaccacatcattgtgtactcattgtgttcctcaggaaaaatgcatccagagatcttaacgaccaacacacactctcagaacaccacccatccataagttggaaactgtgtgaactattccacttgcttttaatatatttacaattatcttaattttaaaatagtactttaatgtagggacattggcagacatctttaattcccctttatgtgtatagagcatttacatgatttgtccaaatgtcagtgatggtgtcaaggattaaacacctgagtctctgctgagaaaaatccatggtgaaatagagctttcaacagagaatacagccttcaatatatgaaactccgttgaaacgagtgggtggaaacacaactattaattctcaatattctccagaggcaacagattaaacatatttattaaaattttttgaaattctagttccaacgaactgcataataatatatacaccgtgtatcctgtttccgtgagatgcacgtaaagctaggataaataaaaataattttttgatctaaaccacaaatagagactgcattctaatatttgtcatttatgagcatgttcttagtaactgatgtttcactttataatattgctatggtacacatttggataaatctaatgggctggcaaagtctaggaaaaaacccactgactttgtagatgtatacatttactcttctgtgggagttaaagcttaggatggagtaatctcttttgtttttgatgttggcatgacctttcttatcctgggacagaaaggcttgttggctaggaatcacgagatcaaagtaatgatatagaaataagagcattagctctgacctactggcttcccctgctgtacaggaggatctcagtctgctctctattgccaaacccacaacagtcattccttccctgggcagaagttttactaagcctgaaaactatgagacaaccagcctggaagtgccacaaagcataaaggaaggactcagtaaagaaatgaatgcttatgcagcttggggaagaacacccaatatcacctcaggagaggctggccacatgaagggtcacacgaagcgatgcctaaaatttccataagcatgtgaataatagaaacagtaaatgcagtttaaacaggctggagtaagggtttgggacagttgtggtattttatccagggaatcaggataggataaaaaagggaaaaggaatgaggagagttctacatcattgaatacatagttaaaaagaattctcccaaactccacagattggcaatggaactcactgcattcctggcttccagaaacactataggtatcaaacatttaccaacaattcactttgtgcaaatacttgtacactggcacacaggtagttgagtgaggaaataaagacggatgcagcagggtccatgttctctaatacaggcatattctagttgggaaaataatcaggtggaatagattgtgcaatctgtggagtcaggtttctaatgccttagggttattctgtagactacttttataagtcatgccagctgttggttcaatggttctgctcactccagcactggagcttgagggttggtaagatgaaagggtcttaaataattactcaggggagttggaaggtcatttttcagcagggtcttaatgaacacattggaagaagcagagaaggtccagttacaaagtaaataactctaaaacttacgtcatgacatataaactcttctcccttttacattttcttattctcttacattcttttaaaaatttcctaggacttcagaattggtacgtatgtgtggttgccctttactttttagcaattggaatcattggagatcaaccgaggtactcagtcccagtggctctaaatttagccccaatttaaactagtaccaacgcaacaacaatcacaattgactagacttgggctaatatttccaaattctccctgtcacagtcatcttttgattatccttaaacatagctgttcaatatagtactgaaattcatgtaaaaatatacagaaaatgtcaaaccaatgaattttctgtttgcctttaacctcaagaactcagacagtaaactaattattacaatacagaataatgggaggattaacaaagaaaatacaaatatttcataagcattgaaacataagagccaacattttcttcagaagcatccttgaggttatatgaatcttacgtagattacttaaattatgatcagtactcgtttccaagatatgattctttacaggttgtagaaacaaggtataataaacaaatatcccacaatcaggaagtttactattaaaataaaatttcacaagaattcctgaattctttgtgggagctgtaactaaatacctttacaattatggttattaggagctcacatctgtgagataaactcagtaattcttcacagtcacataaatatacgaggatttttaatacagtagacaaaacaaattgatatattcactaattgcctagggataaaccatgagtagcggctgcttatgcaaaggaaaactagagcttcgctcttaaaggaattaaatttggattcttctgccttcttcccagatgcagtggggaggtcttacaaaagtaaacgtgtaggcatctaaattacaagcattttctatctcaataccgaagcctctattgattaagaaggatctaaaattgtgaatgaaaattccaaaggaattctatatgtgaataagttccaaaattctaaaatgtctactgcatggtaaataaaaagggatgagctagccttagtgacgttaaaatagacaaaatcattcctttctctaaaattcatattcctcggctataaatccactactttcttgtcatcataacatgaccccatttaatgggcaacaggggagtggtgcttcatataaaacatttcagagttattatgacatatttataagtgtaggtaaataaaatgtattttcttccatttgagattcaattctttgttgttgacgttctaacagagactggatccacagccagatagtcatcatgccatcatgcccctcactgaatacatgcctgctcttcagggcattaaattagcttgatacaatggtatttaaaaaaaaaaaaaaaaaaaagcccagaagactcagccttgaaggagttttgccatctgtaatcctgctgtttgaggcaattccaggtggcaggatgcgagcgaggcaaatcttatgacatttagacaaagctggcagtgagcatggcacgcaggagggcactcaacatcacagctgttctttactttatgcctttacatagaggtatgttcctaaaaagatatttgagaagtgattcgggcagagtaaatcaaatcatggtttacatgttcacgggagattgccatatatgaggattgaggagaatccttctgcaattatctcttaatttactcattctacaatgccagattttccttcatgctggcttttcctactgtggctgaccaaagtcatcctaaaaagcattgaagaaaccttattctttagaggggagtaattttatactatttagccttcttgcttttcttctttttcttttttgttttctatcttttgttcagtttggcttctttagaatccccacagcagggggtggggaagacaaaatgacaaaaggtagaactgtaagtcatgaacccagttcaagatggcagctcttctaaggggatttgttttccagggaagttgacattgttgcttgacttccctgcccagatcccttccctccagatcttcatgggacttgatccttcacgtcatttgagtctcgacttaaataatccttcctctaccagaacttctcagcccctagaggctgcctgatccttaattgcctatacgcttttacttttcaccttaccactttctgacattttattatatactcgttttgtcacttgttaattatctagtcctattcagaaagtgaatttcatgagtgtagattcttgttctgttttgttgattgcttcatccccagtgctggtaacagtgcctgacacacagaaggtgctcaaaaaaaaaaaaaaaaaaaatacttattgaatgactgattgaatagtttggacaaattatgcacttggactatttttttccctgatctatttttttttttttacccctgaactaaaaacacaaaagttgaccatagtccatttatttcctctgattttactataataaaagcctgctagaagctacctataccatttaaaaagttagtattactgttcaaggcacatacatgcacagacatgattacctgccccagtggtggacaccagtttgggcttgctgcgagcaccatctcctttggttgtgtaggctgtgacggtgagggagtaggaagtttcaggctggagcccagaaatgatcatgtcctgaaatgacaaaatagaatgtcactgattcaaaacatgctactaatgctctgggggaaaaacaaggccgtctgccttcattctgcaaatgctcgcacatcccttgcagccatgctaagccctggaaatttcatgcctgagctcatgctatggagatctgttttcatgctgatatcgaaggggcatcttcaggcatcttgggaggtagatcttagggtattagtcaaagacatgaaatctggagccagacttcctgaattcttaaacttaaacttgcatgtccttactagcttggacagaccaagtatgtttacctatctgtgcctccatttcccatctgaatgttggaattataataggaccccataggattatatgagttatatcaggtaaactcacagaactatgcctggcttataggaagcattccattaaagagtgattattttatgccaacagctctccacacatatccactgtaacccacagactacagatggggctgatgccagcatagtctgttttatcactatagacgaattttgccaaatggttgttgttggacctagataccctgagagagaattttcttaggactctcttattaatggattgtattatcatttttattggttatttgtataggctatgagcagaaatcattatccactgaggagaattttcacacacattaaaaagcagccataaaagcaaagaatacaacaggactttagttttaccacatcactagtatgtgctcaatttattttgactttctaaaaattgttaaatatcacatactatttacctaaattcttagttttctcttagtcagggcccaaagctgtggtggttataagaccagatgctctttgatatattcctttaaactgcaggttatgggattctttagagattctggctattagcttattctagtattttaagaacaaataccagagctgcatgtacacatgcgcgcgtacacagacacatgcgcacacacacagacacacacagacacacagacacacacacacacacacacacacacacacacagcaatataaaaaccctttcagatttttggcacagctgtgttttcaaattgaatatggataaatttaggaaaatgcacaatgtcattgtcttccaaatctaaagacaatgtgagtgacgagtacgaattatattgtgtgaaatacagtaggtttttttttagcaaggctgtaacagataccgtagagctcaattgttgaagctgatcccaaatatgacagtttctgggaacatgctttctcaaaagagtaggaatatctcactgtggaaattcaagaagttcagatatcatcctgaagagtcactggaaattttattctgccagataaatggactatttgggagaaatgttgtatttccaggaccttggaatggtttccctaacattccagaggatagaaaaaccaagtaaactacccaagagcagtattttaaatgacagcagacacactggctatcccaaaaactatcatgagtaaatgccaacattatggtttccaaggttcccctcacatgccactggagtactgctgaaaagcagtcatggctaactggaaaaagcagcaaggcttgcttccatcaccaaattttgtagcaagaaattatgcactctgagacttatatgtttcttatcatgaaattggagttaaccacacatatccattatcttgcccaggttgttagaggataacagacataacgcaatttgaaatgcgtcaagttccctgcagtggtataatctcggctggacacacctccaactgccacggtcatatcctttcttggattacattttctttctttaagtggtgggtgcacttccttccttggttgtttcagtatgctctgtgaggtgatgtgcctgatattatggccataattcctcattctctttgtttcctcctgtcctgtctccactttgcttcttgtccctgactgttaaaagttggcatacctgaggttctgtcacagtcactggtctactgtttctctaatcttaaaaaagaaactgcattcatttctaaaccttaaataattatttctgcccatattcctgatttatttccagctgtgacttccaatctgagctccagtggcatatacattgtaaatatctgctagatgttttcctgtgactacccagtgttacttcaagttcaaatgaactaaaacttaaaaatcattcctggaagtagactccccctccttacttccatattttaatgaacggtaacacatctgcaaaacttatgagctatctttgacctctttctcttcctcagttcttagcaagtttttgccaattcttccttttattgatcctaactatcactttttcatttctactgcctcaactctgttgcatttttatcacttcatgactaaattagcaaaataactctttttacctgctttcctatctgccacctttttactctctaatctatccactaagtcactggattttaaactgcaggtaatgacccatttagtaggttgtgaaatcaatttagtcagtcatgaccagaatttaaacaaagaaacaaacaaacagaaaatgaagtggaataaacttgaatacttaatgttagtgtttattatacatttaaagcatggttctataaaaattttattttagttaaacagaggtgtgcattgaatcatgacatacaataatgtatttcttactgtgagttatagtcaaagaagtttacggtcaaaaatgctgctgcactggcaatcccatgagaactgataccttgcacacagttacaagattcccaacaagagccatgtgcattggcagtaaatattcattcagtgaatggaagaataccgtcttgccagcctttaactcatttttctttttatttcttctatatcactctaatattgaagagttaaagactgaccggccagctttttagcttgactcttctggttttcccagtattatattatagtttacctcttagctctatttaccactgagttacttaacacgaagccttcatttatatcaaattgtcaggctcactgtcacgtgactataccacatgctcaactgtctcaatgactggttttgctgtgatcaactttaaaaaatatgtatgttccacctccaactctccaacacacacacacacacacacacacacacacacacacacaaacacacacacacacacacactttttcacttattcagtctttagtcatcccttaaattctcaactaagcttcaggacttcttttactatcttggaccactgtctctgaattcatagcttttattgacactgtccactaatttactaatgcatggtccactgctgtaggccatatattttgctgcgttctatgaaacttttcagaactttactcttccctagccacttagaatgtaaacactagaaaggcaggtgtcacatcatgtgtcccttgcagtggcatatacataacagtccctcaataaataacatagagttttcattcaaatattttaaaaacattcctccctcagcgacatactttctacttcttggcataatccattcaccattcaaatatgtatgggtaaagtgaagaacagccacttctagttagagttaatcagtgccagatctatatcttgttatctactggatatgcgatcctggagtcagatttatgagcattatgagcagcctacaccaaacaatctgacatctccagtctgcaatgccttcatttaaagcaggcttatccaacatgcagcccaacacaaacttgtaaactttcttaaaacattatgagatttttttctgttttagctcatcagctgtagttaatgttagtgtattttatgtgtggtccaagaccattcttcttccaatgtggcccagagaagccaaaagattagacaacacccctgtgttttaaagcatgcctcctctgactgtcacaaggcagagttagtagcagccatcaaaacaaatatcacaagcccatgacatttcttacgcagtcaatagcaccatgctgatttcacaaaacaaaaaccaaaataaaaagtgcaccacacagtgaagataacttaaaaataatttgttagttcatgcatccaagcaaactgtgatgacagatcacaaataagtgaaaggatgtcagagaaaacaagcatatatagtctgcttttgacaaaacagtcaaaaattactcacatgttcagtagtatcatcaaattcccactgattgagaataagaaggttgggaggaaaacaaaataaaaagaaaaagaatttaaagccttatacaggcagtgttgcccttgttagattaaaaaaatcaaaaaaataaagcagtgtgtacaataaaattccaaagaatgtgtgatttgctgccacctccacctctgattgggaagtcaaattaaatatcctttgttactgttatcactaaaaccagctaacattctttaaatgtatggttcactgaaacatagcaatgaggcacagaaaaagttaatgtttctaatcatatcctactcgtatttattttgacttctatcttaagttacacaattaaaagtcactatttagattaatatctttcattatatttgacacttataacttcaatgaagtcctgtgagatgtaatgaaatttcagtgaagagtcaaggaaagtaaatgagatgggaaagaaagaaaatacacaaggaaaaacagcaattaataaagaaaagccaaagaagaagagaaaaaaagacagagttcacatttaatgcatttggtattatataatttcgttaactaccatattttgcaatggaactagggagagaattacagttctgtaatgtaaaatatctaagaaccaaaggagaacaccaaagcacactggtcatattgttttcttttccataattgtagacttacaagataaaacgtagcaatgatggctttaattttatactacgataactttctttttataggcactacataataattatttatacaaatcaagtcaatggcccctttccagtgttgaaggggtattacgaagcactactgcatttacagaagtggcctcggggtagataagtgagcaatgaatccagatccctttacttagaatgtttcaaaactgaagaaaacataaagacttctgagagttgacttgtattaagactttgggggtaagtactttccttagaggcacagggatatttattgctgtcttatttttttatttttttaattttattttttgagatgcaatcttcctctgttgccaggctggagtgcagtggtgcgatcttggctcactgcaaactccacctcctgggttcaagtaattctcctgcctcagcctccctagtagctgggaccacacaggcgtgtgccgccacgcctggctaatttttgtatttttagtagagatggggtttcaccatgttgagcaggatggtctcgatctcttgaccaggggatccgtccgcctttacagacgagaacgtagaactgggcaacctggtgccgcagttttcaacttgcttcataacctttccaactttcacacaaagaaacgcattttcatttgaaataaatttcaaatgtttttacaaactccatccttttccctgccaagtcaccaatttcttggataatgaaagtattccaatgatcataatatcctatccccatgacatctcatcaccatttgacacagcaaaggtaagccagtacatgagtcatgtacaattttcagcatggtggttacaagatgaaatcttcatcttcctttcaggaaaatatgtaaaactcaagcgaatttattatgggactatctttgaatcacctctaatttatgaaaaattttggaaattttcaatgctctgttttaaacaactaattataaaaccgggttgtgataccatagttgcaaaccactgccctaagatcaatacaatttctcacatactcaactactcatttttagtaccttttttttaaaccttggttcaacgtaaggatcccacttatttgctaggaaattctgatttaatttttaatatcattgtaacgatcttcatttgctgggacatgaaacaatgagtttcatcaaatatgtaatttgatgaagaagtactaaatataatactgagtacctgtccctgaataaaaatgtctattcttcagtggaagaagacacacatttagaaattagaacaactaagttgcaagttgttttagcacagaagaaagtagactccatcagcaaaattgcagtttagaaatcttccctttgactcaactaagtcaatcattttttgaagtcagaaaggcaaactcaaatatggttgtaaagggttgaatatctgtattttaaggaaaaagtaacatgtttttaatcagacttgagtgtcatttcattacaattcccttcctcacttgatagtaactctgattgaaaagatcaatatacatcaatgtgaaatgaaaactagaattttgtataggattttttaaatgtcgaaaaactaaaataagagcaatttcaggatatgaactaagataaacttattatataaaaacagaggtacataatttcagaggcttacctgtgcatcagccagcatgacatctttcagcatgggctggcccttgggctcaccattttccatcctcacataatgcacctgatatcctcttatctggccatgctgtttattgggcacgggtgagcgccatgagactttaacagatgttgagttgacagcctctacctcgactttgcgaggaggaccactaggaactggaacaacatcattggataaaagaaattataggcacttgtcccaccctatcagagcattttctgcattttctttacttaggtttctctttcaaaaaatgggtaaacccactatgttttctttgaagaatacaaacattttcaaccaatgaaaatgcttaaccaatctgctctaccttttaagaaaagatcaaaaaacatgaccgatgcaaaaaaaaaaaaaaaaaatggaagaaaaaaagagtatcagagaaatagaaaaacatgtaaaaaatgtacaaaagccaaggaagatgctttgaggttcaaagcattaaagcacaaagaggtatagcattgaaataataacaaaaactggctgttgattgttgtgtgttttttaaaggtttctttttaaacggcagaataaaaagattcttgattatatgtattatcttctctttttttctcatatcaaagttattccatacaaaagatgccaaaaattcaatgttgagcatcaatgtctctgaaatatgtaagacaaaaaggcaacaaaaaggtaagaaggtagttttgaaaagttaacttcaaaatgtaaaagaagtgactacaaaaagccaagaaaaacacagaagactttagatggaggcacagagacgggctggactgcaagaccataggagccaacagttcttttaaagagaagcaaattactgcattgagattgaaaaaaatgaaaaaaaaaaaaaaaaaaaaaaaaaaaaaaaaggccaggctgtagcaaagacaagtctttggcaaaaatactaaagtaacagcaatgctgggtaaaaagatgagcagagaaaaaagattactgtgagcctattgaaagacagcagatcaagactgtgtcagaagggtgcaaactgacgtagcggaggcaacataccatcttcattggttcgaatcaacacggacaagctctcagggccagggccgacatctgtatgggctgtcacagtgatccggtattcagtccatttttccagctgttccaaaaggtatttggtagtgtccgaaggaattcccaaaatctcgtgaggcttgtcatcttccccatccactgcagtgtacttgatggagtattcagtgataatgccattctgtttttccactggtggaggttgccaacttaccaaaatactagtggaacttgggctggtgcaactaatgtcttgaggaggagctgacggctcttattttggtagtgagttaaaggaggatttaagtgaaaggacaggagtggttgaaaaaaaaaatgataaaacaaaagaaaaggcaaaaataaataaacgaacaataaggacaaaatgaaaataaggctttgaaacttaaattctaatgacaaattatgtaccttggcttagtaatatgaataaaccaaaaagagaattaatgaccaaaaataattgttaaataatgggtagggggaatatgtgaaaatgagacctcgagataatggagcctcaaataaaattacctacctgcgataaaaattcttctaaaccaatccctcagtatctcccacccccactatactgactacccagcttcaaaaaagctgcaaatagtgctagtatttacttgagggtctgatgatgcctcacagatgtttccaagctttcacttctatattctagaatgaggatggtttacatacagtactcatttgtgaaaggcttcttaagtgtgaaaagttgcaataactgctaatgcccttctaccagttccaattaaaaataaataaacaacaaacataagagggttcactctatctgaaaaactgagtttgcctgaccagttttaataataaaaaaaatgttaacattgatcatagcccatatacagtgagcatgcagaatcaataaaggatgaaaatgcagagtccaagatttacctacccgagggtaatgtcaggattgttgattctgactgtaacttgtacttaccctacgtcagctttcagctttttaattataactcttcttgagacaccattgctagtgaagaattagaccccaccagcaaaatttggtaaaatcaataataatcatttatcccttacaaaatgtcaataacacagccattaaaaagaactgtttttttaaaaacccaagtatcaactggaaaagatataatttctgtgcaaaatttctttcattttgtacataattattcatacaatgtagggtttatattagaattagaagacatactttcttactgcccattctaaattaaactagtcactttctgagcaatcattttccatcaaattaaccaagcattatgattttaaaaaattaaaaatcaataaaagacagcacaattactatcattatttaaaacttaataatattatgttcctaaagaaaaacaaacaagtgggcaaagataacacaagtccatacacacacgcatatatttttaaagcaatgtatatggtagactgaataaagcaatcctatatttcatatttgaatgtgtagtctggggatttccctagactttgtgactcttaacattacggagtgccaggtgtatccaattgttcaggggattatcagtctttcttaatgtacgtgccttgtgttcattattacagtccatcaaaataaaagctctctgtactgacaaaaaagaaatcctcataggacagccttgtaaatttggaataagatttgcaaaaccactagaatctcatttttattgattctgactaggggttcttatatctcaaattataaaactattttacatgcattatcattattcataataaattgagttgttcatgtaacagcaaggactcatctgtaattctttttaaaaagctgatttggttttcactagggctatcttcagacctcctattttgtgagaatatattcaacaccatttgaaaattttactttaataaaataaggaatagataagtgtttgatgtgcttataaaaagtctattcaatatgtatgtgtgtgtgtatatatatatatatacacacacacacatatgttaaaaactgaggtttgtaaaccatgggaaatataatattgaagcatgtaacatttctcttaattaaaggcttggtttttagaaattatcttctacaatactatttattagcctgcctggaattcaaagcagacatacagagaacgcattaatttacatgcttacgcctttaaatgaaagaaaattttatgggaataaacgataatcactaatagattaaacatgatcctaatcattttcatgtgaataatcatgctttaaagagggaaaaacataaattttattatcaaaaaaccctgaaagttttcaagtttctatagaaaatgaaatggtggaaaacttgcttatttgtatggaaggaaatgaatcttttaaatcacaaatttcatgtttgctgataggtctaaatatgaggttaacagagcatcttcttgacaaaattcaatgtatttctactacagatatctattgtataattcactatgtcaaaaagtaaagacaaaatatcacacaaagaaatctaagaaaataactcaacaaaactcttcaattcaaggtaaatagtattttttatgaatgaactgtaaacacatactaataaaaagcaattaataataataagccaccaaactttccaccaaaaacaaaatcctgtataatactttatgcaaaacaatctgccctgggaacaattaacccccattgtgataaacacagctatgcttaagggtaacagctccaaaaagaaattgaaccccaggaaacaaaatacaatttagaattgcaaatatgtttgcgattattccattgtttcttaatttgtccacatacagattttctgtcaatgttccaaatttccacaggtactacacacagagttaataagaaacaagtcatcagagctgagcttttcttagtagaaacaaatacatgaaataaggacttgtttgattgcaaagctaaagcctgtgtgcttaaaaaaataaagtttttttttgtcttttgcagcctctttcatttgcgaagccctcctatgattattttacagggttctcaatgtgaattttgctttaaagacttgtaattcattaaacagggcttgatctaactcctttaacccacatttcacccatggacgtctactaccttctttaaaagtctttcagtgtaggaagtgggaaggtgggatctgttatttggatcaagtgatgagaccaaaagaagtcacagttacactttcacctgtgaagtgtgatgcatactaacctagagactaactattaagcatattagcaggtttgcttattggtgaaggtgaaagctagcaacatctccccgaggaaataaaaaggcagaaagtaagcaaagagagacacctacttgactgcatggttctagctgatatttctgcagtagaagcacccaggccttgaggggagcgtgcagccagacggaaatagtataagctgtttggtttcagtccttgcagcctatatgatgtccctggctcaatggtaattcgttgctggaagcaataagagaatgtggtcatcttcattaaggttcatgcaaatactttttaatcatactgtctggaccatcagatttctatcatcaggattataatctcatcaaaatatcaccaaaagagtcaatagtgagtatccagggctatactaaggaaattatataatgaaaatatcagtttaaaaggcaagtttctacaaaggtaactggaataagggaagtcagagatctttttaatgttgacacagtcagccaaatacatcagataagacgaagattgagaggccaacacccatgagtatgttctgccgttaaatgtgtgtatgttgctgtgacacagatcacaatagaaaatgacacctgcccctggtagtggaatctgcccaacatgtgcaattttaattgaacagatgtctactcatctcccatgaccttctgaaatctcaattggaggcaaagaaaacatgaccagaagtagcaacagtaaccagtatacaatttacaggaggttgctataaaagagatttgaaattgccaagttttaatgggtaaaatatcacgttagtcactaaagaaagttgaataatttatctgaaaccacattactaccctaggttgatctaaaataactgaaaaccttactttctttgtgaataaagaacccacagccagaaaaaaaatagattcacaaatgtttgtggacttttgatatacgatttcgttaatcaaatgctataactctcaccttccgtgcttaaaatttgtcatttagcaaaaatataagtgtctatgggtaatcaatcttgaacatcagcctgcagtaaaccttaaaatgcaagtgaatacataatctagtaatggtgtgtgtaatcttaacactttatcaaatagtgtttgctattcacacaaacaaatcagttaagaagaattcaaggccgggcacggtggctcacgcctgtaatcccaccactttgggaggccaaggcgggcggaacatgaggtcaggagatcgagaccatcctggctaacatggtgaaatcccatctctcctaaaaatacaaaaaattagccgggtgtggtggtgggcgcctgtggtcccagctacttgggaggctgaggcaggaggatggcgtgaacccaggaggcagagcttgcagtgagcagagatcgcgccactgcactccagtctaggcgacagagtgaggagactctgtctcaaaaaaaaaaaaaaaaaaaaagaagaagaagaagaagaaaaattcaaatataaaactagagaaaccatccctagggtgttctgacttacaaatacaaaagttttcaggaattttagatccaccaagtaagaaataaagaaattccctaaataagcaattgtggagcacagtagctatgccaacatttaagcatcacaattctcctttactctttgtatatatgtatgtttgtgtctatgtatgcctgtattttagtttggtggtcgtgatgaaggtttaaacaattcagtgctgatttacaccttacagaaaacaccaatagctcaagttgtaccatgaaaactttaagtcatatctgcatttcaactatataactttttgagtgcttgatttatattggctttgttagctaaatctaaaaccactgcatttaaaacctattcttttgagattctgctcaattcaaacagatggaataaaacagaagtttacaagaacatattaatttattataacatccaaaattatgtactacaagttaattgagagtagttcatttagcatgtgagttttttaaaagatattctttattagaacacagggactgtttcactttgtgaagatttttttttcagataaaaaatgctaagaggcataataaaatgaatatatgtgtgaagttctcaaacacagtgccattaactccttttgtcctaatgttccccattggatttaacaataataaaagaaacatacttactactattatgtattctcattctgaaaatgttagatgtatcttaatatcgatttctatcatgtattcaaactgcactcaagaagcagtagaccctaaccgttaacaacacagactctggaactcgactgcctagactcaaatcccagctctgccatccactagtgcgagactttgagcaaattatttaactttttttccatgcctccattttattatacgtcaaatcgattaataagaaaggctagctccagtgctactataaaaattacatgcattattgatggtgaaacccttagaacagtgcccattaatgagttaattatattgattttcatttctcttttcagtgacgatcaacaattgccatgccttctacaatctgttatttcatttgcacagcatactcaaatgttatacacactcaccttcataccaaatactttttagcaaacaaacatttgctattggggaatctttgaaaccagggtggaaaaattcatctagccaaggactttcattaacatatagagctaatttagtcacctgtccccacagtgacttaaatactttcatgaagaagagaaagtcctcaagtctcattgagtatttattcttccataacctgatacatctatggaacttggaactctgtcagaagcacattccaacaggaacaagagttattttgttttgtttttccccaaagcctccaaataaccactgttttttgtcattgttgttgttttggggtttttcttgggggggagggggagtcaagttcctcttttaattagtaaatcttttccatcaaggtcctcaatagctctctgaccaagaatgtggataaatacacaaaaataaaaaagtggccccacgtaatgaataattcccaaggtgagaagcactatagtcttacctcctctccatgctccccatctttgtagaccagttcatagttggcaatggtatctgaacgtggaggtgtccaagagagcaaaatacttgtttcagactcaggttctgctttgaagtttagtggctgccctggtactaaaaacagggaggcaatggattgaactcacaatcaccaggagtattcacaaagttcttccattagcgtaacctgcttaaacctttcgaaatctgtacacatgtaccagcttagtggaaaacaagctcctttaccttgtccaagttaacctctttgtgtacagggcaagtacaatgttataaatcctgctctggagtagtagaacatctacacaagatatagtagaactaataagtataaagtatatcggcctctgaattcaattttaaggaaaaaattctttacttcatgatatggttgttagtaataaataatataatttacataaagcacttgaaatattgccaaaagcataataagtacaaaatacctaaaagtattgttatttacaactgagtaggaacttactctctagcactacatgtaacattcaaaattatttccaattaaatttatgaaatcctacctttacgccaataacaaaacctaacaggcaaacagaatcactcagcattttttcttaccagcccacattttgaagaagaggtgtaagaaaggaaaaacaaaacaaaacaaaactctatcacttacaaataatgacttctaatctctaaactatgttaaattatttaaagaactacacctaatacaaacaaaatatcctctctagtgccacaaagctaaactactacaaaaattaagaagtttataggatacacttatcagaaatatggtaacttaaagagatcatctataattctcatgttagccatgtcatctattcaacagacaatttggaagagctgtttatcagctgtaacaaagaatggaaagtctattcagtttaaaacaccttactcaaatgaactagaataattagtaacctaaactttctagtccacacctaagcctatcagttcccctctatccattatacacaaggctgagtcagggtgtcgctggcacatctaatcgtacattgttcttggccactgtctgctctgattggtgagtgcctatgctttcccaattgtaaaacattttgatcattacccttgatattatggcatgtctcaatgtgctgtggctgaacatatgttcatattccctcaagtttaaataagaattccatttatatttaaagaaaaaaagagaacaataatacttcatagcagaggagtaaaaaaacatctaaagtgtgctttaaaacatctaaagtggcaacctcagcaaaaatatttaaaaatacatataatacagtataatttgtagttcaaaagaagcctttggagaaaatgtattgctttccttttcttttatagttatgtctgtgtactatggctttaaaaaatgccctttgttaaagcagtctgcaagaatgatttgtagaattcctaatgataattttattcctctggtaagtcagcctgtgtatatatatgtgtgtgtgtgtgtctgtgtgtgtgtgtgtgtgtgtgtgtgtgtgtgtgtaaaggaatatatgtttggactgatgcttaaggtcacaaataatcagtgcttcatatttctagttgccttcatcatcttttctctctctctttttaaaaatcacaggccttgagagtctcattgatttgatgcctctgggagcttaccttctgaacagagtatcacatttttttccccagtacctgcccagtgggtgacctaacacaatcatttagattgaaaggtggaagcgaaagaagataaaagattgagaagcaagaggcagagggacagaggggaacaaaacacaaataggcaaactgcaaagcaaatggaaaatgcattatttctaaaagggaaataccaaaagcactggcaggagcaataatggaaacaagagtgaccagatagatgggaaaattatgataggacctaacctaatattcacatgataaaagggtttctcaggctaaaaatgcacacatatgcctatgtatgcagtcactgatttttttcctagttttatttgcttctttctttctcccaatttcctgggaaacaagaaagtttgtgttaactcctgactcaaaccaaaccggactacagtatggtcaagaattagaaacacagacaacactgaagggctgctctcgggataataattgcttgttacgcatttcttccctgcctaatgctaataataaattgacattgattgaaaacatcttggaaacctaattaactttttcttacttaaactgtttactttttgcttttaatttgtcttgagtaaattcccggttggtctcaatatttcattcttgtttagtgacacaagctttgtctgatcatctaattctgcttgtttctattaagagccccttccttctaaataatgacttaagtaggcacatccaagtctcagagagtacactgtcctttttattcttgcacaaagctaaaggttggctagacgacttgatgcaaagtgtcttcatctaatgtacagggggttctctcctgttctttccttatccttcttttgaaatggttcggaggttaacttcatttattagattttaaacttgtggttcaggcttaggcatggtaactcacatctgtaaccccagcactttgggaggccaagttgggaggatggcttgaagtcaggggttcgagaccagcccaggcaacatagcaaaaccctgtctctacaaaataataaaacttaaaaaaatcagctgggcatggtggagcatgcctgtagtcccagctgcttgggaggctgaggtgagaggatcacttgagtccaggagcgtgaggctacagtgaacgatgactgagccactgcacaccaccctggatgacagagtgagaccctgtctctaaaaataaataaataaataataatatataaaataaacatgtggtgcgaatacaaatgctcagaggtgtcaggtaatttagatgagtgagaaggccatatggggcctggggcccggtggagagtgcccaccacctgaagagggaccgcaggccatgctcagtgacagcaggttgctgccttgtgaaatgtgggcgcactcttgtcccagcttccgatttccttcacagaagttgatcatgaaccttccaggtaaaacctttccattcttaattactaaaaattaattgaattttaaaagcactgtatggggcaaaatgtgtctacaggctagattcagcatatgggccatgaaataaactttcatgatctcaggctccaggctcatcaatggcttaagagtgcactacccacacttcctcgggaactgagggtgtacctaacgatatcacttcctcagggcattttgtcatatttgaatccacaaccatgaagctgaggacacaaaggaatttttttaaataaggtataaaatgaatgtatttttaaattcccaacatattggtcctaatgagcataatatatgtatataagaaaacactttgttttctctggaacacttgagacatgggactactttcattatctgtctattgaatttttataccaaatattgggtctacagaggttccatttcacatttctattaatgttttctctctatatatgtatttatacatataaatgtataaacgtaaatatttacctacattttatttatatatttatttagttttgagacaaggtcttactctatcacccaggctggagtgcaatggcacaatcatggttcactacagctttgacctccaggtctcaagtgctccttccacctcagccccctgagtagctgagagtacaggtgtgtgccataacacccggctaattttttaatgttttttgtacagacagggtctcaatatgttgcaccaggttgtctgaacttcctgggctcaagaaatccttccacctcgaccactcaaagcactgagagtatgggtgtgagccactgtgcctcgccttcttacacacagatattttatgctcttgtaatcactacacatcacggtttctcactggtatttttttttttaaccttcacttaccagtcctttgtctatgtatatcttattttatttttattttattcaagagtttttctgtgttgtaacatttccttcactgattaactgaacataaattttataagaaaatgtgagattctgggaaaatcatgggcaaataaaaacaacatatccagacctttaagcagttacttcatattcaaaggagagatatgatattgaccataaaccagatttacaataggacatggaaagcaaaaataaaagaagcaaaaatttttctttaatattatatttaagaagtcattatatactgtaaaagtatgtccgccctcttgattacttacttaatgtccacaaggaaatagaaatgtgagctatcgagtccctaaaatgagatcataatcctactgatacatgttaagtacttgagtattactataattacactctatataaatatgtgaaagcaactccaagacaagggatgaaaaagactaacaagagaaaccttcacattatcagatgctgatatattagaagagattaatatttgaataaaatgtagagattatctctaaagaaaggttgacacatattgcactgctaaacaacagtttcatcttgctatagtataaatatgaaatatgaccaaagatactagaaaacccatgattgctaaaatatccagtattttattaaggtacatgttttaaaatgtgtgtatctagcatattgataaatgataatgacaataaaaccgacagccagaattataacggtagtaaaacaaagcaaaattcaaaacaaagagtctgatgtgtaaatgccacaaatatatcattgacaaaataagtacttaatacacaagcatcagcacaaatcttattctcaacagtcattaaatataaatgagaaaaagttaaattttattatagttgtatttatatccagtgctcctttactcattgctaaatctattcagaaaaagcatttaaattggactcataactttggttattagaaagcagtctttttctagtttgcttgtataggcctgttgacatacactaatgaaatgatttataaacttctggaaacctaacagactttgtctctcaatgtcatagcttatattttaacacttttgcaatgcccagaatttgtaatagcattaacatccctaaaatgtttaaagttgatactagtcattagtatttgataaatatatataattctttatcttttgaaggcatatactgttaaaggtatatccatataagtcagatgattttcaagaatctattaaatgaatagatgtaattagaggtcagacatgctttctaaatacagttcagaaaaaagacacatattaggatttaagatttataatgcctctaattagcatgaacatcaagcaacatttaatgcattaggtttgagatttaacttactacttctttgtcagagttttatttctacttcttctataaaatatagttaccctatgcttttggtacaattacctttacaagaaaactataggaggtccttttttccttcctgaatgtgttttctaataatgaaaatatttttctagcttaatataaatactttccttgtcaatggccatatattccccatattttcaaggtaaactagttgcaagtgactttgtaatgccagaagttagagctatggagaactgagaagattgacccatatttcagaaaataatcatctcaatgaaagtcttttcatatttaaaaccatttaaagattactcaacacggtcaactgtactaatgttcacaatcaaggagaaaaactctctgactgtaaaacagacagatcatattctcattttctgtattaccagaaatacacaaatttacatcaatccttcacttatgtccatctgtgtgactcatattagatcaaatcaaaagtgagacttctctcttaaactcactttgatcctaaatactgttcttttggaatccggtttcaaacaaaaacaggaatgtgaatgtcacagaatgaaagataataaaattaaatgagtaccttttagacacagaagacatcaaaatgtacatttctgtgtatttgtatttaaaatgtacttcaattcctacatattattgatcagtaaatttttatagggttagaggagaaaaattgcagtgaaaataatcatatccttaaattttatatctcataatggttatcgtcctagcaatcatcctaagaattctttagtcagtaactttcttgttactcctttttcttaaggagcagctcggcattaattacatcagaacaaacatcattgtttttggtaggtgtccactaatatccactggcctttttaattaagcctatagaacagatcaaatcattgtgctattttggaaggttttcttagcttattgagcttggcaggcagtcattacatcactatatatcttctcaatcaacatgtattaaaagtaaaactattatggaagattcttggaaacatcttcatgcaaaaaagtcagttaaacagagtgggaataactattctaatatatccatgtcccattcatctagattttctgagttctgtcattaaattaaatcagagcttttgaaagtagagtccccagctcacagtaactcagttgcccctctgataatgctaccttcactgagttatgattcaatgtcatattctgtccactggtcatataaaaaaataaagatatggtctgtctacttcaacattacttctatatttttcaatagattacgactgaaggcatcagggtttttcatttagcattctaaatacaaggattctcacaattgtctaagattcacattttggttggattaggtttaggaaaaattttgtttctcagataatcttcctaccatcagaaaataaaaatatgaaacactatagatttctatgtttaaactggtgcttataaaacttagagccaaatttatttaaatttagttaaatttcagccagatttactgcttgagtgtaacgatctttcataaaaatgttcttccttccacttcttttagataaacttagtttttttttttttttccatttctaaatgttttcatgtacttctgcactggaataatctaatagctacctcagtgtttcagaagtaagttatgtataattcttagataaatatatgaataaatgaaacaattgcgtttttctctcttgcctcttttcattattgaatacctacactggcataaaaacacaaaaactatcacattaagcaaattattaatttaaaaggtaatggtagttgataatgattaggctctgcgtccccacccaaatctcttctcaaactgtaatccccatgtgtcaaagaagggacctggtgggaggtgattgaacaatgggggtggtttctcctatgccgttgtcgtgatagtgagtgaattctcacgagatctaatggttttataaggggctcttccccctttgctcttctctctcctgccaccatgtggagaaggtccttgcttccccttcaccttctgccatgactctaagtttcctgaactctccctagccatgtgaaattgtgagtcgattaaacctctttcctttgtaaattactcagtcatgggtatctctttatagcagtgtgaaaatggactaacacagcagttaaaagtatccagaatccctggatttaaattctgcttttgcacttagtaaccttacgacctacggcaagtttctgaatcacgttttatcctctttgatcttcaatttactcattggcaagtgggataattccacatctgcctaattggtttgtgagaataaatacatgcaaagttcatagtatagtgtcctccatatgttagctactattatgatgattacatattaataatttaatgttttacatattaagttacaaaatgtttccctccattatctaatctataccctgttatgaattttattgcatcccacaaaaatccatatgttgacatcctcatccccagtacctcagagcataaccttatttcaatataggatctttgcaatggaattagttaagatgaggccataagagtgaccccaagtccgttatgactgtgtactagtgaaaagggaaatttgggcataggcatgcttttgggaagaacataatgtaaagatgaaggtagtgatcagatgatgcttctacatgtcatggtacagcaaagattgccagcaaaccaaccaacagaagttagggcagcagcattaagtatatttccctcacagccttcaaaaggaaccaatcctgccaacaccttgatctcagactccctaggccccagaactgtgagacaatagattcccgttgtttaagccacctagtatgtggttcttttttacaggagcactagaaaacaaatagaaccactacactctataaggtggttattattatagactagaaaactgaagttcagagagagatgacataaatcacctaaggtgacagctaataaacgaaagcttgggcttcaaaccctggttatgttactccaagaccagggattgaaaaaataatcacagctgagaaatttaaaaagctcaaagtggaatgtaagttcccatataatttcttagaattttttaattgttatgtagctgctaaaacagtataataaaaagcaatctcataatagttaaccacttttagtcaagaaaaagcaaaacaagatttacggatgtctacatttcccaatgagaagcttttttggtaagaacagcctacagtattttttttctgcatattactacagcaaataaatacagaagtactgcaaatggcacacagagaagatatatggatagtttttaatacaactgtggtgagacatatttttatagctggctttcctacaatgtcatagagaaaagagtaaatccatgaacaagccaataagaaccaaataatggtatgaaaataaaggcaggcgaactattaatataaatgtgctctgagattcctagaagcaaggacaaatagttaaacatacttcatataaagaccatgccatgaaaacaagtcagtgattcacaggtatcagtgaaatagatgataggtacattatctagtactggcatctgagaaaatttattaattcattgccaggattagcaatgagttatgtctacagattatactgtctccaataatatgattattatgtagatttcaaaacaagccaacagcatgatgccaaaacattcgtagattaatgcaggtttaaaagatgccaacacaataaggagtcaaagaagtagctctcagatgctcaagaataaactttttttttttttttttttttttttgagatggagtcttgctgtcacccaggctggagtgtagtggtacaatcttagctcactgcaaacttgcaaactccatctcccaggttcaagtgattctcctgcctcagcctcctgagtagcaggaattacaggtgcctgctaccatgcccagctaatttttgtatttttaatagagatgaggttttgccattggccaggctggtctcaaagtcctgaccctcaagtgatccacctacctcccaaaagtgttgggattacaggcgtgagccactgtgcgtggctcaagaataaactttagaagaggcctgttattttatattagcccaaagccaaactgatcaccttgactcaaagaccaaagaggtttgataacctcttagaaaaataaaaccactgggagggccaagttttccttcataaaatagtctaatgtctgctgtagctcttagcaaagttaatcaatcaggcccaatgttctatctgagatctcggtaactgtctctctttatccactgaggccatacagagaaaaacagaaattaaagccactcagagaatacttattttcaagccagtagcttctggcaaatataagccatttaaatacccaaggccctgtaacagttttattttttagctttgtcttgaaccatccaatcttacacaaattaaatactcttttgagaccactctaccatactagctattacaaagaagtgtcgtttttctattctcaaaactgggcatgggggagacattgttctatctcacatagagaagtcttcaagtcattcccatacaaattaaaaagaaggggtgttaatgcattgttctgctcaaaatgattagtttttcagatgtccatgcttgttccttttcagatatctatcatctgttgctttgaagccctaaatctcaaaaattaaaattcataccatctttgttccttctttgtttttgtccttctcacctctttgcaccagcccttccctcctgccctatttccctcctcaaccaaacttacctcctgtctgagtgatgacttgtatgtcacttgaaaggggaccatctccaattgaggtaaaagccaggactttgacagaatatgttttctggggcactaagttgccaatagtagtgatttggctgtcagctacattgtgtttcatccagttgttgacatgttgagtgggatccattgtataataaactctatatccttggatctgtccatttggctcttcaggttccttccactgtaccaaaatggtggtcgaactcaacattcgtgcctggacatccctcggggcactggatggtgcttgctctgaggtttgtgttagcacaggttcgctgggaggcccccgcccaatgttattgacagcaacaaccctgaattcataatccgagtagggacttagtccagcgacactgtagcgtgtggtcgccaccccatcaatttctttgtaaagttcctcagagtttttaggtttatgctgaattatgtaataagaaacaggctcagggttcccagagtcccacgtcagtgtgatgcttgtagctgtgctctcggtcactacaggagttcctggaggtttgggtaaggcttggatgggggaagataaaagacaatgactacccatcatccctataatatttcaaaaatctataaactctactatgaaaatgacaggattatgtatctactgaagatttaattaaatgaaattatagcaaagagtagttttctgaatggccaagaaggacaggaaaacattcataggtgacacaaatcctgctttcctagaagggcttgatagcatatttttaggcttgtatccaaatcctctacttattagctaagtgatcctgcacgcatttcttaacctctctttgctttagtttcctcatgtggaaatgggaaaaatattattatttaagtcatattatacagctgtatgtaactgtatttcatgggtttgctgtgaagactaatgagccaatccactaagattcttagaatgtaactggaacccacaaaaaaaccttagtattagctgcagttattactattattataccaaaagcttggccaattagccccttgccccaataaataaatggtataactgaaataccgataaacattgaaaagaacaaaatgtggaatacattgaaatgaaattaaattgcgatgaaacaataacatctatattctggtaagacacaataccattactaaaaattttcttgtaaatgaaaaaccaaaaattttaaggtgcaaaagaatagaaatttcaaatcaatgctttattcttaatatttaaaaattgctgaaggaagtaaattaaggcacattcaccaatcactttttaaggtatgttatggtcatattaatatgcattctatattccacatcagaaatatccaatgtagctacatgacaaatatttgcaataaaatccatctttttagaggtctaattctttctttttagcagaagaatacaaatcaaaatactactaattaaaaatataaactgtctgctttgctgacctcatattcaagtgccttattctaaacaatgattctgaaacgcagtgctattagggtaggaaggggcattctaatagttgactctttagagaaatctcaaagggtaacattcatataatcagcccattagtgtccctgtttccttgccaacataaaggcaagaagtataacaccccctagaatggcagcttttcaagagcagcaaacttgtacttctgacttactgtaaaattgtgaatgcctagaatgctgcctggcactcggtaggtttttaatgagaatcgttaaacagttaactgaataaatgagtcagcacccattcacctcattctcttcaacctgttcttttgttttgatttattttaatttgccattaagattcactcttatgttttatttgtttatttttgaggtggaaaagacagggaagtggcaagagtcaggaaaacaaagatgagaaggtgaacaaaatattagtttaaagtggcccctgcttttgaattcttaaaggtcttcagcaagccttcaaatatttaaagctgaaatggtaattataaaaaaggtgattcaatatttacacactactcaaagaactacagaatgatagtattttgtcaagggaatttactgaaaataataataaaatgaaatttgtttaaatattctgacctggcatttttcaaggctgtgtgtgctccagatttcccctacatgtctttctgaactttcaaagcaaatacaaatattgctaattaaagctgtgctcactgatatttagctgacattattagtttcactaagtcacatttattgtacagtacaggttttatgtctgtaatgtacggataaatacatgtgtgcttattatattaaggttacacaatataacattatttcacgattgtaaatgttgacaatgtgtacctttgttctcatgtcattagttttatatagcatatatttgatatatacgcttggttagagatgcgataccaattataacgtgtattgcattttctaagatcaccccctagaatggcagcttttcaagagtagcaaacttgtacttcttacttgctgctgaattccaaatgcctacaacattgcctaggaaaagaagataatttgtgttcattttgcaatagttctagccatctgcagaaaacttaagttgccctatgtctgactcaatttgcaaacactttctagaattctataaacactaggggaaaaaaaaacggtacccttacatgcttgtactctttctctttagttcaaaaatattcatgtaatatagtactttggttatatttagtctgttttttaaaggaaagaatattccttgagcactcatctatgcaaggtgaaagataaaactacaacagaatatactcttacttgccttttgatttttaatagtagggctcaccaaaaagttaaatcatctattactagactatgttgatttcaactttttttttcttctttttcctttgtatttagaaattttaagcatttattaatgctcatattgacttttcttggggttcttatcaaggttctggtctagtatgtagactgtacacatcagtcccaccataatggtcgaccatgtgtaaaattcctagttctgtctggttagtgcctgggcctccatggactgtcttttaatattctgatgattatctctacataggctgccagatacttccaagaaaaaatccgcctatctaggcttatgcatgttatataataccacagatatgattaggttatacacacatttaaaatgctgaataatgaattattttagattttcaaggatgggctttctagaggcattagtcacttggcttgagtgtacccagatcctcaaagcataatccattgagcatacctttgacagtgatctgtgctattgcttcaatgacacccagtgttgacatagcaacacaggtgtaatttgctgactgtcttacatcattcagttctagcacatttcttcctattggcatatcatcttcaggtgtcagatcttctgcccccaacatccactttacataaggcattggtgaccccacggccacacaggtgatattaacgcttccgcctggcatgatttcatgattagtgggtgggatagagaatcttggtgggacacggcgaactggaacaaaacacaagggaaatgataacatatacaaggcaagaaaaagtggattattaaacacatgacatgcaccgtacagacacgattcaacaattgaaacattgtggattgtccaaaaacaaaacataaagaaaaactgtggataatacagaccatacaagtatggtgtgtgtatacacagaattatttatttagtttagtcattgatatcttagacacactaatacaaaagttgattcagacctacaagggccccacaaaaaactatctacaaactaacaatacacaaacatcatgcataagataaacacaaaaacatatacatgcaggcatataacaatgattctatgcaggcatgtatatgcagaaaagggggctggaaggtcaccagcatgtttaagttgagtatcaaaaccaacttcagtgctgtgcacttccagttgatgtgaatgtaggtgtgggaccacactgtcacatcccagccctggaaaacatcacctagagtacactgaaagtgcactttatgttttcagattcatagtggatgcagcctcaagacctcacactaacactggaacaaacacagaaatgtatatacatattgatttacagtcacagaagaagaaacaggctaacaccagtagagatactggattgggtcatgcaaggcatgcacaagatggaatctcaaggcccgtgctaaggatattgaaagaatggctggaatccaagacagcaatgaccgcagaagaaataagggggcaatagaaataaacgtgaaagggggaggtaaagtataacgattgaaacacagggacttaggggatgacagggttgaaagacagaagattaagctcaagttgttaaaggtaaggattgcaaattcagaaagggagctgggtgtttcacatacaggattccattcaattcatatcaaaggtaaaacaacataaatgacaacaaaatcttttaaaaggctttttatgcccacattcaaattgagggacactggatctaaaacatacagcaggacatgacattaagagaagagatcatattaaagcaacataacacagaaaaattaccaagcaatttcagttcagtgttcctgcttcagataatctgcaggtttatgtgtgtttaagtaaatgtgttttggatgtgatacaaggagaaagtgaaagataaattggtttcatctggggcttttactggcaaaatgtcataccataagaatttgagatctagagggtaatctttagggagcacaccttaaatacatttaataaagattttttaaaaattataaataaactgataagtaacctcataaccccaagaagaagataagtaattctgtctgaaaactttttggctgctcttaaggtcgagataaacctccgcttatttgagatggctcactgcaatggcctcatgggtgaatgacagtcataggagaagaagagaaagctaagcatgcctcctgcagccaattcacagaggttacacaaagcaagcaggagccagtgtagactctgaggtatcaaagaacatatcaagaaaaatggaggagagtttagtcttcatgcttgggattaggggagaaactagaaaaagtcattctatgggcagcaggcatccttataagacagaaattaaaggcagggtgggagatggggacagtggagcaggaaggaaagcaggaacactgaccaagttcactggaccttacagagttaagtgttaccagttaccatgcacccaggtacattctctcccaccatgcaccacagttagataccaccagcaagcaccagaagccatggccagggcattctctgctaaaacataccattaaccaaaagaagaacacaatgcagctacattcatttcatttgtattctttgttattggtttaattaatagttttgtaaggtgggtaaaaagtaaaaaacacaccaaccttctcgcagctctgagggatgtagggggtttgatgcagaacacaatgaaatgaggaaaggagaaaaacaagggaaacacagagagagtaaaaaggccatatcaaggctttcaactgctacttgaacatctttattcgctctagttcatccttcctatctcagctggaaaagttagcaatatctcacagactaacatggtattagaaacaatagctagcatcattttgaaattttccatggaagaaggtacacatgcctcatgcagcaagggaggtcactattgtggaaaaaggatcaagggactttcgaagaatttagagaagaaatgactttcttcatatttccccaccccagactccataaaaaaagaaaggagagaaaaacatccccagggaaacaaaattacctctaacaaaaatttcaaaatcaagctaggtattttcttaagggaacccatcctattgtaacttaaagccctctcagtcttttctttaatcccacccccacccatgcctttgtggttattcacagatatgtagaccaggaataagaacacttccactggataaaaaaaactacaggaactggctttgagaactctcgggaagaggaagtacttctttctagttgaatggaaaggcatagccattcataagctcacagtttaatcatttctattacttcatgagaacatatgaatgtatcctcataattcattcttgtctcaaggacaactcacattactatttaaaatacagttttccattgcaatcaaaaaactaaatgtttcggtaagtcttaataattcaaacaaaaaggtgtacatatgtgcacatatatgaatacacatgtatatataatactatgtgtttataattaagaaagtatacgaagacagaaatgcaactgtgctatttgcatgtagcacttgttttatagagttagcagctttatccttacagtttcagcagcaggggtcatgaagacataaacacctttatgcttggaattgcacagagaactgattagtagcacaccaagcaattatttcaggggtttaataaggaaacagaagagaaacaacagaaaaaaagagaaagaaaaagaagaaaacctcaaacaaatgcaaagcacagttcaatcaatacagtaaaaatagaaaccaagatgtaaaaatgcaaatatacttacaaactccaagcctcaggacagattatactcaagagttgtcttttggagttaaacaacacattttaaatttttaacttttctatttactaacatgtttcagctacggtcactattaccaaaccagcttgttaactactaatataacaacacggaccctgcggcgtctcaactccccctgagcctgaatgaagaagcgatgccagggttatgtcattcctacctctgacatataaattggcaggagcggaatagcgagtgcccgcgctgttggtggcaacacactcatattttccttggtcagactcttcactctgctcaatctgaagggctcctgtatggatataaaatatattgccaaagagatgatcagagaaggctttctcagttcagaaagctaaacctcttaacaatatgaaaagccctgcaaagcgaaggtccactcaacgtcgattcaatctcttgctaagttgcacagacagaaaatgatgcgatgagaaaaacatatagagattattttttttttttacatcatcaatgctagcattagaaatcaatatctcttttcccaagcaagacttctagtcataattaacactcttatttcctagactaataaaatgaagatgggtgagactgcttcaaggaagtatggcttttaaataaaacaaaagattaatttttggttttgttttgtttcatttgggtaccaaaagtggcgcaaaagataggtacgctcaaaaaaaaccaggctgggttttcaagaaagtcttctgctgaagagagccaaaaatacgcagcgagcacaaaaaggctgcacaaagcaaaaaattaaaattagtcattataaattatcaaaatatcacttaaagaaacaaaactcccttaagacatgcagatttttaagaaaagaaagacagttttccacgacttacaatcatttattacgtttgctgaaaaacaaagagcagttgaattagaagatttttaaaaagttaaaaggcatggcctgtgccacaaggaagagccaaccaaccactgcttgaggaccctgagatggatcccctaagacacccatcaaaatccaccagtgggattagcagtgtggtgtcacaaaaccccaagaaaaatacaaaacaagaattacaaaagaaatgcacactgagtcgaagtatgaaaaaccagcaataccacataccaccaagaatactgagcaccttttgtttccatagcctgaaggacagaagatccaaaaatccggagacgagtaatccaagaaaaaaagaagtggggaaaaaagcattgctgtcagattgtagacgagtgggatcaggtggaaaggggagtcattctttgacttttaagacattaagagaaaaaagaattgaagaacaaaagcaaaaaccttttgaaagataaagacaaaaagcagatgctccagggtgtcttctgcatgtctgccactgttctccagaccaccttggctttggtccagaacaagaacagctaaggaagaaaaaaaatgatctttttttttctccggttggacaaaaaaaaaggaaaaagaagaaaaaaaaaaagaaaaaggaaaaaggaagaagaagaaaaggaaaaaaaaagagggacagatggtacgctgtgactggtctgtggtctaaagacctggatatgctttctttgaagcatatcacaacttaaataatcattttcataaagaaagaaatgaacaaaacaaagagagaaagaaaaaggaaaggaaagttcacaatatgagagtcactgatcataaccaaacagtacaaagaaaaaaaaaaagttgatggacattattggaatgacgctgaaaacaggacaaagatgagagggatgaaaggacagaaagaatgagtaagatcattctgtgaacgttagttcagcactcttacctcttattggtgtaccacctgggtggataatatgaatgcaaataagattagaaagaagaagcattagtacgagaagaaggaggctagggctggggagaagaattaaattagatttacagaattaaataaggtcttaaaagaaacttgaattactatattggtaaaacaggaatatattagatagtattattagatcataaaaaacaagttgcattataccacagagggtaaagaccgcaataggcagcattgcctttctcagagaagcaactgagttttcaggtctggggtcatatagggttagaattatatcttatatgcctcatatctcttaaaaaaaaactatacaatatttttaaagacatagtttaggaaaatactggctaatctatttaagtatatatatagatatgcatatatatatatactgtgataggaaacactaaagactaactggaaacaaacattgttgattggatatcttatactacttgctatgctacattggtgtgccataacttgtgtactatttaatttttctgcacagtgttcttacgataacagttctgtggaggtgtgtgtgggagccactacagagatctggtgtctacactgacagttagtaaaatgcatgccatgcattttattaataataataataatattctggatatggaaattagtggggttgaagtgcgcttcagaactaagcacttaccaatagattctggagatttaaatacggagagaagaaagacagcataaaaatattattatattccttataatttggtacaaatttttcagagttaaagctttatatactaaatcatctatgttacatgtgaataattaattcttcatttacaataacagaatgctaatctacacaattctgctgacaacaagcaaaagaggcagttaacaagacgctttaacatcacaggacaggtcaaaagctgagaattctgggaagacaggcagttaaacaacttagaattctataccaatattactaccaatgtcaaagtaaacagcttattattatatatccctgtgaaattacctagggacaggctctaaaacttaagaaatttagaattatctctacttttaatctaagagagcaaaggcataaacttgggatgggaatgggaaaaggagaaaagggtaaagagagagagaaaacagcaaaagctggagtctacaccaaaagcagacttctgtagatccagtcactggagggttcaaaaaccttgacgggcgcacactactgtggctaatgtgtagaaaatgttcactcacaatgttattatcatagtattaataaaaatcccctccttttactggtattttctaaagacttttaaaaacatacatctggttactcatgagataacgtttctgtgtttttatgtattagtgaaaagaaagcagatgtgcccagacttactaaactttggtactttgatgagttcaaatgtagaaaagatagcagaaaacatactttaataaaattgaaacattttagggtttaatatgaacattttattttttaatggatacaaccattggatctccttgcaagttctgaatgaagtccaatgttgaaataaatttgtttcaaaagaaaacagagaaagaagaaagaaagaggagaaaatggatccatcaaatactgcgaaaaagcagtaaattaaaaaattaccaaaaatacagtcacagcagtgagcaatgtggattaaacagaagctgcaaaacacacagagaaaaggagaaagacagactctgaaacaggctatgacatcacaaacatggaccacccattaagtaacagagaaagagaagagggagaaaaatcagtacctagaaataaaaaataaattaaaattaaaaataaggagagagaaaaattaaaaaaaaaaattctctaggagttagtagaaacagtaacaagaccctacctgatcgtaactgcttaatacgaccattgttgttgcttgtgtccacaggtaagaaatctttaaaccaagtgatttctggatccggattaccactggctgcacaaagcatggtggccgtgcgagtacgctcaaccaccttcaactgtgggcccatgtcaatggtagggaagcccctgggaatttgatcttctgcaagacaaaaggtgatagaaacattcagttaataagtcagatgctccaaattcaagagattccccagaaatctctctttaccttactcagtgcttgttgagaacctaacacaaaccaggcactaataaattagaacacagtcacaatgctgctactgatcagaagagtaaacactctatgtaagaggccaacagactaacacagagctcagacggggccgactatgatgaggggatgcagtgagttttccaagagcaaagagggagaaataattatagggtttgtgcttgagatcagtgagtacccagaggaagctctgatttaaagtaggcatttaggaaagaacacaatcggccaagtcacaaaaaggggagaaggagattttagaaagattcgggaatgtcacaagtgtaggcattgaggtaggaaaggttttgccgagagagaagcatggaagccaacagtgccagcttggagagtacttggggaacaagcagaagctaggtcacgctatctgtttcaaagctggtatgtttttcttataactctgttttccctcacaagtataaggttcaacccaaatcgattactttgtaagagcttcaattaaccagaaaattgtctgaggatgctttgaaaaagaagagcaaaagcaactccttattaatggcacaaaaacacatgttccttacagggataagagaatgctttcctccatcccaaagatctgcatcattttcagtaattaaaaagttgaaattcctaaattttgaatctccaactcatgcaaaattcactttttgctacccacatcgaaactgttccagatcccagctcttgagaaattaaaatcacttaaatcccacaatcatgctccacactgataactgacattgccagctcttctagccaggattagaaaggtgtgttctatctaagcatcgaaagaattttagttagatgggtggcaattatccaaattagaacatggccatttgtttgaagatcatgaatttttgttattatactttaagttctagggtacatatgcacaacgtgcaggtttgttacatatgtacacatgtgccatgttgatttgctgtacccattaactcgtgatcatgaaatatttttacttccaattgagtctggcattgatttaatcaataccccctcacggccactgataaattttcataagccaccaattctaaaattactcgaaagcataaacagcagcgagcagaacattagatatcatcagatctggcatatcgcttctccttgggtgcctcctacaagctccagtataatccatgaattcacagttgatggtgaatcatactgaggttatgttagaatttctaatgaagaagctccattttgatgcctccaccgtgttgccagtcaacagcatgtgttctccaactctctccctctagagccgaggggtaaactcagtctcctaaacctcactagcaaagtccttttcaatcaggtctcatttttctcagcctcttagggatcaactctctcataggaaatttttcttctgcccacattgaaattctcaccacttcccagacaaatcatgtttgctgggtactccgtgcttctaggaagccacgcagccaaagtcaccttctttgtaaatcttttccaaattctctcaaacatatttcattctttcctcctcagagctaccatagcagcggctactcaaatccactgtcttgtacttattaactcatgagtttatccctccacaccaggagttcttccatgttttatctgtattctgctcccttgcaatcatgctagcctgggtttccagattttaagagaaactccactgattcctaagcctaagtatgaatatatatcagtgactgtttaaaaaatatatatatcctactatgcagaacttctggtagagaggcaaccagttaaatagttagggaccagagagattctgaatgtgaatggcgaaagaatgtaagatgctaccaaagattaaagctcccaagaaagagaaatttcactgaacagatgcagttattgtaagataaaattgatggactattaaggaaaagcgtagactctggctctcccgctgggcaggatagaaagtttctatcttttactaacacagtctgtgaaggaccaaaagaagctgaggcaagtttgatttgacacctgattcatgacataataccttcctatcagaccaggtagttagggccgggtactaaacacacttataaaaataattaactgcaatgagctgaacttcacttaagttgaaagatgtggctcatttgtggaagcagtaatacattgtttttgtgaatgtttacacatcgtcagccaagcagaggtctacagtagacaagtgtcagaaacagtagttaaaaattgaatttcaagatgatttttcaaggctccaagagaaagttaaaaattaaaagtgggatgcaaattaggctatgctggttttaataatctattccacatgaatttcatcaggctgttctttatggctttaaaggttttgccaatatatttacatctacaacatagttctgatgttgctggggggaaaaaggagcagaaagatcaatagctgctataccacacacgttatgttattaaatatctcacttggcagctattgacacaaagtgcttcaaaggataaaagtaatttacctcaagtgctccaacaccaactataccgccttcataaaaatgagtttctgaaaaagctcttagattttgttgttgttatgttccatttttaaagcaaccaacttaggttaatcaaaaatcaccttgcgattcctgagtggtttctgtatgtcctaggacactgtatctctcccatggtgtttaagtactagttacatttgcctgcataaatactgctctgctagtcattacttttcttctacaagttcatctctcggaagaactgagccaatattcagtgctgatcagtggcaagtgccaaaggcttaagattgttaagccacttactaaaggctcttaccaaagaaatctagatttaataaccgtttataagaaatatagtcctcaccttggggatagccgacaaaattgacttgtaccttcctgaaaagcagtctaatacattttcatgacctttctcttccttcctggctcataaagaacactccagagcccccttttcatatacacgagtgcacaacaaagataatctttcttgcatactaatgggacagaaaatgtaaagagcgttcctttcttatttttaataagggtaattaaattctatccatccccctttgcacagaatctctttgaatgcactttcttcgttaaattttcatgagaaacatcacaatgtaacagattcaaatagccagagctgttacacgttgacagttgtggcttgtttccaatttgactgtcaggtatttggcaataaaactcagtattcaacataaaacaaactgtagaaataatgaaatttctaattggaatgcttatctccgtgggtgtagtttagaagacgttaattgcttttttcttcaccttccacatttattagtgatttatataaaactgccttggccatttgataacatcaattttgacggctcctcaaatgtgtggtaccaggaacttgggaatcaaatcaatatccttaataacttaaccacacaaactttcacaggaaaaagcagctagcaaaaattaacaaattgtcaatatgctagtagctttaaacttttacatgaggtgaaaagaaaaacattttgtcctattcattaatgtgctcattaagctttaaagtgccttacttatcactgttccatattaatattcaatcatgcagaattagctactaattcatcaaccatttaaatcagacttgaccttcacaaagccatttgttctgtcattttgagaggccattaaagggcagattactacatacttgtgcttagtgaatcatagagtcatacatattttgtttggaatggcagctataatagacctggaaatatagcaccctctttgaatctgttggtatcttaatgaaatatgctgatacaaaactttcagttccattaaggaaagagaaaaatgaatgtaagcatcttccagagttaacttcccattgtggtagaacttattaacaaccctgacctacccaggacttgaaaggaatgaatccatgaggaaaatagtctgacactgttttgtaggtagtcatgccttacatatctgtgaatgatcaagtaacaggttttacatgatttgttcacttaaactgttttcactgttcatgcataaacaatattaacgatgctcttactttcactccactttcacaaacactgaatctcttctttgtaaggaagccaggaaaatctgaattgcctgctaaggctacaggctccttccaaggtggtcctaagtagctcttcttgcctaatcttgctagggctcttgctgcgtgaattcaaccagactagtcctttgactctgaccccaactgatttaacgaagtcttcaataaagaactgtttgccatggtattgggaaaaatcccaatttttaagattaatacaaatatgtttataaagaaaaagcgtgtcaattacatcaattacatcaatgcttcttcaagtgcagtatttaaaaatttggcaagtatacctgaacacttagatattattgacaatacagaggttttggcagtaatggcagtacaataaaacaaaaacacaatatggatgaagagacaagcagctgttatcatgaagcattcatcccctggaattacttttctaagtttcaaacagttcagagtggctcctctttaaaagtccccaaatagtgttatcaataaaccgtaataatagttagtatgtaagtgtgaactcttacaagctcacaggagggcaggagctatttgttactttcttcgtaaccttcccaatgttcaacaaatactcacaattagacatttttatgatgctttgacaattactttttcagcactcactcatgaggtatctctcaattcctcctggaatgtcattcattgaaataccattcctcaatgccactcactgaaacagtcattcttcaactgtttgtgactacacatttggcctccttgagtatcagtctattaagaggcaaagctatctcatagtctcattattttagtgtcataaggagtattagaattagagacttaaaaaatggctgtttgtgactttattttcacaatctttagtttcgtcagcaagtgattttccttccattgagaatatgcaatttatgcttttaatttatcacggttgctatgtgagaagcacacaatttagtccttgcttccttcattttacaggaggctttccctcatatattggttttcagttcctacgtgtcagaagcatgaccacatgacaaaaccacatgtataaacacaatgacactgcaaagaacacaatagaacacgtatctatattctactgttattctatctatagaataacaatggaattcttggtgttgaaactaatggctaaaaaagcccaggagtgaaccactcagtttttttgttgaggcaaacactgtgggtcttccttcactgacaggaatacagatttctaagtcactggatatcttacggtttgagtcattcatatactctcacagaacaagagtgatttcttttctttgacgggtggaaagactgagtgagaaaagttttcattaacataagaaaacaagaaaaatgatagacgagtaatatgcagcgtatttttaaaatgacattcctagagtatatatatatacacacacacacacacactaggactgtcattttaatatatataatacatatatggactttttcacgtgtcagagaatcagtagtgttctatgcagcagaaagtcagtggatttttatacttaagaaaaagtacgaactttctcggaaaatttaaatacacattggtcttaaggtggtcaaataaggtggccaaatagatactttaaaacaagatatttatgaaaattacaccatatattgaaacaagaagataatttgaactattagttctaaaaacctaccggatagtcaacagatggcatcattcattctacaaatatttattgaaggcctcctttgtgctggactgggccaggcactgggtatgaagtaatctagataatctctatattgttgtgatttaattgtatctgcaggataattagcttctttgaaagtaataatagtaccaagcacatacacaggaagattgaattagatgatgcattaaatgtgcctagtgctgcctggcactagtgtctggcatctagtaaaatactagcatatatgtacttgctttattccaagctccatcaatagatctaaagggatcagaggcatgtgactctaaggcttgatcaaacaagtagtgcagcaataaactgcaaatgagaaattattctatgcaaatcataaaaaacaggggttatctagacacgcaactaaatttaaagcatagtgtttgtgccaagtaacctctgcaaagccaataaataccctcttttccctttgaacaagattttaggctctttgattaatcaacagtacaaataaataaaatccatattgtcagatgatttgttcctaaaaatgaattttaaaaatagctctaaatatttgggatgtcaaaggttgttgtgaacaactgaaaacactggaaccaactgtttttccctatatcatggcaggcatttttcttttagttattcagggaaggggcattaagtattcctcatcttggggagtaggtcatgttaagaaggctatatggctttcttaaagaaaatagtttttaaaaagatgatgccaagaagtcagagttttgttttttcatctcaaaagtttcttaacattctgaaaataactgtttggggaaaatgatataaatcaagaaacacctctgtacaaagtctccataaactagttctaatagctccattaattgttcagctctggagaggggaaatctctcgatgagatttgtctaatatgatgctcttactaaatcccacctttaacagaatggaatttagtcagaagatcatattagacaaatttaaaattttacctaatgcaaagcactataatgcccagtatctctaaaatacaaatatttgaaccttattagagttccttgaggtaaataaggatggtatcattatcatttttttgtggctataaaacaaaaactcagtaatattgttatttgtttcatatcctacatgtagtaaaaaattaaagaaagtctttcagctctagatttggtgtctttttattgtgtcatgtttcctctatgcaaattgctattcttcaaataaatcttcatcatgtagtgatgaaactcttaatcacagtcaactcatgaatgggacaacaaaagagtttgaatacttggtcatcctttacttttattttttaaatggcatggactagatacgcaagttccatgagatgtaataatactttaaaaatagatctacattttaaaaatccacatatatatacatacatacacacacacatatacacacacatatatacgtatataaatgtatatatgtgtgtgtgtatatacatatgttataggcttctcattccctcaggattggttctagaagagacagaattctgccatgtctgttagccagtacaaggtagatgagaaatggaagagtgtgaaaaggctgataaatgtcaagtaattttcctagagagctgagatttagtactgtgcctatacctttagcccttctgtaatttctacttaattacctaggaagggctgagaatggcgggccttctgccatgagcaggcaccaaaagtcagtacagagaccagaaaagcagatataagtagacctaacatatctaccctatgactttgggccacaaggtccctcttcggtttatgggactaataatgactactccaaagctttatctggacagggagacagatcagtgtctcagaggctggaaggcagaggattatcatagtgtatttgctactttgtcgaacaatgagttttcaagtcattacatttcaaaatgaatcacagtatcaggctacaaacaaggaccaccattttctttccagaatacagtccttgaagaagaggaaaaaacattcttttcttaaaggaaacagtgtaaataaagcttttattttcaccattccagatggcagcagggtataatttgtactgtgttgacatcatgaccattattattcaaagtcaattttcctgtaagtgaattgaataagggactgaaaacagaaaaataaagagcaaagaaataaaagctaaatcaccgttttctagcaaagttgggctcttgggccattatcgaaatgttacgcatatgaataaaattgaaaaaatcatatagtttctaattacaaatcaaatgctagtccagtcagcaagaaactatataaagcagaaaaaaaaactgacagttaatacatgacattccaaatggaacatacgataaatataagatctgttcccaaaaaagtaattatgaacaagatacaaaaatttttttcccaaggtcctctttgcaagttattacatacagatagtatgcttgtcttaatatggctataaatcaatcagctaagcttttatttcagagtagatttaggtatctcttaaaggcagtcactggatacaagagtctcgaaagatttctcatagaattatgccatgcaggaatagaaaattggacattgttaagctaagagcctcattagcagctactaaatattcagcataccaaccagctacccacagagcattccagagcaaagctccattttatgaaatattcctcacattttgaggagtttgcaaggtactccgggcagagaataaaacaaactgtttagaagcaatgcatgcaatcatcctacaaattacaaagtaatgtctacatagcagaacataaaccccagttagatttaattatcatttgtctaaatgtggtagctccaagtttacattgcattaagttaaggcatactgttattagtgctcggcctgagcaaatgattaccctttttgtgattcataatcaaataaacgcattgagaaaaaaaagaagtaccttctcctcctacctagtaacactattaatacctgaacgtttaactaaatacttaggcatcagggaaacacatttattcccttctttgggattcatttagataaaatccaatatccatccactttcacaaatctcattattccctatcaatttatatttatcaacaagcaggtgtcattatactcaccctttacatccatccaaatgtttaccttactttgaatattcaaataattaaccactttaccgaaatgtatatttaaatcataaaatgaattttattatttttagaaaataattttttattcttgttttttagaaaaagaggcacaaagacaaaaatagtaaacaaggaaagagacttggatttggatcctgcatccattatttgttagctttgtaaaaagttacaaaccaacaagctcaatcaaatgggactacagaaaacattcaatgtggtttcttcaccatattttggtaaatataagtatatatgaataaattttctaagccatcaaatgttataaaaaaaagaaaatcagaatcaattgtgtagtgttggattggaactaatagtgttggtgtgaacacctagttttaaatatatatgtacacacatatatatatacatttgtatacatatactatacatattttaaatatatatgtatacatatatatatgacttgtaaatgagtatgcatgcacaaacatacattctttatataaacttagcaaagacatcttccctagctgaaccaagagaggctgggagcagtaatacccagtagcaatggtcacaccttgtattcagatcttggtttctaaataccattctccagttgaaaggaaacactttcctttcagaaagcttcccttcagaaaactccttagagaaatcactgattccaattaggactggaacaagcaaagaatgagactggaacaagcaaggaatgagaacaagcaaagaagacacaacttatcctgttgtataagaaaatactcaaagaatgaaaggtatatactaaatgtacacagaagccagcttaaaggggctcttattgaccaaatattggacaacttgaacacgaaaattaaaaaagacagtattaacaagttataacacactgaataaaataaagacatgcatccatactgatataaataactgagtaaattaaaagtttcaggagaaatagtatctttacatagtatcaaagggactccctacataaatttattaaatataaagaaagcagtctgtgagagattaaatgatagggaaagtcttaagcatctcctagatttgcagtatgcaattagaaaccaaaaatgatgctccttatgctgctgctgatgccaatgatattaatttagaaaataatgctcccatttacatgattttgctgtattctaagcacggtagtagtcctaaaaataccattaaagacaaataattttgaagttttaaattttaaaaattttaactatttttaaaataataataaaatatgtaaagaaaaattagtaactttacattggagaaggcttacagaaacaaccttgattaaaaaatcaaagttaataacaccagtaaagggataattcaaattcttgtgctgagaaaaatataacatcacttccacaatattcctggaaaagagtcacaacctaaatatgaccaccagtaaacatcagcaaaaccccaaacaagaacattttgttaaataacaggctcgttatcttcaaaactatcatggtcagaaatgtcaaagaaagactgaggaactcttccaggttgacaagtacaaaatacaattctgaactggagcctctgtggaaaattataaaaacttgaatggcgataactggtgaaacacaagtaagaacaactggaaaaatgtgatcaaaagtgaatgcggatctaagaattagatggttatgatgcatcagtgtttacttcctgatttcgatagtcccattgtagttaggtaggagaatgccttgtttgtataaatctgagtatttgggaatgacaggcaaggcatcatgtcggcaattaactctctaacagttcaggaataataagttctttgtactgtagtttctacttttctataagattgggatcatttcaaaattttaaattatatagaagtaaactgttataattaattcatattatcagaaatatatagacttattcccaaagcatctgggtagctagatatactcaagcattgctttcccaattgtgacaaacattcttaaatatatactttatttgaggccctcttgaataccatgactatttaaatgacactccaactgttattaccaatttcacacaaatgatgacaatatctgaaaaaagttaactctaaaaatacatgaattcctataaaattaaggcataagtatttaattacaaacaatgaacaaaattgagtgataactcaagagcaaggtgcaagctcatgaaaagaaaatgtgagaaatcaatattctaataacataatgcacgtttattatttttatttagagaaatgataaagtctgataaaaatttaagatagaagacaaactttttgaggatcttccttccaattaaaacataattaacttagaatagcttcagaaatccaaatgttatttttttaagccaaactttcaaaaattttagaaacaatccaccttcccctcagctcatcacagttctctcttcctgaaacaagaacacattacagaaaatggttgttaccctctagtctttaataatgtaaggcaatgggagcaagaggaacaaaataaagtgactcagatatgtctaaataatttttctaaaaagagcatttcactattttaccacattcagtaacagtttttatagttttaaaggcaaactgtggtaggtatttgttttatctgacaggagaaaattgattctgaaaacagaggtaatggcagttttctttagagggtgtcttgaaagatgaaaagatcaaaatcttaaaacatcaaacatcacatataaaatgtttcactgaaaaaatgaaaactacaggagtacatgaataagcagttaaagataacttatatgtctcagaatgtattacagatctatggggaaacatttcccataaatgcaaatagttttctatttatatggcaaaattcagcctgaatttaacaccagagaataaccaaatggaactaggttttttgttttgctttttatagatagggtcttgctctgtcacccaggctggactgcaatggtgcaatcatagttcactgcagcatcaacctcccaggctgaagggatccttccacctcagcctccagggtagctgggactacaggcatgtgtcacaatacctggctcaattatttttatttttcatagagatgggtctcactaagttgcccaggctagtctgaaactcctgagttcaagtgacactcctgcctccactctggagcagctaggaccacaagcacataccaccatacccgtcttttcttttattctttttgtggagatgggtttttgctatgttcccagggctgctctcaaactcctcctgggttcaagtaatccttccaccctggccttccagtgctgggattaccagcatgcgtcactgcgcccagcctttgtgtttgtttgtgtttgtgtgtgtgtatgtcaatgtatgtttttcttcaaaatctttgaaatcacaggactatcaatttatgaaactgcccaaagaagtttacaactatgatttatttcttttcgaaatgtttgaactttcctctctatcaaaagaatatcatatataaaagcaaacacaggatagaaatttattcactatgctttcaaatatcaaaaatattaagaagctattcaacaggagttcagacatctggaaaataacccaatcaaagtaaaactgccaaacaatggccaaaaccactaccaaaagttacatgaatgaaatcccttatcttttgcaactagatggaagagttgtcaagcatccacataaattctaaaaccttgaccttcttcttcaatagattaaacacagcaaattagaaaaagggtttcaggcaaaacctgagggcatacataaaggattgcgatctttttccaaaagcaaatgaaaggaaagaagggttttgaaggtaaatacaagtgtgtgggcacttcggtgcttgcgggcatgtgtactgggagtgtatgtcgcttatcacaaaattggcattaaaaaatggctttttaactgcattatgaaaaatgcattggggaaaagcaaaaaataagaataaagtgatgtaggcatgttatttaggatagtaccgagatagccctgtggcaagataaacttacattaggaagatgtaaggagatagggagaagtggaaaaagttcagaataatttgaatgtcaattttacaagggttggtaatattttgaagatgaggaatgaaggagaattatcagggatggctttctgaaatgttatgattgtttgcatatgttttcagtcatgtcttcccttgggaagcaatgtcatgtatttgaggcactcatgaaacagtatgcctctatgaaggactctcaccaatagagctgcccctggatggagcacagcactaagtacaaagcaagtgtctgtcagttgaacactgatccagcttttccttcaggaattggcaaaaggggctcgtagagcaagccgtttgcctccttatctgctttgtctcaggatgaaggcaagaaatgtctgcttcagcctacacacgtgagctcagcatcctcactacagacgcaccagaagttccctgggagccagtctagaatgggttgtaaatacccatggatttgcatcagttttctccactaatagctcaattcctgcaatttgaagacagttgagcatgcaagggtagtttctccctagccagaaaaggaattcacaaaatattagagtatgacagccaatggtctcctgaataagaggaagaataatttgagttgtgttcctatgaagacatgaaattaagaatctccttatagataactcacggctgtcacattttaatatacaacatgccaattaaatagatataagtttccaatgataagatgatactcagaagcgatgtaataaaacctttttcttacatattgaaaacaacccagagctgctcattttcgtttagttgtaatagactgacacattgttataaatttgggaaacatacaatctctaattcttaacaaagtgacagcaaattgacaacaaaaaaagttttctcagccttgaattcactggcatagcaacatgacataatccaccaatcccccaacagccacgagtggatggttttgatgtttaccacaagattaatgccccttcaattgctcagtgatgatggctatgaggctgctgaataaataatgtatgtgcattcactaaaggaaggaagaatgtgtatttcagccactgatccctaatataaccaatgctatttaagtgtttgttgttaataaagataaaatactatgcaatacagctttgtatattatacacgacaggttttgtgagcaaattatagttacatgggcacatgttgtcatttttccggaattaactcagaagataaaatataatcaagaatgtttccccagtgggaaaaagacattttcttttcctttttttctttttgagacagagtcttgctctgttgtccaggctggagtgcaatggcatggtctaggctcactgcaacctctgcctcctgggttcaagtgattcttctgcctcagcctcccgagtagctggactacagctgcgtgccacaacacccggctaatttttctatttttagtagagacggggtttcaccatattggccaggctggtctcaaacccctgacttcatgacctgcccacctcagcctcccaaaatgttgaggttacaggcatgagccaccatgcctggccaaaacattttaaatttagttttattttcatggatatcatagcccaccatagtactggtttttgggggttgaaggttcatagacttccatttgctgggaacctattgggtatatcacatgcattaggctggtgcaaaagtaaggttttgccattactttttttttttttttttttttgagacagagtcctgctttttgcccagtctggagggcagtggtgccatcttggctcactgcaacttccacctcccaggttcaagcaatttgcctgcctcagcctcccgagtgatctcgaactcccaaccctcagtaatccgcctgtatcggcctcccaaagtgctgggattacaggcatgagccaacgcacccggtcgccattacttttcaatggtaaaacagcagttgcttttgccattgatatgagcaggaattaccttgcaggaaaataaaaaaaataactttttttttttttttttttttgagacagagtctcatctgttgtccaggctgaagtgcagggacgtgatctcggttcactgcaacctccacctcctgggttccagtgatcctcttgcctcagcctcccgaatagctgggattacaggcgccagccactgtgcccagctaatttttgtatttttagtagagacagggtttcaccatgctggacaggctgatctggaactcccgaaccttcagtgacccaccattgtcggcctcccaaagtgctgggattacaggcatgagccaccatgcctggtcgccattactttcaatggtaaaacagcggttgcttttgtaccaacttatacataagttgcatgatttctcacagacttaatcctttgacaataacagctgggtcatactaaagacagtccttttttttttttttttttttttaattgtcaggaggcacttttgtatcaaagtgccttcttcaaagcttaattcactttcctaaaacatgatgaccagggtttcagaacaaaactttctgggatattcactttcctggtgcttcttaatatgacagagacttaaacatattctagcacacacaatcgtagtttttaaatgtttatcttggttgtgaggaaaaaatgcagctagtggtagatttaacaaacagcacattgctccactctcacctctcttttactctccagaaataatttttgttgattttcaaattcatttcccaacatcatggatattattcgttttcatacttatattttgtccttgacaaagataatattgtttgttcagacatacagggacccatttctgataattcagtttttcgtgattccaaatggaacctgtaacagagttaatcgggggtacctggactccaggatccctaagttcatgagacaagctgttttctggattattcttctaaaaagcagatcaaatggaaaacttctcaacaaaattatttatgaattgcaggacatgaggtagttccgaggaaaaccatgtatcttgataaaacgtataacatttcctagaacagagtcaactatcactgatttcatcacagtgattttcagaaggcaaggactatacagatcaactgttttacagtcaaagtcatgctctttggtaaatattctgaagtgtttgactattttcaataactgagtctacagagacattacctcattcagtttattaaagtacattatttctactgattgatcaccattgaaagttcaaatggtgtttaaaagggccttttagctttaagttgaatgaatgacatggatacttgtttataatttcataatagtttttcaagtttgaattattatagacatactttatggtataaattggtcattccttaatttcccattaagcctgttcaagaagaaatccaacaaactttatacaaactctagctaaacgtagaagtgctcactttgtccacctcaatttatcaggtggctagcctatccaagcacataatatcaccaacctctttagttttcataagaagatgtacctatttagccttaacacagatcagtggtaacatctgagatgcttcacttaaccgaccacatagtgttgctttcatctgtacttatcagggatctcaatcttaaaatgacagtcaaaacaacttggccagaggagtaatatttatggagaattagctgaagttatgcaatttcatccactcctccatataatataaaaactgattttggttagctaaaggatgagagagctagaaaccaggactgttttctctcatctgctggagaacagattaaactgacatgtgttttgttataattcgacagattaacctgagggactttagcaagcaactgccctataatgttgtgaaattaaacatgcatatgatgcagagaatagcatttactatttgactatatcctcgttctcaagaactatgggagagaacttttcccctggtttcaggggaatattatggtttttctttcttttttctttttcttttttttttgtgagacagagtctcactctgtagtccaggctggagtgcagtggcataatcctggttcactgcaacctctgcctcccagtttcaagagattctcctgccttggtctccccagtagatgggattacaggcgtgcgccaccatgcctcgctacttttttgtatttttagtagagatggggtttcaccacgttggccaggctggtcttgaactcctgacctcaagtgatctgcctgcctggagcctcccaaagtcctgggattccaggcgtgagccaccgcacctggccatactatcatttttctaaagaactgatttgttatttatgttatggacatgatgcatctgtgtcacagtttccctctttctcacgtctagagatgttagtagatttggagctaaaattgtggtttatttagcaaaggcacagaagtccatggcatggaccgtatgcacgttccaactatactcctaacattaacctgtcttactacaaaattttcctgctccactgtcataccattttatcttgctatgtgaaacattcctccataaactcttctatctctttgaaataaagttatcatagacacaggcataaatattgtagatacaaccttttaaaaatatataatgtacaaaagtgatgatctgaaagatgtcagtacatgtccaaatgaatccacatttcccataacagtctgagaaatgttaaagtcacccaaagttatgctaaaccaaaaacaataaacttattaaagtgagcttaccagaaaggatataaaaaacttaatttagtaaacactaacttaaaggaaaaaataaaggaagaaagaaataaagatagggttaaataggcatagtgggccaggcatggtcccagcactttgggaggccaaggtgggcagattgcctgatctcaggagtttgagaccagcctgggtaacatggtgaaaaccagtctgtacaaaatatacaaaaattagcctggtgtggtggcatgtgcctgtagtaccagctactctcggggctgaggcaagaaaattgcttgggcccaggaggttgaggctacagtgagccgtgttcacaccaccgcactccagcctgcgtgatgaggtggaatcctatttaaaaaaaaaaaaaaaaaaaagagagtgactattatttctattttagaaaagtcacaggcattggatttaattccaatatcagcccatgataaaaatgataaatatcacaaagatatatacccacacaaaaatacatatataattatgtgtggatatgtatgtttgtacaaagcacatgtttacattacttgcagaaaattataatcacatttaacaaacattaaatagcagtgtattatttgttcaatttaacaaatatttattgaacacctctcagactctctgtgtaaaacattgctcagcacctgacagctgcaaaaacagtcccttaaaagttgtaccatgtaaggtgaaaacgtgcatgtgaacacagaaaatgtgtcaactaatcaaaccctaagggagcacaggggtgaataacgattttgctggagaccagagaaggtagatctaagagcatgaatataattttgatagaaatgtagtaaagggccttcaaggcacagggaaaagtataatctaaggtccaggaaagattaaataagtgcgaggtggattcaaggtgaaatgcggtcactgcttgaatgcttttgtttgcggacaggggtaggaagacagtgtgcaaggtctgttgaaggatgatgcaaagatggctggccaggtccaactgtgacaagctggaaggaatctggggttcatgtgttaggttgtatatgcatgcagctggaattttgttttttttttgagagaggtgttcactctgtcacccaggctgtactgccgtggcacaatctcatctcactgcaacctcaccctcccaggttcaagcgattcttgtgcttcagcctcccaagtatatgggactacaggcacgcaccaccaaacctggctaattttggtatttttagtagagatggggtttcgccatgttggctaggctgttctcgaactcctgacctcaagtgatccacttgcctcgtcctcccaaagtgctgggattagaggtgtaagccattgcacccagctggagctggatttttttttttttttttttttttttttttttttttgagacggagtttctctcttgttgcccaggctagagtgcaatggtgcaatctcggctcacggcaacctccgcctcccaggttcaagcaattctcctgcctcagcctcccgagtagctgggattacaggcatgcaccaccatgcccagctaattttgtatttttagtagagacggggtttctccatgttgaggctggtcttggactcctgacctcaggtgatccgcctgcctcggcctcacaaagtgatgggattacagatgtgagccaccgtgcccgggccacagctggatattttgaaccaaggaagtaaaagaaaaatcttcacattctaaaaagcaatctctgtcaagggagtgcagtgaagggggacaaagagaaagcccagttaggtagttactatattagtttaaatgtgagatgataaagtctatgtgcggatataacatagaattataattatgatcgttggaagagaaaggaagagatgagttagacgcatactggagaaacattccaccagttttagggagtattcattttacttaaggaaaaatggggtaagagtcagtgtcaagtttctagcctcttagttccttcgtgaatgatggtaggtcagcaggcagggatgatgtcactaatataaaagacacaagaagagacagagaaaggtcaagatttgtgtttctctcatatgaaaatgacagctggaatcatgcagatggatgagatgacccagcaaagaatttacagtgagaagagtatgggaaacaggggttttgcaatgttccaagtatgttttccacacagtaacatttttgcatattcctattaaataactaaaagggataagaacaattatattattttgcattgtagattttaaacatagagaaaaatatgtgtgaatatttgccttgtgaggaggggcatatgagaaagtaatgcaactttgagaggggagatgaagtaaaataaacacaagatataaaccccaagggaaattatttaaataggaaatataaaattattcaaattgtaaattatctaggaaaaacacccaataattctaatggtagcttaggatattgagccaattttttaaaaattattacaaaagaaagatactattcttaactcttgcttcaagccatgcaatcagacaaaaagggtaccatttcaagctctttcatttagcgtatctatattcagatctccattcatatagttcctggcatgaagcatctgaaagaagattaaaattaatgtaggagtgcaacattaagacaaacatcactgattaacttgaactgaaccaagctcaaagcaaaagccataacagggaatcagtcagaattgaaaagaacaaatagaagacttgtttagtttttactgtattccccaagaatttgaaaaatttagggtccaatttatattattaggaaaacaaaaagttgtttttcatgttctattggcttatgattgctctggccttttaaataggcctacattccaatataaatattgtcatgttcctaagattagtatagataccttacatgtatatggtacctcccaaatttgaagtgtcatgagtattaaatgatttaatgcatgtatggcactcaaaagtagatttgtcatatagtaaatactttaaaaatttactattaccactactgctgccactactgctactactagattgtatgagattaacagtaaaatcaaaactatattctgcattatttattataattagttgccctgaaatattttaaggccatcaaaatcttagttggttaaatgacctactggataatgtatctaccatacacacaaacagatacgtatgtgcttatgtgcacacacattctccaacataatttgtggaaagagtagcaacaaattaaagaagagatcatgattttcaatcacctaaataaatctaaatccatatgcaagagaaacctagaaatatggtataatgtaactgatagtataaaagctcagccctaagatttcttaatagatccattggccctatagtctacagctttaactatgagaactcctgacaagaacacccaaggcagatccagtgttcaatctttcttttgtacaggcctgggtcaggctctttagagaaataagaacgcaacagcaccaaggctgggtatgaaaagaatattctctccacgggcctgtcttcgacagtgagcttatgctatagctctcataacaattactcatcaccaacaatagcatcccagttctgcagtgacagtgtggttgaatagatttcactcctggcactcccatgataccataatggcaaatccctatgaaaacatatgataagactatcacttgggggtggtttttgctcaatagctattttattcccttggagtattttatctttcttcataattatatcaaagggtacatttctaataactggtaatcccttccttaagtgactttaacctccgtaggcattgggccccatgacccatagcacaaacatattttgtaattaaattttttttcaatttcagaagccattgaggaaatgttctgctttatataattgttctccattaacagacatttaatatgaaagttttcataatttaaacccatttaatctcatccttatatgcttcatatctcattttatttttgctgttttcaacaatcaaaacccttattattatagataagagagtatatggcagatcttttttctttctcttttcctttctcttttccttttcttcctctttgttttttaacgaaggctaatagttcttaactttagaagactaacaaggatgcaagagtgatacaatttttcaggagcctgaagtaccagtcattttaagtagcttcagattacaacctgtgtgggaaatagcatgatcattttcaattacttcatcatgaaggagaaccattaattagttttaactggaaattgctaacaacatttctacaaagtttataggtgtaataattcaattttccaaacataatgaagaaagtccacaaaatgttgactatgaggaccaaatcaacctctttttgcctagaataaacctgcacagactttatcaacatataatcagcagaatcaagcctggaatagatcaaaccagaaatgtgatccagtcatcctgttccaattaaagaatggaccatgtgttgaactaagcaaataagtgtagataaaataatctatgttgggatttgagtacaacttttctggctgtacttcaattgtagctaagatccaagttgaaaagttctggcaatactgcccccatacccaccatatattttaaaggaagctatcaatgacctggaccagaggcctgtgaccatcaccttgcttttttcaggcgatggtcacaggcacctccttgcacggtttctaacagaagacagaactgacctattaccaataaccacaaccctagcaaaacccaaatccaaaccccatttatatacaaaactgagaaaaggaaaagtcacagatctttggaaagtacagggttctttctctctgggaaaaatcattgtatggtttggcggtgcctgtcaaaaagggaaagtattagcaggtttctcttcttgctgtgtcagaacggaccagcgtgagagagtttttgacagagtatgacatgtgtttttggatttggtatccacttttctcccagagcactgtataaagaagcctcagtgaggtgcatggaaagaggacagaggcattcacaccaaaccaccttcattgcactcttcagaggatgaagaagcagccctgggagacttctcgcagcttcaggagaagattcatgatgaacggaggccaagcaaataggaaatccaaccagcgaccagatcaggtaggcagcataatggctgggactgaatatggatgatgacccttctctggggtgttcatgagcaatgctggaggaaagaagaagccaaatgcaaccccaagaatacctactctcgctttgccctctgtggtggattgataatgaccataaatttaattctgagttggctatatgacttgcttttgacaatggggcattagtaaatgtgtcacaagtagatacttggcaagtcactagcactggggctgcttgtgagccccacgactgccgctgtgtgacaaacacttctggagaacaattgcctctgttgctagagccaatagcatgccacatcccagacacattctgcattacccagccatcagctaccctgccacatgaccacagacccaagagagagacagtataaatcacttgagctggcccagactagaataactgcccagctgaaccacagaatatgaagaatcgttagaatggctgctgggttaaacttgttataaccaaaagttgagcaaaacactagtgacctgctttacaaagtatattatggcaccctatagattacaactaaactcggatcccaaatcaacttaaaaatgctatgatacagtttttgttaaactgtgcctttatagaaatattagtgaaagaaaaaaaggaaaacacagagtagaaaccctctacggaagcagaaaatagtcaatgtggagttgctctgacctcaagcagcttgaaagagctcaaacagtgggcctgagtcccctggcgtggcgtgaaaacaaggagcaatttggtttgctttcatgtatcttctgataagttgaagtagtggaatgcattaattccactctaaaataattaaatcaatcctttatttatcagtcgtttactggacacttaccctatgcaatcaactacactatctaccaggagatagtaataataaatacgaaagctatagaaaagaaatgagagaggggaactggagtatacctttatgacaggtacatgactcagcattctaaaatgtatgctctcatcgcttctcagccttttggctaagatcaagcgtctaaaatgtatgttctctttttctaaccataaagccctataagaaccttcttcttatgctcagagaacctatataaccctattttaataagctatgaccttgttgtttgcctgtaaattctatcctaacttaaggagatggagcacctacagtatggtacaaaaaagaaggcggccagtctcttacgaaattcagagagaaaaagaccacagattagccgggcgcggtggctcacgcctgtaatcctagcactttgggaggctgaggtgggcagatcacgaggtcaggagttcgagactagcctggccaacatggtgaaaccctctctctactaaagatacaaaaaattagccgggcgtggtattgcacgcctgtaatcccagctacttggaaggctgaggcagtagaatcacttgaacccaggaggcgaaggttgcagtgagccaagatcatgccattgcattccagcctaaacgacagggcaagactctgtctcaaacaaaacaaaacaaaacaaaacccacagattatagttggggaaggaaggatttaaaaaataaataaaagctttgttaacaaggaggattctgagttatgaggaagagaaataaatctgatattgctagaaatagaaaaaaatgattattctcatgttttgatatcacagaaattgattttaatatagaaatattttaaatatgggaaagtaaaaagtagggaaaaagtccttgttttcctctaaatgagctataaataaatatcctttgggtcaaggaacttaaacttggagtgtagcatgtgctgggaacacagagaggtatatgatcaccccataaaaagaagaaaagtggtttgactgacacagaggccatactaagtccaattgtgacacattaataggctaagaaatggactttgagtgccaggctattgaagcaaatttagatggctaggtataaacagaaatacaattttataatggttctgctaaaaaacagaaagctaatcctgggataagaattcattcactgtccaacacgtttgtttattttgacctgttggtccaagcactgtagagctgtcagagaaatatatgaagcagcacacagaagcctgcaaaccccacaaaacactaacatatttgtgtttttatacgctttctatcatttttacgggctttggtgttggaagagtaaggtgatccaggatcagagtccatcaagttgaaacttaagtctctttgtacttatgagtatatatgacttagctattgaaaatccaattatgtatatatacactatatatataaaaaattgttcctccagatacttgcttctaatttgctaaatgttactatatcaagagaataacatttcttctattataatttactaacttcccagaataagtcagatgcctcctcaaatatttaagactcaaaggggccaggtgtggtggctcatgcctgtaatcacaccaatttgggaggatcacttgagcctaggagtttgagaccagcctgggcaacatggcaagaccctgtctgtataaaaagacttttaaaaattagccaagcatgacagtgtgttcctgtggtcccagctactcaggagactgaggtgggaggatcctgcgagcacaggaggacaaagctgcagtaagctgtgactgcgccactgcactccagcctgggcaacagagaaaaaaccaaaaagactaaaagggagtaaaagcaaacaaactcttacttggtaatcaaccacatgttagctttgggaagctgagagttaatgcagaaggtttttatatgagtccatgtgtatttccccatgggtaatttgatgttaaacactaaatccaagtttctcagaggaacacagtctttaaatggcagcagtatcatcagccttgctgccttctggctttctatcatcttcctttggacatctctccaaaatgggatctggtttttattttagacacaacttagaatgcagtttcctatagtcaggcagggacaatgaggatgtcaatgaaatctgaagtaacaggaaggatgctttgtctacatctagaaagagagtctacacgtgtaggggaagcactggagcacagattgcagatggactgaaagtgggcaacaaataagaagactgataaacattccactggaccacgggtcaaggtccatcttggactttatattgcacccttggggaagcatgggagtacagaaatgggtcagagcagatgcagatctgtgaagacatcttcatttctctgatgtggaacaaggacagatggatgtaaaaaatgtgtcttggcggatctggaaagagcatgctaccctttgggaaaacatctgggctgttacattgttttacagcacagaaggcaagaatttcaagctctctcgccctgcttaagacttctgtcattcttacactactctgtcactgagaaagctaaaaatttattcaaaggtctcttcaatgaaatgcagattaaaggcattttgtgcatataagtctggtctcttaggcagcatttaactttactatgtccagagcatatgtcataactaatttgggtcatgtttgattactcactatgggtcaaagttgaaattctgttgcaaaacaccagagtaaacttaaccatgaatgtttttctaacagtctgtgactaaatgtgtaatatacactaacaacaacaaaaatctgtggccaatcatggactttctaatgcttggaaatggctgaaagtatatagaggatattcaaggccaccaaaatatactgtgctaaaagcacttaattagcaaaggctaactatacatctgcatgtacacatacttgtgtattttatatttctttatatatctgttagaataaatatgcatttaattaatataaccacacatttctttcctatccaaggagtccacttgcatatatacaagggtttgctatattataagaggtcactttcactatgcacttagttacatatgcttattctgtcttagaatgtacaaatttatcattttgacaggtaaaaaaagtgtaagaatccaagcagaaaatatttgaagttacagcatctggattggtaaggaggctaaaagagatagcataggtgacagaatcgaacccatgtctttcattgatggtacaaggtgagtaacctaatgaattagaaagacaagccaataaaaggtcccgagttgacctttatagtccttatatgcacatacatctttaaattctcccattatataaattaatacaatattggcaatattggttgtttcatatcagcacaatttgtagctgaaattgattattaggaagtggtttgtggtatacagtaaaggaggaccagtgagaggaaggagtgcccattcagagagcagggccacagtggaagggaggcagacagagtgatgcagtttgcttctgttagccgaggtacaggggaacctactccttgatgaagatgaaccactctggcgccatgaatacattgaagattactcagtggtcttgacaacggtcattactaatgagagcgaacttcctgaaatcaacagcttgcctaagactagcacagtgtctgatatgcagcaagaactcaatacatgtcatgctctgttattggaagcaaaatgatacctattctagtccattccaattttgaaacttattttagaaacaaaactctttatttttcatttgtaaatacatatatatatatatatatatatttgggccgggcgcggtggctcatccccgtaatcccagcactttcggaggccaatgtgggcggatcacctgaggtcaggagttcgagactagcctgaccaacatggcgaaaccatgtctctattaaaaatacaaaaattagccaggcatggtggtgggcacctgtaatcccaactactggggaggctgaggcaggggaatcgcttgaacatgggaagcggaggttgcagtgagccgagatcacgctactgcattccagcctgggtgacagagcgagactgtctctcaataaaaaaaaaaaaaaaaaaaaaagaaaaacaaaatacacacacacacacacacacacacacacatatatacacacacacatatgcatatatgtgtatatatataaatttataaatttgtaggtatacatatcaagaaacaaggaaataaacatagaagtaaagatcattttctacttacttaagtttactctaatttttttgtctcctttaagccaccactataaatttagagaacgctttattaactgtgaagcctgaaaaaaaattatgtaactaattaatctattatttctgctacaataagtgagcctttgattcttttcccgatatagaaataatgatgtgtgtcagacaatttttaaaaatgagaggtacagagagacggacaaagcaggccttgcctccctacctaggtttgactgttttaaactttaaatgaatactcaaggatttcctccaggatcattaattagctatttccttatgcaaacggagacaactaaagatgttttattttcttcctctatatcttctctcctttatgtttttcattcagccttgccaggaagaataaacatgagctgagtcacctgtactatttcctaatagtgattcatcaccaagaagcagtaacagactctccctcctttcttccctctcaggatgtggtaccaacaaggcaagtctcacagagccatgccacgtgccacatcctaaccttggattccccatatagcacctcccagagagctgaaatagcctggacatctttcaggcctgctctgatggagagagctcagaaacagccttttcacatgtgtcagattttcatctctctgaaacgtattaacagtttacatggcaggccagatgaagcctagaacccagacagtcaacgggcttgggctattgtacaaaccgttatctaataaaaaatgtctattattttaggtcagttgtcatcactatccatttagtttatggtgagtgttcatattaatgttaccaaaatagggtgaacatcctttatgacaccttatcttacgtgtaatcatgacttgacttacatgcaatggcgaactgaaataaaatggtaattgccacaaaatggtgcttggcattctaaaaaaattaaaatttacttcaaaattcctttagaggtaatatatattcatcagaacttatcaattaattgagtaaatacaaaaacactcaaaataataatattcacaagaagtacaactgcgtttaaaatctgaatgcctggcctacatttacatagtctaatagctaactgaagttttacttgtttctatctcttttatgccaaattgtttttattctgactgagatgacataatattttaattttcccagaaaagaaaaaattaatgcagaaaaaatcaacaaaaattcagttagaagaaataagttctagcattcaatagtacagtagaaaaattatacttagcagtaattcgttgtttatttcaaaagcgctagaggaaatgaactataatggtcccaacacaaagagaaatgtttgcagtgataaatatcccagttatcctaattttattgtacattatatacagatatcgaaatatcacatatacctctcaaatatgaactatatcaatttaaaaattcaaatgttcatattgtatcatgtgcaatcaaattttacttaatgcaattcactatcactttgaaacctgctcttgggctaggtttatgcttatttcatctgaatagagaaaccagaagttatcatccttaaataccatcctttgtggatgttcccatcatgaggacaaagtaataaatttcagttctcaaggatgagaagcccaacagattcactccttttctgcacacagaaccatgctggcaacagtcccaatgcctaagcttcagtcacaactttcagaaaggtgctatcaagtggggctgcaaaagaatccctctatcacctttcaaactgacacctgtgttgattgcttgagcccatcacagtttagctctcacagctttaatttactagcccatgagaagtcagcttcaaagaacaccatttcgactctcaaagaacattatcaatgtacatggatagcttccaacttcataaggtgtttctctctacctagagcaattaacattaatttgcagaatagtgtttattgaaaacctttgtgtatctccaacaaagtaatagtgtattgatttcattcctactatcttcaactgtatcattaagaggaatttcttaggaaagtctatatgcagtaagcaagtaagatcgcagaacatcaagggagaagtaaatccaaaactgattttacttcttttcttagtgaggaaagaattatgttttaagcttgcctctattcatataaccttaaaagtaatcattctgctttttgtgggtttattataatttgaacaatgtttataatctctcaattcaaaaaatcataatctgtacatgttgatcaaccaagttataaaaatgagatgaatttttaaactccatgcaaatctttaagagataacatgatctatctgtccataaccaagtttaaaactttgttgataacaaggccaaatgcaaaatggggggagtggaagaaaacaatacaggtaatttagacagaggcaagtcaaatgatcagtaccaacttaaaaaaaaatacatacacacacacacacacacacacacacacacacatatatacactgtttcattgtcaaggctctttcatattaagagtaatcaacatataattaaatttaaaaaaatgtatgtatagatgagtatccagctatataaccctgcagaggagctgaacaaagtcattcaatgaattgcagatgacatagcaatggaaagaatgaattacctttgtagttatcttcccacacccaaccattaaacaaacaggaccctttaaagactttaaggtaaacagtggtttctcaaagtgatgcaatgatcatgctgtgcctgtataaggagcataaaatgttcttcacaacagggttatccagtgtttagaaggaaatctctactggcaaatggatctgtctttttgaggttacagtttataggctggattcaaacgacaaattcctcaggactctttagcctaagtgtaaataaagatgcagaaaggcattcctttaaaaaaaaaaaaaacactccgtagacatggtgatgacagtgaaaggaggcagtcaaatgcctagtcagatggggcaggatccccttttaaactccacctccaaactgaagacagtttaaagcctgaaagccaagctaaaaattaaatccttggaccagactgagaacctgtcttcccatttgttgcactttgttctgattgatccccacccttcatgtattttacttatccctaccctttcctaattggttttctacactgtcctgcccacctttgagtggtgtcttcgctttaatcttttttgaatattcacataccaatcagcacatactcctcattctgagtccataaaaagccccagacccagccacactgagaaaaaaaccacccgactgaaggggtgaggaatcctcccaccccaccgctgcccctgactgtgagctgttccattgttcaataaaattcttctctgcccatcctcacccttcaactgtcagcctaccctcatttttcttggacgcaggataagagctcaggaacccccaaatgtgagtacaaactataacacaggtgggctagggtgcacccagctcagccatgggccaagccggtgtacaagcgagactcagcgggctgactgcctccagcagcaggcccagggctgagcaaggtgggggtgagggggggtggagagtggagggcacatcaccagctggaaccctgcaaattgtcagaaaattcctgcgtcagtgattcagtgatatataaattcaaatttcaagaattcattatttttataaagtctttaggaaaggatccttggattttttttttttttccattcaggagcagtgttggcaccattgtaaagggtaagggtaacggttgagatgtccaaatatacatatatatttatatatatttagtgatctaaatgtttccagtgccaaagttagatgctttgcaaaactataactcctttaaatgccatccatcttgaaaaaatgcatgtcacatcactagaatgttacttatagtcctactagagtttaaaaagatgtttcctaaagacctaccatttaaccacaaactgggaataacctaatatcaattggaaatgctgttaaacggaaacaaatgtaactgatacatttgaagcaagaggagattgaagatgaaggtatatatccaaaatggtgacagtgacagattctgattttcccattttgattaacagaatttcctataggcatcaataagctataaggtggataagatagttctgttgtaaaagtactgaggactcattatctggactctcaattctcattattcagtttacttagtttcataaaactttaagctaaatctatattctataaagtacatatgacaatattaattatattgtcacctttctaagattaaaaaattaagtattttttgaaaacttctcagttcctggcttggtttttccttctcataataatttatttatttatttattttattttattttatttttttgagacaaggtctcattttgtcatgcaggctggtgtgcagtggtgcaatctcagctccctgcaacctcgaactcccaggttcaagtgatcttcccacctcagccttccaagtaggtgggactacagacatgtgctgccacgcctggctaatttttacattttttgtagatacggggtttcaccatgttgcccaggctggtttcaaactcctgagctcaagtgatccacccgcctcggcctcctaaagtgccaggattacaggcctgagccactgtgcctggccaataatatgttttgaggagaaaattttaatgcaatgtaggttatcattaagattcatgtttttggtgttgtagctgaaaaacatttcctaatccaatctgcaaagattttctttttttttttttttgcagaggttttatggtattatgatttacatttagatctgtgagttaatttttgtatttggtgcaaggaatgagtcaaacttagtgttttttgcatatgggcacccactttttccagcaccaattgttgaaaaggcagatgagtagataaataaactgatatatccatgtaatggaataccatttggcaataaataataataaactactgatatgttgaacaacatgagtgaatatagaaataataagcctgagtgtcagcttggcacaagagtatacacattgtaggatcccatttatataaaagtctacaataaaaattaatatatagtgacagggtgatgactgtttgcctgggaagcgtattggtgaggctacagtacagacagccaagatggaggaattacaagtgtggtgaagtttcgcaggtctatgcatatgtcaaaactatcagactgtatgttttagatatgtgcagttgatcacatatcaattgtatctcaataagtatctatacatatatacacacatatgcatatacagatggtctcctacttacaaagttttgatgtagactttttttttttttttttttgagacagagtcttgcactgtcacccaggctggagtgcagtggcgcaatcttggtacactgcaacctctgctcatgggttcaagcaattctcctgcctcagcctcctgagtagttgggactatagacatctgccgccacacctggctaatttttgtatttttagtagagatggggtttcaccatgttggccaggctggtcttgaactcctgaccttgtgttccacccgccttggcctccctctgtcacccaggctggaacgcagtggcacaatctcagctcattgcaacctccaccctccaggttcaagtgattcttgtgcctcagcctccagagtagctgggactacaggcatgtgccatcacactcagttctaagtttttgtatttttagtagagaccaggtttcaccatgtcagacaggccagtcttgaactcctgacctcaagtgaatctgcctgacttggcctcccaaagtgctgggattgcaggcgtgaggcattgcaaccggcctcggcatacaattttcaaactttagacggtgcgaaagcaatacatattgagtagaaactacactttgaattatgaattttgatgtcccaggctagagatatgtggtacgatactctctggtgatgctggacagcagatccaagctgtaactgccagtcagccacatgatctggaggataagcaaccaatacactatatgtactgtgtttcctgattattttttctaactgttagctaatgtaagtattctaagcatgtttaaaattgggtaggctaagctatgatgttcagtgggtttgacatattaaacgcatttttgatttacaatattttaaattatgatgggtttatcaagatgtaacctcatcaaaaatcatgatgcatctgtatacatacacacatactatcaggcgtgtttcaacaatctttttaaaataaaagttgatattcaggccgggcacggtagctcacacatataatctcagcactttgagaagctggaggcgggcggatcacttgaggagtttgagtttgagaccagccaggccaacatggtgaaaccctatctctactaaaaatacaaaaaattagccagatgtggtagtgcgtgcctgtaatcccgctactcaggggctgaggcaggagaattgtttgaacttaggaggcggaagttgtagtgagccaagatcgtgccactgtactccagcctgggcgacagaatgaagactctgtctcaaaaaaattaaaagttgacattcacaatcaagtcatgttacattgatcttgattggacaagaatctccggaaatttttatttatccaaatgcatatgtaggtatggtgggttggtgtgcattcacttattggagggaagagtctaagaaagttttttttaaagggcctaaataatctaagcaaaataaatattaatccatgctagccacattgtaagtgttaaaatggaaagaaatcatgagattctcaaaatgtagccactggttggataaaaatcctcagcaaaatttgtctctagaaatacaaaagctccttcattgaaaaatgccctcaaatgaaagtaattatgaagctactcacaaaattagaagtaaaaactcaatgacggggagagacgaacatgtggccatgtaatctgctccctgctcgtggagtttcaagctaaccgcagtggttttgagtataagaaatcatggtcacaggaacagggaggaagtgtggaaaggggtgggctggaggaccggggagtttacactgccagatatgacaactcttcgcacaatgaagtttgaaatgtaatcaactgctattttaaatttgacctttttttccctagaatagtaatttcctatagactgctttcatgtgagaaccatatttggttgcttaagaaataaactattaattcactacccacagaaaggataacattcatttgttatcaaatactaaatgctgcacattgcattagactcgaatttgaaatgtaattcctatgcatgagtagtgtttcaggaaacatttgcctcccatgttttctccccttgacacttcacgttttagatctttgttgctaccatacagaaataggtgcatttggtttttaaatactggaaataccatacttgacataaaaattatatgaaaaagagcacatctaaaatggacatcaagaggaaggaaaaaagaaaaaatacaacaaaagattcagtttcttccattaattataaatttaaactgctaaagatcctaaaatatttcacctttctggctaattgttctgcatagtttatgagacgcttatcaaaaagaactggggtaagttattcatcaaagttttatcattaatagcattaatagcaaaagcataccttttggaaccatggaatattacagaaatagaaagttgcagttcaaatgctgtttgtatatagagagaaaacaagaagacaaattttatgagatttcaggtacctcaggactggttttgaagtattatagatcaaatatgtgaaggttataaaccagggctcccaggtaagctggtatagaacaaaatcaccagtggaacagaaactgaaaatacttccgctgaaaagatatatactgaatgcaaaatatgtgtgtgtgtgtgtgtgtgtgtgtgtgtgtgtgtgtgtgtatagcaagtttcatttatagaccaatgcattctctttggcaggggtagttttttaagctactgttagaaacatatgaagaggggtgtatgtaggagaactgcttgctctagggttaggtgtatttctacttcaagaagaaagccacccaaagaattgctgtttcgaaatctgtacgaatagctgagcctctcttgttttcttcactcatgttcctaagtaacagacagcagactaggatacttgggagttacatcccttatttggctgtttgaactataagactaacagcatatcaaaagctgatcattaaaccctcctattttgataatatcctcagtatgaaacagcttagtgaaagacagaggttggccctaacagcaatgttcattatagccataacttcacctctgagtagggcaagagttgaaggaacagatctgagtagatcaccagtagctctcactaactgaagcttcttgagggcaggattatccaattcatatttgatcctcagcgcctagcaatgagactgaaatacgttagacactcatgattatttgccaaataagaatggagtcaaattcatatccattgtgaattacccagaaactatacattttaagataaaaagtgattgtaaacatagttccagcccattcctcttaaaaattctagacaaggtatattgatggtcaaatgttgcagttctcaaaaagtctccagcctggacactgccttgggtagatctggtcatcagtcctggttgctgctccaagtaaaaacttcattcttgatttggggttttcttatcacctgaaatacccttttgcaaggtatgtttcttacatctctcctcacataaactccgtaaaaccacccctctcgaatgctaccttctccaacgaatctctcctatttatcttatttgtaagtaatttctccctttcctaaatgacacaatattttatcagtacgttataaacaatgtttcacattgatgcaatgaataactaccagaaatgcaaaaaacacaaacaatgcagatgggttccatgatgaatttggcggtacctgccttttccaggcttcaaggctgctcttatttttcattcactctattgcttctgcctcaaatatcacaacctgcctgtaatcctgttccctcctctcagacaaatgttctttaaggcatagctcaggagtcactttctccaaaataatcttccctgacctcttctccaatttcagatgagtaaggtgttgttaacgtgtcctactcacctgcttccatagtaccatgggcacatgtccttcttcactaaggataccacattgcagtgatctgggaaagcacgtcttctcactgacctgagttctttgaggaatggaatggcacagtcatcatggtatttccagcattttgctaggcctcagtgccacagtggctgctcaatattttatgaataaatgaattcagttatatttgcgtgtaatctcctattctagactgtgtgctctttgagctcagtaaattcagtatttttggtacacagtagatatttttaaatgcctcaatgaatgaatgaatcatacaacctttaggctggaagtaattatagatatttttagtcttatttctctctcttacaaataacatatgatgaccaagctaggttctatacatttattcatggaatcaggatcaaggcataggtcttcagattccaagccacacaatttattcttgtatactgtgacatttttgaattaattaattctatatgaagactaaaatattaaagtcatcactatgaatatatatttagaaatgagaccttattttcacggaaatttaacaaaactggctgtcaaccatttttaatggattctcctagtatgtatcagaggctgacagttacaggcaatccattataatagaaagagaaacatgttatattctaaatactgcaaattaatcattaataataatttaaaaatccaatagattttggtttagtcagcaaaatgttttaaatacaagtgttctatacattgcagagatgctaagttacatttaataccatttatcaaaaccttagggagttattctttgggtctccaaatctcaaagacattaaaccaggaccaagaatttcatgaatactgtggcagattcctccctccctccctctctactaacagtgatttcaaggcaatgtgacagcaacttacacattacctgtcaatagcaatgacttagccatcatctccctggaacctttcattcctattactcctaaatcacctataaagaaattggtaattaagctgctagagacatctgggctaaatggattttgagccaagaagttttgaaaggctgattattaaccttcggtaaaacacaattaagagaacacaccagactcattctcagcttcagtaggagagaaaggtcagggctatatgtgtctggtagatttaattttctatatcactattagacagcctagattatttttaatctggttacaacaacaaattctactgatttttgaatcaaaagtcaaataaaaacctccagtataaacctgagttttctgcaagtattttctttcagaggcataacagtctccattttctacagaattcataaatatgaatattttagaaaatgtctataagtgttggtcttctaagttctcggtgctgcctaaagtaaatatggtaatactcagttgcccacctatgagcttttgtgtgtcattagcacaaatctaatgcttcatatgcagcaatacaaacactaacatcatttcttttatatagaaatatgcttcccaagtttaagttcaaaaacacatctgactttaaacaaaatcatgtttgttgtcaatgttttattctctctcccaaaaaccttccttcctacctccagaggcttcctctcccaaactaacacatctttcttcagcctagggagttcattttaacccacgtaggtgaaactctctttagataccctctaacaaggagggtacaactcctcccaccccaagaaccgctatctcttccagccttaaaacttccagaggaaaaggttatgctagtggttacagaaagcaagaccaatattttgcagaaggaagcccattctatccaatgttacccaaatcatatcaggcaggcaatcatcctccaaactgcttgaaattatgaatgcagaaattaatgttaaaatgaaaatgcctatagtcctctgctacagacaggcagagaggggaagaactttactaacctctacctcagaagaactctttctctttgaggaggaacatcttccataaaaactggagaaaaaattgggccttccaattatcacacatctccgttcccctcaacaattggtgtgtctacagtcccctccatctggtagtgatttattttcaaaggatgaaaattaaaaagaatcacaccttgcaatttggcttatcgattccttttcatttatctaaactgagcagtcatataacatccttaagaaaagagactttaaaacttccactgcttaaaaacatccctaaaagaaaggacttaagaatcacctctatcaaagaaagtttgtttattattttaaggaagatataaattggaaaaaaccatactaattagaaacttgtaaaacttccatttgaattataaattcatgatgaaaactaatacaacacaatatttggatattttgttatacataatgaaagtttcagatttgggaaactgaaaaatacagagcagatatcaacaacatttgggtacataatgcggtgaactgttagaaaaaccacagtttccgtaatgaagttgtagtggaagtacaatcaccatcgcataagtagatatcagccaccatactatgcatcctcttacaacagcaagaatgactgttcctatagcagagatcgagtccattagaatttcaaccactgaaaaatgggttgagaccacataatttgctagtatatgtgacttcattatattaaatagggagatttttatatgtaaattgagattattaacagtaatggtcataataaatacactcctcataatttattgcacttcagtaacatactatttgccacaatacaaatactttcaaaatcctaacaagatgtgctcaaaactaaattgcaaaacaaataagccaccacctactgttaaaggttagtttaagtatttcaaaagcaacaatttaataaagattaaggaatttaataagcttcccttttcctttaacaaaaaagctttcaagagtcaatgagcaacaacaagaaagggaaaacactagcacattaaaatgtggtgtgtaaagtatggtaataaatacacttaagagaggtaggttttaataataacaaatacatttttttttacaccaatgactgcccgttaggcacattcttaagtcaacttgcatggttgtggctatttgtcaaaacttacttcatcatttacagtctcagagttcttttccttttagctcaatgttgtgatggaatcaatacagatctgctcttaaaatatctgtctctgacctgtgtttgttttaagctgtatcattcataatggtgatggattggtaatgctattcctctttgtctgcacaaagcaccatggcataaaaagcacatatattttatgcccaaggtcaggagaaaattaatggataaagagctagataaaatggagttcaagctgaatgggctgagagcgctctacaaggtacagaccaggcaggcagtacaaagtccattatacttaaacactcttgaagcatttcagaagtgaaattgtttccacaggctaacacataaaagcaccaagctctcacatggcttccactgagtgcccacaggtatgggcaaagtactcctgctcacgagcttccacggcatattccatttatcaatttttaccttgagcaataagcccatttggtgtttatcaccagagttgaacaagttatgctttgttgtcattagcaaacttctcttttaacactttcctactaattctatttctattgttcactctcttactgtgccttgtgaatacttaagagtttagggtctcccttaagaggcagggccagctgattccaacaaaaacaaagcttcatagctaacaattacacgctattttccataacatgcactctcagacatctaaatggcagcaaactaagtagaaatttaaaataataacaaaaacaaagaccagtaactgagaattctaaagtttggcatgcagaacaccatcaaaatcatccatgacaatttggctgataatatctatgcataaacataaggaaataagcattttgcctagttaagcagtccaaaaatcaatggttttcttcacaaaccttgctgagaaaagcaatattactattttgttgaatataaaacaactgagcaaagccatattagaatttatcctaaatacctcactttcagatttagaaaaacaatatttaataaatagatagtgtaagtgggttcttccatttgttcattttaaggggaatgcatagtaacagttgtgatttgtccttatagttgagccttcaaccctgtgacactataaataaactgctcctggagctgcggaaattgcccattatctccaagagcatgttctgataagagtccatcaacatgaagccaaaactcattcagagcatcaagagaggaaagtttctagtgatggtttggtcatggtctctttcaggatgattgcatggcagaggaaggaataaaactgtgaaagaattaaagttggtggatgcggaagtaatgtgtacagtgatgatatagatattaaagccaaaatgtggcaactctgtttgacaccgcaaagcaaaatgcattttttcacgtaatttagaaatatattcaggtagcactcaaagagctcatttaatattaaatataataggcaagttctgagtgtcagttaaactggactgaatgtttgagtttgtcataaattaggtgtggctcacccaaaagcataatctttccattttagtttctttatttgtaaaattaagagtcagaatatagcctccaaggactcttctacctaactaaaaagcaaaaccaaacccttccaaatatcttccatgatattctcttaacataaaaagtcccaggtttatgatccaaagatagagatcttggcattttaacatgagtgcagtgacaagactttctgacctgagtccacagggcagttacacacataaaatgacttcagggaaactcttcacttagggaaaaaagcaattatgaggaatttgtaagtattataaaactatttttaaaatagtaatagaaagctgaaatgaagagtaatggtctaaagctaaaaaaaggaagaaattaacattagacaacacaaaaattcttcaaggggaattaggcactagaataactgcttagagaggtacttgagtcaacctcattggaggcattcagaaatagattatatcaaaacctagcaggaagtctagtgttactccttaacttgaaaaaaataaaaaacaacgtagcacatttccactacctaacttaccatattttgcatattattttccatatatttcatattactgtgtatacttggtgctctgattatattggtttgcatgattctattttcacatatatcctaaatatttccaaagtttcaacacactgttattataagcttaacatttcaaaagctggttaaatattcaacgttgttgatatattttaacttcttattctggtaaagtacatttagattataatttattgccatcatagcaactcctatgctacatatttttgttcatgatctgttggtttctatcaaattgaatcctcaatttaaactcctatgactagaaataccaaatcaaatgagtatttcacacctctggctatgtattgctacttctaaagccctaggtatgaatgaatgcatgacaactcagtgctgccattttaacatgtgctgataatacgttccaaaaattctaaaaaatgatgtgcaaattttgttattctcttacataactaaagaaaggtattggtgctactaaagatatacatatttatttccagtatgtatttaatatatttattcctgaaatgaaaagataggcaaagtagttttaaaataatctataatagaacactgctttaacagaatgaagacagacttaaatttcttgagtgttaggaaattggggagaccctggatcatctcaaacaatactgaagatactcttcacaagtcagttcactctgggtcaatggcaatcagccagataaatcttgttaatattaaaactggcttaaagccagacagaattcatttttttctcaattaaaatagatggagccatctttcttgactattaagcatatctctaatgttcacaagcctgcctttgtttcatttcctctccctataacataaaaatgataaaaaatattctctttatccaaaaaagttgcataatttttatcacattagaaaaaaagcatcagtaggagtatttatggaacattactcttaattctgcatttttacctatgcagaacattttgtaaccagtgttcaatattatgattaaaacataaatgaggttaatatttacaatttgtttatatttcaattagaacaattttagaattcatgtgtgcataagcttggcagaaaataatttctctaatgcatattttaacttcatttagggctgactatggtaatactaattattcatccttgtattttcagatagttggaagaaatggcagttccagggactttctggttcctcctcagtacaaaaccatttatatcatattctattattgctccatctcaactcctgtgcaaacctattaatacctacagatactgcacggaacatgctatgccattcacaatttagtctttcagattgaaacatgtcttaattcatctcaagaaaagactagaagaaaatggtagttgcttcttaaaattaccaaaatcatgatcatcactattaacaactgataatacgccataatgaacactctttggcactgtctatcaataaatattattttaatttaaactattcattttggacatcatctactattgtagttattataatattgtcctctgataaaaacatctgaacattttaattcatgatgatgatagttgggaggccctaaaaattggtccaacactttaaaataatgtataataaattaaacaccaaaaggcattaagcaataaaatgtccattaaagcactgtatctcagcagctggaaaacacctaggtggtatatatagcaaaatataagtatcaaatatttggtggtacatatagcaaaataaaggctaaccactaagaagaaaaatatttttcttgcactttccacatactttgttattacttttaaagttcaaggcatagtttcctgtgggttcttttcatttttcttcattcagtaaaataaatatccatcttcagccagacattcattcctccccctgagctattaaaactcaattaattgcttagttaattgccaatcccatttaaacaactcactgctgaactccaaacaaacttataaaatgaagtgatatgctgagattcataagcagtcacaaatgtaaaaataaatttaaaaaggaagaatatgcatgcccaagaagaaatggcttcattaattaaaaaatcaatatcatataaataaagacaaataaaagcaaattaattcaaccttggcaataaaggcacaagataatttggtcatctatttcattaacgcgtttgcaaatagatcacacttcatcagagggtttacagaactgtcctcgtactctacgaatagctgttcaagtagttcaggctgcaaacaagtacaagacttctgaccttctacttaaacagaagtttttaaagttggtgattatatatcatttaccaagagtaagctaaattgttcctgaaattaactcaaatcacttgtgttcatgagaaaaggaaaaaggcgattatatatttatatatttcaagcagggtctgagtgaattgagtatccagtaccaacacactcaagtattctttttagtccctaaccgcttacttcaaattttcatagaaaaagcagcaatttaattctaagagtatatcaaatgcattaaatagccctgtacggagtggccaatgtactaattcatatgtgctggtgaactctttgcctgttgctgtcttaattcttgaaaataaattacaggctagtaagtatccttcgttactgtgacctccctcaccctatggattttaccagacgataatctagaccagtgtctctgcaaaaacgtggctgcagaagagatatattcgtttatttggtaagcaacaatgaagtacttaagtccataaattttccattacaatgtcagaaaaacaagaaggctcactttttgctcaagaataattcagaaaggaaaaaagcaactgctcagtttttcaaaatgagtttaagttgcaaaaacaaatgggaaattgtgcaacaaatgtagtgactctaagtcataaatgcattaacttaaatttattaactacagtacctaccatgtgctaaacactgcacagggtaccaaagatgcaaagactagctagggatgcttcctcagagggctgaactccataatcgactctgctatacaggagatgtactacaaagatttcagcagagaaataacttaggtcagtttacatttacaaatgagatagtcctaacagcctttaaatccccacatgttgtaatggatgatacttagtatgcatgaaagcttgggagcaaataatgtttgcacaaactgtttatctatccttataacaccaaaccttgaagtgttggaagattattgaaggcttttttttccttttaaatattaatgtgcacacttttcaaccaattgttggcatagaatacctgcagcaattcttgattctatcatatttataaaaaataatgtcaatacctataataactataaacacataatactaagttttgttttatggccattttgaacttcctgaaataattctgcatttaaggcagacttccaaatacaatgaaagactcttactgatatttgtggggagaaataatggttcttttatggtcatgatttgcatttttacagattatctattatactttatgtcttttccaatgtttcctaaagcttcacattttggttgtattgtaaaaccaaagtaaacaaaatttctacaggttaaggtcataataattagagttatgtgtagttctctttttgtgtgcatatatacacccacatacatgtatatagatatttaatcttgtctttgatctacagcaaggctaatgcagcaaaaaaaaaaaaaaaaaaatccatatttgcatatccgtgtctctttcctaagtatctctagttgcatgtttcctgaaaagagcaaaattcaacagagccaaagtaaattattccctaccaccaaaccttcacagatatgttccctgcaatcctaatctcagtgtatgccacctataccaaaccaatgccaacccagaaagcatctttggtgactctcttccttagtggcaatattcaactgctattgatgctaccttttgagttactgtgtatctcttcttgccaatcccactgtcagcagagccatctggacctttatcacctgttgtctattttaacttcagtactaaaaccctccaatccattctccttccacaatgcagctagagccaagcttcaaaacagcaaatatattactaaggttttcctgattcaagtctttttgcttcaaagactacccaaactctccagcttccttttttccactctccccaccatgacctgtactccagaatctgagctaaattagagttctgtgaatacacatcacttgagcatatgccattcttgctgcctgaaagaacttgaactcttttattttttatttgtttgtttgtttgtttatttatttatttattttgagatggagtttcgctcttgttgcccaggctggagtacaattggcgtgatcttggctcactgcaacctccgcctcctgggttcaagcaattctcctgcctcagcctcccgagtagctgggattataggcatgtgccaccacacccagaaaaaattgtatttttagtacagacagggtttctccatgttggtcaggctggtctggaactcccgacctcaggtgatccgcctgccttggcctcccaaagtgctgggattatagacgtgagccactgtgcccagcctacctttaactcttgttaaggatctctctcaccaagagatccttcaagacttcaatcaaatcctacctccttttgaaagcctcccctgacttctctaacatactgagcattgcctgtctctattctggaaacgactttaatacatctttgttattctacttatactcaactgcagtagctataaatgatggttccagagcagcagcctctgcatcacctgggaactcattaaaaatgcaaaatctcgggccctactcaagacccgctgaatcagaaactctagggatgtgggactcagaaatttgtagttcaacaagcctttcaggtgattctgatgcgtactgatgtttaaggaccccttttctattgaaatcctgtgtgtccatcagtctctacacataattgagaaggactttgatggttttcatcttcctttcattcttctgaatatgcaatacacatttgttgaatacagagcaaataaactggtaattaaaattagaattttacagttaatttcattgcgctttatacagatacagattcttagcatgctatcggtctgtacataggatacacacttgaaatgtgaagatgatcatgtcaagacgatagcagatatgatgcattgccaatagttttcttatgataatattcaccatgaaaaatgaataagatcatatgaagttattttcatgttagacaatagggaaacttaaaagatgctactaagagtcaagggccatttacaactttttaagtaatcaactaggtatactgttgatcgaacagagcccccaccctccaacccctatatatagtctatttattaaacagagtttaatgtttgcccttcataaaacatttcgtatataactgatattaaaagctgtaatactattatttgattcataatttaattcggtgtttgcaaacacgtgaaacaaaaactcagaaaaattctctaggctgtcaatacaacaaaatgctctacctatatgttaagagagtgcagaggcttggttatcagccagctatgacatagatggggctgagaagtggaaaggcaacaggatccgcccacactagcttcaagtatttagacacatatatctaaatggcaaagtgtttgaaatcaggactgggcttaacatgttgtactttattccccatcctcaagtgtcaattacaggatgtctgcatataatagttatttaacatattgacttaaacagaatttccatgtaattcttctttgcttaccattttgattaaaaagtacaggagttaaacttcaaattacatgaaattagtaatttaagttatttaaaagtcaattcatctcaggcattgtattctgttcctactattgtgtactacttctgtcactgatctcaatttataaatgtattaagctggatttataaatatttcagaggtgctctaggacagagatgatatatttttacctctgtatatgcaacacttacaagtccaaatctgtagtcgattttaaaacttaataataatttgattaataaatcatagcaaagaaacagggagaataaggatattgctatagcatggtatcatctaaaatcagttgatagaaacaacacaacattttctttgtaaatgtgaaagcactgcttaaagttccaaccaactgtccatctaatcttttccatagcttattcttcataatacaaaagcttcttttctcttggatctaatgctaatgctctcctggtatataatcctcagtaagaaataattttaaaagaaaagatataataaaagtactatccatgaagttttaaaactggaactttgctaaatatattatccttattagttttaaataccttgggtcaaaatatgcccaagaaaaactggtgactgttcattcattccacgttcatttgttcacactgacatttattgatcacctgctcatgccaagcattttaataagtcctgggcaataaaagtataaaaaacccacagtgcctgtcataaaagaagtcacattctaggggaacaaaagatacatatatagttgcaaaccaaagtattttaatggaataagagacatttacataaaggtattatcaaatcaaagtagggtattgaccagatctgggaaaggcttcatagagtaaggttgcagtggatgggaaagatttatcaggtgttgtaaacagagaccaggaaattaagctgaaggagtatcatgcagacgtaccttggaaggaatgtagtatgttagatggaaacggaaccaaaagtgttcatgatgggaagaaaagctggtgaggcaagtggaagcctggtgaccaggctaaacagttccctctttttgccacaggcaaaagtgaatcatcagaggtgtgaaacaggatagtggcatgatcagatttcactcctgggtggtagctatgaacattcatcagggtttgcagggattacaagtttccagtcattccacaaattattgaccaaaaaaattatattaaagggaaaatatatttctattaataacaaatgtgtcatgataatgtcaggtattaagacagaatatacgaaacaaatgtttatggaaagtgttatcagtagcagtagacatgtgaaaaaagactagtttgcctttggaaagataaaggaacaaggtaatatgcaaagaaagcaataagcattagagggagataactgacaaaccaagacagatccgaaatgatacatgactctaaaacattgaagcagtaataagaaaatagtttagaacaaacagcctaatcacctgaagtaatagacctaaaaagtggagtgacgatagcaattaagtttctcttgtagaatatagacccaaggtatgagaattttctttctttggttttaaatatatgctatatatgctgccgtctgcagaccctgatggactttttatttttgaaagtgaatacagcacctgaatgtaaagataccaaagtacgtgatagtctgaactatcagggaagtctttgacaggttaattaaaaagacttaaacttgaggtgttgtattccttatgacaccatttttagcactaagtagtgagtgatgagtgagaaaattgtgtaattattggaatagctaattggtggtaggaccatttgtaagtacaacaaaataggtattatggtcagccagacaaaagcagctatttgtatgtactcacgcacacatacacacacacacgcttatataaacagcaaatagcaaatgtggatacaatttttcgcaatgatagaaatactgttttgcagtgatcctgtggaagtaggaagccaaacagtagatcacatatcactgacatcctatttcccaataggtttgctgaaaaatgaaaagcagatttgttgttggtaattgcaaatgccctaattttcaataatgtaaaaattagaacttgtatatattcatatttatcgtgacaaacacactctgcagaaaagaatgttgtttagttcaattaattggtttggtactgggaatggccctaagaataaactccagggtgagttctacctggaagctggaacagagagtcaagttaaagtaactgtaagtaagatgctgtagatgccttaggaatatattataaaaaaaaaatcaaaccaaaaattaaagagttaatatttccagtcattaaaatggaaaaagagactcagtaattctaaagaaagcagaaattagcaataggtaaaaatagaaattggtgaaatacaaaaacaaagaaaagggaggactgacagaactaaattctcattgtttgaacacagtaattaaaatcctaaacttccagtgagtctgatcacaaaaaagagggaaaagggacacataaacatcataaagaaagaaaagggtggccggggccgggcgcagtggctcacgcctgtaatcccagcactttgggaggccgaggtgggcggatcacgaggtcaggatattgagaccattctggctaacacagtgaaaccccatctctactaaaaatacaaaaaattagctgggcatggtggcagatgcctgtagtcccagctacttgggaggctgaggcaggagaatggcgtgaacccagaggcaaagcttgcagtgagccgagatcccgctactgcactctagcccggacgacagagcgagactccatctctaaataaataaataaaagaaagggaagggaagggaaggggaggggaggagaggtgaggggagggaagggcccggtggctcacgcctgtaatcccagcatttggggaggtggaggcgagttcctgtcactgcactccagcctggatgacagagcatgactcaatctccaaaaaaaaaaaaaaaaaaaaaaaaaaaaagagggaaaaaaaggaggacagagctatagataatttacaaatttttaaatactaaaagaataaaagtttatgtctataaatttcaaaaatgagagggcactgataactttctagaaaatataaactattggaagtgacaaagatttgaaaatggtaatgacaaatcagaaaaaagctcggacataagtagggaaatctgctatgagacagaggcagtatttcacatcaggagagaaaggttgggactagccaataaacagtgttgggacaactatgcatccatgtagaataacaagattagatcgccactttacaacaaacagaaaaatccatttcagatgagttaaagacgtaaatgtgaaaaagtaaatctgttagatatatttattaccttgagtcagaatattttttgaacatgacacaaaaaagcaataatcataaaggaaatctaatactgtatatttgactacactaaaattaggcttttgttcagtcaaaaaacaaacatcataatgaggtagataggctagtcccagactgtgaaactatttttttcaatgcatttaactgacaaggaattagtaaacaaatgtgcataccttattgagaacaatgatataatagggaaaaaaggaaattaactggcaatttatagaagatgaaacatatggagaataaggataagaaagatgttcagccctactaggcaccagtggggggaaaaacaaatttaacaataagatactattttataacccttcagattgtccaaatgtaagcctctgaaaatacaaatattggcaaggatatgtagaagaggtaaatcttagttatgctggtagaaatataaactgggacaatcactggagacaaatggtgatatgtggcaaagttggtgggctttgttttgttttttgctatttaattcagcaattggatgttaaggcaaatttctggagaatttctatcttaggtaaataaagaggtatgtatgagttggagcactgcttgaaattggaaataattaaaaaccactcagaagctcattaacttaaaaatggattaataaattgggggttattgattcaatggaatatttaagacagtggtccccaaccgttttggccaagatgaaactgttccacctcagatcataaggcattagattctcataaagagtgcaccacctagatccctcacatacacagtttacgataggttttgcactcctatgagaatctaacgcctccactgatctgacaggaggcagagctcaggccataatgatctcttgtccgctgctcacctcctgctgtgcagcccagttcttaacaggccagagaccagtaatgatctgtggcccagggttggggacccctgatttagacaacatgtttcaacacggattatttgtttttagagacagcatgttagcatgttgccatgttgccaggctggacttgaactcctgggctcaagaaactctcctgcttcagcctcctgagtagctaggacaacaggcacaagccaccacgcatggctggataatttatttaaaaaaaaagaaacataatcttgaacaaaagaaaaaatcatgttgaagaatgataccagttatgtagattatgataccaatttatgtaaagtttgaaaacatgaaaacctatgccataaactatttaacatatatgcacatgtaggtgtaaaacctttcatggagataatatatacctaaattacgttgcttttgtcatctgttatgggaggtgggaggatggaaatggggaagaagatagagtagacttcaactgcaatgtttcatgtccttattctgaagtatgcatgacagaagagtagaatttaacagatgtttgttcattgttgtttttctgtactttcttcatttcatatctaaaaagcaaagttcagctgggtgcagtggctcatgcctgtaatctcagcattttgggaagccaaggcgggcagatcacttgagcttaggcgtttgagatcagcctgggcaacatcacaaaaccccatctctacaaaaaatatacaaattagccatcggtgtggtggtgtgtacttgtagtctctgctacttgggaagctgacacaggaggatcacctgagcctggtagttcgaggctgtagtgagccatgattgtgccactgcattccagcctgcacaacagagtgagatcctgtctcaaaatttttaaaaaattttaaaaagtaaaataaaaataaataagaagcaaagtttactagtacctccatagcaaatatattttccatacccaatcataaaaagcatttaaccatttctgcagtcatcaatgagaaaagaaatccctatctataaatacgatgtcttttctggtcacatcttgcaaccaaaccccagaccattaggttgggtagaaaaatgcacagatgctagcctcccttagattgccaatatgtgtgtgtagtacatattggtattggtactaactgattagttactgaaaaaaaaaaaaatttacattcttctctattatgtttttacttattatgccattccctcaaaatgtggcattctggtattcagcaaaaatactattggttttgattaatgccaagaggaaatctatcattcatgcactcatgctttcatacacatttaattatgtattatttttccaatgttctagagactctggttaagaaatctaccccagcatttcctaataagttgggtgtaaatataacaaacagcagaaaataatccagtactgtattagtccattctcatgctgcaaatggagacatacctgagaatgggtaatttataaaggaaagaggtttaactgactaacagttcagaatggctggggaggccccaggaaacttacaatcacgttggaagcggaagcaaacatgtccttcttcgcatggcagtgtcgaggagaagaatgagcaaagggcgggaaaagtcccttataaaaccatcagatctcatgagacctcattcactatcatgagaacagcacggaggtaatctcctctatgattcaattatctcccactggttccctctcataacacgtggggattaggggaactacaattcaagatgagatttggaaggggacacagccaaaccactgttaaagtactttaaagtactttaaggctcaaatgaatacaatgcttgccacgtgaaattttcaacgtagatcttcaaatatgaaatatgaaattcagttagtcaactctactaaattttttttaactgcagagttacaaagggagaaaaaggggaagagtagacagatgcttgaagatagatggaaacaaatttattatatatttaactttataaaaagaacaggaaattgtgaggctctgcagtctcctgggtcagtttcctgatgccctggttctgtcaaggtttaatcactaaactacaccaactatagtcactactttgtttttaagccactttgagattttcgctatggactggaaagtctgggatatgaatgcctaagcatgaagaaaggctggacaccataaaaatgtgtaagaattggtgggatttaatttcatttgggtcacattaatggccatgaacatgacaactctgtaccataccaaccaccatacattgcaaagtagtcctaactctatatgtaggtaagtcagatttcttagtatcctttacttgctcagatgaaatgtatttatttatatattctggtaaaactatatgaatgtctgccatgtgtgaaagttatttttctgagtgaaatttacaattgcattgaaaaaatgcttgcattttgccaggcacttctgatttctctgcctgtactatttcattacaccttttaaaagctctatgaggtagactatgttcttatgttagagatcaaaacattgttatggagtcagtcatctcataaatccacttgtcctctctctgccatgattgtgccatcagtcaaagattaaaattttattataaccaattaaactcataaacaatttgtggatttaacaataggcattacttttaaaaaataatttataggccaggagcagtggctcacacctgtaatcccaggactttgggtaactgaggtgggcagataacaaggtcaggagatagagaccagcctggccaacatggtgaaaccccatctctattaaaaatacaaaaattagctaggcgtggcggcgtgtgcctgtaatcccagctacttcggaggttgaggcaggagaattgctagaacccgggaggtggaagttgcggtgagctgagattgcaccaatgcactccagcctggtgacagagctagattctgtctcaaaaaataataataatttataatatcttgtgtattataaatagactctataaccagcattgattcttctgtattaagtcttcaccagctcatatttcttcccttcttcaccatagcagtgtcagcctctaccactcattccacattggaatctttcattgttctttgtgttgtccttatttcatccacttctgctaggctgggatcaaaggcaattatcaaaaaaagggaacctaacaggctgacttggttaaatcattccattttaaatattcaaaagttgaggcccccacaacacagtatgacttttcatatgggtaaatcaagatgagaatccatacctctagctctgcctcactacaacaagctgcctaccctcctacccccagtcactgtctatgcctttggttttctattgctacccacacatttgccaacggcattgctagaccaagtatgttcttaaatattttatattaatactagattttaaaatataaagtggtaaataataaagtcagcgaggttatcttgctctaactcctcacttaataaagaaactgaagccggctgggcgccgtggctcaggcctgtaatcccagcactttgggagactgaggtgggcggaccatgaggtcggaagattgagaccatcctgactaacacggtgaaacccagtctctactaaaaatacaaaaaattatgcgggcatggtggtggcgggtgcctgtagtcccagctactcgggaggctgaggcaggagaatggtgtgagtccaggaggcagagcttgcagtgagccgagatcacaccactgcactccagcctgggcgacagagcgagactccatctaaaaaaacaaacaaacgaacacaaaaagaacggaagcctagaaatattaagagaccagggttacactttttatttttatttattcaactacttacaaataataaaaatctgcagaggcactagtgacatgttatgacaactggtttgatcattatttagattttggatttatttagattttatattttaataattttgttcacctctgtaacagtacaaaaatcagcagcttttacagtaatgcaaggtttcttctaatttcactgaccttttcctaatacttcaaaagaaaagaataaatacatattggcttctgccaccgttgtagttaaacaaacttgtagaattcgaaaatatttaatcaaaatgttttgagtaaaatgagtaaaatataaccttctatataatattccttaaagtttcctaatcacataaaatggaaagctgaatttggaaaaaaatcaaattaagttcaacagactaaaagttctcttatatcccaaaaggaaaataaagatatgcttaggtatgaaatatctgacctcaacggccttggaaagctgtacatggtccttacagccaagtaacaaagaaatttgaaacatgtgttacaagaaaggaaagaggaaaacacttagtaggaaaggacaaaacttaaagatccataaatataaatcccgactgtggcaaataattttctgaatgtctgtttccactgaccagatgaaaatcgtaaatcctcaaagatgccaacaagtacttgaaataatcaagtcacgagaattaaggagtaaataatagctctgtgcatctcaggctaagaagccaagagccttcaacaatctaccagccaatgggcaattctcctcagaacacatgcagctcccccgtgacaattttaggtaaacctgatctttgcctatatggtgtaattggttttaatttaaggattttgttttactctgtgacttctacccatgagagcgaaagccagcaaagctaggctaatctgcattctgaaatttcattctgtgtttttattttcctttggagggttcttgttacagaagagcttcattaacttaattaggcatgatccagtgggcccatacaaattaggctagccacagtatctttagaatggacaaaaataagaagccagctgtagtctttatattttgaagaaaatcttaccagctgacatttctttgtgtcacagtcatattaagcttatgacaactgcaataaccaaaatgtgttttggaagttcaagtctccaacactatgaaatataaaagacacaacagtggatagggaatgaactgttttttttaaaccacaattctttttgtaggcatctagctctttgctttattatagaaagaataatcctttggtaaaagtgtgcttataaatcaatttataactactagcaatgtgataactgtatcagaaaacatttaggagaaaagatattttcattttcttcctagaactcacaggcatgtgtacacctgtgcatacacgtaccaagataatataatacaagataatacatgtatcagataatgcaaagaaaaccagacactacttgacctgcaatcttaggaagttattgattttgcctcaatttcttcatcaaccagcagaaataagaataaccctcattcttcttcagagaaatctttaggcaacttccctgtttcaaaaggataatctggataattgttaaaatagagattcttggaccatatttcagacatcctgaatcaggctttccaccgaagagccaaggaatttgtatttaataaaagttattcttagtgggtcactataaactaaaatataaataatgtgaaatccctatagattcttactgggttattataaactaaaaataaataggaaagctctatagaaaattttgagtgatatataagtatataccatcaacattattcagaatttctagcgcaaaggaaaatgttgcaaagaaagtattcttacaggaatttattctggctaacctttacactatgaagagttgctgtgctgatcaaatcaatcaacccaccaaccaaacaagcatcttcaggaagctcaacatatacccttctgcttctcagataagtacaaattttaaccgataaacactaaaagtcacatctcatacaataacatttaatgtagcaaaatactctagatatggttctcgtaagtcctggaattctggaactaaatcataaacaattaagcataatcacagcgactttctgacttgtcgcttgattctttataaatgtattctcaagaaatacaataagaaaacatggaagaaaaaatatgaaaaccttccaacctaattctaattatctgaattaaccatgttgaaaacaagatactacttggagtaggaattcactgtcaccataagctatttgtgacttaaaaactagaacatggagttcagaacacaatccaatttctgtagatgacagtgagttcccagcaggggttgttcctctccagaaacctgtcttggatagtatcctggtacttggttgcgttggcacgtctgccacctcagaaatcaacaaagtcatgcttccgtttgaatgagaaacttgacacattcctctgattcctgaactgtgcctacacaacctgttataatgttttgtagattgcagtgaatactgctgaagtctcacagtggctacgttcaatttcaaacgtatatttgcaaatttggaaaatgtaaattaggaaattttctggaagaaaattatgctggaaataacagaaattgcttgcgttcacttggtcaactaataatgactgaacctcggtaacaaagatttctggggttatgaacgtcggtttttgcaatgttcacgaggttccaaggattatgacctaggccatacttaagggtacatagatattatatctatacaatctgtatagatatagtacagtcataatatgagctggaattgattttattaaagctgataatagaaaccagatggtccaagtatctgaatcaaatatagacttccttaagctagggttgaaaatagctcaagaaaaaatgaatgaagttctaaatatgacataagagctctgcggaggtaatataagtgtggatatccaagaataataatgacttgttctgaactaagttaattacgtcttccaaggtattttatttggagaacgctgcatggttgtgtgctatatcctaaaattcaagtgtgcagaagacttatcagagggtgggtagaaagttgcaaccaatcaagttttacatgccttagtctctttcacttatgggtgataggattatcaagtttcctgtccttctcttcctagagattatatttttacatttgaagcctgtagctactttcccatcttgcaacccaaaaaccaaaaagacactgtgttcactaactggcactaggtatgaacagaatggatgttttcaaacaaatgaatgactcaaaggaattcttaaaatgtttctttggtgtgaagagcaggggtcacaaaggcatatggatagtaaatatagaaatactagggatttgcatgcaagtttaaccagctacaaaccaaacagaatagttctgtctaaaattaaggtaggtaattagtttcctactgctgttataattagctgtcacaaactcgatggcttaaaacaaaaacatttattatttttcagttctggaggtcagaagtcccatatgagtttcactgggttagactgaggtgtcagcaggactgatgttagcagtcctttatggaggctataggggagaatcttccttcttgcattttccagtttctagaggctgcccacattccttggcttgtgatcctttttcatcttcagagccagcaaaggccagctgagtctttctcattttgcataattctgacactgactcctctgcctccaatttaaagacccttattattacattaggctcacctggataacccagaataatctccctcacttaaggacaaatgaatagtaacatcaactgcatctgcaaccttaatttccctttgccttgtagggtaacatagtcatcacaaggttccaaagaataggaactagtcgtgatttggagtgggatggtcagggccattatttggtctacccacaaccaagaataatgaaaatcatattttgctcctgcctgtgaatggtgaaaacttcaaaggaagacacatctgacactcttctgttgggagagtttattcaacttcattttgacttcactgacttctatacactgatccaaggtgtttttttattggcaggttggatttaattttcaaaagataaactgcttgattgcaatcaaaatcaaacagaataatttatgaaaaatggaagcaagaggagaaagaatgtaggaggaggtggacattttccaagtgatttaattgaatattatcttaagaatttctgaagctcaaattcagaaggacacgtctagttggctaaattaccaagtctgagagtaatgaaagagttgccattccatgagcctagagagcaaaccaaactagaaatagcaatctcacttatatatcacagaatttcagtttaagcataggatacaagactaaatcaagctttaaatgtgaactctgtattcactatgtaaaccttctaacggaatagccttcagtgtaaagagctagttggccataaataagtttaattcccttcctttaaatttagatttgactcaagctgcatgaatttctggacagagaaaaaataaatttggggcagctagctgttggttttacagaattaattccagtccagccttgtaatcgcatatatttattaaaataactttgaaataaaatgtacggggtcaaaaagtatcaaaatatggtgactttaacatggaaatttaaattttaaaagaactatgtggaaaaattaaaaataagacatattgacaatacacttaatcagacagatttgtcttgatactaaaccctttcagctaaactcaatgccctccttctagctcttcttaaagtttcactcttcaaacaactactcagactcaaagtacacccccaaattcaacccactcacacaaacctgacttgatcatgtaaaatatcctttccgctttagctgactaaactttaaaaccaatctaagcacctggtgtgtcagtgataatgaacaatagtgcatatggcctatagggagttagagttgactcctaagtgagtaactgcttgccactgacatacaaggacttgaatagctctgggaacgtgcacagctctttacttgcagagtagaaattccaaggattctacatctttcattttgattacagtcgacaccaaaggcattcacacttgagatactgactgtcctgattctacagttctttaaagtgtctcaccaaaataataagcaggcttcctgatgtcttttctttattcacatgacaaaggttgaatatcgtggttactgagtggcagatattgagataattggtgtctcgaagcacataagggttgctgtgcttgaagattttcactaaattagtgcttaaaagataacaaataattgtaatataacatgctgcgtgttaatgcagctattacataatatagactcaacgagaagataactaactttactgaacgaagtcaaagacaggtggtagcacctaagttgaatcgtgaaggataggtagaggtttgacagaaagaatcaagaaggacaatataaacaaatatgaaagcaatttccaacagacataaataagggcagtacatttgggaagctcaggatgtttttatgtggctggtatgaaaggaagaaataggggaacagcaaaagacaaggctggaaaggatggctgaggagaaactaggaagagcttacttactgtcactgatgaggacttctttggaaagtcatattctcagaagtgttaggaaatcataaaagaaacaaaattttcaactgaaagcatttgattgaaaaaagaccttgcttgagggcgtttatctttatctttgtgaggtcaaattttgctaaggatggttaagatggtaaagtcagcacctgatacagaagatgcttgactacaaattcataatatatctatggtctccctggaccattcagttttaatgcctacagaaccagtgtggaacaaaaggtacgtagacctggtgaaaggtcacacttgtttattgtaagcttgcctttgttgttgctatttctaatttcaagtaagaaacaagtttccagacctcaaataaggagatataactggtagatataactagtagatcttctcaaaatgacattaacttctttttgtaaactcctacttcctcatagtatagctggagaaacatcttaccaatgtggagtagacagtgatatcttaatagcagaaatgtctcacaatttgattctttattggtgtgaaacactgtatcataaaaggtttcgaggccatatccttaagaggagtggtagattttcaatgaaagagctgtttagtattttggaaaatgcaacttctaaaaccagcaaacaagtatcacaaatggtgatgatgatcatagcacccttggcaaatggcctccagagaaccatcatagctggtgaaatggatacaacatgattaaagagaacttccatcttttctttctgagcatttcattataccactgattctcaaagagctggccctgggaacctagtgaggtctttcccagtaggatacatatatatgcatatctcatatattcacatatagtagttatgcatatactactgatatgagtgatagggacttctctagatcccaagttaacttcctaatagtagaaaaggcactacattgatgtaatatataatgcccagtaatttccactaattctagtgtttgctttttttgctggattggtttgacatgtgaaatcacacagaataaatctaatctccaatctccactttacaatccccactccatgacactcaattactttaaatgttttatcctctactccaaagtctgctgttttttaaagacaaaaatcaaaccaaataaacataaatcctaattatctcacttttctataatagaaaacttacaaagaaatttcaaacaaatggaaaagtttactttatcaaagatctcctaagaatctgtaatcattctctaatattaaaatgtttggcacaaacatcagaactcaaatatataatataaatcctggcaaacaactccacaatatattgaaaaatccacctaatcatttgatacggtttggctgtgtccccatccaaatctcatcttgaattgtaatccccacatgtcgagggagggacctggtgggaggtgattggatcatgggggcagtttcccccatgctattctcatgatagtgagtcctcacaagatcatggttttatatgtgtttgactgttcctccttccgacgctctcgctctgtcttgcctgcggccatgtaaaacgtgcctgcttccctttctgccatgattctaagtttcctgggacctccccagccatgaagaactgtgagttgattaagcctcttttcttataaattacccagtcttgagtatttctttatagcagtatgagaatgaaatcatatatgtttaaccccttttttttttttttttttttgggacagagtctcactctgtcacccaggctggagtgcagtggcgcaaacttggctcactgtaagctccgcctcccaggttcactccattctcctgcctcagactcctgagtagctggaactacaggcccccaccatcatgcccagctaatttttttgtatttttagtagagacgtggtttctccgtgttagccaaaatggtctagatctcctgacctcatgatctgcccgcctcggcctcccaaagtgctgggattacaggtgtgagccaccacacccagcccctaaacctgttttttttttttttttatggcaaattaaataaaaaactttaagtcaaaatgtgtgaaaagattgcagacaaccaaactatggcagaagagtttgatcacatgataagcttactctgaaaaatagttttttaaaaaacaagaaggatcagccaggtgttgacatacaaaaccatatagccaatcaaagcttatttgaaccatatacctatgttgagagagacagtttagaatttaaatgccatacaggggcattcagtgcttagagggaaaaaaattagtactgcttttatctggatataagccatgagtggagaaaaacaatgtacacacatgtagactttatatatgtatgtatagtcacataatctttcatatatatgtaatataacaaaccaatgtctgggaaagttaatggcaacagtttaagagcatcaagataaactctttgtgcttagaaagtttagttttgtcttaatgctattcatgaagtgcatcgaaaagttagtttaattcaataaacactcttctttagaattatttactaagtttactgtattggaggtcataataatgaatcagaaggtgctcttgttttcactgagcttatagcctaattaataagaaaaagtaatgatgcgtaatccatgtgtgttgacttttaaaaattcctgctctatgtgtctctctttaaaggtgtaagttagtatgtcttcagtaggctagacacttatcttagttacccacaacagatgcaattctatgttgtgcctatgccattgtatatcgctacaaatcataggttaagttcctggaaggaaataacaggctgatcaaggattttcttaaaagcttcaatatgtcttaaaggcacaggtatcagagattctaaacatatttatctttttcacaaaagtaatatatcctatttgataaaactatagaattcatagtaatgcagggtaatgtgaggttcaccaatcattgtaagatataaaatacaagaaaaaataatatagtattttgcatatcatgaattatcttaatatgaaaataatactccatcacataaaatatatggattttatggattatatggattatatggatatatggattatatggataaatatacgcatttataatacagtctcaaaaataaattagcaagtggacaaatacaataattacttttaaagcactctggggaagatctgaaaaaaataaaaaagatgcttaatatactacattatttaaacaaatgtaaattacattgagttcatggttctatttatgaacttagaataagcatcgttaacacataaagaaaaaaacagacgacaagaggcctgcagaggagcagaaacaatgcggaaagtgagaaagaaaagtccagttattttgaaaaacaagactggtttcaatattatcatttggccatcttaaggaactgcaggttaatcaatacattataattgattaaaaggaagtatttacaatatatacaatagtactaatatatttagacacataaactacatttaataaaatctgtgttaagagtcctaaacaatgctataatatttaatccttatctaagctaggcaacacaaagcaacaatattgttgataaacagctttgctacataaggtattgggaaactaagtaaacttgtgatagctttggtttttaaggtgctatggttggactccatttgacacatttaataaatggtgcatacaatttttagctaaatatctaacaggatgtcatcctaaaacctcatgttcctatattactgtgctgttaacagaaacagcttgcagagatttatggcttctattaattacactaaaaaatatggtagatttgctcaaataaatcaattgtaacagaaaaaaagcgcatttttaaaattacaatcatgcgttacaaatgactgccattatcaattctgccttttcatttattcccaaagtgaagggttaaagggggaatctttctgttttcctagatttaaccctggaagagcagtctttgagttagtactttaaatagcttacagggattctagttaatagcctcaaaaattggaaagaaatgagacaaaatatcaagacaagaataagattgaaatatataaatttctgcctatccctgtttttataaagtaagtttcctccccttaccaattatgtttcagttctatatttccattcagtgctactttggctttttttaaaattattcatatacctgttaatacaccctccttgttccacaaagaatttaccaatctttgcatttatacaaacaataaaagcaaaaatatcaaaataaaacaaaaaaaaggagaaaatatttttacaacagtgaaaataaaaggaagaaggaaagatcaaataaaaaacagaatgcattcaagtttacatttagaactacatttcagatttctgaacactttttgttgggctctaaatcaatatcaatttcatgctcactgatgttcccaaggagttgtgtttctttattcaatatggccctgaacactgtgagccctagatgtaacttatattctcaaatacttatgtggcttggcattcatacagaatctgtctgaattggtaaaaatactcagatttgttttttcactcttcattaacctcctatgacaagtataatccactatcccaaatatttattattatttaaaagaaaaatgtactcatttttcttggaccaacttgtttaaagacacaaaggactcatcatcctgaagaaaattacaaatgtattaataactttttatgccatctataaacatctctcattttggtactaaagaagataggggtctttttatccccttactagttagagaagagccaaacatataaatatgcatggagaaaagcctgagagaacatctaccaacatgtttacagtatttatctgagtcactggatcatgattagactttcatacattctccaaattttctacaatgagattattgttcaaaaatagccagtgcactctgggaggccgaggagggcagatcacctgaggtcaggagtttgagaccagcctggccaacatggtgaaaccctgtctctattaaaaatatgaaaattagcccagtatggtggcatgctcctttggtcccaggtatcccagttactcgggaggctgaggcaggagaattgcttaaacccaggaggcagaggctgcagtgagccgagatcatgccactgcactccagcctaggcaacagaacaagactgtctcaaaaaaataaaataaataaataaataaataaacaaataaacccagcatctgaaaagtatcaaagtactgaaacaataaaggacatataatcagtcaatatgaaagcataatatttttgacccttagaaaacaggctaggaaaatggtctttctatcagatcatgccttttaacacaagcaattatttccaaaaaccaatcaaatgtacaatgctgcttatacttcatagcactaaaaagtatccttcatcatgaatgggagaggatctttcattggaagagccatttgtaaaggaaaccactgtctgaccttctcagagaaatgctgtcttccaacgagttaaaatgcttgggttatcaatctatgagccaagttggaatcattaatcccaagtctagacatttcaagacgtagaagcaaaatagcaaaagatacagagtgtatagagttctgctcctttgctggaaaaggagacaaaggttgaactttaactgaaaaatgatacggtttgtctgtgtccccatccaaatctcaccttgaattgtagctcccataattataacgtgtcctgggaaggacccggtgggagataactgaatcaagtgggcaggtctttcccaagctgttctcatgagacttaatacgtctcatgagatgtgatggttttatgaaggggagttctcctgcatacattctcttgcattccaccatgtaaaacatgactttacttctcatttgccttctaccatgattgtgagacctacccaaccatgtggaactgtgagtcagttaaacctctttcctttataaattactcagtctcaggtatgtctttattagcagcgtgggaacagactaaaacaaaaagtaaaaactgtctatggccatatctgtctatatcaccctgaatgcaccccatctcttctgaaaagtaaaaacaaaacaaaagtcattgaagcatcagttacctatggaacatcttgtgtttgcaaaactgatgcaaacaataactctggagtaatgaatttttttgatacttttttttcttaattcaaaagtagaaagttacaaaacacaaaattcacagaaaacaaaagggggaacgcaagatggatgagggctctactgatggccctttcccccacccgcccaccctttttttttttttttttttttttttttgaaacggagtttcactcttgttgcccaggctggagtgcaacggcgcgatcactgcaacctccgcctcctgggttgaagcgattctcctgcttcagcctccttgagtagctgggattacaggcgtgcgccaccacgcctggataattttgtacttttagtagagacggggcttctccatgttggtcaggctggtctcaaattccctacctcagatgatccaccagcctcggccccccaaattgctggaatttacaggcatgagccacggcgcctggccggcccctcccctttggtagaaaccaaaaatcaagtgagcactcgcagtgcctaattttgatttcatattgttgaaagaggcactgaagaaggtagaaaagacagtggtgaattgcccacgctgcccctcccccatcccctggctgcagcctggtagtgtaaggaatctatgtgcttgggatgggtggagcacagtgaatgggaggctttcatccaactcagtgctgccctctcacagtggaaagcagaaccaggctgtattcagccgacacctgcccatggagggggcatttggactggcctagccagacggaggggattgcccatcccagcagtcagagcttgagttcccacaagcctcaccatcacaggctgaagcactctgaggccgtatgtgaactccaggggcagtctaggccacaaatactgaaattcctaggcaagtcctagtgctgcactgggctcacggccagtggactggaggggcatgtaacctactaacactccagcctgggtagttaagggagtgcttggatcacccctccatcaacaccaggcagcaaagctcacagctctaaaagacaccctttccttctgcttgagaatagaagaggaaagagtaaagaggactctgtcttgcatcttggatgcccacacagccacagtaggatggggcactggtcaggtcatgaggtccccattataggccccaggtccctgatatttctagacacatctttggccagaagggaacctgctgccttgtagcaaaggacccagtccaggcagaatccagaccctactgactaaagagcccttagtccctaaagaaccagcagtaatacccaggtaatataccacaggccttgggtaagtctcaaacacatgctggtttcaggtgagaaccatcatattaccaactgtggtggctatggggagaaactgcttctgcttgagaaaagcagagggaaaaataaaaaagaaactttgtcttgcacctgaggtaccagctcagccatagtggggtaaagcaccaggcaggctctccgggtccccagcatcctggatggcatttctagacctgccctgggccaaagagctgatcgccttgaagggtgagtcccagtcctggcagccacaagctgactgaagagcttttaggccttaagtgaacactggcaggagcttggcagtactccctatgggcccgtggtggtggccatggtgtgatgttcctctatctgtggaaaggggaccgaagagtgagaagcactatgtcatatggctttattgccagcccagccacagcagactagaacaccaagtagacttctaaagtttttgactccagtccctggctcccagatggcatctctgaatctgccacaagcctggcagaactcaccacccttaaaagaaggcctggatggctttgccacctgcagactgtagagccctatggccttgagcaaacatagatagtagccaggtaatggttacagcaggccttgggcaagactcagtgctattcttgcttcagctatgacacagcatagtcccagtggtgatggccacagggttttttctatgacctcacccttggctccaggcagctcagcacacagagacagactccatttgtttgggagaaagtaaggcaagagaacaacagtttctgcctggtaatgcacagaacttttctggagcctatccaagaccaaaatggcaaaacatctacaagtctccaagaaccactgtgctattggggttgggatgctactgatggcagtattgtttttcctactgattgacagtgttgtcacagagtaaattcttaaacgaatagcatagaattcaaatgatcaaaagcacatattatcagggttggaaaaggaaaattagaaaaccatacatttattaatttagtcagttaagaaatatgtatcaagcacctagtcattgtgccagattggggaatctaggtacaaaaggtacacaaccagcctggaatggacctccagtatggagatgaaaataattataggtagtgacaatggtgacccaatgtagtgcactgcaaggacagaaaagggtagaagatatcagatctccatctctacactcagtcacttacacttagcaatgtgctaccaaacagaagatgaaaaggagggaaaaatggaacatgacaggaactccctctgcatatatttacaggcacaatgtccaataaactggtgaaagaaaagtgtttctataaacgaccttagcattctatctttcacctgagccaatagttctaaatagaaaactgtgaacatgttttcacaattaaggtgtttacaattacatctatctgtaaagacccctagatattgctggcatacaccttcctcattgcccagggcttctgagacttcacactaccttgtctgtataagcctttggtggtgcttcttctctccacttataaataggatgacaacagcaactgtgactcttgccacatgatataaacttactatgagccttatcaggaatgagaataccagagaccattgtttcatgagatgatgaattccctaaacgtgtaaaaagacaatatacaaacaaatatttaatttttaaaattgtttttcaaaactgcagcaggaatcagcatgtttttatctgacataaaaccaaaacggccttcaacatctctttgtaatagtctcatgtgctcagacactacagacaatcgtcaatagaaaagactgtcaacttgaatgaactcaacctgcatcaatatttttccagagtcagcaccatgcccaaactaagagaaacatgcagttacataaataaatgaatatggatgcatgtgcatatatatgcatttgtatatacacaaaatgaatgtgaatatctttctatatctgtatcctagctttaattccatctccatctctatgcacctgcatatactcattcaactaattcattcatctgcataaactcattcgatataatcccctttagtcaaacccaccactgaattagtcttccttagactgctgccactggaagatgaagagattccaacaacactgcaaaaaaatatagcaactaaacctgtcttaatcaatttttaggtttcaaacagaggttcttaatcataagtagtattctattacctgcaagatgatttgtattcatggaagtatactataatccttaccagaaactaataatgattttaataaacttgcattgacttcagaggtttcaccatttataagttgcttaattcagtctttgtaaaatcattcattactctttacagacatcagctggggaactacaaggcaattattagattaaactggatttaaaggttgcttttattgtaattgcaaaagaaaaaaatctaagttttcttaaatattatattgtacttagacaacagtttaaactcttggtgtgagtagaaaggctgggtctttggccctatagacagctttctccagtcagtggtttcaaaagtatttactttgtaacactggagctacatctccttaacggtttgctttctcacttatttgagaacttttttcctataacgtgaataaaaagaagaaccttagcaccccaagcaccattttttaagttaaatacttcctttatatgagaagcagatgctgtcaatagaagtcacccgaattcagcaagcagttagacgattaatcaacttagaatataaatccaactatagttgttacttataagggaagttgatgaaaagtacatgtcctaactctcctatccattgatataatcaatctatcaataataaagtattaattagaaatattttcaggactttggaggaaacaaacaattatacattgcttccacatgcaaatatttcacaatttagttatagtgaaatcccttaatggaaaagcccaactaattagaagaaaggctacaatgaaaacatgtactttgtattaaaaagcattagacactataatgtgtttcctatcaaccatgcctcaaagtttctcctacctgtcctggaaacacaatatagctattctcacaactacatatatccaaaattaaacaattatgctgagagtgtttaattcttcacttcagcttccagcatatcatactgtcaatgaattaacattcattgacaatctactatgtgcccagtactgttgttgtaaagtaaggaactcaaaaacaagacatagtctctaacctcaagatcctcccaggagaggaggggagacccatgcatgaagtaaaacacaatgctttaaggtatagtcgaggaaagagcaaagtgccacagtggcacacaagagaggaccattagatctcagaaaatagccagggaagtaatatatgagctagatctttttcagaggaatagatttcccagtaaacattaactggatgaatcacagatagggtgggaaaggaagaagacttactaaggcagagaaatacaagcacagcatgatattttttgagtggaaagttcagcctgacaagagcatgaagtacattacatcagataagggtaagtccaagatgaggccagcaagggaccctggccatactgcctcagggttttctcctatagccactggggaatgataccaaagtggacagtcaaggaacagatgccaaaacccttgcaaaaatccccaaagcaataagggggactcaagctaaatcagataaatatagcatgaaaagaggaggtcaaatttaagatgcatttctgaagtaatcaattatctcctaagctattgcctactgagtttggtggaataaggaggaaaagagaaatcaagtaagtctgtgagttttcaggctttcataaacgggtatgatgatgccattaactgagatggaaaatatagaaaatgggagagaaaataaggtcatcccttaacatgtatagcctgagattactgcaatacatttaggtgcaaatatccagtgaggaggtatgggaaagtaagcaagttattttccatgcaacttatttaggaacaatagcaatttgatttctgggttttccatttatttaagtaacaaaacaaaaataaactgccatcttttaatctattagttgaatcactcttggtaacctctggcctatcaaactgtgcaactgcccatgctcccaacccaactgccacaaataaactcttcttctatcaacctcttcagcaagaaagcattttgccaacataatatgcctcagcagaccttaaaataatgaagttggaaaaatgtgggtgagcaaattttgaagtatattaaacctgacaatttaatatttatgtaagctgcaagtgctaagcataattggacttaactattggcttaggtttaatgggttgtgaatttaacttcattatcatagttttgcctgctctttgagctcattcaaccgaactagagaaaaaaaactgagagccattttctacctcaccaaaaccatttttgagatgacctgaaaccattgggtcaaagaaggcggattctttcatttcacaaaagagaagagcttcagtgaagactcctcagtggttacagtcagaaaacaaacatgggtttactctagatgggctagttactgtgagtctttaggcaagttactaagcctctggaagcctccatctctacataaatagggataatataaaactttcaagatactgtgaggatgaaaggagaatgtacctaaatcacctggcagaatgcttttgcacatgatgtgacatcagtgcacgttggttcccttcagcactcatgccattaccttgtgcttcaacagacttacaccacttccaggcctttctgctcatctctatggaagttggcaacataagcatactctacttactagggattgatcatcctaccagctattacagccacctctctgatacgatttgtagcatgtaaatcagaagcacaggtgtgccacagcatggatgagtcctttgggtttttttgtttttgtttttatttttcggggagcgggggtgtcgaggggtggggatgtacatcgtatactatatcatcctaaagaacctaaactaaaaggatccttatttcattccattttatgctttataagcacaaaacaatgaatggatctacatacaattgtggacaaaatctctctgaaggcatgtctccaggaattcctttgtggaatgtagtgatgaggaaaggaggaaggaggttccaagggaaggaaaagaaaggagggaaaagtgtccaaataactgtctttacatgcattcacaaacacacacacacaccccctcacagtagccaataggcatgattctacaattagagaatgctaatgtaatgccagtatgccttgaggaagatcacagtctagtcctttcatgtggggaagaaaagccaagagaaggaaaatcaattacctgtgaatagcatcttacaggggcctctcaacctaacaaatgaagagacatgaagcatatgcagagacatacgtttcctatgtgcaagcatcaagaatccagaccatatgatgtataaaagagatgaaataagttttcaatttatttccagggagtaaataagtaactgttgaaggagggaaaccaaccccagatgctatttagggcaccaagctttacttcactacatgatgcttgatattctgaaatccattctgcctttctccctttctcctaaacacctccaccccttctgcacatgaaaacaatgctaaacagtcttttcatattttgtttatattttatgctagaggaaggtcatttttatatctatacaataatctctctcacctccttagttgccacattttaagttacagaaactttattcaaaatgttcacaaagcacattgcttaaattataaatgaatccaggatctgtcacagttttttttgtgtgaccaaatttgggcatctctctctgtagaagcaggacaatagtcttaggtaaagaaaaccttacttgaatgcttaacttcaacagaagcccaatgggggctggagcagacacataaatcaatggtagaatgctgactacctggggctgcagggtttggaatagttgggaagacattggacaaaggatacaaaattttggttaggagaaacaagttcaagagatctattgtagaacatggtgagtatagttaatattatattcttgaaaaatgctaagagggcggatataaagaattctcaccacaaaaaatataactaggtgagttaatgcatatgtaaattagctaggtttagtcattccacagtgtatatatacttaaaaacatcatgtacatggtaagtatctacaattttgtctattaaaatctgtaagcatataaacagcaaattaaaaaattcataaaataagtaggaatagggccgggtgcggtgccgcatgcctgtaatcccaacactttgggaggctgaggtgggtggatcacaaggtcaggagtttgagatcagtctggtcaacatggtgaaaccccgtctctacaaaaaatacaaaaattagctgatcgtggtgacacgcgcctgtaataccagctgctcaggaggctgaggcaggagaattgcttgagcccgggagggagaagttgcactgagccaagactgcgccactgcactccagcctgggagactgagcgagattctgtctcggaaaaaaaattaaaaaataaattaattaattaaaaacgaatgggagtggcccctggttataatgccatttgcaatggagaatgaccatctcctactagagctgccatgccaaacctcgtggagattcatagaatagtcacttaataaataaacacaaatatttattttattacagtttattgcaaatctaggatatataattttaaggcaacctagcaataagtttaagggatgtttttacattatggtggactttataggaaacaaatattattcttgtgtcacatgtttacatgtcaaatataactctattcaagttaacatggaggctgcctgccacacttgggctgcaaacatctgtgattacaggatgtcagcttttacgacgcactgcattctaatccgataacccagtacactgtttttccattattcaattccgcatatagctgagaataggacacagtatttctaaacctttttttttttaatctagacttctgtataggatatatctatacattacatattgaattgaagatattactgttaccctattaacccggataatacaaatagttgaactaattcaagttccaaagtaaaatttcatgacttggatgatccagttcagctgtcatgaaatagggatgaaaaacggcacattataaaattttagtaaagtattttgcttatactacaaaagggccagcatatggtattcctaataaagagattagataggaagaacgagaggtatttccaaactctagaatgccacttagcaaagcatcactgtggtatattttagcgctccctgttcacccagcagagcgctcaaatctaaagcaactggtatattccaagagagtcacttagaaccactcagagactctcagtgtctctcccatatcttcttatggcttgacccatcccctgctccagggcagcagggaatctgaatctgaattaactgtccacatatatcaaatcagccagaatactggaaaatcacggcgtttagtacatgaatagcagttgccattagagtactgacggcaaatggatgatgtaaacagaactttgaaaatgcaccgaaaaaaataaaaaaggaagaatagaagtactcctttaattttcttaattctggaggggtttatggaaatttctcttcagggatcttcatgaatcgggccatatgtactttatctctacaattgggaaaggataagtggcccaaagagagtgaatcagcacaagtcaagtggttgaggcattttgcagagtgatgagactcagacaggacttcgcaaagaagcaaccaggtgaaaaacaggcttctcagtgtttcccacatatcacctctataattcagaggaccagagtcatctgtgggcaaagtgcagcacaaccatcaacaaaaacaaaattctcacatcttgtctcatcttaaaagtgaatgagaattttacgtttgtctcctcaatgaatgtaattttaatattaaataatccttgttttccttcaatctctgagaaaagctgatattccgggaagatgagacatattaactttatcatttcacatatgcttggctgcatcccaggacttgagtgtgttcacgtggcagcactggacagggtgtttaggaggtaactccataaagggcagcagcacagagcataggaaggatatgggatgtgaagtcagtttcttcaaggtcaggctctgtttcatgttttgtggttttgtcatcttttcttacctttattttagattgatgagttgtgaaaagcattgcccttatgatagaagtatcatgaaaataaactaaattaatatgtgacaagtatgtaactggatgcctgaatcaggtggatgtgcattccacggaagcttgtgttaccatgtgaagatctctgctcatccatacacaaaaaccacagaacaggagcaatttagcaccactcataaaacagggcacttaaagagtaaaattaaataaaaattataaatcaacacaaaatccacatttgaacatcactatttaactcaagtttatttttactaatagctggttataggtactaaattaccctgcaataaatgatttgctcataattcataaaaatggaagggatacttgagtattttgaggttttcccttaatcatttgactttttccttccttttaaccgtattttttccttatacaaataatataaaggagaaaaaattcagtatatttcctacattaaaaactccaacataaatgttgaataagacaagattagattcatattaagttctgattacgagctgagctactaaggctcactgtagctcaggctccctattagtaaagtgggagaactaattttctacctatccctcaggactgatatcgagattaaatgggctaacctgtagactaaagtggtttaagagtagcacacattttaagtattttggcatagcagcacactttttgttaagtgatctttatcatcatcattattatttgttgttgtgcaaacactgctctttctgaactgcagtgcacccatctatttcaaagagataatacttcacaggattgctgtgaaaagtaaaacacatatatatattttttgtaaagcacttagcatactgttcggcacatattaaatactcaataaatggtggctattatcaatttcagtattcagaggaaaaaatctgaggcactggaaagcctagggtttttgttcaacattacattgctagttagtgtcgattctgggatgggatcctagtttttctggtgcccagcccagtgtcccagccacaccacatggtctcctatagatacctgaatccaaactaaaaaccaagggctgatgcttctttcctctctgttagacaaatgaaaacttaaaccattctatttgaacagcaaaaaagctgcgaaagtcaaggagtgggcatgctaagcaccacagactgacctttaaagtatttactcataaatattcagttcaatagccaaatgccagtcttggtgcaccactgtggtttcattcactgtttgaagttacagggacattatttcatccagtctagttctgctgtgttattctacttagtttttagaagagctttaatttcctggcactttttattttccatataatcatttcattaaaccatacaacaggacgtgatctggtttagatgaaagggcaacaacaagccccagaaaaataactttactagccagctgctaacatgctgaaagtaagtttttctaagcctagctaattacattaacattttccacatcaacaaccattatggttttatattttcatgttgaaatattatatggtcctccatctaaatttatggtttattcttttcataaatactaggatactcaaaacacgtgatgaaaaaataacatatccaaaagattacatttcttataatcactaaaatagatgtaattccttacttttcacaactgagaatgtttttcttaatggtatcccctgtaaagtaagaaaataaccaaaaagctgattgttcatttgttaaacaagaatatcaaagttaaatgagcctgactctgttctaatcagaggatatatatttttttaactatcacaaatattggtaggacttgccagttgggcaaagctatccttatgatgacgtcactaaaagatgaggaaaatggaagtgaccaaccagaacatggggtaaaggatggaaagaaaggggaataaaaaccagagcagggccaggcgtagtggctcacacctgtaatcccagcactttggaagcctgaggaaggtgaattgcttgagcccaggagttcgagaccagcctgggcaacatgacaaaaccctgtctctacaaaaaatacaaaaattagcagggcatggtggtgtgcacctgtattcccagctactggcaggggtcaggtgggaggaccacctgagcctggaaggtctgggctgcaatgacctgtgtgtgatccagccactgcactccagcctgagtgacagggcaagaccctgtcaaaagaaaaaaagaaaagacaaaagaaaaaagaaaagaaaagaaaagagaaaagaaaagaaaggaggggaggggaggggaggggagagaaaagaaaaaagaggagaggagaagagaggaggagaaggaaagagagcaggaatagcattcattatcacttccagaaagatgatgtttcaatgttaactactcctttttgtacctaaatatcaagaccttgtgaaaagaaaagaaaagaaaagagaaaacaaaagaaaacaaaagaggggaggggaggggaggggagggtttgggaggggagggaaagagagcaggaatagcattcattataacttccagaaagacgatgtttcaatgttaactactcctttttgtacctaaatatcaagaccttgtgaaaagaaaagaaaacaaaacaaaacaaaacaaaacaaaaggaaaggaagcaggaatagcattcattataacttccagaaagatgatatttcaatgttaactactcctttttatacctaaatatcctacaaaacatatctcctttacacgattcatccagtaagtatatttatatttcatattccattgtttgcttttgtatgtttggccatatcaattcaaaagcactgaaaaatgttcatttcatttaaaggccaagattaaatgtatgaatttgagtctataggcaaaggatacaactggcagctgtacctgaattaagtggaggtgtttgagtgaaactgtagatagatcatttgagaggctgtacaatggagaaaggaagctgttcaattaaggtgttagaagcaaatcggaaggtaaggaaaaacacaagggtcacttgtcagttattacatgggaatgcattggtcagaagaagcaagacagaagaataagttaatgaaaatccacatgcttcgaacttggacacagggagaaggatggcggtactattgactgaaataagaatgcagtgttttggagggatgttcactgaggtgagaagaggatgacaacttctgggggaccctgaggctggtgggaccacccacatacaagtggtacctgcctcaacttttctccagtagagaacaatgaagacatttcacattcttttttatgcaagactattagcatgttttaaacaattgcctctagagtgattatttaaaattataatcgattagtttaaatcatgatgtgttctgtgattgggtatggcattgttatgaactactaccgtgccttcagactgattaggtattaaaacttacaaaaaggaaaggattattaataacaccagtagttagtactttcatgtgtttatattcaacattctgtcaataacaaaaccctaacatttattcattagtaaaaaaagacttatattttacttatatttggtgtgcgtgctgggcaaagggtaggatgtcttagctctccattacttccaacacataacaggtattcaaagaatgttacttttgaatagactgaataacaaatataaaaaagcacatgtagattaagacaaagttactctgcaaatgttttaaaagagaaatggcattctttcatctcagtggcctcttccatttctagaagagagagcaggaaggggaagggaaaggtactatccctgacattaatgctaagggtgtaaacattataatatcttactttgccttccttctgggaaacagagcacttcaaccatatctagaaatacttgagagactattctgctactgacttattttttttaaaactaaaaataaatccaagtgggaataaagggcagattaaaatatcatagcatcacagactctctgacatcatcatgctgtgttttttacccaaagtttgaatctcctgcctctctagcacccccagaaaatgatcactcacctctacctcctaaaattgccctggtaattttcaggaagctgagatcattccagagttcttcctgggaccaatccaaaaatctgccactcgctgagcctgatttggctgtctgcatgaacacaaaatgagtctaatccctcttctacatgacagtccacagaggcaaccaccagtttcataactggtttagttgtttttcttacaccctgagggaccaggagaattacattttcacattctcagcccaactgtcttttctgcaagaactttcctaaatgaataaatagtctgtcattttagaactagctcttatcaaagaagagtatcgctattcttgcagttttttttttttctataaaatagtaaagttgtgtccttcacattatggtaagtctgggaggctattagtgagaatatgagtttctctagttttgttctgttatttgatatagtgttatttttaatatactgtcattcagatgtgaatatgacatgattaatacattattggtaaatgtcatttaagatatgcttccaggagaagcaatggtattacactgagctttttgaccctcattcttcatatttgtgaattcacctatttgctaaagtttatttgtaacctccaagtcaatacttatggtgatttcagccatttcatacagtggcaaaatatttgagttgcccaacacatgcagtcacagctaaggtcaaacaaggcaaccagtttatgcatttgtggcaaatgagactaatgagttcagaggtttgatcatcccatgaccaggtataggtttattcatagtaaaagacctccctgcctgtattcagtttgataagatgccacacagattaatgctgaatgttgtaaggaaggccaggataaatgagggtagactgaaatagagaagataatcacttaagtactctttaggactgagtcaatttcattttccttttatgtagagccctacaatgtagaatcctacagcttctcatatctttgcaaagataactactacaaaggagtttatgcaagaaataagagggcatataagggatctggcacattgggatcttggacctttagacatgagacaaaatgacaaaatgagacaaaagacatgagacacaagacaaaatgacagacatccggtcactttcaggaacaagtatctgttagccaaagtctacgacagagttggacaattacttagccctgactagtcctcatatttcacaaaaagtaatctacatatggcaagtaactccaccaaggaagagggcttcctattttcccactttctgaactaaatcagctcaagctacttttaaagaaaggagagcccactcttgagacttctttgctccttcttttgtttggcctgctaattctttctccatctgaggggtgagaaagacttctttttagctgtctctttcactgccaacctgctttgataatgttctgggggctttaccagaatgacattttagaccactctaactcagcttagccactgaagctgagcacagctgaagaaagcactcaattagcaactccaacttcaaaggctatattattctctcctcaatacacatgtgtaactcccattagcgttaatgggagctgtgggagcccacggctcagagaatatacctccaagtctgtttgcttgatgagcatgcaattaaaccttatggcccaaatttttcaaggagggcatagtaagtacaccaagcactcatgcaaaatcaagtgtgcttactttgagaaaaagtaagctatcgccactatttaaacatgaagaaagagcagtctaaattaggtctattttaatttcatttgtcctcttaggtgtggacaatggcctttcatggtgttttgaggaaagtcactcctcttttttaaaaggtgaattatatgtttttagaagcattagttcacattgcttaaaagactagctagcctcaagggtaaaaatgtctaataagaacaaaaccattctaagtgaatttcgtacacataaaatccagcatggcacctatatacactcagtggcttttcctgtctttatttaatagctgtattctaacttaaaattaggaaaaaaattgatttgacattaaaaagaaaaaaaaattttgagaggaaaatgcatgccccaataataaatttgtccttatcaggaagtaataatttccgtccctttcttgcattctaaagagatttgtccatatattttcaacatgaaatcaatatatatttcagcttcaatgaaatatcaatatatgtcagctagtctgtgctacagccacagtcttgaacaacatcttcatggggaaaataatcttgataatttagtaccatttaaaacaattccttttctattattcagacattttccccaaaatttaaaaagaaatttatgaatgaaagtttttacattttataaaggagagttagctaatcacttttaaagtcatacaagtgaattgttgatctactattgacacataattcactctaccaccaaacctcatatcctgactttctaaccacatgaggcttttttaggtactggaccatcagtacaaatcaattgaagtgcaacgggccaatgaacttatcagaaagacaaaagcgtccacactaagcttatgggaatgtcgagatgtcaggagacttttcaagttgtaacatggcagatgagctagaggaaaactcctttaaaatttcatctagtacatggtcttcataacttcattttgcactaaatatttaacaccttgctttacaagtttgataactaccatgtcttcataaaatttcaaagcccatgtgttaaaggaaagaagtatttcaaaactgaacacagggatcccttacttcagactctaggcagactgaataaagaatgataaccatagattagataataaaccgtggtctgtggttaacagaatttttaatgatgacaaatgtgagaaacattcactatttcttatcaaaaaaagattgtggtttttctctcatatctgcaatcttattcataaagttgaaagctactacaatagataccctactttcagagcatatctcacatacaaaactacctttcaagtgagagataaagactgccgatgttattacagaggggctagacagttttattcttagatgttttggatgtgatttactctggctaaaaatactaataatttaactatgctattaatcctgctgaagtgattatgccctccatgagaggctaagctgaaactcatccagaccttcagttggcacagaacacactgatttcctcatatagaagttcagttggtagtggtttaatcggggattatcagtgtataaaatggcatttattcgaacacccctgtgagtacaaccgtactctactttctataactgttgtccaaaatacttatttacaaatcctttttttcccaatctggctcttctataagagataaaaatatattttcatttgatataaaccaaaatacactgagagttcatgaaccttggatgggtcaagggatgtgaagtaaatcaatgagtaataacagcaattacctaaaatacttgcagaaagaaggaagagagagaagaaagatgggaaagaaggctgggagaatgaagatgtctactcagtgtctctgatgagggttggtcgatgaagcacccatattatgatctgagaggcagctgagatttgtgcacttctcaggagagagaactgctgtctcattttggagaaatgcttataactcttatcaagtggatgtgcaaaacctgatgtacataagtaatttattcctattcctgattactaggctacaatcaacatcagatatgtcacttagatgtcccaacttttaaaatttactgacatgtattatttcagcaacatatttgagtcccttctctgtagcacctcttgtctaagtactgggataagcaatactgatttcattcctacttaaaagaacaaacaaaactactttgtttttaagtcttacagtcttgattttaaaaatccaaaaggcttgaatttaaagagtctaaaaatccttaaaatgaaactcttgagtagataaactttcttaaaaataagtatttctataagtgtatttatatatgtacataaaagggtgaattcaacttctctttatctttagactcttgtaaaagttgccattgaaaggcacatctgatacggcaatttcagcacagaacatactcaataggaaacaactaactagagaactaaagatgtaccgtctttgagtcttgctcattttttaaaaaaatcactaactttgaaactggtaggttgtcccacttaaagctcttgatttttaattgccatttctttttacacccaattaaattgtcagagtagtgaagaattgcccaactgagtagaactgtgaggatcttctcactgctgctttccgcagtcttaatttgcagatgcttttgcctaaaataaaaatttaaagtcacttcctcaacaataagacctgtaaagcttccaccaactgctgtttaagacagacgcaaaaagaaaatttgctgcacgagtttggggccatagaaaaaggaatattttcctatatttgtaagatatttgggttctgaataacagattaccatgtcccttaatctgatacatattaaatgaagaccacataggtaaagggcttggtacctttcaattagctcagcaagtctatcaactggtaatattcaaaaagaacaaacaaaactcatgctggactgttcattttcatgaaaacatattgtgtataaagccatgaatggtgatcaaagattcctgtgaataattttcttaatgaaagaggactaattacttgctagattctcagaccaatggtatggtatcttgacaatctccatctaccagaggtttcaaagagaaagccatggagtcataaaacaccaagacaactcagttccaacatatctgaaatgacttgccctcaccttttaacttcctgtggttgcctcaaacatttaagaaatatctttattaatttacttatttattcttgtttttagacagagtattgctctgttgcccaggctagaatgcagtggtgcgatcttgactcactgtaacttccacctcctgggttcaagtgattttcctgcctcagcctcctgaggggttgagactacaggtgcatgccaccacacccagctaattttgtgtgtgtgtgtgtgtgtgtgtgtgtgtgtttgtctgtgtttttttgtttttttttttttttttttttttttaccggaaacagggtttcaccatgttggtcaggctagtctcaaactcgtgacctcaagtgatctgccaacctcagcctcccaaaatgctgggattacaggattgagccactgcacccagccatacatttattttttaattgagacataaaagtgtatttaccacatacaaaatgatgttttgaactattatgtatacattgtgaaatagttaaatcttgctcagtaacatacgcattatcttacatagttaccacttttgtgtttgagaatactttgtacccattctcttagcatctttcaagaatacaaaacattatgaactatagtcaccatgttctacaacagttctcttaaacttactcctcctaactgaaatgttctatcctttgaccaccatctccccaacccccacccctcaacctgctcagcctctggtaaccaacattctactctctactactgatatcaatttttttagattccacaaatcagtgagatcccatagcatttgtctttctgtgaatggcttatttcaattaccataatattttacaagatataaagaggtataacaaccaaatgcattaaaaaaagaagtaccctcttaactagcctttcagtgataactatgtcttctttaatgcctttttaatgcattttatttttcacaaccattcagctcttacatcccactccaccccatctttttgtgttctcagagctctctttctacccaggttacacagaaactcaaggacgatgactaaataaatctccattacacaaccaactcagcagcccctcttggtggagttaaggtatcttttacacatcttcatccttttcctagagacccccaaaacaaaaaaaatcaacccttacacttttctatgtcacattacactcgattgtatcctttgcaagatagcattaaagggcaatatatgaagtagtaaatacagaataaactttagagtcagaaaatctggtaatcaccacatttaccagcatgtttggtcaagccacctctgaatctcagctgctctgaacttgtagcctctccagacactgcacacagaccccctttagtagtcagtaaagcacttagcagacctctcctttagggctaagaatctatcagaacctcagatggaacacctatatattaaaattcacacattccaaaactgcattgaacgcttggtaattactaattctctaggatttttttcctttgtttgatctttgcttttctaattgccaataaaacctgagcaagcaaatagaggttctgtatcatttgctcattgagaaaagaaatctgaagatcttctaatatttatcttacagacaaacgctttaaagaagaagcctaaaccattcctgccttctacctgtctcttctcctttaataaacaagacagcatgccgctcatggagaatcagttcagaaattcatttgttgaattttagtaaataatgccactagactttagagctagtttacataaaaataaaaattaagaatttatagtgtctaatgtcttgatgaaaaggttattttgcatcagtgatggtggtggtggtactgttcaaatgcaatgagaggagatagaaaccttgacctttcagaatggagaaattttaaccaggtacagtccagttaatggcggggggcagggggtggcagggaatcctgtgtaatgtgcaaaaccatcctgttacaggagagagcagtggatgtgtactgcctgtgtagtattgtatgttaaacagtaaaggaaaaaaatagtaccaagatgttctccataaatttagaaacagaattataaacattgggcaaagtcctttcaagtctatattaagccatggaggattgtgattcaggaaagacattcacccctctacgtgagactcacattcaagtgctgatgtacacaagtaatttttcttcaatcatatgtaaagtacaatgcagttcttagatcccttggccccatcccagcagcggacctagatattattaagtctaaagcttacgaaactttaaaggactactttatgaaaacaaatgcaaaaatcttatttttacaaattttagaaaaatatataatcaaccggagatactagtaagtcttcccgggtctttggaaggcatcgtacaagggagggccctaattccaaagattcctcaactgcagggtaagcctgtctctgcttcaactccacaccaattacttcccctccaccattctgagagagattttctggcacccgagtatggcaagagtttggtgggggtcttcgaacaagaattcatctcactggaggacacaggaagcgtggtccctgagcttaatcaatgctgttagcatatagttaaccaggcttgtgtaaaagacatcacatcagcatttcaccattatgcggtaaagtaattttaatttttaaaaaaaatttgtttgtttttaaataatcacaatcatatcttaaaaatgttgatagggaattaagaaaagattggctcaaaccccagtcgtactgggcaaaaccccagtcctactgggcagcatttagtgtcctccttggttctttgtactaggtttatggcaaatccttgagaataatcatttaagtcagagtgaattcttcctcccagatgatgatttatctgtttgtaagctgagatgagggaattccatttgctattgagccagtgagtgttaactttattaacgcatctttgcaactaagattaatgggacccatagtaagtcagctgtagcacttgatgtcagtttataacaagcttggcaatacctggaaattcagatctatcatcataagttataatgacatgcataaaaatttgagtgtaaataaaaggctctttaggatacagggctctaatccaagttgttcaagccttaaaaagtaacttatataacagtgttcctgttttggagtacagtatatgctaatggcctttcctcaagggttaaaatgcctaaactaccatcttctaataaataaatattttattacaaaaatcaattttgcttaatgaagtcctctgagggagaagatgttttaagacattttaccagtacactttaaaatcattttgtatttaggtatgctctgtcatctccacctagagcaaaaaagaatcataaaaaatgataagtgcagcaataaaaaactcctcttactattagttgggagagaaacaaatgggtatattactctgaaggtaattacttaagtttttttattgcaccatattttctcaaaaccgaaccaaagtatatcccaaatcttcctacaaatgaaatacaatttttctctcagaacatttttactcatcaggacaaaaaggtgagcttaattcttctgtcagctgaggcttcatgtgtcaaacacatcttacatttcaacaaaccttactgtcatattgatggaatattcaaggagacattagttcttacggcaagtactagcttgaaaaggtgtaagctgaattactgtgagagcacttttcttctaaaaatagactttattatctccaaccacagtatatatgtataactgccttgtcattttaaccaaatttatggcttcccatcagagattgtagcttccttgaaggcaagtgggggtagtttctttccatctttttattcccaacacttagcacacttcctggactagagagagctagattatcaaatgaataaattcatgaattaatacaaattgcttctcatatattgtatgcctatccgagatgtggaagcaacatctcctgacatttctaatttttaaaaataaaccttaaatccagcagtctgcaagaaaataatatttagaaactttttcctaaaacttgtcattcattcattccatcaagaaattttggctggtagcagcggcttatgcctgtaatcccatgactttgggaaaacgaggtgggaggatcgcttaagccaagagttcaagaccagcctgggcaatatagcaagacctattttctaaagaaaatttacaaaatacaaaaaaaaaaattagctgggcaagatgactcatactatagtcccagcaactcagggactcaggtgggaagatcccttgaacataggagtgacaggttacagtgagctatgatctcaccactgcattccagcctggatgacaaagtggtaccctgtctctaaaaaaacaaaaaacacaaatgtttatggaaaatgtcaggcactgtgcttactgccatgtgtacagtctagagcaaaacaaagccatgcccttatggaacttctagtctaagcatgcaactaactctgttttttaggataaaaggaaaatttcatctaattttctcttaagtatactcccctatcacttatgacagaatgatgttcaaatttcaaatattttgtggatcctacaacagccaaatggtggcatctggaccacatgattatttagtggacaaggtagcttgacttaaggattaaaaaatttgtgtattcccagccttagcaagataattctgcctgtgccaaaaagttctgcttcacaaatggggcagttccctttaatcaaataatttgaaattaactcttaataataatcctactgatcatagtaatactagtgatgataatgataatcacaacaacaactcacatttcctgagtgcctagaactttgctaacagctttacatggattatctcctgtaatcatcctcttaagtttactcaataggtcttcttatctcgacttgatagacagatgctgaagcttagagaggttaggaaatgtgcacatttgccgcaaaacaaatagtgaagttaggatttgaactcgggtctgtctgtttgctgaacctacacccataactacaccttctatcacttcctacaccaaggttggtaacagaaataatcaaaaaaacaaaacaaacgaataaacgaaaaagcaagaaaatgtttcctattatctctttcaaagtttcaaggatatttgaaattcttctgcttcttctaaaatatatctaatgttacattttcacagaaatcataaaacagttatagatttttatctagtctgtgacctagatgtcatagaacagaaataatattctagtacgacagtgtgactctagtttgagttaggcagttgaagcaattgactacctggacctacctaatgtataagcattctgaagaatatggaaatgtgtgttaacgtaacaataagcacaaatgtaacagggggaaaaaaaggaactaaaattcttgggattgtgtactagcatagcaccaataaatgattttcagtctttcaaaataacttggtaatactgtatgttttcagattgttgtatcatcctatttccttgtgaaaagctgtttttcagtcctttggattaaggactatttgagaagacacaaaaacttatttttcagagttcttcaccctcccttcccttcaccatagccacgtatacatataacacttactgaattactatgtgcctagcactattctagatgctggggattcagtagtgatgggagagccaaaccagctagctcagcttcaaagggataataaagggagaaggaaggaaattaacattctttggcaactttattgttagttactctgccagatgatttaatatgtcattaacttcccccaaaacagccctaaaagatagccaggatcacccccaaccctacagataggaatttaacattcagacttgagtaatgtgtctaaacctatacagttaggaagcactggaaggttgatacaaattcatgcttatgtagctagaaagagcatctctcttcattccctctgtttcactctgtctttgtagttctctttccctttgcctcgacttcttgactctcaatcacgctcttcatcttgcagaggccactgaaataatgactattttgttcattatatgtaaagtaagactcattcttacccaaatggtctcttaatgcattgtatctacataaccatatctatagatccctctacatatgtacctgttcatgccacaaatatctcttgggtgcccaataaatgccaggaacatttctaggccatagaaaactgtaatggagcttatacacaaaggaagaggtatacaggataaaagtctcaagacataaagagtataatttcacatagtaaaaagtgctatgaagcaaattaaacaggtcatatacaaacacactatatatatatatactacatgtacaaaacatacatatatgcaaatataccttctcaagtttttgtataaatattgatagttaataactagctttattaaaagccatcacgtttttatgagcacatacttttctactatacttaattttctagttgaccagtaaatgacagatctgcagttacccacgtaattaaacaaatacataaacaaacagaaagaactatgtatgccgatacttagaaaggtagaaaatatctaaaaactgttaatattgattttctggtctcacttatgatttatagcttcatttttttaatagctcttttggtatttatgctccaagaaatataggatctcttctgggaaaatacaaactatgatcaaattttcaacctgaatacagacatcatcagacatgtgagaaaaatctcaatagtgctacacttatgaccaaaaatctatcaattaaaaaaaaatctactgtgttaaagggtgaaaataacatttatgtaatgcatggataaagtttaataatcaaaggtaaagttctaagaaacaaaaaagaaaggcatggaaagtttttagatataaattaaaacacagctcattttggaagatgacagataagagagtcttgaaatgatatgactattccccgattgcccagtagttaaaaaaaaaaaaaaaatcttgctatctttaacaaaacatattaagaatatgggatgtgtgtcatcatagttgtgtttaatgtggcattaattcacaagtcattgtttttttaataagatataataagttacttgctcttctaaggagatacgtaattagggctttgataattaaaccctagatgaggcatttggcatatctgtgccctaaataccaataaattatgcatgtacaacttttaaaactacatcttaattagtagcttaaaataaaactaatttggaaaaccaggatactgaatttttaaaaactgctcaaattttatcaatgaaagccaaccaactacctagttttaaatataaacctcaattatgtatgaatgactgtttgatagattactttaagtgaagtattttagtaaactcctttgtaattttcagctcacataaagatggcctaggttaacttaatcacaccttttctcacttattaggtttatctccttagccaatgagtcacgtcccaacctcattttcttttactactactattttacttctgctcaattctgacctaccattgtttatacccacctgtaatggttaattgtacgtgtcacttgattaggcgaaatatctggggtgctcaaatatttggtcaaatgttatcttgagcattactgtcagggtgtttttggatgcgattaacatttaatttagtcaccaagcaaagcagattgccctccctaatgtgggcaacccttatccaatcaggtaaaacactaaagagaacaataaagctgagcctcacctaaggaaggaagaactcctcctaccttcaaactgggacatcagctttttcatgcctttggacccaatctgaaacatcagctcttcctaggtcttcagcttgccagcctgtggactagaactgcacatcaactctcctgggcctccagctgccaactttggcagatcttgaaacttcttggcctcattaataatgtcagctaatttgttaaaataaggctcttcctatatatgtatatattctgttggggttctctttctccagagaaccctaatacactgcacacacctaccatcaatactcagtgatttcctccctaagccactttgctcaagaagcttctagtttctactcctctctcaagttagctctgtctcacagactcctaaatattcttcatgccccaacccagcagtctcctcactctcacagtgtatcatccatgtagcattttacacattttgcacccatggcacttgagcactttttatttcccatcatgctcatctgtcgacatgtcagctggaagaacattgttcttccaggacaatatcttgtatataaagtaaaaatctgaagggctgaaactcactgtcacacgtactgcagcagggatcacttcagacttggccaaacccgatgaaaatcttagctgtacgaccaagaacaaatcatgtcaaactctctggaccttggctccttacatcaaaaataagtagtgaggctaggtaaacaccaaattcccttctagctcaacatttctatggttcggttaacaagttaagcagcagtaaacactcgcatgagttgatgttcatttcaaaattattaaaaataatattttaatatgaagtcaaaagaagaaaattgttctcacttcaatgcaatgatttacaagtgtgctcattttttctgagccctttttagacatgatctcagtgtggcaaaacaagtaatagttccaaggaaggagcatgcatcaccaacataacagtcctcaaaagatagatcagaaggaaaatgaatagcgtctcctcacaggtacactttctcccccagattttcagttttaatgtctccccttactagggtctctcatagactatccacatgggcttctgtctttgtgaccactgatacccaaagaatcactgtttttaaattctaaagattacaccaacgaaagtcaggagcgtctgttcacttaaagtggctctgcccactaccaccttttcccagcatggaaatgaggtacacacgaaagctttatcgtgttggtatcaatgtattccaagtactcaactattttataagccttttcaagtaatcttcagtcagtaccataattgtcagcacgtttgttctgtgttggccacccttccttttgtttcagtctttcataaaaatccttttgtgtgacagtcaagcagctgtgctttgttctttaatgttcctagcctggatctccagccgagaccactttataacataaacggcaaagtaccattttcacagcggggacaactgtgttcatcttcaaaaagaggcattaataaaatgagactgtaatcaacatgctaattctgatcacagggtactgcacaatggcagagatagttgactgccttctccctgaaagattgtaaaagttgtatgttttttttcctaacaactgccataatggcttacattttttgaaacagacatattatgcaaacatttctatttcccattgcagtgccttctctgtctcatccaactgctcactgtgtgttttactatctcagtaacagtcaccttcagggagcaaattttttccatcttgcaagaactgacttgctgaaataggcatgtcaatgaatcacggaaagctggagaggggtgatctgagtgatttcatcgctaatccaaggccttcccaatgcatatcaggccaaaaaaaaaaaaaagaaacagaacagaacagggaagttaacgtatttgcttaagaatccagttattttgtgacagagctaaagctggaattcaatttcccaagacctagacttgggtacttcacgtattatcttttgtcctaatggtgatcattcacaaataatatatttatatgtaagagtaggtacacataagtatcacttgatgaaatatatttgctaaactaggtaactaaaatgcctcatatctggtaaactagcatgtttagacaataattgtactgtagatatgttctatgaacaaagccagttccctataaatagataagagcagcagtgttgtatatcataccctgttctgttgtgctagtggtggtggtggtttggggcagtgctatttgagaacagcccagtctaaaaataatctactaagattttttaaatgacccattacatgctgtttgagataagagcaaaataatgtattttctgattactcccctaaaaaaaattctaagttcaagaaacatgatgacatttagtaagatgcttagattcaaagttgattaaatggttccagaactttgtcttagagaagggaggttatgtaagtaagaataattattgatgtctttcctcttgcccaaaagaagcaagtacccttggactcttactagaaagaaaagtctatggatggtgatatctcattttccctgcctagtgattgataacatctatcagagagaatattttcatcctcagttatcactgcataaatttgtattacatggtttcctgctgatatctttagtcaggaagaaattgtgaccagcaaactaacgaaacagacagaaccaattccatttagatgacaatccctgttcttacaacactctctctggtcctatgcttgctcttcactgaaagcctgatagttaattcactgtccttagtagcattccacaattagttaaggcacagtccttagtagcctcagtacatcctaaggccttcacttaaagttctgcttaggatgggaaaacacaagtaaaacagatatactcagcctcctaaagtgttgtatcattagggagtcagtattttcttgtgtttccatagccaagacaactaaaaaattaaaatgacttggaagacataagccctacattcacctcccccctctcctacttctttcgtgaaccacactctatggtatagttaattgcccaaatatcttatttcggggcacattcagcctgagcttgtggttatccctccttattgaaacacagtttttgagagtaagggtaatttgaaacaagctacgaagggaaacttgttcctgaaatgctcccttcgaggcacatgggtggtcagagtattatttcaatgtcttcttcattaaccatacaggtcagatatttgaatctccaattaattagtttctctagtagcttgtgtgagataaatcaatgatcttcatccagttcacttagataaagcccatcatgagagctggcacatttttggcatttgtcagtaaagcagggagaaagtaaatgatccacgtggacgaaatgggaatctaatgaggccactggacgaaaagtgtaaaatggtctccatctactgcagaacagagtgcctgagtgtccgccaacatgatttgcaagagaaagtgaacctaaaatctcctcaactgtggtataaacctcttcacactcatttatttagctattcatgatgttcaaagtctatgaatgtcagtttacactggaatattattaaacactactattaatagaaataacaatatttagaagttttaagcaaacagtgactccaggaaacaaaaataatttccatccatatttattttatcctaaaaggatatataaaagtattctattttaagattatgtttagactacctttctgtcatctaaaatacttttgaatttttctcatgaaagttctaaaactgctcaacatagtctttaaaaaaatggaaagggttaactactcaaatcataaattttcatacaagtatacttacatatgacagatgttcacatagaaagttgagaccatattaaacatttttgatgcatttgttttatatggggactagctgtataaaagcagaggagatgatgaaactccagccaactgagagacaggaaaacattaatccatgtaaatttctaagtaaagtgatattttgctccaattttttgttaatgtcttcattggatgcataaagataagtcaagcacatgactgccattaattccttttaaggagttcaagggatttggaaagtgagaaaactcaaaaacgtttctgataagttttattttattgtacctttttaatataccttctatatgatggcactgattctaaactaggtaaataaatggagattaaaatttttaaagcagatgaacaaatgagccagatttggcttcaaatatgaacacctgaaaaatgacaattttcagacaagctgaagtgaactatgtatgtatattcagaaatatgtatactttccatagtgcatattacagcacatataaacatagtctctaagattcctgccagttctaaaatctaatttctaactcctattcttttttttccctaatgtcttattcttgcctattagaccattccttcctttcccttttcaaatattttaaatatattttgaaacccattcatacagttcagttacctgtggatcagagactatgatttccacccttgatggttgggcttactgtcgcttgctggtggtagctgacttgattgctttagaactggtgttcattagcccatctgggtatgaacaaccttctctagggttgtgtatctggattatcggaatgtctctgtggggtgagtgctattatgggtgtctgttgcacactctatgggactcactgtttctgaccagcttttatgttaaactatttggtcctgagtattgcacagtaggaatagtgctggaaatctcacttgtatgcagaaagctgatctagtctctgttactctcaacttattttatatacgtatgtatcttgctggagtgttaaaactccagcactaaagcataaggtccattttgttattatcttgggttattacaattgtcttttctctaggaaatccctcccttgtttttagcaactggaaatttcaatttcttgtttgtaagcctaattatgcttttaattttattttcagatactttgtcaacatttctatgtgttggtcagggaatggggaacttcctgcaccaacctagcttgtcataacagccagaaatgtagctcaaatctcacttgtctgttttaaagcagcatctgttacatgcatttaaaagatatacatccaattgtcaatactttccctgcaacttaataaggtgtttatactatttcaaacgtaattaaggatatatatgtaaataatctcattttctcagcctcttgaattgcttctttgtgtgtgtgtgtgtgtgtgtgtgtgtctgtgtgtgtgtgtgtttagtttcaaaaccaccaggtaaatttgacctacattactaattactgctggcctccaaataaataagttcttgacaatatcaatagggcttacctccttgaaagaaaccaagatgtttatcaaatcaaacttttttattttataaaagatataaagtaaaaccatccctccatgggggtaaaaaaaatgaaatagtagagaaatgtacttaatctacataagttcctctatgattctgattgtttcctttccaatttctttcatgttaggaaagtctattctcctaaattttggaacagaggaaaatacaacaaaacaaaacaaatgagttgtgtgagggagagaaagagataaaggcacagaatagttaatctggaaatgtcaactgtgaggtgcctaattgggaatgttcgtatctctatacagaagcctgaattagagacatacaacacagtcttcatcatagctttattctccagcactctcattgtaaaggaagtctacaaactgaacacactgtactggagatctggcaactcaccctgtgcctttgtcaaattgtgtaagcaacattgttggagacaaagaaagggatttgtcagcccagttatttagatcaatacatattggtttaagaaagataacagacaaataaaaaatgtattttttttcacataagacaggtgcatttcttatacttggttctgaccaattgcttaaggaaagttcatctttaggctaaggttctttctttaattctgcaaatatcaatgtcagctgtggtagttgtaaaaaacgtagctgctgaatacagtatgaaaaatccatgcacgagtaatgccaacatataaaagagtaccatatcctgtttcctttctagatgctctgccaaaaatcaaaatggtatctggcatttgaagtcaatgcttttttcagcttttttacctctgatattccccctgaactctagttctgtaaagacccaaaactagagaaggtatccactgtctaattaaagttcaagtcttacaaacatttaactgagtttcccatttaagcaccatcacaatgctagtcttttcaatgatgctacaaaagagatacagaattgtaacaatgacacaaacgacaaccttcacttgagcacttaccccgcaaaactgtgagtctggtggatacacttatttctcccacattatttgaggccacacattcataaatggcctcatccctcggagtccgtaagggttgtattctgagaactgatccagacccatcgtcaaactctattacctattagaggaaacaatagctgtcacaggtgttgttacaattgtctacctctcagctaaagctctcaatacagtggtggatccgccattaggctcataataaactaggcatcattctgaaactgaattttgatatagtggtgaaaaaatatttggtctaatttagtgaatcttctactgaacaaggagaaagatatgcaactacatatgcaaaacatggagatttctagtccctactaaaaactaccagggtttattcattaaaatatttcagtatgttcatctagggcaatttgactctattaattttgcaagaggcttgcagctataatggataaacttcttaaattattctttctctcacagcacatatacgaatgtggattcattcaataatgggactgtaaggtgaagaattaatgcatgccaccacagatagctctgctagtttaaactgtctcatcctgaacagtatagataggcaaaccacgaaaagaaattgcataaatctagtacttaggcagccaacgagacagctttcacaacccaaaagcctgatggtgtgcattaattttgccataaatcattccagtatttgttctagcttagcattttctgcatttttagagcattcttgctgtaaaatggaggcttgcttcaccaggcagaaaattaatgtcctaaacactaagcctgaattcaccatcattaggaactcttcttggaaacagtttagtgacactgataatcctgggtacttgttagctaattcaagtaccacttaaaaaaaaaaaagatgatgatattaacaaatatgtatacaatattatggagtcctctgtcttttctgtaactatgctgcattccttcagctgttcactgagaagttgtgccttttttctcttgtatttcactgtgaatattcccatgtgcctaaattatgaataaattgagattgcctcatatatatatttatggggtgcttaattccagattttgtgtgtgcatgtgtatattaacacagagaggaaggacattcatattttcaaaatatgtccacttcaatctttgtgcattccatttttgttcaaaattcacaaaaatattcaaaatggcccatttctcaatgcactacagtttattttcaactctataaagcatacactttaaaataaatctactatgcatcttaggaaagaaaagtttcatagtttcatattggaagctttgttaagcattccataattttaaaaaagttatttatgatcattttatgatttaggtaggaaaaggttaaagcaactataaacccaatttaaatgttgactaatttattaataaatgtcattgtatgtttacatttgtgaactatttcctagatttagatctatcctcttacaacatacaatataccacacattacacgccagtgatgtaatttccagtttgaaaatatccagtattgatttcatgcctgccatggaccagacaccatacttagcactggggatagaagagggagcaaaaacagtcaacatgtactgctctcagggaccatacagactagtaataccatatatattgtttaataatatatatttaataatatatattaaatatatattatatatatattagtgttaaatatagtaaagattttcaaccaaggacttgatacagtttgatgaagctgctttgggtaaaaataattcatttaccccaaaggtgtttatatgactctcatggggaattaggcattgagcagagatcatgctgtgaaatatttagtagtataatttcacttttgttacatgattttgtcaggagccattgtcattagaaagcgtgatgtcaaacttctctttgacaaaaaattaacttcatttaaatttttttaatgtgcagcaaagatgcatacatacatcattttctacatgacacaggaaacattttccaaatattaaagatatttttgtatttaaataaattatatttcaataataatcaagtatttgattttcagacataattttaaacttctcacttgtaaactacaacccaatttccaatggcaaatttctaatttcaccattgtaattaattaggttctctatacatttgaacccctgatcaccctgtgagttcctatgaaaataagtaaaataaaattgttctgaatttgtagttgctatatttcttttaactagaaattgcctttaatctgccaaactgtaaattaggtcatgaaggagattagaaactcaggtaaaagggaggtgagtttcacaatttcaggcagtttgggggtattggtagcccctaaaattaaagctatccttctcatgtcttaaattatgggcatgctattgtgtgcccataatctgtgtagctttctatatatcttattgcctatatttctcctccagaatgagcaaatttctaaaccatcagccttctcacaaacactcaaaaaaagaatctttgatttatgtttcaccatcttcgctgcactgagctctcctgaataaagaaaaccaacttcttcgataggtttctctgcaatatcaacctgtttgcatgtgtttctttcagaatagtactttaaaacactggaacaaatttctcattctagttcacactacttgtaaaacacaggtgcgaggggcagtggaccacttcatttgctgcttagcatccattcccattcttcttgataacgaggatttaaatttcctttgggaaaattctgctctttcattctaagccatgcaattggatgggactgtcctcattcccagaacagaggtagattctgattggcttaaattaagtaggctacactgtccacctatccacacaaattgtctcagggatgcacaagtaacgtaataggagccaatgggatgagaggcttctggaagagacaagctttcatacatcctacagacgtggtcctgtgaggttgcagagctccatcttgcaacctggggatgaaactgacagactaatcctaggaatactattgagccctggcacaagtagaaacaaaaatcagcccttgaacccccaaatttccttttttaaaaagccatttagagttacattttccatcacttgcaatgtaaggaataccatatatcagtgacaccttttatcagagtaaagcaagcaagtaacgtagaaaccaaagacagagcagatacattcttcccccagagaaacagaacaatggacctaatacctcaaatctctgattgctgactttctttccttttttgttccagacaattttaggtcttgggtctcccgtagcttggcagatgaaagaggcaactccgccagagacccctgtctgatcaacgggtgttcgtgtaaaccttggaggtgctgaaataaaaaataaacatcacagttaaattgaaaactgaaatacagactattatcctactaccgctgctctccccaccatcctcaaccacaccgccatcaagacatacatttttacaatgcactatgggattacaaaattagaaaagcatcttttacttttgagggtagtttaaaggggaaggacataactttctggttaagttatctattagtgcttttattgctgaaatctgtattaaggtagagatccaataacatccgaaaagcaacatcacacattaatttttattaccagtatataaaaaaatccaatttgtcctctaacaaaatgagctcatcaatcaaagtgggtaaaattttagcgcttgctttgatgccactatcaggacactgccagaaagcagcattgccactgctgagctattaaaattagtgacatttaagagaaatgctaggaaattttaaagagacaagaaatatcgccctgaattagaaggtttcgcaagaaatagaaataggggaaaatggtaaagtgactctctaacccagatattgtaagctgtcttacttgaaacttagctccacaatttgcataaaagaagatgagtcaagaagcctccaaagtcatagtaaagcaaagaatattttttatacaaagatgtagacttaaagattactaaggctagcaagatagacattggaagcttgttcaacatcctccatctcctttaaatgttcctaacattcttcctccttctttaaaaaacttacttatttttcatcttgtatttcaagatctagatagctatcatacaagaatgatataaaatgtaaatgaatacttatgcacaaagatattcatcatatcatttgtttggcaaaagagtataagtagttgaaacattaaacagtatgggatttctgtcacagtgaaataaaatatggcatgaagatggaacatcatacaagtagttaagtgttataaaatctgtatcataccacatgagaaatgcttatgatgcaataataagccacaaaagcatactacagagttatatgtggggatagcagataatgaaaaatgcacacacacacaaagattgaacaaagtaaataaaacactaataatggtgttcaggaggaggcattttaattatttctccgactgctttccatcttttacacttccttgagtttttacaattatgttctggctgaaaatgttttaaagccccaaaacattttgctgttccttcttttttttttttttttttaatttctaatccctgttacagattttctcttctctcctactgtgttctacttacatgtcattgaaaagtggttttaaataaccatagctaaaattgattttgaaaacaatccttggattataaaaaagaaaaaagtcataacaaagtttgttcttcttggttcatcaccagtatcttctctgtattgatttcatgtttcccacatggtgttcccattaacttgatggtgtgttctgactctgtttggttttcttggagtcaaggaagccggattcctatctaagctccaccaatacatatatggataatcttggaggaaaaaaaatcatgtaactttaccatttcttggtatgacatatgaaatacattaatttacaaaaattgcaaaactatgacatatgaaataaattaatttgcagaaattgcttccagtttcaaggtttcctagctttatatattatttccaaaggagggaagttcagaagaggcatatttgcaatgctggtcctggagaatgaattaccacctcatcagcaaattcaacttgttggtgatcctggaactgcgggcctgcttatgttcaaaaatattaagaaagcaaaacagcctctaacaaccctgctagagatcataacctgtagcatctcagtgtagcaatacagactagatgattactaggagctgtgggaagtacttaaaataattttattttttatttatttttatttatttatttattttagatggagtctcactctgtcgccagggtggagtgcagtggcacaatctcgactcactgcaacctccactacccaggttcaagcgattctcctgcctcagcctcccaaatagctaggactacaggtgcgtaccaccacgctcagctaatttttgtatttttagtagagacagagtttgaccatgtgggccagaatggtctcgatctcgtcacctcgtgatccacctgccttggcctcccaaagtgctgggattacaggcgtgagccaccacgcccggcctcaaaataatttaaaattgactaacagtgagaggattacaaaacactgtacattgatgtcacttttctggaaacaaatgaaaaatatattacaagtttttatatttatctttctgctgtttcaaacaatgcaaattgataataactacttgcttgtcagtaaccaatggaaaaattataattatgcaattaaaatttctagggaatttccctagaaacacaaaatagattgctgtattaaatggtacaatactgtcatttttagctaccttccttttcttgtccatagcctaaaaactgtcaaccgggaaggaaaatacattgtaagagcccagcttcccatttaagttctgttctgaaatttcttgcaagaacatgtgaatacattgaagggctgttgcataaaatgagtgtgcactatattagaaattaaagaaaactagaagtaggatacccttttccctgcatctggatattttttaagggataccgttgcatttcttaacccaaagaatgaagaagagttggcaattctgacaatctgcaactaggcaatggatgcttgggtaagtgcttcatctgtcctgttgccatgtaaggacctaaattagaaagctcatctggaaataactggtgggtgaggacaagtcaaattaaacatagaaatcttatttctaaatggagtgcagagagacaaaattcccatacacttggagaataggtatgagtgccatttcgatgttttccaggtatgtgtctcatttatctttattttctggtcaggcattgaagttttttgtttgttttttgagacagggtcttggtctgtcattcaggcttcagtgcagtggcacgatcaaagctaactgcagcctcaacctcccaggctcagtcagtcctcccaccttagcatccagagtggctgggagcacaaccacacaccaccatgcctgggtaatgtttttattatttgtagacatggggtctccctatgttgttcagcatgtcttgaactccagggctcaaggatcctcccgcctcagccttacaaagtgctggaattacaagtgtgagccatcacgacacgcagagaagtttttgtgtaatattgacaagtataaaaatatgccacccaggaggcagaggttgcagtgagccgagatcacgccactgcactacaacctgggtgacaagagtgaaactccatctcaaaaataaaaaatttaaagaaaagaaaaagaaatgaccattggatgctactgtaggattttatttctggagaccaagtcatggaatgaaattaacctattgaactgtggtaaacttattaaaataaccagttagaatctattttaggacctggaactatttttctaaatcctaccactgtattgatgtgatattcttaaaaaacaaaaaaacaaaaaaaaaaaaaacaaaaaaacctaaaagggctcttaaatttattctttgaaaacaagaaaataaaattgatcacactacagttaaataatttcaggggcttttacagagaaattctgtaaaaaaaaaaaaaaaatacatatatatatatgaaagacatcggcctcactgacaagaaaatcatgactttcctatgggacccaatgtcaatttttctagattcgcccacaagatccgaactacaaaaaggatatatgtcatcatcctatgatacaaagtaagactcaagataatatagtaaaatcctttcactaagcatgggtggtgcatatataatcatttttgctggtcaaactctcagatggtgtctgtcaatgctaggcagccagccaaaggaaagatatgaggtagagagaagactaaacttaataaccccaacaaatgcttgaggcaagtaaaaatctttattctcagagggatataacaacacacatcacccacttcccttctccatatctcagtttaataaaaggaacatgatgaatcgtctgccttattttgtcatagatattgtccaaatttaagccatgctctgaagatgggaagaaagggaagagaattcaagtaaagcataaaacaagggtatctactaaaaagtcacaacataggacagactaagatttgaatcgtgaaaatctccgtttttatcccatgagatacaaccatcagtattatagttagtgtacaaaaaaaagaaatatcaaggtataaagatggggagaaaggcattagaactttccagtcaccattatttagagaggcatccttccattactgctgtagctaatcaccattgccatctacctgaagctgccaatgctgtactttgcaaaatgcatttgtgctcaagttggttttgacaagtgaggagtatgatcttttattaaactaatgccaggtactgcacaggtcaaattactggtcaacccagaaagtctattttctaaatggaaagtagagaagctacgcatgcatatgcgtcacaacagagacatggccgatattctagaatgtgtctgccaggctcgcttgccattttcaaagactgtacattctcaggatgcattcacaacacaggccatagctcctggaatttagtagattattatttgctacacagctcaagagaagccacaaactgcgcactgatttttgcttttaagaagttagattgtttcttaaagtctaaccaatgcacagtatctttgaacctaatgggtctaatatttggatgccatatcatgtttcaagttgctaggcactctgaagacaaggtgatgagctcaatgtgcacttatagctattaaatgtaggtgagagaaccaaccaagaccagcaaactgcttttgtctgtccttaacaaactgccgtactgaggacaaaatcctccctttcgtacactatactaagtagtgctagacataaatcggggagagccattgaagtccaccagtaacatccacagatgaatgcaatttatgagaaattcctaaaggttaagtagataacttagagttgaggtatatgattggccaactgacttaaaacagattcatagaaaggatcacatgctacaaaagtgaagagacaaaatgagggtgccatttatctaatttaattctaattaataagctgtttcttgtggacatcaagaaaatatgtggcatggggaacaaaactaacagcatgtaacgaattggctttgtttcttttaactgattaacatttccttaaatacagagttttgtttttaaagggctgtttgtcataacaatgtacttaaaatttttaaaggggaaggtgaatattgctgttaaatgagacagggagagaatgttcagtgggaacatgcaggtacccctgtctttagcaatctgcttcctccttaaaaagtgcctgtagaatttatgagaagatcagctgaagtcatctctgatctttctttctctgtaagcgtcaggatgagagctctgaaggagagctcaggaacagggcctttggggtctggtgggaaatgcagtgcatagcagaagagtgaggggtggttccaagggtagtagcctggtctgaaggtttgaggggaatgagttaccatgggactttacattcccttccagccacagcacatcctattgacactttcgcaaacatggggcatccagagtttgtgtggatgataggtttttgttataattagcttcattttcactgggacaagggtagtgacagacaacctgcccaagtcaacagcacaactataccaacacatgacgaaagggagggaggtcccaaagttgatgtatcattgcttaggagggcaaaagcatggcacagataccacctggggtagcttccatagcagaggttctacatgaaccagggcctgtggggacagtgaatctgtcacatgaaatttgaacagggtcacctgttgacatctgtggtcaggatagatcttcaaaatcaaacagactttcaaaaaaattgtttatggtatttctttttaaatacagctcccaaaaccacctgttagttttaaaatttgatttaagaagcattatactttagaatggaataaagaaataactgctccttgagttccatgcactagactaaatgtttaatatatcttatatacggtgttttcaaagagtcttgcaagatgttatcattactcctattttatagatttatagaaagctttttagtaatataggtattaggaagggagggagggaaggaaggaaggaaggcaggaagaaagaaaggaaggaaggaaaatatatgaaaagacagtaaggaggagtcactgaggttatgagtgagagaacttctgatctaattgtgaacccctcatgatggcagcagcagcaggccatgtggagcggccactgccctcacactggctgcagatgggctgcctcagggacgcagggcataggggaagcggggaataggggacccaccaccaccactgctgcctctgcagccactcctgccaccactgctcgcagctctgatctcagagcagagttgaggccgagcctaggtgctgtcagcctgactgagtgtgcacatgttggggcagcactgagacaccagccccttgctgcctcagcacccccagactttaggtactgaccagggtggaagggaagccaagtggggagctgagggcaactcagggcctgcagatgccccttggcgtgagcagcctgggtgccacagttggtggcaggaggcagacaggctcctgggcagaaggggatggatccggtgaggtcccaccttcaggccagggagggcctgaagtctgagtgctgggctgtcagccccacagaccatagtgggaactggtggtgccttttctgggaccgcccatggctgtccatggaccagctggcatgcacttcatcccctctgaggcccataaaagttccaggctcagccaaagcaaagcagatgggacaaccagctgcaaaaaggcacgactctctctgttgttagctgaacacctgctgggatgaccagctgcagagaggagctaccctctctgatgagaactgaggacttgcttaacagagaggagctaccctctctgctgggaggtgaacactccggacgacctgcctaacagagaggagctaccctctctgacaggagctgaacattcatcaggacaccctgagacggagagaagatgcccactatgggtctcctctgagctttcctattgctcaataaagctcttcttcgtcttgctcatcctccacttgtctgcatacctcattcttcctggtcacaggacaagaactcaggaccagccaactggcaaggctaaaagagctgtaacacaaacagggctgaaacatgccccttgctcaccacgttgcagatgaagagaaggagagaagggctgtggccctttgaggaccccagacctgggagctccccaagccagggctgtgactcactctttggggcctagtggttcctgttgtttccaagtttccaggtgccactgcattcaccagtgccagccagggaagctgctgtggtgctcctggtccaaccgctgcctcacggagaactggcagccatactagcacccggaaccgcccaccccgtggcagcggccaacatgtctgactgtgcagtgaccaaaccccacgttcactcacacaccccttgccattccatgcctgactcgcagtctcccttgaagacatgggatccaggccggtagtgtgagctgagtgcagcctgccaggccaggtgggcagaacaagaccaacgggcctgagcaaaacttggataaaggtgccactggccacagaggtttctggccaggaaaataacaccccaaagatcttgtaacactaatattttcactgtgccaaattacaagctagaaaattataaagattgcacagataatatatcgcaatttattaaatattttgaaatatcttttatgtaactataaaatgtatactgattgtcttctcaagggattggcacgtactttgtgccatactacagcaattatttttcactagctaagtgagaaacttcacccagaatatgctgtatttaaaagttctcttaaagtgtaacatcatcccaggatccaattgaaatcagagattacgatgtctgaccaagagacaaaaatcaatgtcagaaaattcataaacaaatcacccaaattccaagtttagcatggtaggctactttggtattattttacttatacattccatttgctcatgatttaaaaagacaaatacctcaatacagttcttgacactgattaactctcttccatttcaagacacttcaatgacatatttctatgcatgtctataccattaattttatttaggcctcaactctcaattcctttagaatgagtattaaagcatttcccatttggtagatagatatctatgcctctgtatgactaccaatatctaatttttcaaagggctgataggcacactgacagacaggaacagaaaaggagagagaagaagaaagggaaggaagaaatgaagagaggaagaaaagatttaatttagtgaaaagattatctcccacttgcactttctatcaatgttaggttattatttctaactgcttgaaagattaccttccagcatctcaaaattgttgtgttgaaaacataccatgtcatttgccttcccagtccttctcctcttactgagtgttcatttctgtttttggcatattcactctcccatataccccacctaacagcctcagcctcctcttctgccttctcctttgcccacaataccaattattaagttctactgatttatcactaatatgtcttatccctcttttttgtacccaaaaacaatggccatggttcactcctaaactggacattagaatcacctgggagtcctaaaagaaaaaaaaaaaaaatgaaagctacaggtgcctgaaccccaccctaaatcaattaaaacagaaaacagtgcatgggactgggtaattaatttacagaaaattccaacatgcaaccaggattgagaattactgaatgatgccatgatatccatagcttcccatctggtcactctcacttcaggtgcttcatctcgacaatcaatattacactttactatggatccttcttttgttttcccttttcgttctttgagttttgttttctaacgcatctgtgactacagctcttttccgctcaaaaaataataaaccaactttaatagcttactcctgcaaactaacaccagaaatactgtttggcctttaagatatttcagagctgctgtcaatctattttcccaaatacatttccaccattgcccacggagaacctaaaattctctcatctcgatgcctcagtacaggctgttccctcatgtaaaatgccttctttcccacttttgaatttacagaatttacccacatttttcaattctaaattaagtccttggaagccttctttgatcttccccatctagatgaaatgtaccatcctttcgactcccctatcacgctttctgtatcttttatgaatcacaatagtctatatttcattatagttattttaagcacatgtgttttctcccctttcacattcatagaaccttgagaaaattatacatgcccctggtcatctatgaagtcttataactcccaaccatacccagcacatagtttcaatgcatacatgagcttggtaaaggctgtcccagatactatcccctaatcctggactatacacttttgagtatttaggacggataataatatcgtaaatgtgatctttgcacctctattacacgtatatttgtttatagtttggcgaattagctatggaatacaaagtctatgtgacataccttgccactgcaatacattgatatgacatagtgagagacgaatagatccatgcgaagccctaagctggcaaatgtagcacagccagattacagattcatgtgtatcatcataggactgaagtttagatgaagcataatataacgtgatgagtcttttctcttttatgaatatcattccacctcattgtcatcacagagctctcttcccctctaccaccttttgtgtttttaatttttaagtaaaatgactttactcttctaattgtacgtatttattataaattagaaaatgtacatgagttgaaaggagatattctaatggtgatcaccttgatgaataacttttaagaattttccatgcttattttacatattttttaacaagaaagaggttatatcgtaccattattttgtaaccaacgtttcatttagaatatactgtgaatatcttttatgaccacaaataaattcatcatgtttatattataaagagtaaagattacatttaaatttattgttaaacatttaggttgtttctgctatttcaatcagaaaaagacttcaaaacttttttgtaatcatatctttgcacatatatgtaattcctatatgtgaattactcctacatgtaaaattactgaattcaaaaaagtatatttttaaggcttttgatatatttaacaaattatacttttaaaataattcatatattcatagcagcaatgtgtcagaatgtccaattacctagaccactgctaaagctataacttaatactttatcattggccatatttttatccactgtccaaaataatgaattgcaaacatttggcacaatgtctacatacaaactaagcaaccagtaaatgttcgtagaccattagcacagctgaccaaccttctagctctcgcatcatacccattcctccattccagttgccaccatgggacttccctgccagttgccttcaacatctctgatctcacctgggattatttcacattccagaacagcatgcaatcccagcttctgctattcacaacacaagcacacgcattacaacaggacaatacacatgcatgaagaccataacgtgggtcagagcagaaaagtggaaatggtatgttccaatgtttgagggaaatttgtcataattcaaggtataataatacctggatcataaacacgtgttttacagcaacgaaaactgtatgatctcaccatcataactttttatttaataaacagtcatgggatattatgacaaaaacaatcacctacattctgtgtgcccgggcaataaaacttcctgaactattgatgtgcttagtaaggctggccattctgttttggtgtaagacactcaaaataaccactggtttagtgacataaatttcaagaagatggcctaagtggttttgaatcactcatagacaaaatctgtgaagtcattcttaccattccttatgccatagtcatgcattcttaatgaaaacatgttatcagcaacaccatttagacattcacttaacatcttccacattaagcctctagatttgcttactacctatttatgcattcaaaatactcagactgtgcatccgttttgttcaatagagtgataaaaggcccttatactgaaacagatgagaaagttatgcattacatacaatctcccaggctcattcagcagagatgtaggcaaatgacacaatgcttatcagcttttttcatatttcctttaagtggtaacatactcaggaagccatttaatatagacacactatttgaccaaaaagaacctctaccaatgctttagcatctttttgtagagttagttttcaaagcagattcatttacatcatccactgctaatttactcattaatcataatttatcacattagatgtgctgatcatcattaaaaataatcatttattctctattctaacctgctgcttatcatgtacctgcaaattgggtcacacaggaaaggtaactggcttatttgaaaaggaacatgagagcggataaaactgaagtgggaaagaaagagaaaaataaagaacaatgccatctttcccaattttatgttgccaaactccagaatatcctgccacttcttctatacaatatttccagtgtatcaactacatgaatttttaagaggaactagtgtgatgaactgtactagcttcactttagaaacagtagtaaaccagttccacaaagagaagatctgctggtgtcactgtatgagctgaaaggctttgagccaatatgaatttttgtaacgcttgccttccaaccaaagtgagttattaccacaacttacaaaaacatagaccatttcttttaagatagatccatcttacaggataagctgaccacaacttctcatctatcaactgcacactggttaagttggcaagatactttgggaagtgaaagtagctactatatccccaaagtagctataacacagaagggagacgtgtgtgtacacatgcagacactttcaatgagtaataaaacagatttaaaatgatgtttgattgtatttactggagaaatgtagaagtgtattataagaaatctttgtaaacaaaaaaacatttttatagatacacaattttgatacataacaaaaatgtttcatgtagcacaaaatacaatggaaagtgatttgcctgagtttttattacaaagattaattatagaatagagttttacaatacatatttcctaaggaaagtctataattaatattaacttctaaatattatgacttttaaaatattagatgattccaatgataagatgcttaaatatttggctatttaaaaatattttcttggtacgcaacattttactttaagggctatttttttaatgttttaatttgtttttttgttgagacagggttttactctgttgcctaggctggactgcagttgcataatcatggttcactgcagcctccacctcctgggctcaagccatcctcccagctcaaactcccgagcagcgaggactatgggcacatgccacaacaccatgctatttttaaaatgttttgtagagatggggtctagctatgttgctcagactggtctcaaattcctgggctcaagtgatcctccggcctcagtctcccaaagtgctgggattacaggcatgagcccacactcagcaagggcaacttattaataagaatgtggatatgtggacgggcacggtggctcacgcctgtaatcccagcactttgggaggctgaggtgggtggatcacctgaggttaggagtttgagaccagcctgaccaacatggagaaactctgtctctactaaaaatacaaaattaggcacagtggcacatgcctgtaatcccagctgctcgggaggctgaggcaggagaatcgcttgaacctgggaggcagaggttgcggtgagccgagatcgtgtcattgcactccagcctgggcaaaaagagcaaaaaactccgcctccaaaaaaaaaaaaaaaaaaagtggatacgtgatggataaacaacgggaaacataaaaggcaaagtaaaaaataaagttgacttgcctatacaccagtgtttttgcaaatgaaacagtgacttaaaaaatatactgaaaaatgcccagcattattcacatttagaccaataccctgacagagatcatattctaagtttataaggttcatgtcagttttattttgtgcaatacctaacatgttgtaggcattcaataccttttaaagtaagtataattatttttggtcctatggaaattttaggtatgtgtctatgtcccttccagatatttttcactaaatttagcattctttttttttttttaattcatttctctgcagacccaaagctctaagctgaaaagtatttggcaatgatttgcaggcttccaaatattctcattcagtatcaggtaaccattagaaccaataacattttgtaggatattaaaattcttattttctggtatacttccaattgagcacatgtagcaagaaaccaaacggtatttattttacatattaagtccatcttttctacacaaatatccaaattcttttttagagtgaagagaaagaatctatattcatatatgcaagatgattatgagaaaagcgttctgcagatgtctccccacgtttaatcttgctaaccacgatggatctctgcattttcacacagtggccccgcccattcacaaattctcctgagtgagctatttgggggtacaaaagatggaaagcatgacaactggttctatgctcgggctctgaaggcatgtacaagcaagcagtgataataatagatgataacccaaggccatgaactaactctgtccacacagagaactcaaattgatgttaatcggaacctggcacacggatagaggctagggtacgattccttggtttgtagatggaaataaacccatgaagaactttaataaaatgagttctagatggaacacagtgtaatgcagtaatgtagttcttttgctttttttccttcccagctacatctctgtaaaataactctatcaacatttccatgacagcattttaaatctgaggagaaaatgtttcattcttgccttctgtgaactgaaacacatacacactacaaatttaaaaaatcaactcaaagagggggaagggccgttttttctccctcaccgaaatctgttatgttttggccaatctttttgttacctttttccaaatggcattaaatttgtgaacatgaatatgcatttcacctctcctggtaagagaacttggataacacttggcactatagacacaaggtaacactacacgaatattcttgaaacaattttcagttggattacttttcaaatatcaagtccctaatttgtatccccaggcagtgcagaccctggtagcagctcatttcagtgccgattatgcacgcttttctagagaaacacattatctgagccccaggaatatgggaggctttccaaagaagcacagacagtaaggacctttatttgccagctaactttttcccctgtcctctaatttacagctcagggtattaggtaagaaaacaaaggattttcccacacagaaataaactttttgaaaaaccttcaaatgagattttaatgacactatttaccaatatagaatgcatgccgaaataaactgaaacacttctggtggtggatttttctttttccttttttctctttttcccctaatttaactattgcaggcaacatcatagcaatttaagttggttttgtgacaaattattaggacacttattttagaaggaaaatcaaccaataattactgccctggcacacggctattgttcacagcataaacagaagctgtggctgacagctgatgggcccagccccctgctatccttagaacacatttgcagatacccaagcctcttgccagactaagacatgctgtagcaatgcttttcatccaacagagctgcactgaccaggttatgctggctacaacagaatgacaccattttaggacctcctcccaggttggacttagctttagaagctaaaaatactgttataaatactagggattccacttgtataataacattggcctttttgcaccactctaaaatatgaatgtgtaatcccaagtacttgagtgttagatacaagatcccaagtgtttttttagtgtccacagatcatgatgataagaagaaaatgctttcttgtatttgagtaacagaagcatttgggaatgtatgccaggtcacacacatgagattctagatgaatttaatcttagagaattagaaaaggggtctgcaggttattgtgagataagcctttattccataccaaatgtaaagataaagcctctgggatctcaaaagttgagtgatacatgctgcttctttccctccatctttatataacccagtcatagtcactaatttaatgaaaggaaaggtgctttaaagctctctgtagcacctttgttcaattttactgtctgaagttttttggtaacctagacagagtaaaagctgccttttgagatggatctaaaaatgccatgaaagtagatctcctttcagggctgttgtttcagagggaaaaagacaaaagagaaatctaaagggatgggctgcagttaataattaaatatctattagttactccaattcgctacataaatggcctctgggggctgccagagcatctttccaagtcaaagtaaactacagggaaagacaaaaacagtgtttagaaattgcaaaacaacacagttatacttttacttagactggattacatacaaagcattcggtaatatagtcattatttttttaaagggtcaatataaaggttctgccatccttcactacccatcccatgttccaaacagtcaaacagctcccaccagtggtcctgaaccctttagtatatttccacacagttcctttcccttaagaatccccagtctgttctgaatggctaagctttgcctgagaaatcacaacactgtaagggctagtaccgttgcaaattcatgatctacagcctcaactatacccctctgtcatctatcaatcaacctcccacccttcactactctccagcaatcagcactgcactgacctctcacctccaagagatcgatgcttttgcctcctacatcaacagataaaataatgccatcaaacatgaacttgatggcaagtcacatcctattcactgtatacgaatttctaacttagaaaccatttttccctttatcttattcaagaccaattgcttcacttgtgctcttgatccacctcttcgccatgccctaggaaccttggtgcatcaattgtcccatctccctacataatcagcaccttcactctcttcctctttaacagctacttccccttaaaacagggcctttcactactgacattttgggtcagactattctttgttgtagagcctgtcctgtgcattgcaagagattgagcaacatccctggcttctacccaatagataacactaacatcctagctaccagttgtgacaatctaacattatcaaatgtctcctgggaaaacatcctaagttttagcaccaaaactactgactgtatctcaagaaaccacaggatggttggtcaccctagctcagatgcctccaaacatagtcaactaccccctacttggtactgctctattccatttaaatattttaatttctgcacatttcacctagcttataagtgttcatcttctctctcttctgctagactgtgagccaacaaaaggcatgatatgtagtgggtactcctccgatattacaacgctcaccaaggatcatgcttccactaaagtttatggagtaaacgacgagttcataagatttaagcatataccctgtacatatgagcatatttggttaaagccaaaatacaagaaaaagaaatacttatgaattaggcacctacttatgcttttattgacaaagctatataatcattatatatacatgtaagccagtgtaaaaaagatacatacaaagattatattccctctgtcaaattcaaactgccagaaacttaaatgtattttcaatttttcataagcattaagggttataataaagaaaaattacctaagtgaaacaaccaataattatttttggtaaaaaataaacttaatacatgactacagtaattggtttcccttcctatgtatttatttatccttggattttagtcattaggaaggcaatattgttcaagaccattaacttgccagaactgtactagcttctcaagttgaccctaatatgtgatattattagctctttttttctgttagactttccctgtagcatcttcatcaatctttctagcaagattgtttttttcataagaaaaacaatttcacatactaaaacgtaggataataggaattcattcaagattcctaaacataacttgtaaatgtaattggaattagattaacaacaagcaatcaacgattcaaaaaaattaaatagttaaaaaaataggaaagatgagaggatagtcttcacaaagtggcaatccagcctagttgataaagtactcaactctctggttatccaaaaagacatggaaggtttcctatgtaagcaggtttcacatgtgatacttctctaaggcacctaaataatcaacaaatacaacttctgctttcctcccctgcctctttggggaaatgtgttttataattgtaagtagaattcatagtttgatcgcagaaaggctgatgtgtcttgttttgtggccagaatttattgtaacttaggggttaaaaagagcaaagctgcaacaacataatttgtttttaaattcacagtggtccttcacccctgaataataaaaagcattttctggaaatagtgtgcctcattttaccaactttagatctttaacatctgaacttcaaattttaaacaacaatatgaatatgaaggtgtgtatagaaaaacataaaggagatttaaacataaagctttgaaaaagtcagtaattaatgaacaaatatatttcaatcaccagcagagcccctggaaatgccacatatatgaactttttcacaatctttctattttttatattccctagagcatgactctctcaaccattcccacttgctttttttttttttctttttttaatatctccttcacccttttcttttatattactgtatctttggcagcacttgcttattcttacttctggtctttccaaactcacccaaaccattaaatagacagtgctatccaagaaacgtgcagttgcaatcaggccatgaccttgttcgagaatcttccatggttcgctactattgcctacttagtgcagaagagaaagtcctgttcaaagaatttgctaaacctatcagacaagactttttacatctctaatttacccgagatagcatcaactctcactattcataaacaaatcagactcctagccttttatgaaaaaaacattttttaacatttttatttcaaaatactgcccaacagccccccacaactgaatcacctgttgttacttgttaaagatgcatattctctgagaccagatcctgaatcagaatggcacagtaaggcctgggaatttgtgtcacaaatgtctcctccagatgatcttttagcatactaaaattttacaacctttttgtgtatttgttaagactattccattattcaaaaatattttcactaaaacacctgcttcttgaaagctgattccactttcagagccatctcaaatgccttctcctgggtgaaatcttttctaatccccaatcgaatatcatttctaagggctctgaactcatgtatcactgtttggcctctctcatggccagaagtagatttaccttgaccttaggaagcttcagcttcaggaccctttccttgcataggtaccacacgtcacactggcatggtcaaatacattatacaatttgtaatagtgaggtatttccctcccaagcatttgaaggccactcttatttaccttcacacacagtggtgttagaaagctacaggaaattttgcagggtccagctagggaagctgaattgaaatatatttgttttggatttagcagaatatctttatatggttcacagttaaattattactggccttccggtataggaaaggtttctgggaatactccctactgctcactttattaactcatccagttccttagatgaggatgtcagtgacaaactagctgatatgtcataaattcaaagagtgttacaacctgtcactgtacaagaaaactggaacaccctgaaatcacatagctttacatcacagaaattatcacattaccaatagtaagttgtaaagatgaaagtttatgaattattaattttaagaaatataaacttaataattaccaatctgactggcgagggatggtagctcattatggttttgatttgcatttctctaatgatcagtgatgcagagcttttctttcatatgtttgttggtcacatgtatgtcttcttttgagaagtgtctgttcatgtcttttgcccacttttttttttttttttttttgagacagagtttcactcttgctgcccaggctggagtgcaatggtgcaatcttggctcactgcaacctctgcctcccgggttcaagtgattctcttgcctcagcctcctgagtagctggaattacaggcacccaccaccatacccacctaattttttgtacttttagtagagacagggtttcactatgttggccaggctggtctcgaactcctgacctcaggctattcacccaccttggccccccaaagtgctgggattacaggcgtgagccaccgtgcccggcctgcccactttttaatagtggttttttcttcttgtaaatttgtttaatttccttgtagagtctggatattagatatctgtcagatgaatacgttgaaaaaattttctcccgttctgtaggttatccgttcagtctggataatagtttcttttgctgtgctctttagtttaattagatcccattcatcaatttttgcttttgttgcaattgtttttggggtattcatcatgaaatctttgcccgtgcctatgtcctgaatggtactaaggaaagcatacattttactaagtctaagttttatatcctctgcagaaattggcacatgggttttttttaaaggcacacagtagtctctcactaaaagtctatctaactaaactgacttatttccatgatcataacaatttagatttcatttcaaattatttcttataataatgttttacatccttttgtaatactttataataaattatcaaattattttttctggatttcacaaatttatttgggcttggccaaaaatcttagcagcaaaatattgcttgtctttttaattaatgatgtacagagaatatgctttgttcttttatctctccccgaaataactgaattgagagaataatgcagaaaatgtagaagttaaactgattcttttcagcttatttggaccctaacatgttgcctaattacaatagcagtgaacacccacagataacatgtataacagattttatgggaattaaaggagctctataaaggactgatgttttcttaagcctattattatggaagtttatatgtaaatagcaatttaatttttaaaatccttactactagttgcaataaatgttcaatatttggtaaattaacaagtgctatatgagaaccactgtgagtccctctcagaactcacattgtgtcctattaaattgttctgacctttcccattaaggcaatttttcccacaaaggacatattgagagcttcaatgagcagtttttaataagttaactatcaagaaagatatttttctattagtaccagtagccaatatgtctatttttaaaaaatgatttcagtatttcctccaagaggactagattctctcatacgtatcctcagagatccacaaaataatatgaatttggccccataattagttttgcaattttgtgcagcatctagataaaagcacatttggaaaaaaaaaaaaaaaaaggtgaagacaagtcagaaattctcctttttttgtcctttttttgtatctagatggaaacactaccctagctacaaaggatgaggcggtatctatttctaccattgtagagtatttccttcaagaaggctggaatactacatttccttgatacggaatccctgatatataaaatgaccaacataaataaatacaattgcaatggatatctagacaattaactaaaatgctaatgaggctccaaaatccagctttagtgccaatttttacatagcatctcctctaatcgttcatgattatatttttgccgcaggccctttgcttccttcatccttaggaagccttgaacttattctcatccttcaacaatgtcaaaagaagtaactggaaaaaaaaaaagtgacaaaatcaagaaggacactgtgccattcctttgaagcagaacatttctgaatgagaggggcatgataattatgcctctcagatgcatatccacatttttgctagccatggtccttgaggatttggagacatttttaaaatgaatttcttcaagtgaatgctgagacactttggctgcaagaatctcaggagactgtgttggccagatggtggctaccatgccagagaagtcacaaaatgttccagctgaaaactgatttaagacaaggcaacaattccatattttatgagccaaaatattacactatcccatcaagagtcctccagattccaacctgttgttatcaccatgaccatcagtattttcaaatactactactaaataaaaaccagtcaagaggaaaggtttctaaccctctccatccaggaatatatctttgaaggtttctatcacttctaacttattttacaccatgttctgaagtaacaagctatctaaagtttaaataccagtagagtggattcccatctgtggggtcttggaccaagaagagggtacagaagtaattgattggggcaaatagaaaaggaaggaaatccttaaagcaaatatggggctgttcacagccatttcatcattttacagggatctgtttgagaataaagaaggattccaaatttaaaaattttctacctatggttttagatgtcactacaattaatatcaacgttctctaaattattagaatcattcctcttcaatgatgatatttgatctagagaaagaatattatcatggcagtgtaaaggaattattcaccaatgaagaataaatgtagagagagagagagagactggttcaaaagataatgcaatatcatacctattataagaaaaagaattgttcaaaacaacttcatccaaattggtggagacaccctctgttcctcaggtacaaaaatgtgtaacatagtcattaccacttcctaatgaattgcaaatgtgtttttcagaaattattttcccaaaaagcaaacatacccacctcagtttccccaaatattaaccacatttggttgaaatctttctgaaatatagcatgtacatgctcttgtcttacacaggcacatatcctatagaagaatcaataatctaagctaagcaataatagccatacacgtaacagggatttattttttaccatcacaaatatttaaaggttataggacttgcatgtattatttgttttccttttccgcttttgattctgtgtggctccgttcgtaacagtgctttgagggttaagcccactggtggcagatgactgggtcagatgcattcaaaaagataacacttatccaaattagttggagtcataaaaaacactgtttctcacattcctgtctcctattactgagtctgctttattggttactgatctttggctcccattttcagttatgcctccaggatcctccccagctggctcccagcccctcagtgaacttctccttttgaccctggcagactgccatgattccacctctgaaaccacaaactaaactggacttgttctttcttctgcaatgacttcacatactctgcatttggtcctgctaagccctatattgtatcaggcagagcaatcaaaaagcaaacctcaaagaagtaaggttttatatacaaggactcttgactttccacttactctttacctttttaaatttcattccttccatcaacttacaggaccttccacaacctgacagttgtcctggatagcagtaacagtgagcaatatgactccctaaaaactaaccttcatatggcatctcagacctcagaaaatcacatgagatttatcatttaactgagacacacacacacacaaacacttgcactcactctggctatgaaagagcttgtatcatttcccttttgcagatgatgaatctgaggcttattgttctcaaaatcagacatttttctggttatagaacagtcccaagttcagatattgtatctataaataccctgctctttttcatatgccagacccttacaagctgaagagacaaaaatgctctggacataaagatctacctggcctgaggacactaaaaagaatcaaaccttattataatggtcagagaaaatcctaaaggagaaatcgcctcttcatcatggtcaatacacagttcagcccaggaatatgattcactgttctaaattgcattgtcaagtattcaaaatcagtctcttatttctcattaccaattatagcagaaggttgtatttatagtgggggcatttccacatctagtatcaaggcagtactatgcctgacatatagaaaaaatgactttgtattccaaagggaaattttaatgtctaggaacaataaaagtgttagaatataaaatgtttacaaagaaataaaaagttcactttaaaagtttaacacaggtaagaatagctgtaattttacaacacttgttccttttcactaacgtttaaaaattttgtgcatgaaagcagaaaacaaaaaattgcaataccatcagcaattatattctactattactctgccatatgctgagaaaagcaagataagaatgttgatttatactttcacagttatttctgtgtttgtgttttatttctccaaccattgacacttattgagtgcttgtgacctatgcagttatagtaaagtaaaaatgaaaaatctcctcctggttaattctaaaacttcatagcattttgtacatttcactaaatattgaaagggacagctaattaagtatttggtctacaacacggatctatttatttatttatttacccattcattcattcattcactcattcattctacaggtaaagccttgctacgttgcccaggctggtcttaaacctccgggttcaagtgatcttctaccctcagcctcctgagtggctgggactccatatgcataccaccagagccaacttttttttgttttgtttttcatagagcttttcaaaacctacagaagaacaataacttatgaggatttgatgtattttacataagtgagagacaaccaagtcacaactgcatgtttaattacataaatgtatatgaagagcaccgaggttcaaactctcaaaaggaagatcaaaatcggtccctacatttgttactggggaaacggggtcactgctatgttggaaaacaaacaaacaaacaaacaaacaaacaaaggtcagactccaagaacaggatgacaagagaatgcttgaggaagaacaccaatcttgggatcaagagacaaggaagcatctctgctgctggttatgttcatggtatggtctgggtacaacagggaagagatgacatacaactatagtctatctgtagcccacacctgttgtctaattgtagacaactcttcagggctctgatacagcctaggaaaaatggaaattttcatcctctggcttttctccaacctccaaacctaaccctcacaagggtttcacttcctacttgttcatcccagtagcatagactcaccaattcaccataggccccaatactccctactgcctttccctcaaatcaggaccattttttcacttttatctggaccctgtaagcatctgaatttgtgattctcaaacttttatcccgtactaaaatggatattttttttccattttgcaaattcatttctgaaaacaactgttttaaattttggttctgtggcacacacatttacctttttatgatgattatcttaaaggaaacctctttctacatatgtatataaaagttaaatgctaagcatattatctaaagtcagtagagacacaccagggaaggaattcctggtgtctggaatatacaaataaaaaggttttgttttcatacacttggataactctaaacttctcagaataattagtctgttagcaatgataaaacctggtataaaaagtcaaatactttttattttatcaaataaaaactatttggaattgagcttttgaaactgactcttccaactggtcttttgattgaaagctaattttttaaataatatacttcttataatgaggagaatatttttcaaacatgtttgaggaatggaacacccaagaatcttgttttttttctttccaaaacgaaactagtattgagataattggctttttttttttttaattctgggtccacaaggtaaaagactcacaaggaaaaagctactattaagaaaattaaaattttggttaactttttatttaccaaactaaaaaaaaaaatatcactgtcactgaatgttaggtgggaaattttgttctgcatgtgattgtaaaagcatagctgtgattgaggattttaatagtgtatttttgttgttgttatttatttattgggaggcagtctcactctgttgcccaggctggagtgcagtggtgcgatcttggctcactgcaacctacgccttctgggttcaagtgattctcctgcctcagcctccccaagtagctggggttacaggcacctaccaccacacccggctaatttttgtattttattagagatggagttttaccatgttggtcaggctggtctccaactcctgacctcaaatgatctgcccgcctcggcctcccaaaatgttgggattacaggtgtgagccactgtgcccagcctttaatagtatatttgaaacatgatggtactatatttgcttaaatgaaatcacaaaaatgattaattaaagtgtagatattaccaattaagtcttcaaagtgcattaaaaaaaaaaaagcaagcttaaataattggcggaaaatgttttttaaatcactgtgtttcccaagacgatctctgatatttcacactgcttacagatctttccggatgtcatggaaaaatatttcctgcagtcttttcattatctctaccatgtcgagaggatattaacttttattttaaccaacatcatctggagactgaacactacaacacagtgcaaaaccaattggctcttcatcctctccaaactttcactagaaacttgaagatatgcaaacgtttacacctatcatcaaataaatccattcaagattcatatcagaatcttctcttaataagcctttaaaaaaatgaccaagcatcatattccttctcatttctcatcaccatcatgtgtatctatcaactcttctgaatcatattaaccgtgaccatcaaggttcaaaattttcttagtgaatacggacattttcctatagagaacacaagtgtgtagatgctgccaatcttttcttcaataaaggcaaattgttgtttaagcactatgggtacaaatacaaggcaagcacccatccctgatatcaaactgcacaccaagaagcatggaaaaacaagcctttatatagtactccctccaatgtgatagatcagccaagtggcatgaaagttacacctgccagtcaatctatactttcctagtgagcagagaccaccagctcatatacttccagatagctctggtgtttatggtatataatcctcttaaatgcatgtttgctgagacacagtaatgactcacattgtatatatccccacactacactattcctgcatacagccagaagctgctttaaaatatttccccagtcatattcatatacaaagataaataaatttttcagtttttcaccaagttttaaatgcaatctcttgagtcccatggttttatcacagaaaggtacacttcagcttaagaagggaagaattaaccattcaacttctaacaataacagtacactgaagacctaattcaattggcacagtctgggaaatgttcaccaactacacacaattgagtgatagaatgcaaaatacttcatgctttcttagcagaacactaaaatctatcagagaatgcaccttgattttgtcaaactacagcaataaaagtaaagcagcaaaaaaaaaatatgttcgctcattctcaaaaactgagttcgaatttttttggagggagggtgtggttctttcacaagcagtttttaatcaaaagtaagattttgtttatttgtttcaaatgtgtcaaattgctatgaaaaacagaaacaaatattaagctagccattgtgtccccacgaaaatgcagcaggtcttaatactctcccagctgttctgacaaccactgtaggcagcccttcccctctgtagacttggctgcattgcactggggagtagcatgatgtccacttgaaactgtattatctggagcttgcttttaatgtaattacttcaaaacagagaaaagaattaaaaggcagggttttttgtttttgttttccatgagctgatcctttgaacagctactgagaggaggacagcttacctgaattagaaagaaaagctcaactgttaagtcacttaccctaattaaagatcaatacagatattattagacattcattctacccatctaatccagagttgtgatgttacttttcataatacctgtatacacttactgccaaatctgttttcctgcttttcctattgtctttttctctattatttcccttcaccccacttttatttctcttcacagaaatgcccctgcatgacacatagtaacaaaagtcacagtccctttgcaagaaggaagaagcttgaatttaagcagttcttttaaaaattcaatatccaaagaaatactttactgtaacagtgtcattgctactccttagacttgttattatgtttgtgaaagttaattatctgataagatacactgtggttactactgtcacaaaaaaatgcatgggtatgtttattaattcaaagtgttccaatgaaataaagtgtgttaactaaagaactgaacaattatttccccgtaattattactgcacatttaggcgtttcataactgttttttttttttctgaatgaaaatcactttatatttaaaactatcagcatttacagctttgtattgtaaaagaatatgctattttgtccatatttttatactaaaggcccaggttgaaaaatccaacaatttaaattgaagatttttttcccctgctgtagaaaagtgtcaacatttgagcaaatcattaaacatactagaacaagaacctacaactaaaatgctgattatgattcatttcaaatattttaagtgttaagtcaacattcaatgcaggataaaatgaaatggtttgttcagaaggaatagttagagatctgcttactattctttctatttctgttattttcctgggataatccataaaaatcttatgtgaaagggaaaaaaagagaagatagtttaaaaatgaaagccataatctgaatggaattcgtatggcttcatatcagaaagcccttataggtgtcactgcctcataaaattctagcaataaaattgaagccaaatactctcctttcacagaaactacctttttctcaatatctaaaaatttgttctaagacaattggaagagaaaatacatgcactcctctagccaatagatctgcaaacttctaggtgactcatttgataacaggagacaaaattgtacaacacactaaactctattatttctacatcccagtagtttccagtataatgaatgtcctgtgagttttctgcagacatctagcagaacataactgccccctcgagtgaatgctacaccacctggattcaacaatacatatcactttggccatccatgacctccgccttctcaaactgatgtacgactaaaaacttaatattttcacactagcacaagcattgtgtcttgtgtacatacattatctctaacaagacacaagcattgtggcttgtgtatgcacattatctataacaatgttatttaatataattatacacaaaaataaagggaatttggagggccagtttgaaacaaaaccagaaggccaggcgccatggctcacgcctataatcccaacactttaggaggctgaggcgggcagatgacctgaagtcaggagttcaagaccagcctggccaacatggcgaaaccccatctctactaaaaatacaaaaattagctgggcgttgtggtgggcgcctgtaatcccagctacttgggaggctgaggcaggagtatcgcttgaacacgggacgcagaagttgcagtgagccgagatcatgccattgcactccagcctgggcaacaagagcaaaacgtcgtctctaaataaataaataaaacaaaaccagaaaattcaattttttttccatcttgtttcttaaatccaaccagttcaacatatcctcatgtactggttaagcttccctaaaccaaaaatctgaaatccaaaatgtttcaaaatccaaaactttttgagcactgacatgacaccgaaagtgaaaaattccacatctaagtacttaacagaaacttcatttcatgcacaaacttatttaaaagattgcataaaattatctctgtgcaatgcatataagacatataaaatataaatgaattttatatgaaatttcacatacatgaaatataaatgaaaggtaaatataaaatataaatgaattttgtgtttagacttgggtcccatccccaagatatctcattatgtatatgcaaatattccaaaataaaaaaataaaataaaataaaaatccaaaatctgaaacacttttggtcccgatcatttcagataagaaatactcaacctgtatcataattaccctgattctacaggcaattaatgcagtttcagtaagaaaattaagaaaatagggagtctctctgagcctattctggcttgagaagttgcccagtaaaaaataataaaaataaaataaaaactaagaagaaataaaatatacagatcactaattagaaaataaactataaatcatggggttaagttggtcacttttaattttttgcaaaagtgaagatacccaatgaccactggctaccatgttgtgctagtgtaaaaatatatcaccctggaaagaaattccagtggtaactgactcttttagcaccattttactcaatgtaagcaacaccaagaacagtgtcatgctacctaaagaggtactaggtctgaagaaagccacatgctcatttattctttgtagtaaaatctattctttatcatcataattattcttctaacctaaaagaggctttaattagatgttcaaaaaatagatcaaattaggtgaatattcaatttgcaaactcagccaaactcgacaggtttcattctaattacatgcagatagatacatggagacacatatgttcaccacagttttccatgtgcttcctctttcaggcaactgcaagattaagccaaactgtatggcaaagcgttccagaaagtaccatcttacatagaataagataatttctgatttttaatcttaactgtaatactaagagactgcatcaaaacaaagactagacgatttacttgtttaaaatgtcaattatataaagagatggtgaaattactactagaagaaaaaatgcaggccgaaaacaataaaaatagtgaaaaatatttggaaaattgcaatgtatatgcactgtgttaagtgattcataactgtctttcaattaaaactcgaatctttactataatagaattccaagagggattttcttagtctcaaaattgtgtctacaatctgaaattgagaacaaaaagtgcaaagtattccaaaagttagagatagcttgcagtgagcaagccagaagcttgtgggaacaattacataccttgagctcagaccaaaatataccagagcagatcctgctacaagtacctcccctcagcctgtccaccccttccccagctgtcacaagaagaggatcaaagaggagcactgaacagctttgtggggagttcagcggagagagagaagactcaattctctctcctctctatgggaaaggggagggaggtactccttgccccaaagtgatgaggtttcaaaatcagcactcagaagattagggatgcatgtaggcagacagtggcctcttattccttggttggatgcacacagccccactctggtactgttactagagggtagcggggtgaatttcaaggagagcttccagagagctcaggaatatggcatcttatctgttttactccccctccactatggagaaaagaagtttcttaccatgtatctcctgaaggctggggtagacctgagcagagagactggcgctcacttctgctatagagatttctgagggtataagacccaatatgcagtccataccagaaagacagacagacagtggtgaggtgtaccagggagaaggatgtgggaaatcccatccctagagtttgggttgggggctggaggaagtccctagtattttccattctcccatataaaaagacaccaaggttagtggaaggaaataggctgctgtgctatccaagtcacctcaaggagaagtcgtggaaaccccaactcatgcaaatctggaagtttcaaagagagacaaggaccttttaggatacagtaaattagaagagtaagagtagagaaataggtttgtccaagaaccaagtgagtgataatccaggaaaagtaggctggagtcacaaggtgggtcacctggaatgccagttaaaagaagtcatagaggttatgaataacgtggaggttatgaataatgtagagcctgtgaaggtttgaagctagagagtgagcagtactgtaggaaggaggagtgggaagttaatcaaatatcaagcaagaactttgcaagtccctgtgaaatgatgtcctgctttctctctcctctcctacttgtgccaaagaagttcagattgctaaagagaaagattataggggtcggtgttttctgcctctttttttttttttaattcatcaagtaagacaagtgagtaaattatcaaaaatcactcagctcactaacagagggacagttcactctttgaacccatggttttcttctctaaccccttgacttgggcaggaggaaaaggcatcagaaaaagatctacttatttaacgaaaatccctaataagacacaactgtattaactttaggcattatgtggtacattagatatttagacttgttcgtcctatatatctgctattttgtatcctcttgacctatatctcccatttcctttccctcccctgacctgtagtaaccactgtttcattctgtatctctgtgtattacatccattacacagagaatgaaacagtggttactatagctatatcagcttgaatgtatggattatagtctacatgtaagtgagatcatgcaatattttgctttctgtgtctggctaataagtagattttacctgcttttgtcagctaaaatatgtgagatgacagatgttaatctgcttcacaacagtaaccactatgctatctatatgtttctatatatctataagtatcccatactttcgcgttctaaactttaaatatgcataataaaatttgttttttaaaaatctattcagttgacagaaatggatgtcatttacagtgttccaaaagaaaggatgacaaaaagagattcagtgccccaatagcaagaagacaataggtcacctgccaaagcactgaagaactaagactaggggtgtggatgaccactgggtatgtgaaatgctacagagaggcgacagagaatgagacccagtaaaagcacatttctttcagtagttagagaggatcactggtacatttgagagagcagctgagtttttccggaggaagacagattgaagggaagtaggtggtgaagaattaaggcaaaaatttcttgaaagtgtgaggacaaacacagcctgtgtgtgtggatgtggaggtggggggaggatgtttccttcacttaatactgtggcaatagagacattcttgtatattccatttctacctatacagtgtgcttggagagtatcagcttgaaaaaggaaagtgaagaatacaattaaacaaaataaagacaaaatagaaaataaatgtattctaaacgaataacccaaaatttgaacaacttaattttgcagaaaaatgatgcgatacttctcatttaattttttaaaaatatatgcaaggtatcatccctaaactaatattcactaaatgaatttaaaatacaactaaagtaaaatgagagtggaaggcatataaattagtaagtcttgaaaaggtgttttggaaaaggggaaaagtaacaatggtaggaaatatgtatcatgtaaattaaaagaagcaaaagggaatgaaagttcgcccaggatacagaacatattaaagatacttttaaagcttattgctgtaagtatacttttaaaacttattgctagaattttcctgaatccattttctaaactgtaaagcagtttagaaaaaaaagtccactttttaaaaatgtacctagccaaatattttatctgtaggaatcagagaaatgcctacactgaatacggaaatacattcacttccagtaacctaaaagggcacatttaaagaggcatagacctaaaaagaaatctccagaaattattttttacacacctattgcttgaagagactgctgcatcaaaagctgcaacttacgacttttagaaaacacgccgcgtgcctttcttgtggttccatatgaaagaactgtatctagaaaggaccctatttttatactttgcactatttgtcctgaatcctttgaaaactctcttggacaatttcaaagatattggagtaactaaatgttggaaaagatacattctttacatacatactcaaatattcatcaggaaaggtaaacatctcacgagtccataaacattcatgggtacaaaatgttttcattcacaagttttcattcaaactaaattaccagttaaggctattatctcctcatacatgtgttaaattatctatttgtgttgtaccatctttttggttgtttactgttcatgttcatgacaatttgaagtcaatctaacactaataaaacctttgatgtaaccttcttggtttaagttacctctagatcttcttaaatccatttcttcgctgagacgtgaaaataattttattagtacagaagctctctaattaaacagaatgagattcaagtagtttatgcaaatgggttttcatcatatgataccaaatgcaaattaaagggaaaagtcacctgagacagacattaattttccccaaaagaatttgacactacacatatctacaaaacatattgactaaaattttcatttcagaccttcaactttgtctaaatgtaatctttcgtgctttattagggttgggcaggatgttacagatattaatagtgacatgctagggttccttgtaacacacatttaactctaccttcttataattactcattaatttgctatttcacttcttaaaaatattaaaaagggtgtaaagttagaaattgaatatcctctaatgaacaaatctccagttattaaatactcttaggaaagcaccacttcacaaatagatgatgtcacatactgtccctgaaatagtattcctttcagatgaacagataaaaatggcaactgattatgaaatttttagttaaggacctaaatataatgtccctagttagcaaggaacatgtaacataccttcattttccaacatcttaatttttgtactctgtgtggggggggtgggtgggtatgtgggggtgtatttttagaggcctaaatcctctcaatctttctgtttcaattctgccaattaaaaacagtagacacagcaaataaatgtaactggaaaatttatatggaaaagaatcagaaacctcctatccatttcctatattaaaatgagcttatcaaacctgcaaaacttaggtatttcataaaacacttgattttttttctactaagatatccttacacatcttaccatagatatttcaagctaatttgtattagctgatttttttttttctctgagaatatcagatcatctctcaaagtatttttctctatgaaacacagcggctgtctccatttaaaggaaaacacacacatacgcacagctaaaggttaactgaaacgtaagtagaaattgcacaaaacaaaatttgaagcaagttatgacctctttctcatgttgtcacctattttccccatcctaagcttgagttggctccatctgcctaattataagcttaaaaccctctgggtggtgactgagtctatattctgcactgcacttaacacatttttcatgctctataaattattaataataacagtagtaatagcatatacttttcctactataaaagaaaatatgaacctcacaactgccacttatttacactctcttaagccttccagataacagacagctgggtaatggttactaagatgactttgcctcttccttctattccatttttaattctccttaatgtatctcatttatgtttttctctttctatatttttaatttatccctctaatttcttgacctcgtatatttattctcttattctgaatgcaaagcagcaccagtattttttaatttagctgctaaggaaaatatctctatttgtgtatgttcaattggcataacgagtgcactgaagtagtgtttctcaactttggtgctattgacattgggggctgcatgatttgttataagtgctattgacattggggctgtcctgtgccttgcaggatgttcagcagcacccctgacacccacccagtacatgccagtagcacatcctgccccctattctgacaaccaaaaacgtctccaaacgttaccaaatattccctgggaaacaacttccccaccaggtggagacccactgcaatatggtaaaactattcccttcactgtgtcacattgctggagctaagacggaataaagatgtgataaatatgaaatgggaataacaaaaaatcacatagacacacacacacatatacgcatccaaaattattttgaatgtgcaattcaagcatttaaaaagcctgaagtttggctcatgcctgtaatcccggcactttgcgaggccgaggcaggcagatcacaaagtcaagagcttgagaccatcctggccaacatggtgaaaccccgtctctactaaaaacacaaaaattagctgggcgtggtggcacacgcctgtagtcccaggcactcaggagactgaggcaggagaattgcttgaacccaggaggcggaggttgcagtgagccgggatcgcgccactgcactccagcctggtggcagagcaagacgctgtctcaaaaaaaaaaaaaaaaaaaaaaaaaaagcatgaagttaatacaagcaaaaataagtaaaattccaatactaaggattatttgatggctaaaaaattagttctgctactttacttatgaaagctaacctggaagagctctaagtaaggcactagctgtgatttaagaccagtatgttttaacatccaattaaaataaatccttctaacagcacttttataaaatcacttagcttgttaaaacatataaaatgtttggctcccctgggctagattatgattaaggtacattcagagaggaaaaaaatgcttctcatttcacaaggtcacagtccatttccaaatgagcttatacttcactattttccaaattgggttgttttttgtatgtgttttttgtttgtttggggtttttttgcttccttcactaaactagccaaggtcctcctacttctgagcattactgtaaatctagatactgtcaaatagcatttaatctccaatgaattttaaaagccttgtaaattacaaaagaaataaccagggtatatttttttttccttttaagttttctctcctgtggtcagtaaatacatgtcaacatccaccttctttattttaagcaccaatgcagatagcattaagtggatgtcgcatacacttgggacatatgggaagcctcatgagataatgtttacatgcttgagatccgcagttgattccacccgggtttgaaatctggctcccaacctttctcccctatgtgtctttgaggatgttgccctctctaagcctctagttcctcaagtgtgaggggtggaaatttttgtacctattttatggaattgctatgaaatggaaatacaaaggttttatcacatatcctgcagagtgagctgtataataaatgttgactattacagattcattaatcaatagatgagcttcaacgtaagtattgtctcacgcaaaaaccccactcctccccctcctaaatctatgtaatcctgtatttctttatgtcatacccccacctccaggtacacactacacacatatgcacacatacacacacacacacacacaaaaaaaaaaaaaaaaaaaaaaaaacctcacgcctggcaatcctattccctccatcacactcaatacctcaagttcctatccaagacatgatgaagccctgtgcctccttcaacatcatcaaaacattccagttactaagcttgtggacccatcatctcacgtcgccttcaacatcttagacagatcttatctccatcaccttgtctccacccctgccgtccccactctgattcagtctcttgccttctacaaccagggcaattttagaagcattccaacttatctatatttacagtagcatccctactctgatacactcttcatagtgaagtcagagtatgttttctaaagaacatatcccatcattacttccctctgtgacatactgcaatgtgctcctggtccctgaccttcgggatcaactccaaccctcagaatctaacaggtaagtctatttatgacctgagccccgtcgttctatcccattttgaccaatagtgagtgcctttcatacaaacctatacaataaccacagcaaactatctccaggtccctgaataagtgacattactcctaatacttttttgtatattaagactgttgcctggcatgtaaatctccatgcatttgtttgcctagctcactttctagacctcctttaagcatcaccttcttcatgaagcagtttcagaaccctctgaggctgagagatgctccttcatctgaattcccttcttacaactccctaagcccaccttaaggagcttaccctccattatagtagctttctcatctatcacacccaccaaaattcacagccaaacattagctcattttcatttttttttttttttttttttttagatggagttttgctgtgttgtccaggctgtggtgcagtggtgtgatctcggctcactacaacctccgccgcccaggttcaagcaattctcatgccccagcctcctgagtagctgggattacaggtgcctgccaccacatccacttgatttttgtgtgggtttctttttttgttttgattgtttgttttttgatggagtttcactcttgttgcccaggctggagtgcaatggcgcgatctcggctcaccgccaccactgcctcctgggttcaagcaattctcctgcctcagcctcccgagtagctgggattacaggcatgcgccaccatgcccagctaatttttgtatttttagtagagacagggtttctccattttggtcaagctggtctcgaactcctgacctcaggtgatccacccgccttggcctcccaaagggctgggactgcaggcgtgagccaccgtgcccggcccattgtcatctatattttgttgttgttaaaaaaacggagtgcttggcacacagtaggcacccaaaataagtctgtaaaaaagaatgcctgaatgaaatgaacgaataaagtgaatattaaggaaattaatcgtttcatttagttataaaaagccataatggacaaagacataatcaaacggcatttttaaatggcttgcatacctaagatagccataaaggatgttgcactttaataaaaaattaaagatctgaaacacagaactgattttcaggttccacttaataatttctaaactggaaatctcaacaatcaaaacatgggagccgtaaggatgcatgcacacatacatttatcacagcattattcacaatagcaaagacacggaatcaacctaaatgttcatcaacagtagacaggataaatacactgtggtatatatacatgaggaaatactacccagctatgaaaaagaatgagataatgtcctttgcagtaacacagatggagtgggaggccattatcccaagtgaactaacacgcaggaatggaaaaccaaacacctcaagttctcacttataaacgggagctaaacattgagtacacacaaacacaaagaaggaaacaagagacaacagggcctaattgagggtggagggtgaggagggtgaggatcaaacaactaccaatcaggtattatctgagtgatgaaataataagtacaccaaactcccgtggcacacaatttatctatatagaaccaatctgcacatgtacccctgaaactaaaataaaagttttaaaaaatgtgatagccagattattatcagaaaccagcaaggcataaagtggaacatcaagtaccactttaatagcaaaatgtctgatttccccatgacaatctgtagtactccctaaattattaacagacccaggcaccacaagcagcggggactcacttgggaagcgagcaacacatttatttagttctaagattgatgaatcagaggaaggggaaagcagcagcagttattttgatctgtggggggtcttggtgccttttgtatctcagcctctgctggtgttgaggctctttgtgggtgcaggcctgcaggctgcttgtgtctctctctcctgctatctctgctgacagcttctctgtgtgacagcttggaatcccggcagtgaagtgtgaaaataaaacacaggcaaaactttacatgggaatttaaaattggagttatatttttgaaagttttgaacgcattaaacatccagaaaactgcttccttgttagagcgcacagggaaggaggagtgaacaaggtcaaatccaattcagacatcatttcacacgaggctccacaccaccctcactgtccttacgaccccgggagtcctagattaaatgttctgagtcaagttaatgtcaactatttgaccttttcaaaaccacggttttccaaaagttaacatctaccacatcacacttatgttccttctgttacatggtttgctcttttaatagaagttttaaaaaaactttgtcataatctaaggagatgagagaatctatactctcttgtctcttcttgattcagtcttctctcccccagcccccttcactttcagggcattccagaattcaagtttaacgagggcaaaagacagtcctgccaaagtcaacaatcaatacttctcaataataaaggaaatacagtattttggcccatatttgctttctataggataagattccaaaagcgaagaggaggataattatcaactccaattccccaaaacctttgtagtataaatgtttctgaaaggcactgtgttttgcaatggtttgatagaacaaactcccttatgtataaaatgacatatttttggccacagatacataaaaacacagaacacatttatatccagtctaataacataaaattgatggcatggtttggaacctattctctggattaaaagtagggtccagtagtagaaagggtgatttaaacaacctaaaataaaatgctttggtaaagaataaaatgtttcatgcaaatatgcattaataatactgtgccaataatatcgagagcagttcatgtcacaatgcaaatcagaaaaacaatctcaggaatttctgagttaaacagatgaccctgttcgaagtacatagagggttgggatggaaaccgataagaaatggaaggtggtagtacaggaatagcaaccattagcctcaacagcctataaaaaggattccatctttagaggcagaaactagtcgcttcctactgaatttctggaatcctaaaatgatgcattctcatctagcatcatcccacaacttcaaagcagtttgttcattatcatgcaatttcagcaaatcacatcctcttgatacgatttctgatctggaaattcagatatttaaataactgttctccaaattcctatttctaaaactgcttcaaaattcctaaactttcccacagttatgagaaaaatgtgtgatccttgatggtcatcacttcatattcactgtgattatctttgctctctcagagaatgatgtcagcaaaagtttcctttcaccacttgcgggtatctatgaaactacaattttacacaggatgcactgtcagacagcatagaacgccttcaactcctgaggcaatgttgctttcaaattgctaaattatcttttaaaagattcaccaattatgttgcaggaaaaacacatgtggtttagaatataaatatttacaacagatactgagattcagaggtgaaagaatgaatagtgatgtgatgttttctcccaagagacatttgccatgactgagaccactgccaaagaaagctttgttctccattccctctgtgttcctgcctgctgagctcttcttccactagtcattacaactacttctttggatagcttatgactgttgagcaaatatggcatttgtgccttacaaagctttcaatttaacaaaaatttctcaaatgcacaaatgtactaattctaattaccaatatcttatatttcacactgcatgtctactagagaaaagatcaattggccagaaagcaaattaatctcattaaaatccttaatgtaatccagtacagtaacaaggagattaaatgtaatattgaaacatttcttataaatcatattttatatattagatactatgattcttttgtttctactgcataattacacatatatcattttgaataatttatattatctatttaaaatctatttaattaatcaagagaaataaaggaaagaatgaaattgaaaagaaaaatttatctaaaagccgtatgtaagaagcaaaagcgctaacactggaaaaccaatgttgaaaagaacccacagttttcaatgataccacctgttcctccttgaaagctaattaaaatacaccttaggaaacataattgcctacagctttaattacatctcttccaagaataaagggctaccactcccaggatatgttttctcactcagctactggtgtgtcttctctcgtgttgaatctctttctgacatcataagtgactgcccacctttccatatatgtgcaatcatgagattcaaagcctgtatcatttcagaacctagtaaattcaatagcaattttatatttatacctatctctacattgagtatatatacacacaaacataatgtacgtacatctatatactatatatgatattaaatatacacacacagctacaattatactacctagcaaaatacagatactatataaatacataaacacacatacacacataaatacatacaaatatgcctatacttctatatctatgtctttccattaccagaacaaattatgatatgcatctgttggcaaatacattgtttgacattcagaactaattttccactggaaacaatgtcccagactagcccatggcaggcttacaaatccaacatgtagtcgaatgattggcctcacgggactgatttgagtttcagggccctggaagaagatatgctgtgaaagcagcagcaacacaatggaggataggaaagggaagaggagaaagaacacattttcctatatttcctaggttcaaaaatttgaaacagtcactttttggtattcctcctctcccttccttcacctatctcctgactttgttagtgccctcaagtgtcctccacattctgcctgtggccctctaccaaggttacgtcattcccaatcacgcctcatgccaacacatccacagcttccctgatcaatcatccatagacgcagacactcagtgtagatgaactcttttagatgttagaaatcagtttttagttaatggtaaagtccgtataaccaaagcaaacacattttatttacatgtttgtttcttaaagaacatgcttactaatgcaaataagaaactgagagaactatagctagcgaagaaaaaaaaagaaagaaaaagagagggcatagatgcagtgggttacagttttacatattttggaacaggctagtttgaagcaacagtttaaccaagaagctgctagaacttgagataattctgttattcccagccttctctttttccactgagagaagcaccatgtctttaaaagcttttgtccctcaatctgtacctcctccccatctccatacacacacgtatctagactgcttaggagaagcttctccaaccaagatcaggttagcagcagaagaaagtggtggtgcaaagccgccagccctgaacgatgtgcatgcgtcatatagacaagttgcttttgtagagataccccactgcaaacattcttttaaagatgacctgaaaattcccatccttgaatataaattcatttctccactgtcattattgtttctagcaaactacttaatataaaaagcaactacagcaataagaattcagtgattgcccttccccacttaaaatacataatatctactgttttcattattacattcttggaaaccagtacattacttcagctctaaaaggtgctgaacaaccgactacggtaggagaagacaatggaaatctccaaaaagttctacaaacatttcccacaaaacatgcaaggattttttttaaacccttaaatatgaaaaatcacttcatagcccacatttatgaacatatgtacgtaaaaaattcaatgagacagcaaaatagcgatatagacacctttgtcattcagtacaagctaaccacacaatgtgcagaatgtatgtgactcatcaaaacataataaaaatgcattatgcattaggtaaacaacaaatagtgtttttgcacgagagaagtctaaataagaatgtaaatttatttattaaacctcttcaatgagacttcgactcctaccgggatatacccattcttagcatgacaaacaaaaactaacaacaggagttcccagggaggaagcctgaacttgggctttaaataattaacacctttcaaagaaaacataaatgtttggggggatacatatccaaattacaccaatatcacacgtacccccaaaatatgtactatgtcaataagaaataaattaaaaacccctgtggtacacaacatatacatttttgcaattaaaaagaaaactatatgaaattataaaaaacatttaaaaataattaacacccttttttcccttaatttatgcctatggcaatttgttgttagcagttaagccaaaatgttatcctagtgtagcaggtgatgtacaaagctctttcttaaaacattgaacagaacatcacatttaaggaaaattaaggaggctgaaatgggggaggtctgagtatattttcattaaatatcaaagatttagtaatactaattacatgttttcttcccactcagttaagtgtataaaacagatattcactattttagctcttctaatgtaggcctatcataggtttttgctgttcctttctgagttgttgtttatttttttgtaagcgagtttctgctgttgctattttgttttcagtatttgtttcaagcattcaagactatgacttgcaggtttcccaaaaaaagtgtctaaaggcttttaaacctgggttctagagagatgagttttaacaataactccaacagttaccttaatcactgccttaataggtccacatgattttccacatcttaacttttgtaagaggaatataaaaaaagagcagcaggcttggaagaaaaggtggatctggcttaagaaggcataccacttttgagtgccacacacaaagctgtattttctgcatgtgctgtggtgtctctctgaaggaattctcttcaaatctgactttgcattcatgatttgactgtcaggtttgaaagcaaaatttatgaaaacatagggagaatataagaccctaaaagttaagcttctttgaaaaatgttaattcataacttggataagcctctctctttcatggagacactcctttctcaaaaaaaaaaaaaaaagtgtatacataagtgagagagagagaaaaggaaattacagaggacatcagttgtttgcaaacagttcacttttttcaggctggttttaataagcctccaattcagctccaacctgactctcagaacccacctcctctatatgtcatcaaggaaaaggaggaagaaataaaatttaaaagtccttcttgccagtcctatggcaggtcatattttccaaagatgcacatatctcacgccataaggtctccttccactagcagtggggagtctattccctccatttgaatctgggcacagggttgtgacagcactggccatagagtatgctggaagtgatgctatgtgagttcccagctaagtcgcaaggagacacggcttctgccgactctccttctggcagtcttcattctgccttcttcccttttcttccccgaccagaaccaggagtcctgggctaagacgtaagggttccaactactccgaagctgccatgctagagagaactcatcaggagaccaaatacagacagaaagggaggtgtctgaggagtcctaactgtaccagcagcgaatgttcaagaggtcccaacatcaaccagtgggcttgtgagtaggtaaggtcagaagactccagctacccacccctccttagagtcttctcattgcagctaagatatggtggagcagcgaaaagtcatctctgctgcgccctatctgaattactaacctatagaaatctgtgatagtaacagatgtctttttataagctaccaacgttttgtgtcatgtattatacacatacagaagctgaaacactcccaatgtgattgccagcaaacccaattctctgcaaaataaaaacaagtattatgtcccaagaactatattttgtatatcatcacttctcctcacaatgattttgtaagccatctctattttacaaatgagcaatactgggctgggagaagctaataaggtgctcaatgtcacacagctgacaagtgaaccaagattggaacccaagtccctctgactgcaaaccccatgatactcctctttccttcaatgatatccctctttctttcccctacaagttcacactgcagaggaaatcatgtgactaaggtctcagttatagtactgggctcagtaaaactagcctcactcatttcttcctttccaactaacctacactgaatcctatcatttacagactaatacacaaattatagtaatttctatatatgttgaaaaataataaaagaatgagggagctatgttaagattgattaacaggaaactatttacaagaagacacctatttagaacaatattaagggtgcctgctgtgttttgattttaagggttacagattgcactttgacaaaagtgcttctacgaattataattatattcatttacttcccaatgaatattttcattcaaaggattttactgctctctgtgggcatatgattaatatgcatgtgctcaaacaatattcacaaacttcacaatcctagagagagaaaaaacagtgatcagctttccccagtccgagtaaattgctttgagtgaatttctgcacctgtaaagatgctcttctggggatgggctgtgtttgcatccggggctggatgtcaagatgcccttctgtcctgatatttttcaagggcaacagcattacattgttattccaatggacagagctcataaaaagacatccttatattctggagcctttaggagaaagcttttctttggcagtgaatgaaaacaaaggcaaaagatgaaaggaaccatctttcaaaggaaacaaaaaggcctctacaaagaagtgcataaatgtagaaagcagaaaaaaaaaaaaggtacattatatttggcgtgagagtagagacaaagcaaggcccaatggagcaatactctttctttacaaatactgtcagaattttggggaaaaaaaaatcatttttgaaggttccaggaacaaaaccaacagacgagagcttaaaatatacacagccacaatgtttccattttgttggagtttcagaagaactcctgtgggcaaacgctgcatgtaaaacagactgggtgtgatgtaactatatcaaggcaacaaacacatcaggaacagttggaaaccagccaatactttggttttatataatgtccatcaactggttgggctgattttttaccataaatggcctgttttaaaactgactgaacagtggacttgaataaatagtgtaccaaactaacaccatagagaaatatacagaatcaaaggtgttcaagaatgtcaagcaacagcacagccacagaagaggtacaggccgatattaataaaccaaatctaatcacattttcattttccgactgaaatctttcccaaagcagtacctttacatacagtgctttttgttaaaaataaataaataaaaataaaatgccaaacgagcactaggctcctctttattatgtctttaaaaataaaagactcaagccagattggacagttttctttgaaattctagtttcagctgctttcagcggctcattttgagaaacatctgtccagtctggctcttggggagatgttcaaagacaagtgttctcatctgaatgctaagggactctcctaagggagtcaacagtcctctgaaagcaagcagaaactatcaaaacatctataacccttgaacttctttatcaagttcagtgcacagcgtacaatatgactcaatttcatctttagtaaaaaataaagtttgtctgcttcactgccacctttaagacatcatgttgttttcatattaaaaacttaaaatattcagtgaccaattaatttggaggcaaaattggccaagtataaagttatgcaggggagaattcagatttgaacacagctaacttggaatctgagttcatgtacaacatatgtatatacaaacccacatgttgcatttgtgaatgtaggcacagagtgaaaattctccatgtttaggtccacaacacagagccatgtcacgaagaattaacacatgttctaattctcaccagaagtgatccaaataggttaatgaacacctcctacatttcagatataataatatacattgtcacaacaatttcataaagtaggtaatagctccattttagaaataagtgaaggggggtcaaacaagccaaaaatgtgtccatgttcacatagttgcaactggcaaagctaggatcggaaccagagttattttgactaagaggtccagaaacttggctctaccaagccaccatccaagtagaaggttaccaaataccaaaatgaggaaatggtaaaatattatccatgagtcactgaaactacataataaaaaggaagccaaaataagttttgacgcatttaaagctaactctctaaggcatgggttaaaagttgaaagctagctatcagaagtttaattttatattctctcaagtaagagaaccaaacaaaagtagatcaaccagaccaaacttttaaaacactttaacttctctatgaagctaatgtgtaagatatggtatttcccccgggggagaagagcctgtgtaacattgcttttcactctcatgattgaaagaaaaatcaattaaaattatcctgggagacctttcataccattccaaagagccaagaaaatgctggatacattctgaatgcagcaaacactagactctcctaaaaaatattccacatatattgtttgctaaatcaaattcagtccttagattttacaggtttaagagaatctctggaatacatggcagaaatcagaaaaaaaaacaagcttatcctacatttggtttcaaagcgctttctttcaagatctcccaatttttctatgttaaaatttgtgatggcttctctcaaaactctgccagaaatttatgaggaatgaaaaaactcttctaacagattcagaaataaaactatggcattttcaaaggaaaaccaatatgaatgccttttaaataaagtttggtaaggacaacacaaaccgtatgttccaggtatgtgatgtgaaccacatggtctgtgaggcttcttgcacttgatatgctcctcctaaggtgccaacatcaacaaacaacaatgtgtactgtgactgaagttacagccaaggtcggatggaagtgtgggctctgttagccttgatctaattttttaatgtcaagcaagaaaactgacattttggggtacaatattgctatccaaagcaaatatgtggaatggaaaaaaggcaaatattaaattctgaagtaaacaaaataagaggtccttaggtaaaataagagtttttttttttttctcaactagtctccttttctcagagtaagtttcacattttatatactactcatattccctgagaactttacgtacatcagtgtctacatttggagatgatgaggttatttgatttaaaattgagaggccttggttcaaatctttgtctttgataatctatatgtataatgtcccaaataatcagaaaaataaacaattgagttatatcacttttacagttttttgaaattctgaatgcctacaaaattattctttattacaataaaaagttcgctatataatgacaatatgagagttatgtggcttaaaacaatttttatttgcataaatagtcatcctagtccacttacttggcgagtgatcagtaatttacaatgctgaataaatgtatcgttttcataagggacagatgtatttttatttttccttcttatccttctcatttcccttatcccattattctttcagtacataagatcaaatgatgaatacactgagttatccagatgtggttcaaaaaggaaaaatatagccaggcgtggtggctgacgcctgtaatcccagcgctttgggaggccaaggcgggcggatcacaagttcaggagatcgagactatcctagctaacatggtgaaaccccgtctctactaaaaataccaaaattagccgggcgtggtggtgggcgcctgtagtcccagctactcaggaggctgagggaggagaatggcatgaacccaggaggcagagcttgcagtgagccgagatcgcaccactgcgctccagcctgggcgatagagcgagactctgtctcaaaaaaaaaaaaaaagaaaaaaatatatataagatggtatctggatagcaataagttataaaaaaagaaagttatgtaagaagaaaaacatttagtaaacacgtattcttcaggtttcttattcataacacacaggccataataacccttgcaatggatacattctttttgtagaacaccaagctatccatccatagtcaaatgaggttataggagatttaccaaaaaatatacatcaaactacattcagtctcaattttctcatccatgaaaaacgaatggttttatccaaataatctctaaagtcccttgcaggcctatgactttatcactctaaacatctatgcctgtattcatatcattagtaccatcaacacacatgaatgcatttgaagaatgttctaaattttataaatcagggcatgagaaactaatacaggggcaaaaaagaggctcttcaaaattatggattagaagcaggatggattcattaatgtttttaatttcactcctcctgagaaatggagatgtctaaatcaggctgggcaatcactaaagtgactctgagaatcatccttacaaaaaaactttcttgttaaaatacagcaatatgattccacctctaattgataccaatatcattattaaaaaataaaaataaaaaataaactgtgtggatagaaagatgaaaacaaaatcagagtaagagtatatgactacagagaagggaatattttccctctgtactaattagttcatttcttgctacctgaagacttactgggttaatctgtggcaccacagtgtagtagtgtttttacactgctgatgaagacacacccaagactgggaagaaaaagaggtttaactggacttataattccacatggctgggaaggcctcagaatcatggtaggaggtgaaatgcacttcttacatggtggcggtaaaagaaaataaggaagaggcaaaagtgggaatccctgataataccgtcagatctcgtaatacgtattcactaccatgagaatagtatggggaaaccacccccatgattcaaattatctcccattgggtccctccctcacacatgggaattataggagtacaattcaagatgagatttgggtggggacacagccaaaccatatcacacaggatgtaatatcctatttggttcatctcttctttagaatattactgtttttctacactttgagtgaagagggaatacttatttggatagaatatttaaaatttgggccaggcacagtggttcatgcctgtaatcccagcactttggaaggcaaaggcttgtggatcaactgaggttaggagttcaagaccagcctagccaacatgatgaaactcccatctctactaaaaataaaaaattagctgggcacagtggcatgtgcctgtagtcccagctactcaggatgctgaggcaggagaattgcttaagcccaggagggggaggttgcagtaagccaagattgtaccactacacttcagcctaggagttacagcgagactccatcttaaaaaaaaaaaaaaaagaaaaattaaaaaaattcctctcctaacaattctaactccttctgcaacaaagtcacaaaggtaggatattttttcacatatatgactttacataattttcttctttaaaatatttagatttggccgggtgcggaggcttgtgtctgcagtcccagcactttgggaggtcgaggcgggcagatcacaaggtcaggacatggagaccatcctggataacgcagtgaaaagctgtctctactaaaaatataaaaaattagccgggcatggtggtgggtgcctgtagtcccagctacttgggaggctgaggcaggagaacggcatgaaccaccaggagggagagcttgcactgagccaagattgcaccactgcactccagtctgggcgacagagcaagactccgtctcaaaaaaaaaaaaaaaattagatttaatcatatggtcagtaatttatccataggggctaattttattcaagagaacacaatatgtttctcataaaatggagcaaaatgcccaaaacgatgttaaaattaagaaagaagatagtaggtaactgacagaggggggagaatgaaaaacaaaaaatgtagagaaaagacataaaaaatattaatttcacaatagtgaaatctactcttagtgaaaactaagaaaactcttttagcaacttaaaaatatacaggacattacttaatttcaattttcaaaatatgccaaaggactttgaatattcaagtacctagacctcccttttaacagacaattttaatcttgaatattaagcagacttaataattaagtggaaaaatggatttgactggggcatttctgtcttttcctccatcaagggaggtattagtaaatttcacaaaagtaagcctctgagaacatgtgaaagaaaaaattatctttctctcctaagagttcagaatggaaaacaatttgtaaactaagaatgagaagaaaggagttcaaaaaaataatgaaatggcttttgacaaaactattcctcgtggccacatccccgaatattccccatggccactgttctaaaatatgtactaactcatttgattcgagaaggacctaagggagaagagaaaaaaaaagaaatgacattttgattaaagaggtcgtttatccaaacatatgcgtatccactattggtttcttcctctccatcctactgtgctgcctccaagggaaacaatttctgaggagagtgtctacagtaccatgttcagaaggattctgaggctgttcttctctagagaaaaaaaaaaaaaaatagaagagtgctattatcaaatagtaatgtctgttttgaacaagggataaagagagtagcagcaacatacaaaggagaaaaaaaaaatgaacaaacctctcctggttggtcagaatctctataaatcttgaaatttcacaagtcttttgaaaccttcattacataagaattctattggatttgaaggtgatttgcctgaatatacttattggtacaaacagcattctgaattatcctttgaggttgtaaaatagtaaccagattccaagaggccaaacaatttttacctcagtacttgccagctttcttaaaatacgttggttatgacttcctttcacattttcaatgtgatgtgatcaaatcctcctgtaatctaaactaactttataccaaaagcaactttatgcaactttattttattccttcatattagtcccatctcacaccaagtatatactggcttgcatttcaacaacaaaagtcttgaaatagtgccattcaactcataatcatgttggtttttccttcatacctcctatttctatcattctattgcatactcactgggttcagaactgagggcatctacttcctggatttttactattctccctttggaaaattccgactctgatggtctctaaaattccttcttctctttttgatcatatttccttcttcagactctcaaacagctttgcattaatttataaataaaagattttcacttacatagattagtaataaaaaataatgaaaataaactaagtaaagagccagcaggtggattagagaaggctgactgctgttataaacagtctaccatctcagtagctgaacacaataacattaattgtttcattcatgtcacaatttaatgtgaattgtacggaggctttgctccatgtagacttaaagactcagtttcttccatctagtggttctatcatctcttcctggaatcttccattggacctcctgtcttcagaagccacctccattcttaaaacagcttagcctagaggtggcaccactcacttccacatcatttccaatcacatcccattaaccattgcctcatctttcctagctgagaatttgatttaatgatgtgctcttgaaaataaagaacgtattagtgaacactagcaatctctaccataggaaagctactttgatttccaagaaaatggcatattgaaattagccctatctgtctcaaaaagctgtcatgaaaatcaagtaagtcaggaacgtgaaatacttttaaaattgttaagtgctgtgtaatgatatggcacactgacctacgcctccttttgataccttcacttctatacttccacaaaagattattttccagacttttaagaacccccaaattcataaattttcaaaaagaaacacagtttttaacatgtgtcaagagttactgtcaacttaatccacaagacaatagaataaacctaaatcaaaacatcaatgtttggcagtaaactaaattcactactcagttttgggttccattcatcacaccaggcttaacgccagtgtgattcaaatccaagctccaaagattagcaaaatgtatacagactgcatgtcctgacactctgaggtatgttattaaaaacagtcaaaattgtaaatggtaactctatgattgttaggcctatgtggtattatgcgccgggagttttggggatacttgctcgtgtcctttgcacctgaaggttgaaggtaagtttcacagttttttccactgtctctcagtccaccaccacaactcccacctatacttttcaagcagctctgtaaatcctgtctacttcctgaaaccttactcagttgagtagtggaacacctcatcttcttgtctcctatggacttgaaagaaactcccacacgggatcattcactttcctctcatgacaaacatatccttcttctccatgttgacgtacgccaatgaaaataaactgggatatcagagaaaacatggaaagaaactgtatcctagcaactcatggccaaatataggcattaaggtgcttaaattattagcattcactatgttttttcatttccctaaagtcttattctttgcaagcactttatcagtacttagaaaataaggtggttaagcttcctccaggagctcatattctacgaggggtgtacatcaatcaactgtccatattcgatgtaagtgacagaagtctgagaaatcgctctctggttacgaggaaatgtagcgtgttaatcaaggtaagtgagctgtttctacagagcaagtcctgaaactgctttgcatacatttgcatgttcattgctctgagaagtcccatagtaaaagcaaagcaaagctgagaaaacaacacctacacacacaaaacacttccacaacaaaacaagccaacagaacaacttgcgttgcttgaatgtatttttgtagggtgacttttttctctatagacttgttaatagccctcagattttcctaaatgctagattgagaagcactgaaagatgcagatgttttaataatttaaaagtagataatttttactttacaaaagcattggaaatctcaaaagaaaagtctgtgtcattaatattcaaatgcttgtacgtttaagtcttcttgtaaataatcaggtaaatctctgaatatcttacctagatgtgaaaacatgatttaacaatggatagtgatgggatgtattttaaataagagaatatatttaaatgcagagctaataaatttttaaatctgaatgaaataaataattttctgggaattatataaattacttcttttgcctcaagaaggaatgggagatatgaatagaaaatagccatgggagagaaattttaaaagttgtaattttttttttcatgtttagcaaaaggaagcagaatccatagaggtatccaatttagagaagcctctaaccccaaaacaaatgcatactgataacattcatacaaacaacacttctacaataaaagtctgatggaaaacatgatttgtaatcggtcccactgaaatagaaatgttcagggatttggtattttccatagaaaagttaaatgtataagaaaaatatgtttaggtaggatctaaacatgctcaccagcagaagataaaaatgacaaacaacaatacattttattcaggattaaaaacacttgttttctgcatatgccaaggaaacttacttgcttgtgcttagacatttttacccacattcagaaaatgaagcaaaattcacaaattcaattcataatttctttttaagctgcatataataaatacctattattcatgggtgttggcaaatctgtatactacctatttttttttctatgtttagccttcggagctgcttaaatcttaaaatatgtaccttctttgttgttctctttcttactgtggagccccatggcttggaactgtaagcactgctacagtcccaaacaattctttacttgacccaacaaacatatccgtcaaaatattttgggctatagataacagaacatcctactaaaagtggtttaaaaaataaggacatcattctgtcacataaaacctgagggagggtgatttattcagctactcaatagcagctcaatcgctcagtcttttcccatccgtctgtcccctctgcctttctcattgtgctggtttgtctccttagactggttcctctcatgatccctacaggcctgcagcagctctaaacaccacatacagaggaaatattcaagaacagaaaaggaaacatctttgtcttggtgccaatcttgtgagtaaataaacccttctcaaaaactccccagtgtatttgctctaaattttcattcaccaggattgaatcacatggccatgtttaagtgcatcacttagcaggaaactgagaccacttcacttttttcaaccagtaagatttgccacttaggagccagccccacccccgcacccccacccactggcatacacagcaggttactatagaatgagagtagataaaatctgggtcaatgttataggcaagcaagaaggaagcgtctaacaggcaaacaacaatgtctgtcaatagtctgtttatatgcccagacactatcagataccaatttatattccaaggagtcattctcattggtaggtaagttgcataaatgattatatataatttttgagtaagtgataaacattttattctattttctcatctatatatcaaagctactatagctgaacttcatagaatcacaaaattctaaggcagaagctcctagaaaattaataaactgatctatgataaatcaaatcatattttaaatttcctagggatgctccctacttaagaaagccttcaactgaagtttgctttcactttgttttagcatatccagttttcttaagttggaaattactgtaagtaaatgtgagagtggtacacgcacaatcatttgctttctctctattctcagattatcttgttggacttttaacccaaccacctgctccaaaccaaaatctagatcaaaataaatgttattgactccttaccctatataggatttctatttgattgctcagaaactccagtatgacacctgacataagagagtaaaagcacaacccaagaggcgctccagaaactggatcagcagagacatcttcagaggcagcagacctcagctgggttgaggaccaaacaccaccttcacgttatgtttttcaaggtaacaacacaacacaacagagagaagaggacacgggatgggaaaccaagagggctggcctctaccattcttgctttccaacagattttctgtggcaaggctctttcccttatcttgcagatgaaggagtaaatcatcttcagtgaaattcagctctctcccattaactcattgatttattcacttaactatcaaatgtttattgaacacctacttgcactaaactctacattaaattctagatgtgtggaggaaaacagttaaagtccctccagtcttggggtggggggacaagtaatcactgagcaatccagatgggacgtgttatgaattagataaacttggtgattagcagaaggaagtagaggagagaggtccatttagagtggtcaggaaaggcatcacagaagagggggcaggggagaaagatgagttaggttagacggagaaagaattacaagaacagggaagacaatggatgaaaatgtcaagagaattaaaatgtcgtgagctaacagggtctgacataagatgacggcagagaggaatgcagaagctaggtcaaccaacggccttgtaagccaagataaggagtttttacttcattccaagttaaattgatacattttaaatccacataaattgcttatgctgtagaaggttctgagaactgtaaaaaccgttccctttcttagtattcctgccagaattgtcgacaaacatcacagctacacagaggtgcacagaagaaagagatgataccttgaactttccaataacggtttcttcattttagttttctctttcttttaaaaaatcaaatgggttacaaaatgcttgcggaagcgtgagaacaacagtaacagtttctgcctagaagaatcctatttttgcttccactaaataagcacaagtctgttgtctagtatttggcttttggacaaaacataagagtcagaaaatcacgaccatggaactagggtcaaaattaagtagttgattggaaataaaagaataaatctaatttctgaggactgactatacgtagggaagggaaaagggagaaaagggcttttacattcccttcatgtaccatcctcagcttaatagccagagaaatctagaggcccaatgagatggatcatggggctctttaaatatattttaaagcattcttttcctggtggaattttcagattgtaagtttgttgttgatttgggattttttattatttatttatttttatgtactttttttttttttttttttttttgagacagaattttgccctgtcacctaggctggagtgcagtggtgtgatcttggctcactgcaatccccacctcccaggttcaagcaatgctcctgcctcagcctcctgagtagctggacttacaggtgcccgccaccacacccggctaattttcgtatttttagtagagatgagttttcaccatgttggccaggctagtctcgaactcctgacctcaagtaatccacctgccttggcctctcaaagtgctgggattacaggcatgagccaccacgcccaggcctggatttttttaaagacaggtgtgtatgtgtgggtgcgtgggtgtgtgtgtgtgtgtgtttggggaggagcacacacaattgtatgcaatgacattattggtgggaagaataaacaactgaagttatcaaaactttctaccagagcactggtaaatatgggttgtcatttaaataacatatccctaattttccatccactgccatagtgcagaaacaacttaattacaagtgtccatgggaggctctaaacttctgaggtcatggaaagtgtcattcacagtcctctgtagtctctgctatgattatcaccatgtccacagtaagcattcagtataaatttgtgaaactttattttatacaaacataaagctttatgtcattttccatttaaggcaaccagttttaaatacaacactcaaaaaatgaggatcaaagttgatgatgtagatattgtaaaatgcagagtactagcatactgaatgcatacttatgcactgaatacctactgtgtgatagatgtttattcagtgctttacttacactgtctctaactgctgtagcttttaagactatccatttttgaaaatgctggtgaaaatcaagaatcaaggacagcgaagacgacagttagtgatagtgtaaaaaacggtggctgtaggcatagttttaaatgttcttgagaaaggattactgttaactgcggaaatgtagcaagtgtatctcctatgattcatgttacaaatgtaaaggtggtgtacatttattaacaaatagctggatttaaaaattcttcagtcattttctgttgaaagttttatctacatctgtactttatcaaggcctatttagtttcctacaaaacaacaaaggatacgttttatctttaaactcaggaaggctgtatgaccacaggttcaaaatgcatcctgaggggattctacacctgccgcctcatggtgaaactgcctgaaaactgtctccagggagagcatacagaaatactccggcataatacagaaatcgccttttcgcaggaaactagatagcttgttaccaatctgtttggttggggataacgcatagcaatcctatcctttgtttttcctgatttttactgttcttaacatgcccaataaataccttctcactgttcaagaacaggagtgctgataaacatcatctcaaaactggcatctacacccataatattatattatataataatattagaagcactctccagccactgggcaaatccttcatgagaaaacagcatccatttgaagttgtgaattcttttcttctttaaggatggatttctcataccctaccagaatttttgttatcacaaaatgcacactcttttttcagaattcctgaataatgaaaaatacagaatttatgatcctttgagtaaatttctaacaagtgatgaaattccgatgaagtgtataatgattcctcattttctttatgaaatctatcagttcaactctttgccttgaggacagatgctaaacagttgctctggcaagttattaaatcaagtttctggtttcttgcagggcctttcaacatatccccacagaaagatgaggcagacaaagaaactctgtcaatacacctcatatcattaaaagtaaaaaagattaattcctgaaataatgtaaatacatggtatttttcatgataagcatttgaggacatttttcccccatatcccttaacaactagaattaaatccctctataatgactcatttagaatacatttatttaacaaaggaaaacaaagtaaactgactccattggacaagtttgaaaataattttatgaaaacatgttgaaattaaaaccaagtgtttctgatttgtgattctacttggttgggccagtaactttcatgaatataatttcatataccaatatgaatgcttaatgtactaaataaacaagttgtaaaaaattaattcttttctgaaatggtatccatcacattgcttcagtagaatctttattgaaaagaaaggccagtgcaacgcccaaaagaaaaaaaaaaaaagaacacattcatactccatggtaatattttgcacaattaggtagcattttacattaaaatctgcagaaagcctagcaagagtttcccattgtgataagggcaaaaactaaacatggccattttgtaggccctgattgatttaaccatttttttctctgtgtattttcaaatatcagtaatgctgagaacccaattccaacatttatgatggcggcattcttaaaatatgggacatacaatacaaaatcagcaatttctgaacagtggtacaactgccagtaatcaatggttttttaaattccttattatcccatgggccatttcaaatagtttgtattttccaaatttcactccctttttaatcaatgcatgtgacattctgctgctgtaaatcttaatggaaactatataatttgatcatcatactacaaaattactttcatttaagaaactatgctgccatcagtaaaaatgcatctaaattattatttactgaactgtagtaaaaccctcgaattccactaagaagagtagtcagcataaaggaatcaaaacagcttttccatttcagaactttcacaattgtcaaacaactgctttatcatcatgatgtacttaaattcatttctactattgaatatcaccctctacaaaaagtgttattcaattacgtggttccacagcacactggaggtcagctgttaatagcaaagatgtattatgatgtgcttttattatttctaaggagtgagaaaaataatacgttgtattacagaacctcagtcacagtcaatgttttcattcatttgtaaaaacaggcaattgaatccagaagcacacaaaagagaaaaaaatcttttcatggagagtaattaaagaaaactcttgactttaccatcactaagcagtgaacaaatccacacacacacaaatctgaagttgcattaatgcagacatacaactttcaaataccctttagccaatgtttgagttgctaaaacactagtaatattcattcaaggtgtcttgtcctttaaataccattgctcaccaacaatttaaattaaaaagaggaagcataaagtttgggaattttttcatgaaagtaaaatttttcctgtaatcccagcactttgggaggccgaggcaggcagatcacaaggtcaggagttcgagaccagcccgaccaacatggtgaatccccgtctctattaaaaatacaaaaattagccaggtgtggtgatgcgtgcctgtaatcccagctactcaggacgctgaggcaggagaatcacttgaacccgggaggtggaggttacagtgagccaagatcatgccactgtactccagcctggacgacaaagcaagactccatctcaaaaaaaagaaagttaaatttttattttagtgccataattcagggggaaaaaaaataagaatcttttccattgctctggggagaaacaaagtatccaaccatggaaaggtaaaagagtacatttaatatttcaactcaagtattataatgacagaaagtaaatttctctatgttaatgcataataatttcccagccgggctcagcggctcacgcctgtaatcccagcactttgggaggccgaggtgagcggatcacttgaggtcgggagctcgaaaccagcctgaccaacatggagaaaccccgtctctaccaaaaaaaaataaaattagccgggcgtggtggcacatgcctctaatccaaagctacttgggaggctgaggcaggagaatcactggaacctgggaggcggaggttgcagtgagctgagatcgcgccattgcactccagcctgggcaacaagcgtgaaactccgtctcaaataataataataataatttcccaaagattttgtgccatttgctacatactgctcttcctttgtcacccttggatgcccaattcttatgcaatgcattcccagccccaaattattttaatctccctgaatactctgatgtgtttaccacaatactatctcagttactgccaccattaaaaatagagtattccatataaaagtgagggtttgtttctctaaactatacctattttcatactttattgtaatctttattcttttctcaatgtattaaatgtcgttctgcttttttgaacaacagaatgatcatttcctgataaatcagggtttatttatactgtttaagtaaattcatttatacatttggctttagatctgatagaaggccttggcagaccactttattttttttaacgtgaggactctcaattactttgtgtcactttagtttgctctcctactttttgtagcttttgttctcatctactttcatagcttttaatttccctgtcagacggttgcttggatttttctggaatttatcagtgggtcagcagttggtctacgtttatataggacagaatggctgccagataaataagcattttagtgtgtaaagtaaaaaaaaaaaaaatgctctgagtgaggtttctgggcttttacttgaaataaagtactgtgcttatttggtgtgccttatcttctgtggtcttttttttatacttcttgcttctcagttggatcagcatagttgaggttcatggattcattcaacaaacatttactgattacctactacgtgagttcatgagaataaagaaacagtatccctgtcttcagaaagctccagttttgaagagataaaaataaagccaacaaggacagttgggagttttttgatagacatctgtaaaggagagctgcacaagaggttctccctgggtctttaagaaaagccacaatataagaggtgcaattttttgggtttcttttagacagagtcttgctatgtcgccccagctggagtgcagtggcacgatctcggctcactgcaacctcccgtgttcaagcgattctcctgcctcagcctccccagtagctgggattacaggcgcccgccactacgcccagcgaattttttgtatttttagtaaagacggggtttcaccatgttggccaggccagtctcaaactcctgatcttgtgattcgcccgcctcggcctcccaaagtgctgggattacaggcgtgagccactgcgcccggccataagatatacaatttagttcagcctaaaaacaagaggaaggaggacattttggggagagttagcactactgaatcaactggattgactggagaagtttgtattattcataaagacaatttccaattacataaagaattttaagcagttcaccataaaagggttccatcaaatcagcagaagagctggtcagataccaaattatgaaaaagtacttggggattataccaatagtgaatctggaaatctatttagacttcctctccagaccaaatatgcaggatggtaatagactattctttgaggagatcagcaggaaagtgaagaaatatgataaagtctagaagcctagaagtttaaagtgctctttttttgttaaatgagtacttatgatattacataaaaaatattctgctttgaattgtctgagttaaatgaatattcccagattcagaattctctgttccacttctcccttaaaaattattcctctttaccctttcagttccaccattccaccacctcagtctccctgatgtcattaatgtccctgctattaccaagtccaatggacatgttcagatccatcaacagcatttgagagcagctttcctccaaacctctatgcatgcggcctctaggacacaaccttccctggattttcctccaactctattgtttttctttctcttttctcctgtttcccctcgacttctcatcctcacctctattaattctattaactggggaacccaaagcttgggtcttgaaccctacggcattgttattctcttttttgttgattttgtctaatcccgtggctctgtcaccatttatatgctagcgacttccaagagaatatccccagcccagttttctgagttctggattcaagtatcaaattgcttatttggcatctccagaaggttatttaacagacagataaaattcaatatgtcccaaaccgagctcatgattctccattcaagccaaacaactctaccctcctccgagtgtttcttatcaataaatactacaatcaccccaacaggtgctcttaacacaaatctgggagtcatccttgacatttccttatatactcaccctcaatatatgaggaaataatttacttcctcttgtttattcaacctgcctacatatttctggcatccatccacttctctccaattccacagccaccataagagtaggggccagcattctctctcacctgatcaaccactcttcccttgatgaacactgagtttacagagcaggcaaagttcacactccacaccagagccagcaacgttgtgcagggttggctgccttcccccctcccactccatcctctgcatctccctacacactccctaaactccagccgaattggtttcctctcagtaatataatctcagtaggcatttctgaatgaatgacggaagaaaggaaggaaggagttacagggaaggaggaaagcagagtaggaaggaggatgggaagaaggaaaaaaaggaataggcttaaggtcattaaaaagaaaatctgttcctggaatcagaaaatctgagtttgagtcctagctcattacgtagagtatcatgaacttgaaaatggacttaatgtctcccttacaggggatgcattaaaggttaagtgaggtgatgtgtatgaaagttgtctgtacactatcaaagcactgtacaaacagaatatggaagcttaagacaggtaaaatacccgaggagcctatcacagagataatgcaatttagatggtaaaaagaaatgaggcgagcggatcacgaggtcaggagtcgaagaccagtctggccaaatctctactaaaaatacaaaaaaaaaaaaattagccgggtgtggtggtgtgtgcacctgtaatcccagctacttgggacgctgaggcaggagaatcatgtgaacccgggaggtggaggttgcagtgagccaagatcatgccattgcactctagcccgggcgatagagcaagactccttaaaaatataaaaaataaataaataaaaagaaataaaagaaagttcaatggctctcaatctttttctccctctattgtccacaagtcataactgtataaattcatcatatccatgtaaaacaggttataacacacttctatctgagcctctccttatattactgcaattttcaataagtttaaaaaaagggctcagtgttgaccactccctgacccaaggattttcaaatttgtgtaattctcacaagaaaaatgtattattcccttaatgagtatgatcactttcctaaatttttgttgttgttactgttgttttgttttttgagatggtctcacttgtcacccagactggagtgcagtggcaccatcttggctcactgcaacctccgcctctgggattctgtgattctcctgcctcagcctcccgagtagctgggattacaggcacctgctaccacgcccagctaatttctgtacctaaatttgttttgaaacaaaagtattctataattttaacaaatgcagaggagcacatacaagaaacaaattcccagaagttaaggtatcaagtaatactagttttggattttgaattatttcctgattacttgggaacatcattttccatttctaaaccaacatttccttgtctcttaaaattcataagaagcaacagcaaagaagacataaaagatatatctgcttcttaagttagacagcagttaaacacataacaaattgagaataaaaaataatttatcatattcacataaaatagttttaaaggaagcacatacatgtcttggtagaaaatgtctttataattatgtatcacatgtttattacttactagattaaaacagtagtaataataatctactgctgatatagtaaaggcaattccctaggtgtttcttttggtaatagcacctagcatttatatttgttaagtgtatttttccatgagcagagttctctgaaagctctatcaatagtaataaaaatggccaactgtgattcggagcatttagtcagcactgtatccatatgtgtaaattccaagccaggcattcatttcaactcaattctgctgcttcactactgctatcttgtcgaccagaaaagtacaggactcaaattctcccaaagaactgccagactcacttagtccaagcaaaggagaaaagaagccaattatgaattttattacttccacaattctcctcaagagaaacattataagaaagaacactgaattaaaaaaaaagaaaactgcctcgtttccaagggatcttgatcaaaccaagcttactacggaagttcttctgaaattagatataataggattttcagggaggtttgatatttatcccaaggtaaaacaacttcttaccgctttacctttcctttatttagtctgactcgaatattattgtagttattggattagagattcattttaaaaagcaacttttcagacttgaaatagctttatggaagcatctcacatttcagcagctaaagacaagtgttcatggttttgccaattcaattcactagaagccatctaagtctgcatggtctctcttttttttccttcccctactgtggctttgaagtttaaaaagaacttcatatatttaggaaacagagcgattatcccaaggctctgaacttgagcttaagaaaaaaaagcgctcatctcaggagcagagatgcgtgagcatatgccaggcaggaatgcatgtcagagtcctttgatggaaattcacagtctcagagatgtacccaagcaaagcacaacaaacaatgaaagctaattgccaagagtcagggttgtcttcataatgcattgcatctgcatagcttggcgtccagtgttaattaaccacagccaggttgggattgcttcctgatttcactgcagcatgcctctgaagcaacagcaatgtccacaggttagcattatcctcccgtgccactgtccccgctggacagcacaaaacaccacaaatgaagaggcgaatgaagaactgaaatggcagttcttatgggatcaaacagaaaagcactgagttttactattttattacttcctttagcagggatcagctccaatcaattaatgatttaattacctagactaattaagataatgaacaacagcaagcctacaatcaattagctttatccaaactttctattttgagtataggaccttaaggactatactctatgtctttgttgcagcaataaaatatgtgggtatattacggaactgccagggatgtggtcactcccaaccttaagcaaacatacaaggtcacttgaataattctttggtgacagaaggttgtgaaaggatgttacctggatgggcaatggatatttctccatcagaaatgcagatcttaaattgaattatgtctctcaaaagcaagtaatggaccaaagacaggaacatgcccttttggtcagccagcttctgtgatttgagttacttcagagtaaccatgtaaaaataaaaagcccctttcaaacatccagcagaaagtagcagtgtttcttgattacattgttcttgggacaaagtgttccttaaattacttagcatgggctaagaaattcatatatttcctaagaaagaagtacagacaagaagcaggcagttagggaggtgagtagtctaagttctagtttttcctttccatctgttacatctactttgaaatttaaggcttaatgatctgattccctaattatattgggtgttcctcacagagagaaaaggtctcctactattgggtttaaccatggccactactaaagtataatctattattgtctacaataaatatttttcaataaccttttcctcaagcaagaaaccatataatgcataccacagtgttcacatctgtcatctcccaggtaccacatctctcggcttacctatactggttgtgtattgtctctctcagaataaaaatgatcatagtgcaagtttccttgtatgtgccagcagtattgcactatgcttttaggggaacttcaaacttgcccatggataaaaggcattaagattttatacctcacaggctaagctagctctgcaccatgcaagaaaactgactcactttccaaatgccttctaaggcacctctgaaataaaggggaaatctcaatccaacaaaaatggatgccgtgtataaaatttatatctgttctttgttcagccaaccagttattgagagtataccatgtctcagccaatgtgcaaatagaacatagaaaaagttatttaatatcacctcatgtctgttagagtggttgttatcaaataacaaaaggtaggtgttggtgaggatgtggagaaaagggaacccatacacgctactggtggaaatgtaaattagtacagccattatagaaaacagtatggaagttccttaaatatgaaaaatgaagctacaggccaggtgcagtggctcacatctgtaatcctagcactttgggaggccgaggtgggcggatcacctagggtcaggagttcgagaccagcctgaccaacatggtgaaaccccgtctctaccaaaaaaatacaaaaaaaattagctgggcatggtggtgggcacctgtaatcccagctactcaggagactgaggcagaagaatcacttgaacttgggagtcggaagttgcagtgagcccagatcgcaccagtgcactccagcctgggtgacaagagcgagactctgtctcaaaaaaaaaaaaaaaaaaaaaaaaacagagctaccatgtgatccagcaatcccactactaggtctatatattcaaaggaaatgaaataggtatgtcaaagagatgtgtacattcccctgtttattgcagtaatactcacattagccaagatgtggaagcaacctaagtgtccatcaatggatgagtgaataaagaaaacgtcctattatgtacacagtgaaatcctactcagcctttaaaaaaagaatgaaatgctgtcatttgcaacaatatggatgagtctggagaccattatggcaagtgaagtaagccaggcacaaaaagacaaatactccatgatctcactcatatatgggatctgaaaaactgatttcatagaagtagaaagtggaatagtggctatcagaggctgggtagggggttgggaggggttggggagatgttggtcaaaggacgcaaaattttacttaagaggaataagttcaacagatctactgtacaacatggtgactacagaaaatgtgatactgcattcttcaaaaatgctaacagaggccaggcgcagtggctcgcacctgtaatgccagcactttgggaggctgaggtgggcggatcacgaggtcaggagatcgagaccatcctggctaacacagtgaaaccctgtctctactaaaaaatacaaaaaattagctgtgcctggtggcaggcacctgtagtcccagctactcgggaggctgaggcaggagaatggcatgaacccaggaggcagagcttgcagtgagccaagatcacatcactgcactccagcctgggagacagagtgagactccatctcaaaaaaaaaaaaaaaaagaaaaagaaaaagaaaaagaaaaatgctaacagaatggatgtaaagtgttctcataacaaaaattataattacatgaggtaacacattggctacttagccaaatttagtcattctacaacatatacattaaaatatccagttatattcagtaaatacatataatgttgtctgtcaatataaaaaaattaaaataaaaaagaaatcatttagatcctaatggaagagtcagtctacataaccaaatacaggaatcaaagaggaaaaaagtgactagagttataaaatatgtttggtgtgctaagggaaaggtaaatagggcatctttaagtgcaataaagatgggcaaatgaagataatagagagtgcctcaggaattaagcatgtgatctctgaagtcagacaacctaggtatgaatcacagcttattatttattatgaacaaacagcgaacaactacggacaaattacttaacccctccaaactacaatttaccctatcttaaagtctaggctaataagggttcttaaaacacatgattgttattaaataatctgcgtgaagcaaggtgcacgcacatcctaagtgcccaataaatattagctctttgttactaatattagaagcttttttcctggcaatagtggaccatatatgctcctggtaatgagctacaaccctttgcaagaaagcaaatttctgaaagacttggctctcttaaaggtctcagggtcaagtacattcagctcatgttcattagctaataacattcaaaaggtaaatcaagaggatattaaaaaataaggccatgcagggtggcttatgcctgtaatcctagcactctgggaagccaaggcggtgggtcacttgagcccatgagtttgagaccagcctgggcaacatggcaaaaccccgtctctacaaaaaatacaaaaattagcaaggaatggtggcaggcgcctatactcctagctactcaggaggctgaggtgggaggatcacctgagcccaacaggtcgaggctgaggttagcagtgattgtgccactgcactccagtctgggtgacagagtgagaccttgtctcaaaaaataaataaataaaaataacaataataataacagtaataggatatcaaaaatgtgccctttcataattataaatgagtttttatgtcagaattaacaattaacgattttatatcagaaataataattagtataatctaaatactttagataagtcttattaaaaagactttatttctgagaactttacatatgaagggccttcaaacatttagtgttcacagaattattctcaggatctccatcaaacgaataaaactagccttaaactttaggctgaaataaaaattcaccttggtaagcactttgattatcaaaatatattgctttcaagtaacatttctactaagtttgggaaattaatttaaactccatgtgttcttatgtaattaatgctagatgtgaaagtatcttactttattttaatgtcagatatccaaaatgtccaatttatagtaacatttaatgttatttcatgccataactcaacataattaattaactggttgttaaatatcattataaaacactgtaagaatcactaccaatatatatgtaagataataatatatttcatcagcaatataaaataattgtcttggtaattaaggaagctcatttagttctagtaatagtttattcaaacatataattatactgtatagctaacaagtacgccttttaatcaaatatataattattaaaatattcttgagggatataattggcatattataaatatatttctatcatgactacttaaacctcaataaatgtacctttaaaaaggccttgatttaattagcatacagtaactctctccttgaaatgaaattaagtccttaagaaaaacaactaatatgaagcataatcttatattactcaaattactaaaccttgccaagcaaaaataataataaaaacccttcgagagctcatttaccaaaaatacaaagatcacgtctccaagcaataattctcagcctgattgcccagcaggaccatgtagggagcttttatgaaatctattagcccagaccccatctacagagattctgattaggttggttgggaggtgggcccaggtatctgttggttttgctttttagaaagtccataaaccaccacaccagagactgataaaacgtatttctcccagcccataaatgtttattgtagcttcattcataatcaccaaatatttgaaacaacccaaaggaataaataaaactgtgatacggatataatgctacgcaagcaatgatctattgatttatgcaacaacatggatgaatcttaaatgcattctgctcagtgaaagaagccagacccaaaaggctacatattgcggcagtgtgagggaaattctgaagtgaaggaactgctacatgtaattgtagtaatgaatacataactatgcatctgtcaagactcatacaacagtacaacacaaagagtggattttactctatataaatttttttaaatcgaccaagaagtaggggagggagggagatgcaatgcagagtgtgacaaatgaaataactgtcttacaaatgtatcacataactatattgaaggagacagggatggagctgtccttagtaattttggtaaacagtcttttggctggatattgtaagagtaaagacagcctgtatcaacagtattttcttgttctgaatgaaaaagaagtcattatttattacaaatatttagcttactgtttatcaattgtgtgtctttaataatgaacaacactaaacaatcttaaaatctgaaaggttttgtaaaaactttttactggtgttattttcgtcactatgtgccttttttttttttctttttggaaagaagctgggcaggatgagcatgtaaaggcttcttcaaagtgtgaaagtggacagatactgcctccaggatccagaacaacagtcatttacaaagctagagacagaatgcactgaaaatacagcaattttacaggtagttccagcaggggataatttatctaatcaaacagctgatctcctacatattctactgtattcagtcttttcatgttaataaaatttgaatatgcaaagatcgtatcaattcttttttggggggtggggggcatggactttccctccttgttgcccaggctggagtgcagtggcacgatcttggctcactgcaacctccgcctcctgggttcaagtgattctcctgtctcagcctcccgagtagctggggccacaggcacccgccaccacgcctgactaatttttgtatttttagtagagacggggtttcaccatgttggccaggctggtctcaaactcctgacctcaggtgatccccctgcctcggcctcccaaagtgctgggattataggcgtgagccaccgcacccagcctgattctttaatatgttacaaatctcaaaataaaaatctcagaaatctaggtatgtgtgtgtgctttttatttataaaacagaatctgagaggattaaaaagacttaaaaacaacaacaacgataacaaaacacaacttctcctgcataactgtcagtgccagaatttcagggtcaaacatttgatctgaaatttggtatccagttcgctcctaaactgagtctccaattgtccacttaaaatctttatccactgagcttttgcgggtggcggcgagcgcggagaggacgccatgaaggcctcgggcacactaagagagtacaaagtagtgggtcgccgcctgcccactcccaaatgccacacaccgcccctctaccgcatgcgaatctttgcacctaatcgtgtcgtcgccaagtcccgcttctggtacttcgtatctcagttaaagaaaatgaagaagtcttcaggggagactgtctactgtggtcaggtgtttgagaagtccccgctgcgggtgaagaacttcgggatctggctgcgctgtgactcccggagcggcacccacaacatgtaccgggaataccgggacctgaccaccgcgggcgctgtcacccagtgctaccgagacatgggcgcccggcaccgcgcccgggcccactccattcagatcatgatggtggaagagatcgcggccagcaagtgacgccggcaggctgtcaagcagttccacgactgcaagatcaagttcccgctgccccaccgggtcctgcgccttcagcacaagccacgattcaccaccaagaggcccaacaccttcttctaggtgcagggccctcgcccgggtgcgccccaaataaactcaggaacgccccggtggaaaaaaaaaaaaatctttatccactgacgcataacttggaggaccatggtgagaattagtgaggcctgaccttggtacacagtgactcaatttcaggctttgaatcagttagtcctatcagaatgctacaagtcagagtatcctggcaagaaatttactattggccataataatgaataacggccctaattaaagcctaaggtggatcagatgagaagcgggtcacaaacctaaagagatgatctatataatctacttgttcttggacatccatcacttcaggagaaaatttttgtgtctcagttatcagtgccatcaagagcaatgattattttccatattgtaatcagagtaatcctaacaaagcacaaatataatcatctttacctttcccctttaacagcttattgggtttttttttgttttgttttgttttgttttatatcacggcctcctttattctgccctttgcagacactagtcatattcctttgagccttggcacaagcttttttttctgcctgttggctcttaaatcccaacatcactagcaaactcctaaatactcctgttgcttccaggaagcctgacctccagatagcttggtgcgcagtagaatacctccccattataggatctctgtacaaggtttttctcctaatcctttacattttctccattcattccccttgctattcctagaacctgctagtcaaggtcctgccctagggtctttggactggctgttttcctggcctggaatactcctccccatggctaacttccctacctccttcaaatctttgcttaaatgtcactttctcactgacctgactacccaattttaaatcacatctgaacccctacccacccccatcatgcaccctcctgatttcccttactctggtctttctcccaccataatacttaggtcacctttgaacacataatatactttcctatttatcaattgtattgtttattatattgtatttattgttcaatttcataatttagagccccctagaatgcgaccttaatggtgcaagatttttttttttgtctgtcttggtcactgttgtatctcaaaagcctagaataaaaagaatatctctgaaatgaatgagttgcttaaggacctatatacaagacattcaagaagaaagagagaaagctcacacttccaagacctgaacaatatctgtgagttaaaatgtgaatgcacaaaagatctatgaaaaaaaaaaatagctgctgtaaatttaaggtagcaaattagaaggtgtcatcaactaagctcagcagaaaaagcaaatcctacagctacatcgaccaattatgagcctctaatcgctgccaggacctcaaacacattatcccagttaattctcacacaacacataacaactgcaggatgaggttctcacacccatttcacagatgagcaacctaagattagcctggaagctacaggagtgcacagaccctacctgttcccatcttgccatcataccaccagcatccagcgatatgctggcgggcagtaggtgtagaatatatagaagctgcataaaattaaaaaatatatatgctcagagaggttaacaaacttgaccaagaccacttatccagtaaatagcaaaatacaggatttgaactcagatcattttatttaaaaaccaatgctcttcccaccacaccatatttcttctaactaaagttataaaacacatacggacctacaaaaatgcaacagtcaggccaacgatctaccacagtcattcctcagggcctcttaacagagaaaaatataaattgatattcctaattagtgtcacctcaataatcaagcagcaatcatgtttcatttgatctctttaatattgagacaggcaaagtacattctagagacaattacaacaaaatagataagtttaaagtttagcaccaaatgtttagccttcagacaattcaaaagtcattttcacagaaatagtacacagacattacagtatgagtaaattcctgcttctacttagctgctcacttgggcaatgccctttggagcactggcccttgaaatgctaattcactggctgaactactgttcacctgctctttagccttaacaggtctgtggcttcacattgggtagccacagcagtccctaagagaaaaaaggagctccagcaaccaagctatttaattgcgaaaaccgcaattacctttgcaccaacctaataacctaataacttgactccagaggatggatgaaaccaggagaagagagggggagcctctctccccacccttgggctaggagacacctaaggtctgtaaacctggcattgttagaacctacaaggagaaccaaaggatttaaatgaataattcatcatcccaaattcacattcactagaagtatctatgtaattgtggttaaagtacttcaaatgtgtccttctgcttcatattttagtgtaagatactaggtaatagaatccattctctaattcactttacacaaacagaatcagcccaaatgtttgctgccaattcttacatttcctattgttaagcacagaaatagctggaaactgctggtattgagaaattttattcatttcagttctacaaatttctagaggccctacacagagattgaaagcctatagtcgcagacgagatccatcccaaagatgtacttcctttagcctcaatattattgtaaaacctaggggatggttcacatataaacctagactttaagctgcactaggaaaatcaaaggatccggagcatgcactcccaaataggaagaagagaatgggtggtggcttccctcatgagatacaacacaaactttcgaaacagttgaactggcctacctcaataatgaatgttactctcctggtcactggctgtatggaaggcccagtattggaatgtagggggttgggggtgaggcagaatctgagatgaataaataaacttgtatgagaattgaaaattttaggctgggcactctgggaggctaaggggagcaaatagcttaagcccaagagttcaagaccagcctagacaacgtggcaaaaccccttgtctacaaaataatacaaaaaattaaccaggcatggtggcatgtgcctgtaatcccagctactggggaggctgatgtccttgagcccagaaggcaggggttgcacctgtaccccatcctgggtgacagagtgtgtcactgtctcaaaaaagaattaaagaaagaaaagttagacaaatacatctaaaagtaacatatgaaaactatgatacctctaggagagacacaaaaaccgtatcaatgtgcattaggtgtgttggggggagaagcagggatggaagagaaatacacaaagtgtatcctccccaacctacgtctcatcctctctggctgtcccttctatgactcatcaagcacttataaagtcaactcatcatgacatcctgcaaattccacctcttgaataagttttgtatagggtcctttggtatcccatattcaaaaatacagttcagatcctcaagaccctcattctatttgacttcacagcagtctcctaactggtcttccaccctccaacgcatcctccacatagctgccagtgacctattgaaaattcaagtcaggccacaacacttcccagtttaaaactttcactgggttccctagtaatttgtaatactcagcctcacttgagaataaactgaggggcattttttaaattagctatgcttgatcctcaccttcacatgtttttattaaattagttggtgtggggcctacatgtctacattctattccaagtgattctgatgttttatcaagttgagaatcaccgttttaccggacaagttccaagatcattagctttgccttaatgccctccacaatttctctgtctccggcacacctatgaacattccctgtaaattccaataaggaacccgctcctggtagcatcctgtgcatatatctacctcctgccctgaattccctttattataattatctttaccactagtctgacagcagtgacttgggtctatcttccttgtaactcaaatgcctgcaacatagtgagcactaaataagagtggatgaagacagcagaaaaagatggacctggaagaggaggtgagacctgaaaggcaaagctgtgaagtaagaaagggagaaggggagaatgcttgtaaagctggaaaatcagaaagcactttttgggctagcaaaatgttggtgatcataatttgtcaaagctttcttcaggctagaaaaagcaatctagtggcctgagtaaatacaccaaagggatttaagccaattattccctgcccagtaggggtgtcagattcatttgttaaactacaagctctctagagaaactagatctcagaacgcaagtaactgttttattataattatcataatacccctcgtttccctctcactccaaatcacaacaattgaaatgaaaaagaagtatgtgttgttcagttgctaaatagtctttttataaccttttctgatgtagtttggattatttcagaaatagtagttctccacagtggtttctgctgcttacatcaaatgagtcatgctgtggggctctcactctttcccctgagagtttacaccatagttgaatagacttaactattagtcattttccttcatattaagccaagagttttgtttaatctaattagtccgccttctctatacaattctaaacaacctcagtccttacaagaatataggtatgcccttcctacatctgcagaaacgtgtgcctcctatttactgccaggacaagctgaccatagttcgttcttaaattttcccacgtgagccagggattccaattctgaaccttctcattcccacctcccacaaaagcgtttcagtttgctggcacgatggagcgtagtgttatttccgagcgtttgctgctggatcaatggtgttttctcattagttttattttgcttttgatttataagcaccaaaatggtacagagtatatctacaccagaagcatctataatgtgatcaaattcaccatgacttttgtgcttttatttgcctttatgaaaccaatctcaggcttcgagacccatgattacaaactgtttcttcacagaccccttacaactttccaagcaaatgtaatactttccagcacttttttcctcttttttaagatgttcatagctccaaatgtcaggcacaccgtgcaatgaaaactatccctcagctgataaattattcatttttcaggagtttgcaatttgaaatggcactaacagctgaatacctgaagcacccccaaaagacatgaagagcaataacatgcaaagctttttctgcatacattttaaaggttaagcgccattagacatctatgtttatcaagagatgtgctccttgaacatatttcttctaattaatctgctcccaataaacattactaacaaagcaaagtgataaaggaggctaatcaaactaatctcttccctttaactaacttcatcaggttaaacaaggtcctttgctgatattctccactttctcctgtctgatgaggagttgcaggtgagtaaggtcaaaagcaggagtgatcaaactaggactcttgaacaatctggcccactgcacgtatttttaaataaagttttattggaatactgttttacccatttattttgtattggctgtggctactttcttgttacagtggcagagttgaatagctgtgatagagacccacaaagccaacaatatttaccatatagctctttacagaaaacatttgctgacctctggtcaaaaggcatgcaaaatgtataaggcttttaaaatgttagcgccaagtagggctttagctaatgtatatcaatgtgttcatttactctaaaaaaaagaaaaagaaaaaaaaaaaaccttgcatttaaaagtgtgttatctagaataccatctgtgttacagttccagaggaaactgcaggtctaagattgttcctcaagctggtagatgcttcattttgataacagtaatcaccatgtgtttcagctatttattgctgtgttaaaaaccccttcaaaaatggcttaaggcaaagatttctttgcacatgattcttccctccaggcctcagctagaagattttaaactccacctcccatgtggtcactcatatggcttatagtcatgaagaagaggctggactctggctggaatgccaagatggcttggctcttatatctagctcctcacctgggacagctgcaacaggtgtgggctggctgagtatttctccctctctgtggggtcccttcagcagggcagttgagcatcttgctatgatgactcaatatgtcagagagtgaaagtagaagcttccaggctgctgaagggccaggcccagagctggtgtactaccacttctgcaccctcctattactgatcaaagccagtcaggggactaacccacattcaaggagtggggaaacggactgcaccttgatgagaggaactgtaaaatattttggccatgatttccaatttaccacaccatgatgatgagtaaaaagtgacaacatgatcacaatgacaaaatcttgaaagcagaccttactgctgacaatttataatcaaattgacaaataagaacaagaaagcctaataaaagaatggaaatcattttatagtgaaacactagtcacacagaaatcaaaaatttccaaattgatgtgtttttttttaattgaaattagaagccattctaaaagccactcagtgcttctcaattcttacacagtgtgtaagctgtgactgtgacataactttcctccatgactctagggcctgaagatgactatcaatgaggggcatagtaactacaatgaacctggataactctggacctgatgcccactggcatctcttgggccctctggctgctgtgcattttgagctctcttgcctgctcttttcagctgttctgcctcttctctggacagggaatcatgagtgtgtgttttaggtccttccccatcacctattcacctttttgctctaggcaggtcatctactctgacccttggatttttttttttttttttaatctgagaagtgaggaggataaaaattatgttgcctacacttagaatattcaggaacaaatgagattaagaagataaagtgtttaaactggctgggcgtagtggctcacacctgttatcccaacactttgggaagccgaggcagggggatcatctgaggtcaggagttcgagactagcctgcccaacatggcaaaaaccccatccctactaataatgcaaaaattagtcaggcatggtggcacatgcctgtaatcctagctactcgagaggctgaggcacaagaatcgcttgaacctaggagtcagaggttgcagtgagccgagatcacaccactgcactccagtctggacgactgagtgagactccatttcaaaaaaaaaaaaaaaagaaagataaagtgtttaaatcattattcaagtattcaagtgaaaggtatcacaatcactgtggtaattaattaagataaaattaattttattgataaaaataaaatattaacaaaattaatataccataaaatagtttataataatggctaatgtttatttagcatttactatgtgcaaggcatagtactaaacaccttacattgcttaacctgcttttgtctttacagcaatcctataattatcatctaatactccagacaacaaaaactgagacataaagtgataaggcaatctgcttctggttttacagatattacacagaactacgatttctctttcccaattcgcacagctgatttcaagagcttgtgaaaggtctatcatatttctaacaaaatttctcccttccaaaccccatattaattagaagggcattatctatctctcctaacctctgctccaaccttctgttccaaagctttcacaagcaacatcagtggttctcaattgggtgattttgcccccctcaggggacagttctcaatgttgagagaccactgggttgtcacaactggactgtaagctgcttcctgagtagaattccttgataagaaaaatcatctcaataggtcaaaaatgttaaatagctgatttctccatacattaagtattactctgtgtgtgtgtgtgtgtgtgtgtgtgtgtgtgtgtgtgtgtgtacagagagaaagaacagaatgaaaactgaacctcacaggacttcacattcaggatctcatttaaacttcacaggagcctgtgagagctgtgagcattgccaaagggtcagaattctcctacctattctcaattatcctcccaggagaattgagaaaattgctcctggtaggcaagggagccattatttaaggcaaatctggttactaacaccatgtactattttagagaaaacatttaagttatggtttaataatcattttatgtattaccttacattcccattggtcttaaaataaatccaaatatgttaaatcatataaacaataaagggtttttttttttcttaaatggaagaagtttaccaggaaatattttattaaaaagctttaatctatatagggacttcaacaaatcacttaggaatcctattgctgtaattttgacaaaatggaagcatatagggaaaagccctattgaagttcctttcttccctgcaattctatgttgaccatcaccctccaataacagccttactttacaaatgtaccgtccttcactatctgcagctatggatattgatgaaggaaagtgtagacttaattgcatgtttccaatgtaaaactatcatctgctttaaaagaaaaataaaactgaccagagataacgagctaaaagcagacatttgtgcttttatttaccaaagtctttggtgttgcaagtctatatcggctggtgcaaagaaaatttcagttaagctgtttagacagtgagtttataacttgatcaggaggttgtatcaaaccttcaatgcactatttgtggaaaaatatatacacattttgtcctagtagagaacagtagtacctaattcaagtttaataaatagatgtcccaataatatatgtgtttccctacatactctcctatacctagcccagcaatccgaaccctttatacgacctccagggccccatgatgtgtctcctggaccttattttgtcctttgaacacactaggctccctccttgcactaaggtctttacactcattcccccatctgcctggatgctctgaactccattttttcatagctggacccttcccattcttcggctcaagtgttgtatctcactcagtaacaccttccttgacatatgacaaaccaaaccaagacctatcctctcccttcatatcctctcttactctcatattacatcatgctgttttacgatctttgcagcatttatcactctccaaagtcacgccgttcagtgacttgttgcccatagccatgtcttgctgcactgctcctttctccacaacatcccaactagaatataaagtctgtggtaacaggaatctggatctggcttattggaggcacactgtagtcatgcgctgaatgaaaagtattattacttttaaatgaaatgttactgaaatttgttttaaaagataagtatagatattagaggagtttctatcaacctaaaatcactgtagattaaaggtttaaatgacttttagtgacaaacaatggcattttatttttctctcactcctttataagcatcttaaaaaggtttaagtatatgtttctctatatatttatctttacacacaaaaaaactaagaaaacatacttggtttagtagatttgttatactttccgtatttttagcttaaaaggaatagattgtgtgctattttttaaactgacgatttaagtacttagtgtatcttaaagccacatttaataactgtagttactgtaaataactgccacagtactatgttgatttttgaaaacctattgcaaattgtacagtgaatttaaaacttttatgagagaacaaagctaaattgtaatgtcttttgtagtaaggcactgaacttcattgttttaaactgattctggattccacatttttaacagatattaacaaaaagataagtttagataaaactatctgaacttcatgattaaaaagtgaaattacaagactgagtaaagataaatttggggggaattttttaaatgccatgttaaaaacaaaggattacttataaggtactgaatacactttaggtcccttcttaacatggttttctccttcactctaaattttaacaatctgttggtggttcagttttagaataatgcttcttcacaaaggtcaattttaaaaaatgtttaagtgtcaagcagtctagcctccttaaacctctatcaccctggtcccttgtaccacatctactccgtaacttccaactagcctcttaacagatctcaaggccactctggctggcctccctccaaagaatttttccaccatgctgcctcattgctcttttaaagttgtaaatgtcttcctatagcagcttaaaaataagtcagtgattcctgcagttcatagaataaaaaccaagattttgaacaaggtttatggagccttgtcttacccagtctccaccacttagccaggctcatttatttttatcatgtctgtaatctcagcacgtcgggaggccaaggtgggtggagagcttgagcccaggattctgagaccagcctgggcaacatgaggaaaccccatctctaaaaaaaaaaaatacaaaaattagccggacgtgacggcacgtgccagtaatcccagctactagtgatgctgaagtgggaggatcacccgagcccaggaggcagaaggtgcagtgagccgagatcgcgtcactgcactccagcctggataacagagtgagaccctgtgtccaaaataaataataataatagctaaaaataagtgcatgtaaaaactggtaaaatctaaataacacatgtagtttagttaacagtactgtgcaaatgttaacttcctggttttgataatgtactgtcattatgtaatatattaatattaggaaaactgaatgaaagctacatggaaaattcctgtatgattgttgtaatgtcttttaagtgtaaaattatttcaaaatagaaaaaataaatcactccctcaggaaagctgtggattacttttcagaacagatgagccacttggctgcttattttcttccctttaatgcttgttactgttagaaaatgtaaattttaaaaattaatgttaaatatttggctatgccactagagtttaagctttttaggggcagggatcatattgcttttaatccacattttatcctcagtagttaactcaatgcttggcacgggaaatgtgtccaataaacatttattaatgggactgtgaaagacatgaatgagccaatcagtcaatgtcccttgaaatcataaatgtatataaatatacatatttacattttaaaaagattctgctcaaattgtgaagttaatgggataatatatgccaacagagatctaaacaaagatgcttctaatttggaaatgacacaaactaatgagaaaaaaaggcataatagcaactaacaacatttagtgaatatttaatcctattattcaaaatgctttacaaacagttatttccttagtccttgtgataactgtatcaagtgtgtgctatatttatcttcattttacagatgagagacacatagagatttgtaccctgtctgtggtcagagtaattatacagcagaagcaggacttgaacacaagcactctgctccagggtccacattctttatgcattacttactgccgagagacaaagtctgagaagattgcttgagagcatcctaaacactagctatgaattctgaagatagattacaggctggtgtaggcccacactgtttaaaatttttatattcccaccacttcacacagagctttccacatagcagacagacagacagacagacacacacacacacacacacacacacacacacacacacagtttagtgaagaaataagtgaagctaaagcaaactgaagaaaaaagaatatactaaattttaggttaaagaattggttctaaaatggtatctccatccaatcacaggacctttctctttaattcttcacttcatgatagaggctggcttggagtttctgaattaacaagaaacacatctacgtaggcaggaggggatggggctcccaaccaagtcaaggttacttgaaatgggtcaggtacagctgggtgtggtggctcacgactataatcccagcactttgggaagccaaggctggcagatcacttgagctcaggagttcgagaccagcctgggcaagatggtaaaaccatctctacaaaaaaatataaaaattagccaagaaggccgggtgtggtggctaacgcctataattccagcactttgggaggctgaggcaggtggatcccctgaagtcaggagttcgagaccagcctggccaacatggagaaactcggtctctactaaaaaaaaaaaaaaaaaaaatatatatatatatatatatatatatatatatatatatatatatatatatatatatatatatgacagccaggtgtggtggtgggcacctgtaatcccagctacttgggaggctaaggcaggagaattgcttgaacccaggagatggagtttgcagtgagccaacatggtgccactgcactccagcctcggtgacagagtgagactccatctcaagaaaaaaaaaaaaaaaagattagctaagcatggtggcgcgtgcctgtagttccagctactagggaggctgaggtgagaggatgacttgagcccaggaagtggaggttgcagtgagcggagactgtgccactgcactactccagcctgggcagcagagccagaccctgtctcaaaaaagaaagggaaaagaaaaagaagtagatcaggtacatagaaacagaatgagaggaaaattaaagaagttaagaatgttaagggaataaaaccaggagatcacacaacagtagaatcaaataccaccagactattacaaataataagaattagttcacaaatactgttgataattgttccatccttagagtttagggcctattcccaaatagagataacaaacaggtcacactttggaattgtttaaaaaagcaagtcctactatactcaataaaaaatgctttgaaatgtacacgtgttgattttgtgacagagtcttaatcttactaggtagctacagctctgctgggagcaattaattcaaaaagccacagaaactccacaatgaggctaaaggatcagtaaaatagctggaatactttccttgcttcagacagctggatgctgctaatttagctactttaaagtgaggggaggaaggaagagggagtaattttgccacacctctactaatttagagaaaagagaaacaatgaaggctgataaacatggctacgtgtttatcatgtaaacatacaggttactttcagattgcatatactaaagggactctaaccaaagaactagggtaagcagaaattgctttttgttttggtttaggtgttttttgtttgtttgtttgtttgtttgtttgttttgagacagagtctctctctgtcacacggctgcagtgcagtgatgtcatcctaggtcactatggccttaaactgggctcaagcaatcctccctcttcaacctcccaagtagctaggactacagatatgtgccaccacaactggctgttttttttccttgttttaacagctttagtgagatataattcaaataccataaagttctcccatttaaagtatacaattcaatggtatttagtatattatgtttatactcagtaccaacactctaatctaacttaagaacatttttgaggccaggcgcagtggctcatgcctgtaatcccagcaatttgggaggccacggcgggcggatcacctgaggtcgggagttcgagaccagcctgaccaatatggagaaaccctgtctctactaaaaacacaaaaaaattagccaggtgtggtggcacacgcctgtaatcccagctactagagaggctgacgcaggagaatcgcttgaaccgaggaggcggaggttgcgatgagccaagatcgtgccattgcaccccagcctgggtaacaagagcaaaactccatctcgaaaaaaaagaacattttcatcatcccaagcaatttatcttttaaaggatacttaaatgatagagataacactcataatctaaaacaaaaacaaaaagacatttttattttactttctaagaatttttgtgcagatgaggtcttgctatgttgtccaggctgatcttgaactcctgtcctcaaatgatcctcctgcctcagtctcccaatgtgctggaattacaggcgtgagccaccacacatggcaaaaaccaaaatctttttaataagatatgtttctggtgtaaactgactctgcctactgaaatgtatgcattttaataatataagaaagttatcctttcctttcctaacttttttgggaagatctcgccaatttctgcaagatgcaatcatttgccctgctttcaacatcatcattttcctattcctttaaaaaaatgtttttggctggcacggcggctcacacctgtaataccagcactttaggaggctgaggcaagtggatgatttgaggttcgaagttcgagaccagcctggccaacatggtgaaaccccgtatttattaaaaacacaaaaattagccgggcatggtggcaggggcctgtaatcccagctactcgggaggctgaggcaagaggattgctggaaccccagaggtggaggttgcagtgagccaagatcacaccactgcactccagcctgggcaacagagtgagactgtctcaaaaaaactaaaaaatgtatttttttcctgcaagataattcctggtcatatcaatggccactcactctctttctcaccaagctcaccccctaccttcagctttctgaagaggcactgtattactgtgtttacctacagtaaatttctatagttccttcctgtgagctgctcaataaaatgtatgtaagaggcaaccgtacaaacagaggaaacgccttctactatccattctacccaagccaaattaattttaaatgtgtaattctaagaagcctttttttaaccactttagactaaagtagatatgcttcatatttcccctcttgatcttcaatttaatgcccggaagcaagggtttataagaactcctacatataggactttgcagagaagcaagctggagactttaacttgctacaagaaaacctggcttatccaccacccaaattttgataacctctaggtcaaattaaaaaaaaaaattagcacagtgcttcacacgtgctcaataaaactgtttgctaaatcttgttgaataatgatataataacagctaacattcacgaaacacctaccttgtgttatctgctaatctatgagttttcttttaattcagcaaatcctcgcaaaacccaggagtattatatcatgaccatcaccgtcatccacattttaaaaataggaaaactgaagcaaagagcaagattgatcaaaatgacaaagatatgggaaactgaggctaaaagcatgatttaccaaatcacagccagacttcaaaaccagactatggcttcagagctcacattcttaaccactactctatgctgcccatcaggaaatacttaagatagcaaatgattatcttacaacacagatgtcagtctatgctctaatgtcaaagaaataaagaaactccatggtctacagtgatataataccaaaggggtttgaggagggactcactgcttccataaaagacagaaatattgtgagtataggccgggcgtggtggctcacgcctgtaatcccagcactttgggaggccaagatgggtggatcacgaggtgaggagatcaagaccatcctggctaacacagtgaaaccccgtctctactaaatatacagaaaattagccgggcgaggtggcgggcacctgtagtcccagctactccggaggctgagacaggagaatggcgtgaacccaggaggcggagcttgcactgagccgagatcgcgccactgcactccagcctaggcgactgagcgagactctgtctcaaaaaaagaaaaaaaaagaaagaaatattgcgagtatatagtgactacagcaaggctctttaacaataaggaaggagaatgaagaagtattcacaatctgaagtggaaaaatgacaaaaagcaacaagtaaatggatgaactaaaccatctgaggaattaaattatgaagagtgtgtctctacaatttaaaaaaaatgttctatttctgagatcaggtaaacattcaggtttaattataatgaccacagtgtaaactcaggtctagaatgtaacagtatgctacaagtgatttcgttagagtgaaactggtctgacaaagaagatgctaacagtaggttcttggtctgcatttagtttttcttttttaaagactggtaaatagcaaacgaaatttatgtatgaaatacaactaacagaagctattatgaaaactcatccagaagaaaaacattcacctgaggattacattactataatctatatgaatctttaatctgcatgcatcttacagccgaatggttctcggagcactacctaaaccacaaaactggttggccagccctgaagaagagcttactcatgctgctcgaacagaagtcgcatatgcccttccctgagatcacagctctactgtccagacatgcattcaagaaacaacaagcaaaatcatctgggccattcaagacaccggaatgaacagaaatcagatacaaacacacgtctagctttttcaaataatagtggatatacaaggcattttaaactggcaatggcaaagactataattttctgctgagggatattatcacaattttccaacctaggtttgaaccaaggcttataagagccctcctccttaatgcaacatcacacccagtactttgctatgacattctatacagcagattataaccctgactctcaggctttttggagttaatcatttcaaaagagagtgagttggacacattaaattaacatggcaaactagagtggtttctttccattcccatccccatatggtcttctttttcaaaggaggacaaacatttgaaaaaattatttcagagttctaaaatgactctgacaagctactattaataactcttgatcctttggatcaatacgaaacacagttaggtaaaagggaaaacaaagaaggctagatgtgctaatgaaggcataagaaaacaaatcagtgacccaggcaataaaagcctgaaaaatattatctttatatatgatagtgaataaatcaaatttttctgtagtgttacttataactttatttttatttcagtgtttgaagaaaaggtaatgacagtatttgataagttataatctggatcctattttaccaattgtttttaaacatttttagtgactaaaatgatatctccgactctaccatgtgctttcacaaaccacaggtatcttctggtagattgcaaatggatgtcccttcttcttttaaaatgtaccttaaaagatatggttaaattttcctctttcgtcaataactttcagaatacacatgctattcaagagtgccaaatgaatctgtgaaaaggaaaatatactacatggaggctgattagacaaggacaaagctaatcaaaattgatttggccaagttgaagcctgcttcctctttttagctataatgggaggagtgagagggagtagattctttttcaagggacatcttaaggttgaaagctggtatcacaaaacatacagcatgataaatatcttaactaaaaattgctaacaagggcctttgtgatttcttttgtaagactacacagcataagaagtgtgatgaagaagaacgagaggaagatggaggagaaaaccagtaagatgacggttatctgcagaaaagattgttttttcaaacacaattttaaaagtcttcctttctaaactccacatctgtctgccacttttcaccagagaattaagcaaaggcatcactcctcagtagaagaacatttttagttatctggaaatataacttcatggacgtacaataattatatctagtaactttaagaaaaactctagctgtgatctgacattaaactgggctcccagggtctaaatgggcttttgccaaaaattaacaatggtgaaacaacttacttttgcactctagccaaacaaaaataataaaaccatagtctcaatttctctttaataaactaaatttagattacacctttaaaataagctttgacataaatggctttaaaataacaagaacatctaacatttgggtcttttcccagttaattatttgctggcattagactcgaaattccttggcttcaccttaagttgacactcccaagtgctaattaggaaactatatacattattaaccagagaatgttgtgcttaaaacatgcatattacatatgtatcttcttattaatgttattcctttcacttctcaaaatacctctttagaaaatagagctcctatttccatgaagcaattggtggctcgtgagggaattcctgtcaaaatgcaattaatagaaaggggccaagatgacacaggatacttgtcttggaaacatccttaacatgagtcaaatttaatctcactgaaatagtggagagaaatgttaatgactgcagatgtcacacattttactcatactaggtgattcccaaagaaaatggctaactcatgtatgaactaaaccactaccaaggaaccacacatgtcagggagtacaaggccgagacatgcctttctccaatactatctcttccaaaaagccacaggacagatgggaaaataaatgcaggtaaacaaggtagacctaatgatttcctaattaggaagatgtgatcttctcattaattgtcaagttaatggaccacaatagcagtttcataaattgagtccagtaatccaagctttggtgtctctagtccacagaattctcctcatacttccagacccttcatccagccacaaagttgtcagttctgcttgatttgtttcaatactgtactcgacgacagctgtcggaaacagtacattagaacagctgctatgacagctacaaggggcttggaagtttaattaggctcattgtgacattgtgcatttttctaaacacggaatgatccacaaaaataaagaaattttgagtgggtctgaacaatgtttacttattggcaccaccaactggttaacctcagtttgagttatatccttggtctcataatatctttgctaccaggctgataagaggtataaaaaaataaataaacaggaggagcagttagatgcacaagaaaaggggcattaaaacggagaggaaatggtgaggaagtcacgtcaataatctctttcaaaggctggctggtagccaaggaggatcccgcagtgtctcaggatttacttccaaaggaaatgtattcagaggccctgagcctggtgccaactgcaaacaaaaccactcattatggtcacagccccctagagaaggggagaatggcttactctcagcatccgtgcggaggaagaaagtgaggagcagcagcagcagcctggctacgtgcaccatcctgcagcttggcagcagcgtgcgcgagcagcttggaatcactgcctccggagccgcagcgagtctgtccgatctgaaatttcagctggaacactttcagagcctgaaagcggggaggaagagaaaagaaaaggaagaaaacacaaaagtgcttagatttcttactctttcccccctggttccatcacaatcaccatgacagacacaatccattgtaaatacacaataaattgtaactgtcatactttgtttgtattaggaaggaaataacttggtttgtaaaatgtaggagtcttagactatccgggtttgtgttacgtgggagctctcgcattcccaattttaggctctcctaaagccaaccaccttgactttcattctttgcttatgccaccttttgggcaaagacctaaaaaaggaactgtcacttcttatgaaacattacgtaaatacatcagtgcaaagaagcacaccagtgctatgagaaagatttaagagaagttcctccatgcaggataaaagtctattactgacacaataatggaagctgcttttttggcatcagttgaaatgacagggctaattcaacttctccaggtaaatagcagaggttagaattttttacactagcatatttggcttcttccctgaagacacatcaatgttcaagtctagtttggcatcaataagtcaaaacaatagttagcatgagcctctttcatttaacaggatttttatatgcctcctgggcaagggtttaatttcctcagtcttctctgtaaaatcaaaaagccacaaactatttttagagcacctactgtgtgcaaggcatcaagagtgacagcacaaggtgtctcaaggcagaaagatgagtcaggttctattatttttgtttccagattagtagggaaaataaagcaggtacaccagatgattagtacaatttaataagtgattagcgccaggaaggaaaaccagataatgctataaaagataggatcaagactgacatcatggaaatagtgtctcaaactaggccttgaagtttaaccaggattttaacaagatgacgaaaaggcattccaggaattctatgcaaaggcagggcagtgggaaaggaactttggaaaacctgagtttcctggtttggttggaatagggcctcccaaaggtcagcatgcacggggccccctggaagccttcttagaacagatgcgtgagtactaccatcagagttcgtgggtcagtaggtctgtggtggggatccaataattcaataatttggtttttttttgtttttttttttctgtttttttttttgagacagtctcactctgtcacccaggctgtagtgcagtggtacaatcacggctcactgcaaacgctgcttcccaggttcaagtggttctcctgtctcagccacccaagtagctgagattacaggtgcccaccaccatgcctgggtaatttttgtacttttagtagaggcaaggtttcaccatgttaaccaagctggtctcaaactcctggcatcaagtgatctgcctgcctcagcctcccaaagtgctaggattacagggatgagccaccactcttggcctaccaaagtgctaggattacaggactgggtcacatatttgcataaatttgcatttctacatgttcctgggtgatgctgatgctgccagtccagagaccacactttgagaaccttctggttgaagtcatgggaaaccatcttctattaggaaaaccagaagatgaagcaaaagaaaatggttcagagtcaggcgcagtggcttacgcctgtaattccaccactttcggaagccgaggcaggaggatcacttgaggccaggagttcaagaccagcctggccaacatggtgaaactccgtctctactaaaaacacaaaaaaattagccaggcgtggtggtgcatacctgtaatcccagctactcgggacgctgaggcaggagaatcacttgaacccaggagacagaggttttggtgagccaaggtcctgccactgcactccagtctgggtgacaagtgagacttcgtctcaaaaaaaaaaaaaaaaaagaagattcagactttaaaaaaaaataggtcacagagagccttggatggcgatctaagtcaaatggcctttattcagcaaactacaaaaagagccatttaatgttttagagcagaggaaccatggaaccaggctttggaaagattaactgacaactggatcagggatgatttagagaatgctattaggccacagcaagagtttcaggtgagaagtgacacaggacttaagagtaatggtggtactggtgggaattaggaagggaggcaatgactggctccaagcaatcatttgaagtataattcttcacgtgttaaataattgtacctatagaaccctcaataaatctagcacagcctcttatgcagagtacactcttaatgaaaaatttaaaaataaagagagtagatcacatcctactgcatcctctattactgcagaaaatatctgaaaatgactatcagtattcatttgcaaaatgaaactgcatacctttaatttttaaaactgaaatatttgaaacatatacaaaatttttgacaggaaatactagagatatccagcaataacctaatccactaaaataacttgtactttaaaaagaattataatgcagataccatagtatgtcatttctgaaactcagcttaagcatgagaacaaaaattgttttaaagatattaccttttttattagtattcataagcggtttgaatgcaggaaagataaaactaaaaaggagaggaatcactctaccattctattagatagtctcctttttttttttttaaacagtgggttggcatgaagaagcaagtggtacagtggaaaacttcttgaatccagaagctggccagctgttccaaatcagctattgttatcaatcgcctctgaaaatcaacttatcaagcagttcacagctatcagatgttaaaaatctcaaaagttcattggaaaagtgctaaaggaatcagctctcccctccccattcccctcctcccgctttcactgctcccatcctcatgccagcatttcaaatgacagcaaagtccaggagacatcagtcctgtcggactcaatttgtgtctgtgcaagcgtatcagagccaactgctacataatgactccgtgtgatcacagagatggagacctatgaatgctcactcagggaagaagtgatttggcttttcctcctactcagctgaagtgcataagaagaccaaattttttcaaatgaaccttcaaatgttactcctggactagcaacagtgataggatctagcactctagaaacgaatgcaggtataaacatacatatttatccttaaatgggttgtgcccaaaggaggtcagaggtgtgaagatgaaacgtattctaaatgttcattccagctaatctccattccttatcttgtttattacacagcaacattgccaaaagggaaatgctagctgcctatcagtaaggtggaatttaaatttaggtacaaaaattggaaatggattcttaagaaaataattaaaccaaaaataaacaggataaaagaatattataaggagtttccattaatctatagtaaggcttgctaagtactctgaaaaaaaaaaagagcaaggaggttcagtgatattaaaagtaccacgttttaccttacttccatcacacattatccagcatttgtccaatagcctcagcagaagccaaccctttgatttttatatgttctgctccttctttcttgagacagagtctcactctctgtcaagcaggctggagtgcagtggcacaatctcagctctctgctacctccgcctcctcagttcaagcgattctcctgcctcagcctcctgagtggctgggattacaggtgtgcgccaccacgcctggctaatttttctatttttagtagaggcagggcttcaccatattggtcaggctgatcttgaactcctgaccttgtgatccgctcgcctcggcctcccaacgtgctgggattatagatgtgagccactgcacccggctctctgtctttcatcagcagggacatgcagatagaactcaaccatgtatatgaatctaaaatacaatttcaaaaaatttataactccccggtttcttatttctcataccacaaagatcttatgaaacaataattttgctgaattccaattaactgaattgtatatcagcttctgtatatctgtacatgggtggttggagaaactaacagttcagagggcaatacgatgcatgtaatataatttgaaatggaacaacaaagagcgcacttgcctaaaagccttaacaaatcacggtttcaagcgatcacataaagtgacacctatccaactctttttcttcaacttaccattgtaacacttttctgtaataagtatattcatattcaaaccaatatgaatgttgaaggatttgtactattttttcagctttctatactgttatttgtgtctaaatactgtattaaaattttctttaaaaaaagacaaactagggcctagagtcccttagaaaatggcagattataggctttgtatgggaaatgtagaaaattagtcaacatcttgccataccagaagcaaggaagttgtcggaactactaggctatattaaaaaaaaaaaatccaagatgatgaggtgcctatcagctaaatgtagggaaatctgagtgacaaaaagaataataactgcaaagaactacaacaaatcacattataatctatgagttcataattttaaaaatttcactggttactctaggagaaagttagagaaccaaatcattactctgaaaacgggaacagaaaaggaaagaattaagcattaaaaaaacaaaaacaaaaactactgctgtcacttaaaactaggtatcattgtttatctctgaacatttttcatttttctatcataacaaacccatcctctcaagtctagacatctcagaagcaatatcataatgatatttaacctgaacatacatgcataaaagatatgcattaagttgggggatggtatgggaaggagtatgtccccaaattacttctttttatctacctcccaaaccaggcctctgtaaatcagctgaatgtggcttctaattatttaagagaaggatccatttgtacaaacgatgtgctgctaggactctccaatttgtaaaacagacaaaagcagggctgctctggctgaagcctgaaggaggggaggggcctggagcctacagcaaacctgacagaggcttcagggggcaccccaggaattccctaggccctcagtgtccagctacaacacaagtacatgaaaagagaagagaacccaaaagcaaactttcaacatttcactgacttgtggattttccaagagaagggagccatctaaatattttaacgtggtataaaacaagaatcttccagtactgacagatataactttcttcaggatagaaatgtttttttatctgcattgactaataattgaccactttaaacgtagctagtgcgactgaggaagtaaagtttttatcttattaaagttcagtttaaatttacacagccacatgtggctagtggctaccctattggacagcacagactacaactacaggtttacagcactgaacagaaagtcagtgttttttggaggtgtagactgaaacaatgaggtgagaattctgagttctcgtagtccttggcttcccaataaccagacactaaagattcactgtgttatgtgaggatacccatttaagctttggatcactcactaactgatatggtttgactgtgtccccacccaaatctcatcttgaattctcatgtgttatgggagggacccagtgggagataactgaattataggggcagggctttcctgtgctgttcccatgatagtgaataagtctcatgagatctgatgattacgtaagggggagtttccgggcacaagctcttttctcttgtctgctgccatgtgagatgtgactttcaccctccaccatgattgtgaggcgtccccagccatgtggaactgtaagtccattaaacctttttttcttcccagtgtctcaggtatgtctttatcaacagtgtgaaagcagactaatacactaacccacccatgtccctcatcctgccaaataaaagatttcattttttttaaattatttcatagaatgtaaagggaagatcagtctatgaccaaactaccctgaacacgcccaatctcatctgatcaagaatgcaaagggaagatcaataagtggttgagtatataactggaaaatatccaagtagaaatagtgttaacgaatgttcctttaatattaaaggaaaaattatgttaaagatggcgtttcatacttcattgtatttctcactacttctggcagcaaagaactgccacattctatagacataaaggacaagcatacttctaaacatcctcatgaaataatttgtatagttgtatagtttttataaaatggccacattcgattaatattagcgagggatacgggaaacacattcttaaatgtatgcagggcaccaaaagctttaatgtcaattacggaaaatattactgagaaaaggggccattgaacaaggttattgaatttaataaaactatgaaaaacaaccacaaaccaagcacctctgaataaaatagtcaaacctaaaaatataagaaattatttgtatgaaacttgtaacacctcaaaattatactccacataatcagcacatcaaatcaaaaactccaaatttttctgttttgccctaaacatgtttttatgacaatcagttaggaaaaacaacaagaggtagtttaagagctattacatataaacacaaagtgataattcaatcatctcatttttggcttaggctatgacttaatatgaagaccccaggggactataagcacacaatgattctttgaagaaatcaactgaattttaagaatacccgaagagtaaaacaattcctatcaatatagacacttaaaagatcccttatatgcctaactctaatacacagagaaaaaaaagtcaatagctattattctgagctttttctatagtttatgattcactttccaaattattattgatgcatccctgtaagatatcaagtggctttacattggaagcacatataaatattagttattttcaaggatggcaaaatgacattattaactttgattgtttctttctcctttgggaagaaaaaaatgaggtatgccgtgagaaatgaacagatagaaaggaaaaaaaaacctcatctccctttgtatctattgttcccctacaaatagaactataattctgatttgaaaagaaggatagctttagaaaaagaatctaaaatttctttcagttattactgcatgtcatagcttctatctagttttatgtgatgccagtagaaactggcaatgaaacggttaaaatacaagtctattcaacatgccgttggaactctaatatttgttcctttcatccaaaaagacactgtacaagtgagaaacagatctttctcgcaaagtgtagatagatatgcaatccagccactttccactcaaacagaacatggattctattattttaatctcaggcatttctttttttttttttttttttttttttttttttttttgagatgaagtctcattctgttgcccaagctggagtgcagtggtgtgatctcggctcactgcaacccccaacccccacttcccaggttcaagcgattctcctgcctcagcctcctgagtagctgggactacaggcacacatcaccatgccaagctaattgttgtatttttagtagagacaggatttcactatattggccaggctggtgtcaaactcctgatgtcgtgagtggcccatctcagcctcccaaagtgctgggattacaggcgtgagccaccgcgcctgaccgggcatttctttttttatgttaaataatttattaggatattctgttcaaccaatcaaaagaagtaattaatatgcccttgattaagaggtctagacaagacattttcatgctaggagtatcaccataagcctaatttatcatgaagcgattatgcacctgttccaaaatttcatattattccctatatttcacttttaataacctatatacatcaagctataagacattagttatgaccaataaactaatatgtcagtcaagctttaaaatttccttgatgacagactgcacacattacaataggatcttatcctaatagtaatgtatgatttgttgttttattttaaattgatatataaaactgtatatattatgcacaacatgatgtttgaagtatatatagtatacattgaggaatgactaaatttagctaattgacatatgcattacctcatatagttatcatttttataatgagaacattttacatgatctgtcttggcatttttcaagaatacatggatatgaaactatcatttctacatcaatataactgattttgtcatctttaaaaatcaaaacaggttttcttaatgaatgcaaaatatctgtaaaatacatttacttttcaaatgttatgggtaataggttttatttattattgtatctattttatttgttttagccctatcaatacatagtacggaaaagtctggcaatacatattttacttctttactatgaaaagcaattttaaaaattcactttgaggagaatttaccactctctaaagggaataatctacattgatctcttttccttaggattattttaagaataaagtgaaggaccttttaattgttttttaaatagttcattatgatagctcaaagaaaactaatttagcgcctcgcaggtgtaatatttattggtagctccatcctcagggtgatcaaatctctgggccagctgtaaaagtgactttgccctctccctcagggaatgcctagagacaatttttgttgtcacagcgcaagaagggtgacccatggcacctaagggtagaggccacagatactgccaaataccctataacacacagaacaactacctgccccccaacaagaaattatcccattcagaatgtcagcaatgccaaaggtgggaaaccctgtcctagaacagctcattggcacagaggaaaaattccaaattaaaaaaaaaaggggggggggacttttaagacataatctaatacattgctttctaaacccaccaattttaggtgttttcatacataaactcaaaacagatttgaatttctgggcatgggaatatggatgacacccaaatttccctttttgtcctaagttagaaccaaagttggcttgccttaaaagtttagttcacaggcttaggcagcataaatattgtcaccaattaaaagaatgaagctgttaaatggaacagacattgcactgatgtcagtcagtgaatagatatggttcccatgtctcatgatgggagcttagctcttctctaagggaacagtctcaggaaagaaatactcagtttcaaggactgttttctcatatcactgctagcaatagagatcaatagtggaacggtgaaaggctgtcataaatggctaaggaaagtggaattaaagaatattctcttcatacctctctcaccttatacacaaatcgactgaagatgaatcaaagagttatatctatgacccaaaaccgtaacaattctagaagataacatcagaaaaacccttctagacatcggcttaggcaaagacttcatgaccaagaacccaatagcaaatgcaacaaaaacaaacattaaatagataggacttaattcaactaaaaaagcttctgcacagcaaaaaataacaataataataataataataataataataataatatcaacagagttaacagacaacctacagagtgggagaaaatcttcaaaatccatacatcgacataggactaatatccagaatctacaaagaactcaaactcaaatcagcaagaaaaaaaaaatcacatccaaaagtgggctaaggatatgaacagacaattctcaaaaaagatatacaaatggccaacaagcatatggaaaaacgctcacaaaatgctccctgatcactaatgatcagagaaatgcaaatcaaaaccacaatgcaataccacctcggtcctgcaacaatggtcataatcgaaaaaatattttaaaaaatagatgttggtgtagatgtggtgaaaagggaacacttctacactgttgacaagaatgtaaactagtaaaaccgctatggaaaacggtgtgaagattccttaaagaactgaaagtagatctatcatttgatccagcaatcccactactaagtatctacctagaagaaaagaagtcattatccgaaaagatacttgcacacgcatgtatacagcagcacaatttgcaactgcaaaaatatggaaccagcccaaatgcccatcaatcaacgagtggataaagaaaatgcagtatacttataccacggaatatgactaagccataaaaaggaatgaaataatggcatttgcagcaacacagatggaattggagactattattctaagtgaagtagctcaggaatggaaaaccaaacattgcatgttctccctcataaggaggagctaagctatgaggatgcaaaggcataaaaatgatataatggactttggggactcaagggaaaggctggcagcagggtgagggataaaagattacacattgggtgcagtgtacactgcttgggcgatgggtgcaccaaaatctcagaaatcaccgctagagaacttatgcacataaccaaacaccatctgttcctcaaaaacctattgaaataaaaaataaattttaaaggcagaacattataatcccaacgttgtcctcatgactattcccacatctctctaagatactattaacaatttacatagtagagaaaataggttgtgtggggaaactaaataaatgactatcaaaccaaacagaaacataaaatctaaagaaaggtaaagaggacaaatattaaccatatatatatccaaaatacactcttcacttctctcactctgtacatatatttcattcagttatattgcactcatctttactgttagtgccctcttcacatctactccctccttcaatgaaaccacagactgataaaaatcagaagaaaaaaataacatcattttgggcaaccctctcatttaacagacaatgcatgaagtacaaggacataatggaattaataacctcaaaatgcacaagtgagtagtctcagaggagggcttagaaccaattttctttcttctatagcatggtgtatctacttttactatctctgacttactgcaacagaaatagatagctgaggcgatgtcatgattaattccaaagtgatcaacataaagaaaaagtccctcctttaattagcaaagagacaatattacaatgggcataaacgaaaggggaaggcaaccttaaaggcggggtataggaaggcaggatgaaagaatctcactgaatgaaggtatttggcagtcactgtcctagaccaataaataattcacaaatgaaagtttatcctatgagtcaaaaattttctaaagggtcaatctttaacttggtacctgttattatgtacctgtgtatcttagagtaaaagtttatagacgtgcttggaaggaaaaatgattaaccagtaatagattttctaaattctcacgtttgtaattgaacgaataacatgcagacacatgtttataccaccttaaggtatacctattttgcatattaccatcaagttctattttatggagtttctctctctctctctctctctctctctcttttagatagggtcttgttctgtcgcccaggctggagtgcagtggcacaatcacaggtcactgcagcctggaaatcctgggctcaagctatcctcccgcctctacccccagagtatccgggaatactggcaagtgccaccacatttggtttttcaatttttattgggaaggggtcttgctatgttgcccagactggtcttgaactcctggactcaaaacaatcctcccaaactggcctcccaaggtggtggaattacaggcatgagccaccatgcccaatcgattttttttttttctctgtaaaatttaaatgtcagcaaggacatatgttgagtaattgtgacaaggtgggaacgggttagattctgaattcacagagttatacagtctggttatctcagtggagagacaacagcctgagtgcactttattacgaagttgctgagggcaacatggccatattgaaagaagaaatgaagatacacaatggttatttttcaaaagaagttggcgttacaaagtgatttgataataaagtacgaaaatttcctgcagcaataaaagcactatgcatttcccataccaagatgtatcagagtggcagcgaaaaaaatattattccaatactcactcctttagaaaatatatttgagacctctggaaagactttttaaagtactgtcatttttattgtacttctataaaatactgaaacaaaatacacaatatggatatcaaaaagggagtttaaagtcattaaaagcctgctagcaaactagctgtagtaactttctcaacaccaaactttctagaaaccaattgttatcttaaatgaacagcccattaaactaaaagaaaagaaaatgttgaataaaaacatcgatcaaacttctctgctgggtcaggcacgatgcctcatgcctgtaatcccagtgctttcagaggctgaggcaggaggatcacttgaggtcaagagttcaagaccagcctgggcaacataacaagaccccatctctaaaaacaaacaaacaaaatttatctgttggatatgggtctcacataggccttttgaaacccagatatttatatttcaaagtagaggagtagtcattctaaaatgagtaggaataggttcaggaagcaagccaggagtgtggctggcaaagatgtgcaaggatgggtggaagagaagtgcagggaatgcctaattgttatctggtgcaggatcaagccccaaattaaaatgccatctttttaagaatttctctatcttttgtggtgtacctaacaatgtttccatcacaaactgaatatagactgaccctttcctttattatgtttcctttaatatttttaaatcataggtttaatcatgaatatttatattgccttgtttaaaaaaattgaacagccacactttagaaaatgtgcttacttcactaatagccctcactcaggcactagaattaggaaaaggaaaaaggataaatatatatacaggctctaagtatgcttacctagtcctccattcccatacaacaatatggaaagaaagggaattcctaacttccgaggaaacacctatcaaacatcaggaagccattaggatattactattggctgtacagaaacctaaagaggtggcagtcttacactgcaggggtcaccagaaaaagaaggaaagggaaataaaaaggaaccgccaagcagatattaaagccaaaagagccacaaggcaggaccctcccttagaaatgcttacagaaggacacttagtatggggtaatcccttccaggaaaccaagccccagtactcagaagaagaaatagaatgaaggacctcacgaggacgtagtttcctcccctcaggatggctagccaccgaagaaggaaaaatacttttgcctgcagctaaccaatggaaattacttaaaacccttcaccaaacctttcacttaggcattgatagcacccatcagatggccaaattattatttactagaccaggccttttcaaaactatcaagcagatagtcagggcctgtaaagtgtgccaaagaagtaatcccctgcactgcaggccatacatttcaatccctgtatctttaacctccttgttaagtgtgtctcttccagaatcgaagctgtaatatatatggttcttcaaatggagccacagatgcagtccatgactaagatctaccgcggacccctggaccggcctgctagcccatgctccgatgttaacgacattgaaggcacccctcctgaggaaatctcaactgcacaacaactactatgccccaattcagcaggaagcagttagagcggttgtcagccaacctccccaacagcacttgggttttcctgttgagagcggggactgagagacaggactagctggatttcctaggcggaataagaatccctaagcctagctgggaaggtgactgcatccacctttaaacacggggcttgcaacttagctcacacccaaccaatcagagagctcactaaaatgctaattaggcaaaaacaggaggtaaagaaatagccaatcatctattgcctgagagcacagcaggagggacaaggatcaggatataaacccaggcattcgagccggcaacagcaaccccctttgggtcccctccctttgtatgggagctctgttttcattctatttcactctattaaatcctgcaactgcaaaaaaaaaaaaaaaaaagaaaaagaaaaagaaaaagaaaatgcgcttacttcttcccgtaattgtcactagggtcaaaactattcattgcataaatcttcatcactggccaggcgtggtggcttatgcatgtaatcccaacattttgaacagccaaggcagacggatcacctgacgtcaggagttcaagaccagcctgaccaacatggagaaatcccatctctactaaaaatacaagattagccaggcatggtggcgcatgcctgtaatcccagctactcgggaggctgaggtgtgagaatcgcttgaacccaggagcgggggttgtggtaagccaagattgcgccagtgcactccagcctgggtaataagagcaaaactccatcataaaaaaagaaaattcatcattttctaacttgcactttagattggtccatacactccatcacacaaatttagtgcttatttcaacacacatgtgaaaatatgtatttatatattatatacatttactatgctactaatgaactaaatacattttcaaacacagaattagaaattttaaaaataagaaaaaaaaagtagaagttctataattcttttcctaggccatataaataattaggggcccattgccctagatatagttgggattttttgtttttgttctttgtgttgagacagagtctcgctctgtcgcccaggctggagtgcagtggcaccatctcagctcccagcaatttccgcctccgggttcaagcaattctacattctcgtgtctcatctccctgagcagctgggattacaggcaggtaccaccatgcccagctaatttttgtgtttttagtagagacggggtttcaccacattggccaggctggtctcaaactcctggcctcaaacgatccacccaccttggcctcccaaagtgctgggattacaggcgtgagccaccatgaccaggtgaagtttggatttttttaaacctatattttaagtgaccatagacaaaaatgacatattttactagtctgtccaccaatctctatgtgacagctgatgtcaacaagacatattataacacatagagaagacactgttgtttgggattttcagacaatgtcctcatgttatcattgtaaaccatctacattaaagtagaataactttacacacaaacagtgtttgtgctttaaaaatgaattccttcattcttttattccatgaatatttctgaataccaggcaaggtgatagggacaagagacttataataaacgtacaagacagcaaggtccggctgggtgcggtggcttacgcctgtaatcacaacactttgggaggccaaggagggtggatgatctgaagtcaggagttcaagaccagcctggccaacatggtgaaaccccatctctcctaaaaatacaaaaaatgagccagctgtggtggcggtcgcctgtagtcccagctcctcgggaagctgaggcaggagaatcgcttgaacccagaggcggaggttgcagtgagccaagctcgcgccactgcactccagcctgggcaacagcatgagactctgtctcaaaaaaaaaaaagcaagttccctgatactgatacattctggtgctaggagatagaaaaatacaagtaattttttgagacagagtctcattctatctccgaggctggagtgccttggcaggatctcagctcactgcaacctctgtctcccaggttcaagcgattcttctgcctcagcctcccaagtagctgggactacaggcgcgggccaccacgcccggctaatttttgtatttttagtagcgacagggttttaccaagttggccaggctggtctcaaactcctgacctcaagtaatccacccaccttggccaccgaaagtgctgggattacaggcatgagccaccatgcccggccaagtaagttttttttaaggtacctggtaagtgctcgaaagaaaattcagcaagttaacaggggtagaaaaataactggtatgtgggaaaagaaaggggagactttagaatagggtgacaggaaaggaccctagagaagggtggggcatgtaagcctgaacctgaatgacaagaagaaatgcagaaaagcttcccatgtgaaggcacagactgcccagggcagaggctgggatgcaggaatgagcttggttgtggctggagcccagagattcccagcagagaatgataccaggcagactgggaaaataaagtgggcccaggttgcacagggcctgtaagcaacagtggagagactggattgcatctgaaatgcagtggaagacactggagggctttatgctatggagtgacacggtctgatttatatttagatgacttctccagtggctgtgtgccaatggtctaaaaaaatgcaacctcccccgactgccctccctgttcccaagtctctgtagagacttccaatccatttacttggacatagccattaagctctattgtgaagtcttttgaccctttataaaaggctcaccagtttcacttttcagtgatcctatggcagtctcctcttcccaattcagaaaacaatcagaaataatgtgtcgctttttaatgttttcagctgcccttctctgttcctacacagcaacctgccctacaaaatcaaatgactttttttctcccatttctcttccatagagcagtttaacacactttagaatttttacttaaaaagtaaagtacctgacattagttctcatttgcgttcctgaaaaacgcaaatggaaaaaatctgctttcatgtacaaagaaacggtcagcattacggatctctatggccacacttttcaatctgtgattccggaaaggctttctacactcacttaaaaaaaaaaaagaaaagaaaaaaaaatatttttaggtttctgaagttttgtagatcaaagccttttttgtttgaacattttaaactctgtaatgttagcagtgatactaatacccaatagtacactggaattcaggctattagaaaacagggcccttccaataattcaaacattctttctttcaggatttagaagccaaggcctgctgtgagtcaattgctggctatctttccaaattagcttttcagtcttagttatcttttacatttcatcccttagtcttcactccaggatttcctccattattgaagcaaggcttttaacaccccaacatgaagtcatttaactcctcagtgtttcttattagttacctaaatagatttgagactaccagtatttaaccctctgtcttaaaaatgcattataaaacgagacagtttgttatatggagggtgtagaacctgacacacacaataatgccaccttattctgcttctcaagtagaaaagtctattcccttcctggattgacctttctacatgccttggccaaaagaatgggacaaaagcaacgttgtgtgcgtctgaccctgagcctcaagaaacccaagaaacatcaggaagaagctctgcatggtcccttccacttgctgacctggggtcccctgccaccgctgtcagagatgtgtgaaccagagcaactttatcttgaaaaggggctgggtaaaatgaggctgagacctactgggctgcattctcagacggttagggcattctaagtcacaggatgagataggaggtccgcacaagatacaggtcataaagatcttgctgataaggcagcttgcagtaaagaagcctgctaaaacccaccaaaaccaagatggccatgagagtgacctctggtcgtcctcactgctacactttcaacagtgccatggcagtttacagatgccatggcaacatcaggaagttaccctacatggtctaaaaaggggaggcatgaataacccactccttgtttagcatatcatcaagaaataaccataaaaatgggcaaccagcagccctcagggctgctctgtctatggagttagccattctttcattcctttacttttcttaataaacttgctttcactttactctatggactcgccctcaattctttcttgtgcgagactcaagaaccctctcttggggtctggatcgggacccctttcctgtaacaccaccaccacacaaacgagcccagactagcctggtggaggatgaaagaccatggggagcagagatgaactagctaactgacccactgtagaccaatcattccccagaagacctgacagctggttgcagactcaagagtaagtccaatcatgatcatctaagctgggccaccaacagcagaaccaccaagttgagcccagctcaaactgctgatccagagaattgagataattaagtgggtactgggttaagctactaagtttagggatggtttggtatacatcaaaagctgacaatacaaaagtgtttaatattttcctcatgcactataaaacaaagataaataagtgtatgttttcttcagtacatttaccctactttaaatactcaggtaggtaacttggcttcttacggttacatctaaattaatttggtcttctggcagcaaccaactaataaaatcactagctttcagatctttaaagtaaggtacgttattctgtgatttagaatatcagaacttatttgtgcctcttggcccctttttccgattataaatattttctgccacatagctcagggacagcaaaattgtcctaaaatgtccttaaccactggctaaaaccatgaagcatgatgttcctttctggtgatataatggaagtgacgtatgtatctgagatgtcaactgatttcaccaagtacactgacaggtagtagttagcataattttagatgctattttccttaagcaggttctgccgggggataaatcccacaattcaagtagggttgatactttaaaagcagaaaagttttcactcaagcttcttaaaggaatgatattttgaacaatctgtctgtgctcctctggccggtttctaacagcatgttgtatgtgcctctccttaaacaggagctagtcaacttgactagttactagaatgtgtgaaaaagtgaggagacatgataactattgaaataaataaatgaattttgcaaggctgctaaatacaagatcaatataagaaaccaactgtattcagaataattaggtatttcttaaatgtgctatttatagcagcatcaaaaatataaaacactaaaaatgtaacaaaagttcacaagatttctatgcagaaaattagatagcatgatcaataaattaaagaagacttaaataaatggatgattatagtatgttcacagcttaaaagactcattattgtaggccaggcatggtggctcacgcctgtaatcccagcactttaggaggctgaggaggttggatcacctgaggtcaggagttcaagaccagccaagccaacgtggagaaacccggtctctactaaaaatacaaaaattagcctggcatggtggcacatgcctgtaatcccagctagtcaggaggctgaagcaggagaatcacttgaaatcgggaggcagagggtgcagtgagctgagatcgcaccactgcactccagcctgggtgacagagcgagactccatctcaaaaaaaagactcattcttataacgatgtcaatctttcccaagtttatctatgaattcactgtaatcccaatataaacttcagcatactattcttgtgaaatagaaaaactaattttataatttataagaaaatgcaaaaacacaagaatagccaagacaatcttatagaaaaacaaatggtaaagaatttatactaccagttaccaagacttattataaagccacagaaattaagatggtgaagtgttagctcaaggacaagcaaaatagtggaacagaaaaagaagtctagaaacagacccacccatatgtactctcagatgatttatacacagctatgtccctgtattgcaatggaaaaagaatcttttcaatcagtggtgatgggttaaatgggtatctgcatgaagaaaaacatacactgaccctctacctcacaccatatacaaaataacatattagagacctagatgtgaaagataaataatacatcttatagacaatggcacaaaagaatatctttgtagcctttctcaaagcatgttttgaaaataaggtaatgacaataaagattgataaatttcaattaattaaaatttaaaatgtctgttcatccaaagatattatcaagaaagggcaatctacagagtggaaaaagatatttgcaagaaatatgtccacaacagccctgaagctatccatttctattgtattctctatccttttggggaaatggggtggagataaaagccttaaacaggcaattcacaaaagagataacccagatggtcactgaacatatgaaaaaggactgaacaatgttagccattaaagaaatgcaaattactatcaaaatgagaaaccactccacactcaccagaataattaaaatcagaaactcgacaccagtacatgttgggaaggttgcagtgcaaattaaaactcatatactgctggttagagtgccaactggtaaaaactcctttgaaaaactgttttgctaaacatatacctaccacatcaaccagcagtttcattaggttatactcaacaataacttagatgttattattaaaaaaaaaaaaaacaaaaaaaacaaacaggccaggtgcggtggctcacgcctgtaatcccagcactttgggaggccgaggtggacggatcacatgaggtcaggagttcgaggccagcctggccaacatggtgaaaccctgtctctactaaaaatacaaaattagccgagcatggcggtgcatgcctgtaatcccagctactcaggaggctgaggcaggagaatcacttgaacctggcaggcagaggttgcagtgagcccaagacacaccactgcactccagcctgggcaacaagagtgaaactctgtctcaaaaaaaaaaaaaaaacagcagcacaaattagaaataacttacatattcatccaaactagagtgaataaataaattgtggcatattcataaaatcaaatacttgtttacagcaatcaaaatttaaaatttctgctgagaaaatatagcttttctagaaacagcttattaatgcatagtttgtcttagttaccttctaatcattttgaagaaactaaattgatcactaagaataataaaagtcaaagttacacacaaagtagaattgaactcaaattgtcttggaaacatatacagaagggagaacagtaaatgaccagcccaaagcactgagactctaaagactgatttcagtaactagcctctaataaatttgcttatctgaaaatacagcaatatgtaatattagtaaagcatgataatatgtgttaagacccaaataaatggtctgaatgataaacattagtatgtgtgtagaagaggaaaatatgatctcagacttttagttcatactggtagaggaaaagataatgaaacttgaagaaagaatccaaatgggtagagggaaggcccctggggccaagagaatcagtgtagtgcaaacaaaggaaccgagacagtcaaagaaccagattctagaccaacttcagcactgactttcttatatgccttggccaaatcactccccttctctgcctctagtttccctggttgctctgttttatagcatttgttaccctcaacatgttaatattatataatagatttgctaggttttgttgtcattgtccccacccccgggagactgaagttccacaaagacaaagattttttttaaatattgttaaacatgcaagatttgtgtgaaagtacatatatgtaacatgcatggaataatcttattttgcaagatgcataaaaaacaatacagcaaatccatctgcaatttcttctaactcacagatcaaaggagactgtggtatccatgttaaagctgtatcagttggctacagtgtttactttttgtaggaaacaatactgggctatttgagagtgggttttataaagctccggagttctaacgttgttagggaattaaggtccaatcaccaagcctagtccatgcttaggaatttccaaggtacttatacaggcaagtgaaaggaggtaaaaatccccaaaataataacctattttcagaagcatgtattttctttctttaaatattaatagggaaaaaataattaaaaaaaaatttaagtagttagaaagaaattgtttagtgataaagccaaagagttgaaatatggctccaaagaatctataaaccaggccaggcgctgtggctcaagcatgtaatcccagcaccttgggaggccgaggtgggcagatcacttgaggttaggagttcaagaccaccttggccaacgtggtgaaaccctgtctctactaaaaatacaaaaaattagcggggtatggtgatggacacctgtaatcccagctactcgggaggctgaggcaggagactcacttgaacctgggaggcagaggttgcaacaagccaagatcgtgccagtgcactccagcgtgggcaacagagtgagactccatctcaaaataataataatctatgaataaatatttattgtcaactctctgtttctcagatcatgctaatacatgttagacaaacaaaaaaaggtcaaacaaggacaatgcctctaataaatttgcttatctgaaaatatagggaatgtgaacaattagaaaagcacgataatatgtgttaagacccaaatacatggtttgaatgagaatatgtagaattttgagtaaaaagcgtatcaataatcagcataagatttagatgttgatatgttcaaaacattatcagaaactaataaatcggctattttacaaataccatataccatacagtttgggtgtaagaaggaattaagatgtgagtaaagccaatttgtgggagaccttcaacaccggctgagtatcccagggaacaataaatctcaaactatcaacaggaaaagtagtgatagagttggagttagaattctgcatatatataaattctgcatatatatatatatatatatacatacatatatacatatatatatacatacatatatatatatacataaaaacattgaatgtcttaaaggaaaaagattagaactatactgatagcaatgagctgtcatgtggatattggtgaactagataataacaactcatgatactgcattccaaaaaacttattcaaattaaacctttgccatcaaaatataatcccaattttgacctgtatggcatgagacatttctgatttccttgggatctctatctatataaaacacatgacattcattttataatttgaaatctggatctcacagaagcagactggtggttgggctgaatgggtgttacattctccactttctcattatcttatttcaagaaggctctggagacaattcctgacatctccgtgcttcaacttccatctgtgtgaaatgaaataatggctgcctccagcctacctcatcaaaatcagtgagccacaaaagcacattaaaatcagagatgcaggaaggattttgaggaaacaagcttctgtccattatcattaaaaacaaaacaaaatgtagtcagcctttctcaactgcggttccacaagataatcatgccctacagaatataatttgagtgactcctcaattctcctgagatggtacaaatgtagtaccactctagatgcataggaaagaagttaactcattacatacaatagatcccttaaggcatcagggctgaactctgtgagttcaggatgggaaaagctgataccttatgttatatacaaattagggtatgatatttgatatcattttgttttaaaaaataaaaagctatgagtttacagacctatagatccaaagcctcaccacattccagaataaaaataaaacagcctagagaaatgctagaatgaaaggctcataaattttgggctgtcacacagaagtaacaaagaagcaagaaaagactaagaactcatactttacagtttacaaaatgtttttttaaaaagaatttctgacttaattgtcaatatttatggagctcatttaaaattctacgcaatatgctacaacaagacaaacatttcttgtttgagaggaggaaagaacgagatattagaaaataaccttttttttttttttgagatggagtctcgctctgtcacccaggctagagtgcaatggcgcgatgacaggcgtgtgccaccacgcttggctaattttttgtatttttaatagagacggggtttcaccctgttagccaggatggtctcgatctcctgacctcgtgatccacctgcctcagcctcccaaagtgctgggattgcaggcgtgagccaccgcacctggcctaacagggtcatttttttaagctcacaaaggtgttctttggttttgggtttttttttttttagaaagagagcatctcactctgtcacccaggctggagtacagtgacacgatcaaggctcactgcagcctcaatctcctgaggtcaagcgatcctcctgcctctgcctcccaagtagctaggatgacagacacgtaccaccttacttttttattttttgtagagataaggtttaacttttttattttcatagagatagggttctactatgttgatcaggctgatgttgaactcctggcctcaagtgatcttcctgccttggcttcccaaagtgctcagattacaggtgtgagccaccatgcccggcctaatgttatttaattgtaattttgatctctattgtgtcttggaggaggcaactaatattttaaagcttctgttctctgctctctcttgttttcatctctctcatctttatcaaggtattgtctggtcttctgaatcctgtgagacctgacaatacactgactttacataataatttttcaaattttttacactgtcaatcttactctgttctagctcccagtattttaatctgctgttggcatcttttgttcctgttacatttcttttttttttttttttgtcctcatcaatcttcttttcctactcatttcactatgttttcttttcactccatcctgctgctcatgactttctgctctttcatcaagactatatcttcttcctttctgctgaggaagtaaaacattcacttgaaattctctcctggtcctataataaatcctattgagaaaagtggttcttctcttcttccgaggtctccagacaagcattctttcccttgtgctgaaacattatttcctggactcgtgtttgtttgtatgcttcgatttactatcctctaactgacaggacctatccagacactgtttgttgaaagattccatgacaaagtttgtctgtgtcccttctccctactaatcaggagaagattattgtaatctcctcagatgtgggactcagtggtgcttgtagctggaatctaaggtagctgggattacaggcgtgcgccacaacgcccagctaattcttgtgtttttggtagagaccgggttttaccacattggccaggctgttctcaaactcctgacctcaggtgatccacccacttcggcctccaccgcgcctggccagcctaacacctttttaaaggaagaagcttagtcagaattttaaatacacacagatacacacacacacaaataattttatttcaatcatcagcttttttccttattatagtatctaaacagataaaaataagtgagatcaatattcatgtttggagttttgtttggtttcttatttcacttacttttgctgctaatctctattttaaacaattctttgttatgaattcactattctagttaaaaataacaggtatgttatttcattgctgagctattaatatccccacctactcattttctatttcctcaaaatttttttgaatgtcagcattacaaaatgtggaaatggagaactcagtgtgcattttctctctcccttgctccctctctctgtctgtgtgtgtgtgtgtgtgtgtgtgtgtgtggcggtggggggatgtatgcatgttttatggaggtgcctagtctggctagcagagctatcactttgattcttaatgggaatgtatatctccctttgatgtttctgtgggtctgaagaatgcaatggcctttctagtgattattctaggagatctggcttcccacaagaaaaaaacaaaaggttttatctcgtacaagtaaagtagaaagtaaattgaggtaggaaattgtactatggttccttgctgaaataattttgggattagtgaagatgtgagtagttccacttctatttctagtgcctactgcataataggaataacatttttaaaatatatgatttcatgaatgaatcatttaatctttagtcccttttttcactaaaaggtttataatttggggcaagaaggacaccaagctttttacatctcatgtgtcagcagatgactgtgggatgaagctacaggtagaaaaatttaaaaagacagaagctgatttcatttatttgcctaaatataaatgatctaaaagataagccaaaaacattttacaaatagaggcaaatgtggttgtccttgcatcctaataaggcaaaaaggcaattatcaagtaaggtggggacagaaaatagaagttttaacatggtagctataaaaagagactaggacactctagcagaagaaaaaaggtggttaaataaagaataatttgataaagtgataacatatattataactaacaaaactgaaagacttctgtctttttcacaattataacatttctttgtgtgctttttttcctaaagtgacataccacacaatatggttactgtttataatgaccatggatggagagagcaagcaagctaaattagaattggaggatagatgctttttcatgagattttaaaacccagggttgcagcacagaaagcggagctgcaaaggttagtagaaagaactaaaatacatcaaatgtgtctcctaaggagttacaatcctaagaacgtataactaatcgctaactgtaaagctcatctacatggataattttatagacatctaataatactgttaataataaccatggtcaaggacgagaaatgaaaagatgtagggtctattaaagaaaatgggaaagagatgaatcctcagaagaaaatcattttaaaggtcactaaattctgccacagtagtggaagaaggaagatgagattacagttttagttttaaatatatttgcaaagtggcctacatgtggatacagtctcttatccctagcttctctggtgagctataaaccaaggtccctaaggcaccattattaacacatgaatcacagagggtcaaataaactcagatgcccaatttaggtacattaaaatatacctactggtgggaaaagtgagtagggagattgagactgaagactaagtctaacctttttaatgtccatactatagcagtttaggggatgtgtgtgtgtatatatatacaaaggttctgtctttctaggaaaacattccccactaaattaaatatattagtataattctcaataatttttcctctgcattcaatagaactgtatcataactaatttcatggaggcaagagagatcaagtttgaacatcaaaacgagattgacttttgggaatttgtttggttttgtttcctactgacagtataaaagaagcacccttattgttaggactatatcaataaaactgcatatatcaccttcatggaaatatttaaagcatgcagaagtcagctatgttgatagaatacagatttacaaatcaaataataataaataatgagaataaatcttttattattttcttaatttaattcaatttcaagcattttcatataataaaataaataatttgtttttctaacacttctctctggcacggaggagagaaagcaatacaaactaacctatcatgtcaccagatgaacgggctccttcaatagaaaacctcttttaaaattaatggcctgctgcagcatgatgagtgctcaggaaaagaaatatttatgggttttctcctaacttctgacccttgaaactaaaagcactttctccacctcctctgttccagttaacccataggaaaaacgtctctctttatggcagggagaaatttttatgatactcagagatatagctatatagataagtgagccagtacacagcttcccccaaaagcttgcctcccagcggtgagaaaaagcacagaatgccttgggaaagagggtaactggaacatgcatcgcctactcatctcccagcatgggatggagcctccttccagcgtgacactgaaatgcccaggccattcttcaggctatccaatgagtctctgtagttaataaccaacctgagcattcaggtaggctcaggatcctggctcagatataaacccagattccagcaggagtagccactgaaaaatcaagctttttggatgctctgccaaagatggtttcaagctactgaagatctcaaaaagaaaacactctttctctctgttctcatttgttagcttgagacagtagagcagactataagactccagtcataaataatggtaggccagggatagtggctcatgcctgtaatcccagcactttgggaggccgagttggatggatcgcctgaaaccaggagttcgagaccagcctagccaatataacgaaaccccatctctaataaaaatatacaaaaattagctgggtatggtggctcatgcctgtaatcctagctacttgggaggctgaggcatgagaaccacttatatccaggaggaggaggttgcagtagccaagatcacgccactgcactccagcctgggtgacagagtgagacttggtctcaaaaaaataaaggcaataattatgtattaatataacatatatacattatatataacatatatagtataacataacactataatgcattgctacaaatgtcatttttgttttgaaaaacaggaaagaaatagcacacctaagagaaagtgatgttccctaaaacaaaaaaaaaaaaggtcacaatcttcttttggaattttgctatttttgagaaaagtttttcgttttctagaagagaatgatcataagttacccctctcttatatcaaataaaaatgtcccacatcaaaatgagaccatgagcacaaagacagctagtcatacacacttcataaaaagccacaaaatgtatttcctttttaaaaattctctctcattagcttactaaatatggtaaattcaagacaagactgaactattctcttgataatttattttcagaaaattaatgctttttaaatatcagtttcaagagttcattaaaaattattgagggattgtttcttaataatgaaatgcaaatattataagtgaagggagtgttaattacttcaaaatgtgaaaccatttgcagtatttaaaataaattaaggacactctcactctaattattccaggactgcagttaagtctcagtcctctatggttgttgtacatatggcattacatcagatatgacacgtatgtgaaacatgctttttcttcttcctactctacatattttactgtgatgtgagccatatgtttcattacaaagggtggtatgaaaaggctattgcaagagaggaaaactcttgattcagatttcagcaatacagaaaggcctcttcattaaaaacacattattgtttggtttcaaggcatttaccttatgttcccagtaacaccctgacagtttagagatttaaaacatctggaatttaggcattaagattttagggatcatggatctgacactaaaaatacggaccattatgggacactctaaagaatgggttatttgagccaggcatggtggctcactcctacaatcccagcacttaggaaggccaaggtgggtggatcacaaggtcaggagttcaagactagcctggccaacatggtgaaaccccatctctactaaaatacgaaaattaaccgggtatagtggtgcgtgcctgtaatcccatctactcaggaggctgaggcaggagagttgtttgaacccgggagctggaggttgcagtgagccgagattgccccattgcactccaggatgggcaacagagagtttgtctcaaaataataataataatgataataataataataataataataatagcagcttatttgatggcaatagagatcacatgatgcatatattaatatgtaatcatttaataattaaacacatctcatgattgggcatgaggatacatttaatgagttataattctgggtcccaatattatctcctgtttattagccagacaacctttaaaacactgttctgctctattaattccagaagtttatttcagttgtgtgattatgataaaatgattatctagcttcctttcagggccaggaagtgaaataaaacgccctttgagcagaaagtacaaattttgcaattaccaaatgctaaatacgatttaaacatatgtgtagtagtttaaagatatgtacacaaattatctgatactcttcccctcaaaagatggagcataattccactccccttgactgtgggctagacttagtgactgcttccagcaaacagattatgccagaggtaatgcaataacattatgccagaggtgatgcaataacaataacactataagttatataaaaaccatgacttccctcttgggtgcaatctcccgccatcttcattctctctggcataagccaaccttcatgttctaaggacacttaggcagcccgtggacagccccacatggtgagaaaaaccaatccctgccagcaaccatgtgaataaggttagaagcgggtattatcagtcctgccaaaagccaagtagcagagcctacaagccaatattcccccagcctagccttgagatgaccacatctctggccgacatcttgactgcaacctcgtaacagatcctaagcaagaactacctggttaagctactcccatattcctgactcacagaagctgtgagataataaatgctgttttaagttgttaaacttggcagcagtagctaactactacagtattagtagtcagaaaaagctaactactacaatttgtaatcagaataagctacagtgggtcaagaatgagtcctgttctccaaacccagcattatgacttttcagctgtttgatattggacagtgtatccacagcttctgggcctcatttcttcatctatacaacaaatattttaaccaaaatgatttctaagactcctctggtcaacaaaatatagtactctaaagctataaacaggtagttctaaacctgatgtaggaaaaaatgacaattggaatagcccagcatcagggactgtctttaaggccctcttggtggatagtcattggtagtgtccataccaagagtttccttacactaggtgggaaatgtaggctgaaaacctaacagcaggtcctcaggtaacatcatttggttcaaccccatttcgttttaccactgatgaaaaaaaaaaaaaaaatcaatccccagccgaggccactgtctttgtggagtgtgtgcatactccccaagtatgcatgggtttcctctgggtacttggtttcctcccacatcctaaacatgtgcactgtaggtgagtcagtgtatctaaagtgtcccagtgtcagtgagtaagtatgtgtgagtgtaccctgagatgggacggcatattctgcagggtcaggtccccaatttgcaccctgagctgccagggtaggatccagcctcctgcaattctgaacttgaataagtgcattggaaaatgaacaaatgaatgattaaaaattactatcaaatagaaaattaataatttatctataatcatacaaatacacgacaataaacactgcagcacaaaagcactcacctatgtttgtaattgattgcttttgaattgcatggtgggaaaggacacttcttacaattttcactttgcaaacatttattccttgatttaacccaccaccactaggagcatcatcactcatggattcaccaaaagttgggtaaataattgtcttacttgtttttatgaatctttcttaaatgtatataaagctcacattaatttcaatgtttaatattagaagtgtttatttagaagtttcgtgatgtgtttgtgaccagacatatgccataggaacttaactcttgtttatatcaattagccgatggtgaaattggcttcataggtttcgcataaggtcatagttttcaagaacctatcaacaatgttaagtgaggacttactgtatatgtttcctttcaactctggtatgctatatttctgaccctaagctttaagaaaaagagaaatagataatgcccccaaatcaaacaaaaccaaaatgaagaaccgcatatgtaagagatttagataaaatatttccccacttttttttcttttttttgagatggagttttgctcttgttgcccaggctggaatgcaatggcacgatcttggctcaccgcaacctccgcctcccaggtttgagtgattctcctgcctcagcctcccgagtagctgggattacaggtgtgcaccaccacaaccagctaatttttgtatttttagtagagatggggttcaccatgttggccaggctggtctcgaactcctgacctcaagtgatccacccgccttggcctctcaaagtgctgggattacaggtttgagccaccacacccggcgtcccacattttttgaaccagtatttccccttgtacaactctactcaaagatcatttatataggaactcaaagacacatgtacatttgttgcagcattttttttgtaatggcaaaactagaaaatatctgagtgactatcagtgagggtgcaccatacgttgagtcataatagatgggtggccatgatcaatcttcaacaaagaaaacaaactctaaaagctttgttaggaatctcaaacttgaccatacaatagaattatcagggagttaaaaattttgtgtttgtttttttaattcggatgctcaggtcatactccacaataattaagtcagaatctttcaaggggagacccaggcatctgtgtatttttgaaacttaccaggtgattccaatgtataacttaagttgagaaccactcagtatggtctcatttaagttacagtaaaaagaaaaaagacccactgctgtgtatgggaaagatgaaaaaggaaacatatataactaaacatggtgagaattaggataaagaggaagttttactccttacaaattttttacaacaaatatactacggtaattaaaaaaggtcagagggaaagaaaatatttcaccaatttctcaaatacagtagggtctggaagaacaaagacagttgttactatttggcctgaatttgcgtctttaaaagatattaagtgtgggcgtgatagctcacatctataataccaacactttgagatgccaaggcaggaggcttgcttgagcccaggagtttgaaaccaccctgggcaacatagtgagacccccatcttgattaaaaaaattaaaaaataaaataacactgggtataatggtacgtgcctatagtcctgcctgtaatcccaacactttgggaggctgatgcaggtggatcccttgagcctataagttcaggaccagtctgagcaacatggcaaaaccttgtctctacaaaaatacaaaacaattagctgggtgtgatggcacacacctgtagtcccagctactcaggaagctgagaggtggaagaatctcttgagcccagaggaggaggctgcagtgagcacagattgaaccactgtacttcagcctgggtgacagagcaagatcctgtctcaaaataaataaataatttttaaaaataagaaataagagtcattaaacctttaactacaaaatgacacccagctaaaaagtaaaaaatgtaactaatggattagacactacagaagactactgttgttactgttttatttttcccataaaacttactttccttctaataatgattccataaagatatagtccaaaacccttcattggaagaaaaataaaccaaatatgtacagaatttataatctggaattaatattagaaatgaagtaacctagctcttcttttaagatataagaaaaatgaaactcactgaataatcattaaacagtttgcaagggactagtacactgacttactaagggtagtctaatgccgttcttaccatgttatagcactatataataaaaacagatttcccgtgtttcaagggtgtttgtgtacatggcagggaggcacaggggaggtgtttagccaaaagcaacccacctaattctgtgtgttagcataacgccaacttttgtcaatgatttatgaatcacccaaggaaaatgttttatgtaacagtggaaatatttttatatatttaaatgtgcagcatgaagaaaaactaataaagataaatgatttatgttataatgtttactaggcattgtatcaggaaacatttgtgtctagtatttgtttgagttcattcggaatttctttatttactcactcactatttatatatctttgtttagtttcctcacaacgctacagttttgtaaacactagtactgagaactaaatgaaaattgcaaaagcgtaattacagctggatgagaatgttaagcactcactccaagttttaacctgagagtgttttcagtgaatagcatcatcaatcaatatttattgaacatccacaaagtgtgtgatttggccgaggcagtagacaacaaaggcatttgtagttgtgtggttctcccttcttcttgcaagtagtggaaaactgccaaaaacttaatgtgataaatgaaaaaatgtgtcccccaccactcatctgaataccaattgcaaagtaacaggtttctctctaaacatcagccctcagtgtaaaaatgtaatggttctactgtgagaatattgatgtcagaaggaaagcaactctgttcaacagttttctatctcttaaaaaactttattgttttatatttctaaaacaaagaggggagggagagtttttgcttgtaaatagttcaaaatttacaattagaaaaaaaaaaaaatacatagaaatctgaccgcactcccctgctcccaatccaaggatgccagtaattgcaagctggtagatacacaatgggtttaaaaaatggacattcacgtaaataggaataagaaatgatctgccaaatattacagtgctaagacagctatgagtgaaaactgtctgattgaaagtaccggtcaggcacggtggctcatgcctgtaatcccagcactttgggaggccgaggccggtggatcacctgaggtcaggagtttaagaccagcctgaccaacatagtgaaccctcgtctctaccaaaaaacacaaaattagccaggcttggtggtgcacgcctgtaatcccagctactcggggggctgaggcagagagaattgcttgaaccgggagaagtggaggttgcagtgagccgagatcaagcccactgcattccagcctggatgacagagctagattccgtctcaaataaataaataaatagaaagaaagaaagtaccttctcaatttgctatgatagtgtaataaaaaaaaaaacacgatccactatctattctaatacaatcaaataattagaaaatacaagaaaatttattcaaagaatgaaaaaatatgttctatgagctttgtctattttctattcaacagcaattcatttttctctcattaaatatactctctaaactgtgtaatatggaagatttaattattattagacaatggtgtagtcaatccctctaggaaactgactgagaagctttcactaaatccaaaatcttacacttcagaccaaactcaaagaagatccaaaaacagatctacttgatacttgcttgacctttttttaaattaaatactttcgtggaaatatatattgtatgttttatgtaatgtatgttccactaattatctgaagtcttttccaaaaaatgttcatatattaatgggcaaaaacgtcaaatattcaaactcaattgaaaggcaaaacacaatagaaacctgaaaactttaagatgtaatcagcattcattgaacggagtaaaacttcccattgcacagtttctttgataacagtctttatgccaggcgtggtggctcacgcctgtaatacctgcactttgggaggcagaggcgggtggatcacaaggtcaggagattgagaacatcctggctaatacggtgaaaccccgtctctactaaaaatacaaaaaaaattagccgggcgtggtggcgggcacctgtagtcccagctacttgggaggctgaggcaggagaatggtgtgaacctgggaggcagagcttgcagtgagccgagatcacaccactgcactccagcctgggcgacagagcaagattccgtctcaaaaaaaaaaaagatagtagtctttattctttattaaaaatttaaaattctttctattctaactgaatacactgatttgtaaaatattttcctagttatttacaaaagtttttcccattatggaggaaaaccaggcatgtatgcaagtccgtgtacacaaaatactaaagactatcactgtacttttaaaaattcttagaatttagaaccaaggaaagtgttttattccttaatatatctaacagtagtgctttgtgtgtcatggtaaaacatgaaatctttttcccaccaaaaacaggtgacaagtctaagtcagtgtagtatagtgacacacggactttaaataagtattcagtaaaacccaaagacctcataaatttccaatgtaaattttctctttggtttgtcacttggagatttgtggagtggaaataggtattggatgtttgttttatgaatataaaatttactcaaagttccaaagtcatctaaaaagaaaagtcgaatacttaaaggataattataagagaacactgttttcaaattgcatgcacgtatacatatgttcaattataagcattcaacccttgttttagatgaccaaactagtagccacagctgtgacctgtgcatggctttaaaaaaaaaaaaaaaattcagccatcagtcatttactaacatcatcttataaaaaagcccaacgcagtgtacctcacgcagaaaagctgggtcataaaccaaatgctttatcaactaatcaatattagcaaatatcagactgtaagaataattactaaaaaaagaataaatgcttgagatggataccccacctaccctgatgtgattattatgcattatatgcctgtaaaaactatctcatgtactccataaatatatacacctactatgtgcccacaaaaattaaaacttaaaaaaaaactattccttcctgaaaaaacaacaacaacaacaacaacaacacagattttgaggccagaactcttttaaattctgcttatttttacataattttattgtgatggtttcaagttcattaaccttttcttctgtaatgtcttgttggctattaactcatcttctctaattttcacctcagacagtgtagttttttatctcaagagctccaatctgggtttttaaatatttgcatgtcactacttactttttaaaacataaaggagcacagtacataaagaagtacagttaaaaacctcaagcagaagaactgcttgagaccaagagttcaagaccagcctgggcaagatagtgagaccccatctctacaaaaaattgaaaaatcagcttggtgtagtggtgcatgcctgtggtcccagctactcaggaggcaggaggatcacttgagcccaggagtttgaggatgtagttagctatgactacgccactgcaatccagcctgggcaatagagcaagaccttgtctctaaaaaaataataaaaataattttttaaaaacttgttttaatgttcttgtctgctaactctaacatctgtgtcaattctgagtcagtttcaataggttgatttttttttctcatgagtataacttttctgcttccttctatatctggtaattttttattagataccagatattgttaattttattttgggggtgctagatatttttgtgtccctataaatattcttgctttttgttctgagattcagttaagattcttggaaacattttgataactttaggccttgtttttaagattctttagttaggactcagcttagggtttaacctaaagtcaatttttccccacttctgaagcaaaacccttgttctactctactgaatgccctatgaattactctatgaatgtactctactgaatggcctatgaattatggagctttcctctctggtgggagcaggcaatattcccagccctgtgcaagctccagagattgtttcctttagtctttttgagtggttctttccccagccttgggtagtttgttcacatgcatttgctggtcagcactctcttgaatatcaaccagagaggaagcctctgtagatctccagagctctttctgtatagctatctgtcctggtactatgtcctgcagactccagctgccttagcctacccagacactcggccccatcttcccaactcaggagtttgccaagttttaattgatctcttctgtttaaaccctagaaactctcgccaggcagtaagctgaggcaatcatggtactcgcttgttggtttctcatcactcagagggcactgtacttcaggacctgaagtcccatgtcttgaggaccactgttgcatgtattttatctgttttatggcttgtttcacacaggagaataaattggtccctatcctacttgctcaaagctgaagtcagaattatcttttcacaacaaaaatctgataatgtaaatcccctgcttaaaacacttcattgaattcccatcattaaaataaattccaagctctttacattgatttagaaattgacttcataatttaaatcttgtctactttgctagctaatcttgtgacttgtttacaataactatgattcaaaataaaatagctgcagtttcaaatatacaaaatattctttcattacacttgcacatgctgtttcctgtctagaactctcttttctgccctggctactgagaaagtcttattcattcatgagtgatcaacacaaatgtaatgtctgtgaagctttccttacatgacacacttccagctaccttctccctctctcctgactccaaccccaagaagagttaggcagccctcctcaacgcgcaaaggagccatctattatccaatctcctgttacagtgcccattactttgtaccacagctatttatgtaaatatctatttccccaccttggacaagctcctcagatatgtttcctcatttgtaaactggggataatacagggtgtcaaaaagttggggtgcacaggataaatatatcttaactgggatgatacttgcattttcaaccaatatgctcaatttggtttccttcaacgtccggatatcttttttaggtagcataccttataagaaattggattcaattgctaatttgaataacatattatttaataaaaacactacagagaaaatcctaaaacatgaaagacctcagtgccttcagaaagggagaagattagagattacaggagagagctgacaagatgaagatgaagaaaaaacagggagctttagagactttgtaaaggattttatgatgtaacataaatgcaacaatgttacacacgcataaccaaaatgcatgtgaaaagtaacttttttttttttttttttttttttgaaacggagttttgctcttgttgcccaggctggagtgcaatggcgcaatctcggcccactgcaacctccgcctcctgggttcaagtgattctcctgcctcagcctcccgagtagctgggattacaggcatgcgccaccacacctggctaattttgtatttttagtagagacggggtttctccatgttggtcaggctggcctcaaactcccaacctcaggtgatccccccgcctcggcctcccaaagtgctggaatcacaggcatgagccactgcgcccagccatgaaaagtaactttaaagggagaaaatatattagaggttagcaataattcaaatgttgattacgaagatacttcattatatggtgccatattttcaattgaaaatatagtgaatataaaggaaaaattaaagtctctaccaccctgtactagggatggcaacagaaaggaacaatttttgatcgggcgccatggccaaataataacccacaagtctccaattaattgctatgtccagtgatgccttaagtgatgcaggtactaacatctttggaatgaactttgaatcaattaattgtattggtatttaaaataaaatacatcattaaaaaatgtctcatacgtcagagcaaacagcagaaggtgaggcataatttttaaaaacaacatttcaggggggtctttttttctgatatggtctgtttaagctttgtttactttctcagcaagaataaagacctggggcaacatttaattaaaatgttgcctaagctttcatgcttcctgaggcagtaagactggggacactgctatagtcttcttgctgtggactaggaaataaacaaggatggataactttgaactctctgcataatatgtagagcaaagccatatccctggaaaggccaaaattaggtgagatgcagtacataacaggtatggaatatactaatgctttggattgggagcaaaaaaaactggaaaggccttagtcacatgtactttctattatctcaaatattatttttataatttcaacttttattttagagtcaaggggtacatacacaggtttactgcatgggcattttgcatgatgctctgttatctcaattataaaccactaatttctaagatccaataacctggctgggcatggtggctcacacctgtaatcccagcactttgggaggccaaggcaggaggattacttgagctcaggagttcaagaccagcctggacaacatactgaggccaagtctctctaaaaaataaaatttgaaaatggaaaaaaaaaaatgatgcaataatctgcaggaatgaagaatagtaacaatgatataaactactattcacatgaacagcttgatgtttcatttaggctgggccagtcctaactcctagcagtaggtaaagttgatggacagtaaatcaaaaaatgcttcgaaactatgagttaaaattaaaaagaaatgaagatttggtttggtagtgcttcattttctttgatttttaaaagcagacaataacaaatgttcccagagactatcatagaatttccttggctcaataactagaaataattataggtcccaggatggaagagtagaaggaccgcaccctgattttgggacagtgaaaaggtgagattggaccctgcacaaggcatacaactatactaaggctcagtttgccatgggtaaaatgggatgttgtcaaagttaaactagacacctcaaaagtaggcatttttgtttttatttttgagacagggtcttactcacatcgcccaggctggagtgcaatggtgcaatcttggctcactgcagtattgatcttccagggtcaggtgatcctgatacttagcgtcccaagtagctgggactacaggtgcacactacaatgtccagctaatttttggttagtaaagatgggatttcgtcatgttgcccaggccggtctcgaactcctgggctcaagcgatctgccggcctcccaaagtgctgtgattacaggaataagccactgcacccagcctaagaataagtatttattaaaatgaaagcaatgatgggggtgatccaatgggctctgtaagattattttagcagcagtatgagtgatagccacaaaacaggacatttgagaggcagggattccattcagaaacaaagacatttaaatttttagaataggctattttttttttgaagtcctaccctttaaaaaatatgtattatatatatattatatatgtataatatataaatatataacataatacataggtataatataaaaatattatataatacatatgtatagtatatgaatattatataatacatatgtataatatatgtataatatataaatatgatgtaatacatatgtatagtatataaatatattctattcatatatatatacatttttttctttttttgatatggtcttactctgtcacccaggcaggagtgcagtggcaggatcacggctcactgctgcctcaacctcctagcctcaagagatcttccacctcagcctcccaagtagctggaactacaggtgcgtgccaccgcgcctaattttttgttgttgttttttagagatgggggtcttactatgttgcccaggctgatcttgaactcctgggctcaagtgatactcctgcttccacctcccaaagagtaaattatcatttaaacttttttgttaaactagtatgcttaagaatgaaatttaaacagaggtattacccaactggttgacaaattaatacatttgtcttttatatttccttctggaaaaaaaaagagcattaaagaaaaatgacatcaatgtaaactagcagtagttaacagcaagacatttttacgtaattttgaaagtagttgccatacctccttcctcaaaatataaagacaattttgtggattatgttttctgtcaaaagaaatttcataatctaggaaaaagtttacagctagtgcatttgttttttaagatacctaaaactgtcctgagaatgtgtatcccattttgagtgagtcatacattaatttttgtaagtcagtccaacacttagcaatcttaaataaatgacacatctgtaaacattcagtggtatgaaggtcagtgataaaagagagctggtcatatattaaattgaattgaaagccttatttactgtacttcctgatttatgcagtcctatattcattgtaccaaagatatgatcctatgggacctaattttagtgactggagcaaagcatagtgattatctctcattttttatcaaattgtagtttcacatgaaatccttcctacaacccaccatgaaaaacatcctctatacaacagaagaaattttgggctccatcctgaggtatttattaaccaatccacagagcgtcttccatatcaatgctttcaaaacaaaatacaatgtctaggattggttacttgctttctcagcagaagtaattcagatgtgggctctcagattagaaactactgttgctctgtggtaatacattacatttccatctgaaaggttcatgctactttttactgtttaggtggttttatgtcatatatatgtatgtatgtattctaatttaaggccggcgtgatagccacaggctagacaatttaaactgattggcaaattataacatttcactacaatgagccaaaattagtaataaagattattcccttcttaaaacttgagataattgcctttttatcatatttttgagacaccaaagttcctttcttctttgatttatcttaggcctcaagtcttgtcttttgcctggccaatatctgttgtattcctgacagctcagcctcctctaacttctgagaagttctcgctacctctggataacagagcgaccgtgtctggacagattactagctgcgaatctgcccaacactgaaactgacttcatgctgcaagatcactggtgtctttttgctctcattcttgcgctgggtcctgggccgtgacttccaagctccacaggaccaattctgctttgttgaggaaagcaccttctactgcctaagagatgtggattccactgtttacttaagcccttttctactggaaacagaaaggagatctgcttagaaagatcagtaatactgaaactaggaggccatggagtgtttcccacttgtccactctgagaccgtggctacaatattcatccactctgagcttcagttttatcacataaaaatggaaataatatcatacagagcccatagggttgctcaatggattcagtgaagtaacacatgtaaagaatttaccacactgctcaacacatggtaaaaggtgttttattaccaccaccaagaaaattacttttcaagagcagtgttaaaaagcaacacaatgattctttatgatatcttcactctaaatcatgtaaaagcttatttaagatccactctgaaacgtaaagctcaaagggaaaaagaaggtggagggaatgtcagaggcaagccctgggctaaagacaggagatgagaggagaactagtccctttataccctgatggaaagacagtatacccatagcagaaggctgacagaaaaataacagcaggaagacagagagagcgagcgaataatataaagaacaacaagaatctgttaagcaaaatacaataggaagccattttaattcattctccctttccagttcttttctttttggaacctgttctaccattaaccaaggcaaccaagtacttacccagcccctcctttagagatgaaaacatctctcagttatctgtcagccttttcaacatcacatgtcatgggctgggtggggccgggaggtggggcggggcttcaataaaacctaatgtgtcgtcccggggttgggtttccatgttaattttatccttccaattattagaaagaatgtaaagctagcattcaccaccaaagactgtcatacatattattacaactaggaataacactaccaaggcccactctctttctctaattctcccatccctgctcctctctccctcacacacacagagccagagatgccactatctcctcagccatttcaagctttccttttaatcagcacggtaaacaagcttctatgcctcaggctggcgttccacaaactcagccaaatcgtggggttttgtgaatgctgcagtcagcagggcccaagaaggcatatttgctcacacattatgtcgatgttttgttggtttttttttttttttttttggtcctaaggatactccttggactgtgggtatgatcaacaagagatgtcatttatcttacaaagactctaattccattggattttgattagcagtggtaaccaggtgaactgaataattactgttactaaccataatattctttacatcttactgcacaatgtaacatcaaaatcctagtgagggaaaagttaaagtgtcaaacattcaaagtcataagccctcagtgctccagttctgagaatatctgtaaaggatctcccttctggggaaaaactaagaatagcattttccaaacaaaaggaaataaaacgactctaaattcaccagatcataattattgacacaaaattataaagtataataccttgtgttcagtaaaaattctagataattattccaccgcacaggattaggccatttattcaagaggttctcatttgataaatttaggaactcttaccaatccatcccttttccccgagagtaggtgtaaacatgtaaaaatattccttaaataccaattctgagctcaacctgcgctaggcacagcagacacaatagccaagaatttgaactttgttactagactcaggtttctaatttaatcaggagcctcctgagtgtttgagactaggtaatgttttcctcagacacggagggattaattttgcaacactgggagaaggaggtaccggagaagtctaacaaaaaatgtccatggtagtttctgccaagccaaggtgcttttattctctctgtgaggtacccgaagcaaccccagagccaggctctcagtgtgtgtcagtcagtagaatgaaaaactagactcaggcaaggcctgagaatctacctcatgtgaacatgaattatcatgcatgaccttcaaggccaagaaatattctatcctcaaaatcctgaggtaagtaaagaaacaaataagtcatccttaaaccccagtttatagatgccagaaaaggaaggagattgtgccaaaaataatctcggaagtggttgtatgtgtatcaattgtggaggtacgtttgcttacagtatctccagtgcttccttctgcacatcacagatttgctattgatcagctgtggtcagatattgtaagtataaattaacctgctccagtgaaaaatacccaggggagctattacactctgaagaaatcttctctttaggtttaactgtacttacaagtacaattcaataggaggatgcgggatggttagctccaatttcaccaaccacttttttttttccagtccctgattaaaagattctgcagtttatgaccagcaaaaggctttgccttggtaccacttcaagactgaaggaatgatacaagaaagagaatttatcatcggcagggggcaatcagctgtccagaggtgcactctttatctaaagaatcttaagagtcagggggctgctctttaaatgactttggcaactcctccagaaggcttaaaagctgtctctgaagcctgtggtgtggtatccatattaatccatttgagtgaaaattaccagttccaaggaaaatacccttaggagataaaggtagtaagggaaagaagaaagacacagtcaggagacctgtgtcctagctgagaaaaagatatgtcaaaagatttactgaaaacagaaggcaggttttaaagtaagagtacaactcattagtataggaaaacaggaaaaaagcattatccaaagcactaaaataaagaaagagtcaaactctatcattttctaagcttttaaaggtcacatggagcactatgctaatattttgcaataatggactctggggcagtgctttaatgaaatgaaatgaattccaaggctctctgaatcttaatcagactgtgcaggggatgcaggaaggtcaggctgacaagcaaatgatgcaaactatactttcatattacaatgagtacgttttcccaaaacaagtttagtgtcttctctatatttaaggtcctagtaacttatcacattgtgaaaggtccttccatgtcactctgtatgcctaacaggccagcaagtgggtcagctcatggtccatccataagacattctagtaaatcaatttaaaagtatggtgttagcagtggacatcctcaatttctttttttttttatttttcaaacggacaaaaactgtatatatattatgcatattatgtatgtttattatgtatacataatgttttacgtttatggtataaaacataccataatgtttatggtataaaacataccataatgtttatggtataaaacataccataatgtttatggtataaaacataccataatgtttatggtataaaattgcatatgtgtacatatacaaaatatacatgtatatattgtggaatggatcaagctaattaaaatatctatgcctcactttttgcggtgaaaatatttaaaatctactcttagcaattttcaagtttataatacattgttattaactgtagtcaacaacttttttatggtgaaaatattcaaaatctactcttttagcaattttcaagtttacaatacattgttattaactgtgtcaccatgttgtgcaatacatctcctgaacttactcctcctatctaactgtaattttatatcctcaatttcttttcatcatatggctaaaacatatgccaaacacccttttcaaggtaaatgggaagggaaccctcaacctatttcagtgctgagacactcatgaaaacagaaatacttaacgctttttttttttttttttttgagacggagtctcgccccgttgcccaggctgaagtgcagtggcacaatctcggctcactgcaacctccacctcccgagttcaagcaattctcctgcctcagcctccggagtagctgggattacaggcgcacaccaccacctgactaatttttatatttttagtagagacagggtttcaccatgttggtcaggctggtctcgaactcctgacctcgtgatctgccctccttggccccccgcaaagggctgggattacaggcctgagccaccacgcctggcctacacttctttttcatgtgaaattcaatagtctacgtagccagaaaagctccaaataggtaagcagtgatgttttatctcaaaataggtttcttctctacccttgcagtttttctccatccaactaaatcttacccattcctcaagactcaatttcagttttaaattcaacaacccaccacaagaagttcgagcaaattacagcatatcaacatgaccagaatattaaacttgaaaatatcatatatgaatcataacgaagaacggaaattttcataaagaaatccattttaaagtcagaacaaaaaaagttcaaaatgattgtaattatataaaaaagttgtacattgacattcacaagtgaatgaataatgacataaatagagcacaatgttggagttattaatttcccacaaagttaaagacttttcctagtattagtaactttctgtatatcataaagtaactggtgtttcctactcaaattcaactgaaaagtatgaagtcattacggtttattttgctacatgatggatgctgtactgaagttttatatgtattctttcattttatccccaagtgattctatggagtaaataaatactattacttgacaccgttttgcagataaaaaagcccaggcctacttaagttacataacttgtcaacggtgacattgtgacagaagtaggaatttagtcccaccataccctggtcattagaacacactacctcatacctcaaggtgaagcccactggtgcttgagagtggccactgctttggtttcccagattgttaagatgacaaacggctcagttccgtttcaatattgcagtactggtctgatggctggattctactgtcataggattttcaactgtattttattcctttacaaattcccagatagagcaggagggcaggtaaagaagacatattaccctccaaaaaagaaaaataaaaaacttgagcatcgagacactcaatatttacgctaccccttcagtgctatacatcctaacacagcttaaagtttttattttactcacaagtcctgctgctttggtaattcacgaaagggttgtgcgcctgacctctaatgataattcgtcatatatcctcatgctttcttattggagctgtgaaacaatgaattagcaacaaatcctccactctttgccccttcagcccttggagtttaactcctctcacattacagtatttattgaatttcccagccaaacggtgttgtgctccataaaattctgacaagtggactctgccaagctaataatggcttcattctgctgaaataaacttatttcactgtggcaaacaaaacgacatgacctggaaaggttatttttaactgggtaatgactcagtcccaaccaagcttttctctcaaggttcccagttttaaataaatttcatttcttaaacgtaaatgcatgctattacgtgtgttcttgtctgtcaatctttcacaatgaagtaaaggcagatattttcattgcttaaggtgtatgattctctttattcaataacttggtcggcttatcaaactattcccaaggatcctggcatagagaagccacccagagaacctgaaagacaaggctacataaagaagcaaaatccttttaaacagaatctggttttattgcatttttcttttaattaaacagcgtcagaacctttccaattcggcaaaacttttaagagtgtgcctctgagaaagagctcttatctcatgtttttaaagcgtgaataaattttgctaagtttgcttagcctgcttaccaaataaagatatgccaggacaaatttctctacatccacattagttaacatcccccctgtatcttaaactctccataccaaaaatgtctgctactaaaaagtttgaaaagcagaaacacgcgtttttctctatactgcctccatatcttacagttatcatttacatctttttatcttgcactgcgagcccctcaaaaacaaacaaatgaacaaacagaaacaacttccatgataaggtcaaattttcttcaagtttcaaatgatcagggactccgagagcaccattacaacagctgggatcttgtaccaacatgctgcaccctgccagtcctgccttctgagactaataaaagagaaaacccttgacagctaacagctgggctccttatgaagctgttcaatagaaacaacaaggcctcccacagcccaccaaaaatcaggacttggtgtatagacacaaatatgtacaagaaaagaaatttggtaagagggaacacatatttaaaagagactgaaacaaggagatgatgaagaataacaggggaaaaaaacactaatcaatgaaagagaaacccagtcataccggcataactattgaagatgttaagagttagtgcaaaaggaattacccatggttttaatctggctggagtaggggacttgtattacatatgattagctacaaaggcaaaagaacaagaaccttttcagtaaattcacatagtcatggttctgtccaaaccacaatacaaaatcctgaatatccttttgatgacctatagtgtgtattcacacttgcagtaaaagaaactaatgtgaatcgccttactattgcttcctgccagcccctctgcctccatattaaagaccatcagctaggctgtggctaccagctacaactcctcagtcaaagccatgtcacagaattactgccagtcggcttaacaaataaagtacaaaaataaaagcacactgaagccatataaaagtactgtggctaaacaaggagtggttatgctggccattgagtaaaaatatctgtaattccttcaagttcagtaagttaaagtaaagcttcaaactagggtagctgaggttatagtcaatatacagataatacaaatagaaactagcaaaagcataaggaacacaaaaactctcctgtaatgtattacagatggtttttaaaagtttctatggctactagtaaggaaacaaaagcaaaatctttttcctttataatgtgcactttagatggcccaacagaatcacttccaattgctacagatagataacaaacaccagacaggcagtctgagaagccgcttaatttgttgtgtgtgtgtgtgtgtgtgtgtgtgtgtgtgtgtgtacctcatacacattgttcaccgctagtggcaattcagatactgacccagaatatgaacaaggtagggtgggagggattcagcattactatggaaaatggccatggaaccattcataaattaacgactcagagataattgaacttgttcctgtgttaactatgagtttcattttgttaaacagtcaacactgaaattgttttaatcctataaattcaactaaaacaattactgaagtgtgttcaatgccgtggttatttctatttttgcaggtattaggcactatgttttgaaatttgttccaggcagacaaaaaaggaaaagtttggagttctttttttttttttttttttttttttgagacagagtctcgctctgtcgcccagcttggagtgcagtggctccatctcagctcaactgcaaccttcgcttcccgggttcaaaagatctgttctcccacctcagtctcctgagtagctgggattacaggcgcccgccaccacgcccggctaatttttgtatttttagtacaaacggggtttcaccacgttggcgaggctggtctggaactcctaacctcaggtgatccacccgcctcggcatcctaaagtgctgggattacaggcatgagccatcacacccagtcaaacatttggagttttatacctgaatcctcagggaaaaaaaaggtgggggggcggggggcgaggggtgtattttcattaacaaactgattcccagagcgtgaatctattttaagtatctcacctaaggaaatgtttatttcaattatgatacctaggtgtctgctgaggaaatataaagcatggtgagaaaactactttatttatttagagacagggtctcactctgctgcccaggctgcagtgtagtggcagctgggactacaggtgcgcaccaccacgcccagctaatattttcttttttttgtagacagggtctcacgatgttgcctagtctggtctcgaactcctgggctcaagcaatcctcctgtctcagcttcccaaagtgctagaattacagacatgagccactacgcctgacctgagaaaactatattaaacagcccagaacttacacattcctattgctattgcatccttttccatagttaccttgggaagctagacactcatgctgcttaagcagatttttctagcaacactttcaacacacaacttctagctttactcagcttctagttactctacttgagcaacagcaatatggagtcaaagctgctttgaggattattatttctctaatattaaaaatgggtactaaccccttaaacatccctcatttctgacgatgacaatttgttccctgccctttatcttaaaattttttaccttctcattttcccccagttgacatgtataatttgtgcctttttctagtctattaatgtctaggacaggggtgtacacaataatctatattggttaaaaaaaagatattgaataaagcctagatccatctggatctttctcaatccccctggaaagatatgtgaaatatctaaagttgaagaaggtagagaaacggagcaggagagaagattagaggggagtcatgtggagatgacaggaggggaaggaaggagagatgggacaggacaggaagacaggagagaggtccctattaggtctcataactacatctttgcaagtatgtgtactgactctaccctttatgtcatgtctgccccagcaacacaactcatgctgcctccaccccagtcatcttccaaatgaatgatggataatcttgcttactataatttcaacctctagaaaggaagcattttgcaccctatcacctttttttaaaactcattttaaccctatctacaagtgttatttacatttaaaaggtgctttttgctaactttgagaagtaaaagatttgctaactttgagaagtaaatgaatccagtttagttacttacttttgtgaaaatgttccattacatcaaaataagggagaaatttttttcttaataacaggatgtatcgaaaacattctgtgcttgatcacatctgttattctgcattcaaaattcatttaggacaactaaattaagaaagcaaaaaatggttatgagtaaccatggccataatggaaaaacatagccaaatatttttggttcatataagatgatttttttttttttttttttttttttgtgtgtgtgtgtgtgagatggagtttcgcttttgtcgcccaggcaggagtgcaatggcacaatctcagctcaccacaacctccgcctctcaggttcaagccattctcctgcctcagcctcccgagtagctgggattacaggcatgcaccaccacgcctggctaattttgtatttttagtagagacggggtttctccatgttggtcaggctggtctcaaactcccgacctcagatgatctgcccacctcagcctcccaaagtgctgggattacaggcatgagccactgcgcccggccaagatgatattttttaacttagcctaaaaacgtttcccttaaaatcagcaaaggaaaagttatggaggaaaatcaaaacaaacatctacactgatgacatttcttatcattcgaatcagccataactgttttcaagtgcaaaatcaaatttaaaatatcaggaaaaatagcccaagtcaatcctattgcttccaacccacttccgaagaacagaattcatttatcaaccaactgtttactcaggaattgatgcaatgtgcagtacaactttggaagttcatggaaatttaatccagtacaggcaagatgtcttacatgttatgatgttcttatatcaccaatttaatgtttactggaccttatcaatgtcacattactttacataaaaataactttatctagctatatatatgcatcacagttcacagctaaaacagacacaggactgagtcattccaattattataagaagcagtactgtgagaggccagtaagaagcatttgcttagaggaagccagttgactgcctgaaggatgactccaaaggcatcaccaaagatgccattttatgggctcaattagagtatgagtaaaggcaccccgagacacagattatacttaatgcttctactaatgaattgttttttcagcatttggcccaaaagttctctcttctcatctgccacattttgcagcagaagccaccatagctgattggcacagaggtggttgtctgacccaaaatgtgtcaatgaaaatgtgggacataaatggaaacagacttccttcagtagttggatacatgatatgtaaagctcaggaactgttagtagccgtaattcccactgacctgctctgtagaaaaatgtatgaattgatgtacacatagcagtagaatttcaatctattcctaaggctgcatccctgccttaaggttctgtgacccatattagcactcctgtcttctttggtgtttgtttttagctagttcaagtttaaattccgttattggcaatgtaaatgccactgggcatttaagaggtggtttagaaacagtagagcaattttttaaactgctagtaccttattattgaggggcaaaaaaaatcaatttaatgagttacaatcagaaacatctttaaaaaaaaccagaatagcagagaattagcatcccatatcgggagggggtggaattcaacccgtgtctcacaccatacacaaaaataaattccaggtggattgaagacttaaatgtgaaaattaacactataaaacatttagaaaagactagagtgtatctttgaatctggagggtagaaagcagttcttaaacaagacacaaaaagaaccatatggaaatgacagataaattccactataccttctaatacactatacaatactatacaactcactttcattgtgtttattatttatttacttgcctttttcttttttttgagacagggtttcactgggtcactcaggctgaattgcagtgctgccatcatcactcacggcagcctcaaactcttgggctcaagcaatcctcccgccttggcctcctgaatagctgggactacaggcacgcatcactatgcctaatattttttttattttttgtagagacgggatctcactacgttgcccagactggtctccaacccctgacctgaagtgatccttctacctctgccttccaaagcattaagattacaggtgtgagccgctgcacttggcctcatttataaaaaaataaataaatttattatttattatacattgtctttcttgtccaataaagtgttagcctcaggagagtagggaatcttgtctgttttttgttttattttgtgtttttgagatggagtctcactctgttgcccaggctgtagtgcagtggtgcgatcttggctcactgtaaccgccgcctcccaggttcaagcaattctcctgcctcagcctcccgagtagctgggactacaggtgcctgcatctgttttattcacagatacatctacaatgctttgtacgtactagatgataaattaatacttgttaagcatgtatgaatatctaagcataccttagtcacaagagaaaacattttttagtgtggattgaggttaaaaggttgcaaaatattacattagatacatacaatttgtatatttgcttagtatgtagggaaaggaaaaaaaaaagggggtagtgacaaaacagaaatgttgtactttattctatagacctatgctatccaaagctatttaaattaatttaaaattaaaagtaaaaattcggtccctcagtctcactatccacatttaaagtactcaaccgccacgtgtggttactagctctatactggacaaaacagaagatacagaacgcttttgttattgaggaaagtgatagtaggcagtgctgctatagccaataaagactcacaccatatttgaagctggtgaatatcaagattacatcaggatttttaaggcaactggcttctatggagagagtgaactaaaggcagaagaaagtagaatcctcaaagaggccaattacatggaaattaaaatggtaaacatgagaaacagtgacaaaggatgtagaaagaatacaatgcagaggagaagacaattttttttttcctttttctttttctttttgagacagagtctcgctctgttgcccaggctggagtgcagtggcgtgatctccgctcactgcaaactccgcctcccaggttcaagtgattctcctgccttagcctcctgagtagctgggattacaggcgcacaccatcacacccagctaatttttgtatttttagtagagacatggtttcaccatgttggtcaggctggtctcgaactcctgacctcacgatctgcccaccttggcctcccaaagtgctcggattacaggcatgagccaccatgcccagacttttttttttttttttttttttgagacagagtcctgctctgtcttccaggctatagtgcagtggggcgatctcggctcactgcaacctgtgtctcccagtttcaagcgattctggaggagagaaatccaaaggaatttcagagctactatcatgagggtttgtggactgaacatgagatttgaggggaaagaaaggaacgtgagatgactgaggatgctgactggctaactaggtgactggtgaagagaagtcatttttaatggacggatactagacaggctaaaagctcttttgacccaggtgttttaacttagggaacatttcaaaatgatcaaatcaaaatgcgggaaaacaatgtgttttaaggccagggaatgactgcaatggacagccagacctttatccttccctgacgcaggtctcagataaaagggagagtgaaggtcagggactgaagaggtaatgaagcaagaaatgtgtgagaattatgagggaatgtgtgaaattatctgtcacaatcatttcttaagggcggaaaaaaagctgaaatagttcgtttttagacaacgtcaaaatgacctcgtcaaataactatcaatatagcatgtatatgcagagggtagattgaggggataatgcatttggccttggacacatgaatttgaagtacttatgactccacttggtaaatggtctccagtcacctattgtactacagagattgttactttgattctaaaagtaagatgtctccacaaattggatgccacaaaatgaaactgaaagtcatccataggggaaatgagttccagaacatacgcattaaaaatgataataaatgcagtcactttctagattctagtttatacggagccaaggtcagtggcttatggaaatactaacggctaccttagctgtccttttctaatgggcggcagaagcatttataatggaggtgagcattcagttccatttttgaggaagacaatgaggaaatattggtgctgatgactgaaatctagcttttggactactgacttaaattcatttgattttactcaaatctgccccagctgagaagaggggcttgtcatagcctttccgttgttgtttaatcctttaaaaaatgaaattatatatctcgaggatatatttaagcacacattttgtgagcaattaaatttaactattgatagaagaagacgcaaaagcctccactagaggtaaagacctctcgtccttgctcataaaagacacactttccttttttgcccctttttccttttctccatttctctccattcttctctccctcttttttctttccttttattactgctaaaaagtaatatgattccttaatcaacccccacagttacagctacttcacatttacaaaatgctctcacatccatcatttaagatctttacatttcaagggatcagtaggaaaagtggtacaatgcccctgctgccaataaggaaactcaagctcaagaagctggcgacctatgtaaggtcctgtagcgctttagcggcaaacagatgactcgtacctgggtagccagcctcctggttggccctcaattatccctgcttccaactatgcacatattgtctgtagccctgtcattgtaacagggttactgcatgccatacaatgatggtatgttacttctacaattaggttataagcagcttctatctttggctcttactctctcttcctttgatcactcattttggaataagccagctaccatgtgagcagtccaacggtggaactcaactgataaggaattgagggttccttggtccaaaatggaagtaagaatgcttgtcaacaaacttccatcttggaaaaagatcctccagccccagtcaaaccttcagatgactgcagccccatctaacattctgactgcagcttcatgagagactctgagccagaactacacagattcctgaccctcagaaaatatgagataataagtatatactgttgtaagctgtcaggtttgggataatttgtcataaagcaataaatatgacaatgtctaagtcttctcattctgagtccagtgctcttcctactctacacagttacacctgcattcagaacacttttgtttgcagaggtttgccaaataaccataatattctgttagacatcatttttaaaaagacagacaagactgacaacatttgcgcatgtaatttaaaataacgcaagtgctttatttggatattagaacagaaaaaaaaacctatactgaaagtgtgctatagatacactatgtatctaggtttgtatttttgagttcatttataaatccataaccacctgtctaaaatcagtctcaaaactgaaggctatcagaggaagaggtctggctggattaacttttacccaaaggagaattaccaagagctgaagaagttcttcgattccctgcagcacagctgtgatattgatatagagtactaggaaactaaagaaacgtcttacttgactgcagttgtcacattatcatgcattacagtgcagcagcctgaatcaaagagatatgcaaaattcaccaaggacagcagcaatgcattttttccccctgtatttgtggaaagacatcaggaaaaggaaggcaagtatgaatgcaaaaacatctgctccctaaactcatttaaaaaatatcactgcaaaaaataaatgtgaatcatctatagtgtagagcagatggaagtgcaatatgtttaacttaaggcagaaaggggatgcaactgaagaaccagaggatatggaaataaaataatacttaagcccattttacatactgctgcccgttaggttacactctggtaaaatgtgtagaaaatcatcttttatctatatcacactactttgaaagaattccaaataattacagtagactgtccagtggcacttatattcacactctctagtgacatttatattcacagaagccatttttttttttttttttttagacaaagtctcattatgttgcccaggctggactccaactcttgggctcaagcaatcctcctgtcttagcctcccaagtagctggagctacaggcatgtgtcatggcccccagcagaagccaaatttgagggcagcaacataacttccccctaaaatgagaaataaattacagagttgtcttggtttcaaagagattttaagttcactgacttgcctcagaggaacttaacaagaaagagcaaaccgaggagtaagttattttagataattgcagcaacaatgcaatgactcaggatttagggaaaaattacatatgaacttatgatcatgaaaaaaaaaaacatcaaactgtccaaatgccttgggataaatggtcaatgagtgacagtatacaaaggaacataagtcaatttttttgtactgctgattaattatttggaacccaattttaaaacaaagttgtttatcttcttggcatgcacttacatttcttgaattcataacatctcttagcctcaaaaatggaaccttttcaaatcttccgcattcatttaaaggcgtcattttaatttcttgggcactaccaaaatgggaaaacattagtatcatccacccctatgtttattttatatgaagaaaaaaaaaattttttttgagatgagtctcactctgtcacccaggctggagtgcaatggcatgatctcggctcactgcaacctccgcctcccaggttcaaacaattctcctgcctcagcctcccaagtagctgggatcacaggcaccactactactcccagataatttttttctattttttagtagagacagcgtttcaccacggttggccatgctgatctcgaactcctgacctcaggcaattcgcccacctcagcctcccaaagtggtgggattacaggtgtgagccaccacacccagccaatgaaaaaattaaatagcctacttaggaattacacaaaagaaagtatgatggagaattaatttcacacattggataccaccaccaataccacagtcactggactgatagatgaaaacttttgggttgtggagacggagtaacagcaatcaatatatcatttatcactatctcagtaatattttcatcatagcccacgtaagaatagattgcaatgtccttttaagacagtccaaaaattttagagttagaaaattattacaaagtcttatttatgaagtggaaacgcgtaaaattctaaagtcaaagttatctaaagcaatctatgctactgttcactatgtaacatataagatctagaggagaagattatttgttaatatactctcattttgaaaaataagctcaaacaaaatgcataaaagtatgcaccaagtcgcatgttcaaaaaaaaagaaaaggcactttttaccttgtatagttacactatggagcaaagttcttttaacttcgataagaaaacacttctgaagaaattaagtgccaaatgataaactatgatgaccacaaaggcaggtttaggtttctaacaaaaacgtatgaagttaagcctttccaaataatctatgcatactgttggtagccacagcagaaaatgctataggccaatagatgtttaggaatatacatgtttatctatatctgcatgtttaaaaacatatagatgaagggataattagagatgaactgccccaattcttaattgccaagttttaagtaaattttaattatactggaatctaatatttcaaatttccttgggggataaatatttaaatatataaaactgaacagtattctataataggggctagtggaagcctgtgaaacatttgacctttaccattaatacaaaatgttcttcagtaggctgacactgggatgtaagaatggtcccactaaattacaattatcagcagctcagagtaagtgagtattgcacagcctacaatacttatcagtcatcagagtacttgtgactatcaagtagaaatatggaatttaactgtctctctcctcccaatatttaatttcttaaaaactctgcagttatctgtggcttttttatttggatgacagtaacttaaaagccataacttatcacatcaaatcatcatgtgcctgataatcatggctttgaaaatgagtacaatttctattttattcacataatagatttatgtaggagactaaacatggaagctctaatcttctggttgagaaattcaaatttccttaatccaggattatgtcaagttcccataatttattttctagaaaataaaggataacaaacactttcattggtaaactcaaacatcgcctagaacttgaaagagctttctaaataattaaatataaaattcaattcaaattatattcagagtattttccatgttaaaatttttgttttttttctagtttatggaattgaataatccaagtaaaattttctgtaatctcttagctactataacattagattaattgaaacagtccattccccaaccatttgggataaactgaaaactgccataacatgatacgccttactattagtacatattcaagagacttaaagcacacaagatttgatcatgttataaaataaattcaagcttttcgaatttgtctagcaggctttccaatttttgccagaaagccccccaccatgaaaaataaataaataaaataaattcaagctacaaatgaacgtaaatcctaatacgattgccttatggccaagagatttactcctagttcttctcacgataaccataatgtacaataatatgaaaagctcatttaaaggaaaagtcatgaataccaaactcttccaccatcaattcattttccaaagctatcaaatagattgcttaactttgatttgtttattcggtgctagcacacagaatcttgatgatatgcaaaaaggatgtctaagcgatatatgatgcagttaggaaaagttctttctgcaccatcacacactatgaagatcgccttgcccttgagatcccttaccacagggttctatcttgcttatcaaacatcccactatccagcagaaactctctggaactgtctcaaacactatcacatctgtgaagctctatctcatccaccaactacatgtgattttcctgtcactgatctcaccaggagcaaaagctgaaccatttatcccactatgctttgtattaaagatatttgcatatttgtctttggctctctgttggactccaaggtcctcaagagtagagaatgtgtcttctcatatttgtatttattcactttagtgtctagaacaggacagactctcagaaaataaatttaacagaattttttttttttttcatttttagagagtcttgatatgtcaccgaagctggagtgcagtggcaaagatcatagctctctgcagcctcgaactcctggactcaagcaatcctttgacctcaaccttaacagaatctatcttgcaagagaaatggtaacttgagtcaaagctcaaagtcttatgctggtcttacgtggaattctaccctatatgctttatagaatggaattctctccttttttacttcattatatgataattagaacattttatatgactaagtatacatctatggatcaaattttcttttttcttctttggtgtctcttttcccaatcaagtcttaatacattagatctttaaataaaataactaaacaacctgatcatatagggtaaatcctaggatcattaagtccagttctccagcaactctttaagaaataatcaagataatcatcactttaaaaattttttaacagtttaaatcataccaaagtgccaagaatgcagataatactgctttcaaacggattagagaatggaaaaccaaacaattctgggtttgctggcctaagcacaataaatcagcagagaagttctgatatttactcacaggaaaaagattataaatggaagatgtttaaatctacccaaatcattctgaaccatctttaataaagaatagcttcctgttgcattcaaaagctagtataccatatcgtctaaaagctgtgacttttttactcatccattcatttaacaaacgtgtattaagcatctactctacgttaagtgttgatggtgggagttgcaattctgcagttcatacaagaaagctgtgccttcttgaaatttacaggtagttaaatgcatttaatctgcaatattggctcctactagtgcttcggtgatcatatttaataaatacagttattttagtcacagacttctcattgatataaatttacaatgaactataagtcagagtatctaggtcctagtctcattgctgcagtttaagtgcctatgagatgtcataataacgactcagagcctagctttcacatgtaaagcctgaatgcataagcccagcctgctttccttacagggttattataaggattaatacaaagatccaataaagtggtaatgcactgagcatatttatcctagatactatattaatttcacatgcattgctttatttaatattaattagagtcctatggtactataatactctttatctacatgtcagagtccacaggtatctataagaaacttctctttcaaatttgtctgttttaaaataaatgcatgtatttatttacacagataattatcaccagtagtctggtagcaatcacttcccatgttcactgtccttaaaggtttcctcaaggaaccttagcacagataatgctagaaagtgtttcagttttgttgtagttggtataagaaagaatccctggaggcagcttagaattcattaaagagaactgcctcagggtgacccctgaagttctttgaagtttccctgctggaagagacctggaattgtccagtttggaagatataagcactaaatacatcagcctaataaaaagagaaaagaaaaggaatgcatttggttgacaggcagtagggaagaggaaggaagtgttaccttgcagattcctagtatctgtaaagtaagcaaggaagtttgttgttatttctttccagaaatctagctcaaagtcttagcaaccaactgaaaactccagctgccctttcaacttctgccttccttaataaagatggtatagcagatgtagccaggttcaattaacttttcttttatgaaaagaattattcttttatgtttagatacattctgtaatgaatatctgtcactcttatttactctaccaatgctccagagaaatcctccttctttaattacacttctaatgttttgatctcccaactcccccacacactttttttttcttttcaagttggtatgtgacttcagtcaatccagggcagattttcccagacacacaaaaaactttttgttttcaggcaaataccagtaagattctgttagaaataataaatatagtgctgccaccataattttttagagaagatgataaacaaacattcatatccatgagttacaaaaagtatacaagcataggacggcactaccattatttgtcaaggctccaaaggtgtgataaacagcaatcatcacttcttcatttccctaccttccacatataagtacatatgtatgtatgtgtgcatgcatcatgcctttctgatgactgctgaacaccaaaagttttaatgacttcatttttttggctttttttaaggcatgtatatttaaaaaacacgtgattctatttgacatcatgtcagccattctgtcagaggcatgtgagccagagcaactccatcttgaataggggctgggtaaaacaatgctgagaactactgggctaaattcccagacagtgaaggcattctaagtcacgggatgagataggaggtcagcacaagatacaggtcataaagaccttgctcataaaaacagcttgcagtaaagaagccagcgaaatcccaccaaaaccaagatggccacaagagtgacttctggtcattctcactgctacactcccaccaacactatgacagtttacaaatgccatggcaatgtcaggaagttatcctagatgttctaaaaaggggaagcatgaataatccaccccttgtttaacattacatcaagaaataaccataaaaatgggcaaccagcagcctcggggctgctctgtctatggagtagccattcttttatttcttcactctcctaataaactcactttcactttactctatggactcgcgctgaattctttcctgcaggagatccaagaaccctctcatggggtctggattgggacccctttcctgtaacaattccattctttctctgaaatggccaaaagacatttctcagaaaataatattggtaaaaattgtatgaatgatattataaatgtaggagctgggaaacctaggcaggcagtcctggatttgaacatcaatgctatggggctatgatacaaatacttaatctctctaagccttagtttcttcatctgcaaagtgggtttgtttttgcaaggattaagatgtgcaaaaaataatatgtagctttcaaacatataatttgctcctttcccaatttctctcttgctggagtcacaagatcatgatgatggtagttcaggaactaaccttccaaagggtcacaaaagtcaggataaactcagaaataaaaatgcactggcagtttttattgactcacatagtaattactggttctcaaatcttgctatagttaataaacttccctttgtctcatattgatcattttggcatcatctgatggaattaaaaatggagcttagatatttgtttcactgatgtttaggtaacatttcagtcattctgaatacattttaatcattttgatgataacgtgaaataagggttgcccatcaaacctggccaagcacagtggctcacgcctgtaatctcagcaatctgggaggctgaggcgggcggaccacctgaggttgggagtttgagaccagcctgaccaacagggagaaaccccgtctctactaaaaatacaaaattagccaggcatggtggcacatgcctgtaatcccagctcctcaggaggctgagtcaggagaatcacttgagcccgggaagcagaggttgcagtgggcagagatggcctcactgcactccagcctgggcgacagagcaagactgtctcaatttaaaaaatgaataaataaataatattttaaaagtgtacaggagtgttacccattaaacctggctcctagtgttacttctttcactgtgtgccatgtggcctgacctctgtttagtctcaatattaacccttaatggtattaccacagttatttgcatactgtacaaactgaaaagcagtttttaaaaaagaaagaaagggaaggggaggagatgggagaggagggaaatgtgaactgagataattcccacttactttacctctcaatgaggtaagggtaaagattttgaaaatcctaaaatattatttattatcgccaatctgaaacttttatatcaccacataactggagtcagactgtataatgattaaattgctctcttaatatactctttaaatgtaggctttttcagagccctggtccttccatccccccatagtcacagattaataaactctaactagagaaagaaatacagggattatctgagtaatgttcccccacaccctgttatagatgcatccattaaagtgaaatggtgaagggttttttggtacaagtctgagtgtagaaagcaatacagaaatctctacttcagacaccatgtatcacagggatcctgaggttgcttccctgactctcacgccattaatacgcttcatatgctatccagccacacctaaaggccctcaaatagaagaacattcacaatcgccttccttaatgacgctccctgccctaaaggcaaagaaaggaatcacaaaagaaagtgaaaggagatgcacaaataaactgagtaatagcctgtgcctaagggaaatctggattttcctgaaaactggcctcactcagcctgcaggaagttcccaaaagtggtaatatttccaattacaaattctagctccttccttctaggtcaatttgtagatcctaaggccatatgtttttattcggaaaaggccctgacaacccacaactaacatttaggagttatgtggtcttggggaaattgcttaaattcttccaattgcctcatctttaaaatggagatgggctaggagtggtggcttaaacctgtaatctcagtgctttgggaggccaaggtgggaagacagcttgagcccaggagttccagagcagcctgggcaacagagcaagatcacatctctacaaaaaatttaaaaattagcttagtgtggtggcacacacctgtagtctcagctacttgggaggctgaggttaggaggatcacttgagcccaggagtttgaagttatatatagtgagccacaacagcaccattgtactccggcctcggcaacagagcaagacctcagctctgaaattaaataattaaataaataaaatggacataataattatacttacctcctagggcggttaaaagaactacacaagataacgcatgtaaagcaattgacacatagtcatcttatagccaatgttagctattatttttatttatgaatgagtacacacatctgaaagtgtttgtgaaaaaaagtccccttctctctctgatctgagcaaatgtacaccttagataatatgaataataatgtataccataattattaggcttccctataatttaattacctgaggaaataaataactatgattactgaaatcagtgaaattagttttgccgatgagaaaatcaaactcaattggaagctctttgacactccctttagtaatctactctgttcagatccttttagcaatgatatcttctagcattattatctttaacctttgagttctttacacttacatttatattataaaaattataacgcctgagcaacatagtgaaaccccggttctacaaaaaattaaaaaattagtcaggcatggtggcacaggcctatagtcctggaggctgaagtgggaggactgcttgagtctaagaggtgaagcctacagaaagctgtgatcggctcacttgtaaccactgcactccagcctgggtgacagagtgataccctgtctcaaattaaaaaaaaaaaagaaaagaaaaagtacgaaatcatgtttggtagtcctattcataatacctttttttggcagaaaaataaggaaaaaagcctattgccaaaaagccatgtgcaaaacctatttattggtaaacaatattccaaaacttacactaaaagtgttttttcttttaatatctactggattttttttttacgtttgaagtccctcacttcttccctccacccccccacagacggagtctcgctctgttgcccaggctggagtgtagtggtgcaatcttggctcactgcaacttctgccccctgggttcaagcaattctcctgcctcagcctccttagtaactgggattagaggggtgtgctaccatgcctcactaatttttgtatttttagtagagacagggtttcgctatgttggtccgtctggtctcgaactcctgacctcaagtgatccatccgcctcagcctcccaaagtgcaggaattacaagcgtgagccactgtgcccagcccctcatttctcttaataacacaaatctataggcactttaaaacaaactatccttatttatattgaccaagcacagtggctcacacttgcaatcccagcattttgggaaccgagagcaggaggatcactagaacccacaaatttgagaccagcctgggcaacataagaagactccgtctctacaaaaaaaaataaaactagccaggcatggtggtgcatgcctgtggtcccaattacctgggaggctgggacgggaggattgctgggcactggaggtcgaggctgcagcaagctgtgatcacgccaatgcactgcagtcccgtgtgacagagagacactctgtctccaaaaaacaaacacaccccctcccgccccaccccttccaaaaaatatatatgtatctcctaactggagaaacgtgtggcatgaactttttcttactcagaatactctaaaactcttacttctttctagttccacagaccttgatgagtggccaccttttagtgtgctgaagaaataagagtaactgcgacatgatccctagccacaaggactttagctcaaagtccaggagagaagacagataggtacactcataaaaatagcttgtgttgactaatgtgatgttttaacacctcccagatctcataacatcctgggctttctaaatttgaaagagaatcctggtgaatatactcaattagaaagctttttctatttctgctgtaacagaggaaaaagaaggggaggctcagaagggattacagcatgcttttggtagaaattcccatggaacttcatttcatgagacctgtgctgatcagatcaaagccatgggatcagaacctatacctcacagatagtatctggaaaaataagaagaatgaaagaaaaatgaaccaagatcaccttccttttgtgggcctagccccacttaatttcataacaattctatgaggttggtattacccaaattacagtaggaaaactaaagttccaaaaatttgagtagctcaagtccacaaagcaagttggagctgcaattagaattcattttccccatttgaaggttctgaccaggtggtctctctctaaattctacatatccttgaaggcaacatgaacatcagagtaatccaatcccattatcagaaatgaaaatattatgcacatcatctttatacaataatcgtagtaagaaagccagtggcttgccaattttggaaaatgattataaacctcaattgcaatagaaaaaaaaaacagaaaaataaatatagacagaataggaaaatctttttgatatcaatgctataatttacagcttacaatttttattttttattattattattatttttttccgagatggagtttcactcttgttgcccaggctggagtgcaatggcacaatctcggctcacagcaacctccaccccctgggttcaagaaattctcctgctgggcacggtgggtcacacctgtaattccagcattttggggcactgaggcggacggatcatgaggtcaggagatcgagaccatcctggctaacacagtgaaatcccgtctctagtagaaatacaaaaaataagccgggcatggtggtggacacctatagtcccagctactcaggaggctgaggcaggagaatggcgtgaacccgggaggtggagcttgcagtgagccgagattatgccactgcactccagcctgggctacagaacgagactccgtctcagaaaaaaaaaaaaaaaagaaagaaaaaaagaaattctcctgcctcagcctcctgagtagctgggattacaggtgaccaccactatgcccagctaattttttgtatttttagtagagacggggtttcatcatgttggccaggctggtctcgaactcctgatctcaggtgatccacccaccttggcctcccaaagtgctgggattacaggcatggagatactgcgcctggccagcttacacttttttttttggtggggcgggggggggatttttaaggagctaacttaatgtgcacatattaatgtgtgcataaatatcacactttcatttccaaagagttataaaatgctgacatcaccagtaaattgatttcaaaattcaaactgcaatcatataattttttgaaaaaaacacaaccaatattcatatgtaatgaacagattcaaacctatctcttatcagcaacacttccagagatgtaaataatacctgctacactcaaacaaaaccatcttacccccttttacattgacttctatgagtcatgtagctttaaaaagtgtatgctattagattatctgtaaatatccagcaagtattgacaaagccttcctgaaattaattctatatgtttaagactagccaatattttaatttcataccttggctggcttaagagatgacatgatcactctactgtaactacctgaggttctgttctgatgttttaatgtgttccatctgattaaaggggttttaatagaagatacttagattactgttagaaatatattttaaaaaccactttgcccaaattaagtactcaaacacactccctccacttggctactgtactaagatttactataatggtgccagaaatacatttgcactgatataacttatttgatggaaataaaaacctaattctgtcataggagtaagtaggacaactaaaatgtaggaagacccatgaattgcctttgttccatcacaattacagtgacaaaaatatttatgttaagagaatagctgctgatactgaaagaagtgggaagtaggccaggcacagtggctcatgcttgtaatcctagcaatttgggaggccgacgcaggtggattgcctgagctcaggagttcgagaccagcctgggtaacacggtgaaaccccgtttctaataaaatacaaaaaattagccaggcatggtagtgcatgcctgtaatcccagctacttgtgaggctgaggcaggagaatcgcttgaacccgggaggcagaggttgcagtgagccgagatcgcaccactgcactccagcctgggtgacagagcgagactccatctcaacaacaacaacaacaaagttagaagtaaggctttaaaaagatgaaaatagaagctgggagttttcacagactccagcttatttggagatacaaaccactgcacctacctacccaatcaatactaatgaacactataatcactataatcaaacaaacaaagcaactacacatgaggagagaattaaactattatttagaaagtttcactagttttctgtgtgggtaattttatttgtgaatggttaaagaactttgaatagctttttttttttttttaaggattttgctttctctaatatggatttggttagagctcacctcatatcttaatcatcacccttttagatataagtttatgaaataaaacacaaaacgtctttcatggttattcagaacttgatcttactaacagttccaacgagtgtggtctgctcctttcctgaaatttgtttcatatccacagtccttccatttcaacttagagatgaacctttaataaaatatacaatgaaggtgggcaacagtggtatgtatggcgagacaaggcaaaatgggtctaaagagaatctgtattccactgaatgcactaattcagtctagtgtactcactcttgtatgttaagttctacataaattagaaacctaaatttcaaacactgcttggggacatgtatgctctacaaaatgaaaatgctatgcattttgcacaaggtcatgaaagtccccaattgatttccccctgctcttcatcattgacaccactttaaactcaaaagtatcatcgtgttttgtctttttctttcatcaacatcctgttcacatgtctaaccgatttaggatttagaagcacacatgagtcaaggatgccaccataccactggaatagaggtttctttagttaaaggggaatggtgtgagaggtgaacaacagcaaccacagtgctgctcccatttgctccctccaccacaatcctactccgtgcagacactgcgtcaagtctttttcatggtaagcacttttgggaaaacgctaagctaaccccacattcactaactctaaaatgattctgatgaaacaccaaatacaaaatttatatgccagtagaattttaaaagccccccacctttttttttttttttttttttttggctttcatggagaaaaccagaaagaatatgacttacgtatgcaaaaccatagtacactaaagcccagagacactcaataatcctggttaatcctggcccactgtatttatgcaaagccaatttagtaatggaagtaaagcagtagactcaatacaaaataacaatcaaaataatatctttttgaccttgtaaattattaataaatattaataaaacatgaaatgtatatatgttctacaccaacggttatcaaaagaccacctgcactagatttaaatgggatgttgataatagttcttcctaggacccagactggactcaatgaatcaaactctctggatatggtgtcccgaaatatacattttcaaagagctccccagatgccttatatgcaattaagtaccgctgactgaagcatgaacagtgtttacacttcctgatcacaaagatgaaataacactgtgagatggaacacaagtgcttaagcaaaaaaaaagtagccactattcatagaacaaaagaacggaaggaaagtcagagaccactgtccagtgaaactaactaagaccacagcttggttttcaaggtcaccaagctagttgttacaccacttagacttgaaaacagatctcctcattctgcttggtgcccattccagcatcctatacttcatctatctccacaaaacaaaagcttgaaaatactagttgttaaaatgtcacataatgttttgtaatatctgtatattcagagactgaaacaatactaccgttgtatgtttatacagttctttgccaaccaaaaaaaagtgcttccaagtttcttataatctctgacatacagtgtaaggtagccagggtagaaattggcatctgcatcttacaggtggaaaaacgagatttccagaggttgactgactcctccaaggtctcataggcctaacagtggagccaataacccaataaccaacgtctttccattttccatattccaaagaagctgtctgctttccatttacacctccctgaaatctgtaaaactctcagctcaaccactgactattttccacttcttaaagatttagtcctcaaagatattattatgaaatagatgttgccctctgcaaccagagtctctgagcagatacctgaaaaattccaggtgttaactacatcttatctccattgatttctatgatatagctggcataaggtttactctgcgtacaaatccagcagatacaacactgctgtcgagagccagtgttcattgtattatcagtttcagcctgataatttgatatgacgggtgtgaggcacaagctacaagtctctccttcttaaaacaataattgtaagcctttattcttcaccaggaatatcaaggtcattgtctggttcaaacctaaaagggagcttccatcaacagatgtcataagagataagctccaatttgacacgctcttgcagaactatcacctgctatcagagaagctatgacagctgtgtagtaagacaatgtgggccaattcatcagtcctctgggccccaagtgctcccctaatggatatgacaaacatatgccccactgccacacactggacgtttactactgcagggctgtttgtataacaatccaattaatcaaggtagatagtcatattttttgtaattgatggaaagctagaattgcataactctattgaatgactacatcttttgccatagtatgatagactttggaaagaaaaaggtagactattgcacacaaaaaaaatcctgtggcgatataaacaacatgcccatttccttggctttgagatgatgttaccattgccatgtagggccttctccctcctgcttggttaccttcttcaaaggttatcttcctcttcctttgaaagcctcaattcaaacatcaccctggatctcaagctcccctgcttttagcgtctgagtggatattttgaagaaagattcagactgcatgggcattaggatgtcctaaaaagttcagatcacctcattttaagaatcagccactcttcagcatcagctgaagcccaatcagtttctcttgattgggcttgggttatcgaacacgctctaaaggaacacactctaacagtcatcacgtctttagtgtttcaagagaagtagagatctgaatttttatttgccattctccagtttttaaatattggcaactatttgaattttggttaccctgaaagtggagcctgagaaaaggacttgcagtagttttcttcagaactaactctaataatcaggagagagaaaagtgggacaaaggaagaataaaaatcaaccatggggtcttcgtgaggtctcagaggctcacagtcttccctgtggatgagggaaggcaggggcatttatcctccaagcccctttcccttgttggctatgagttcgtcctaggggcattaattccactacactttccaactgtacctgctgaagtgctgactgagcttcctcggtttgggagaaagccctgaacagaaaggaaacaactgtgcccaggcagggtgcggtcagcattcagagaatcaccactgtgagtgaaatcgaagttgaccaaggggatctgacttacggcacaaaaagcaactactccagcaactaagaaaaactgtaaacatagtgcaggtcaaacaattaattaatgggcgcagtcttgatctcactcatggactccatctccttttcggcttgagagaacccttcccgacaacttcccagtaccaatcctttacagtaaagctcaacattctaccaccaagatgctggcatttataccactcaacttcaccatttatagtcaagtccattgacccccctaggctatgagcacaacctgtttatgacctccagcacctgggttaaggtaggagtacaataaaaatctgccaactgaattagtccctggaaaaggcccatcagtgtttgtggaactgaataaatgaatataatttttaacaaagctctgttagctataaccataacccaagcccaatcgggaaacagtcctgaggtcactaaggaacagaacaatcattcttaattcctgctctaaagagccttattactcaaatacattaatcactgacaaagatgaactttttttttttctgaaaggctatactgcctcaactattaaaagtatatattctcaacatatgtgctttttcatatcactgaaaaagtctagaaaagtatctttgcccccagaaaaacaacgcagtcgtaattcaatttcatctcttgctgttactgaaactggatttttcttacatgcaacctagaaattcaccttgtttcctatgcacactcttcttgatatttccacctttcgctaaggatctcagagcatttcccatctgaaagacatccacttgggtggggacttgaggcttgtgaggcctgagtgaagatctgcacagggaagcttcgaggagatcaacacagatgggggaattctggaattgtgaaacattccataaagatcaaggttctccttataccagctgagtggatacttgaacataaatagcagaggagcaggctgcatgttcctatcctacatatggcacaaacaaaagagaaaaaataagtactcattagggaaagctaaatgtagaatggcaagatccccaacagacttccattctttaaaaaagtgaaggaaggtcttctgtgttaccaagctgctacattatttctagcaattatatatatgcacagatagatgtacatatatatttataggtctacacatgtatacatatatattttaaagcataagaatctatataaatgggttcttatagaaaataatgtcagtcattcttggataataacattacttatagacctaggaatagttgggtaaagtttccatgtatctgctaattaagaatcccctgctttggtaaacttatatccatcaattcccacttattttttactctcaaagggagaaataatttccgtagatgataaagttatttaatatattctgaaagtacatgtgcaacgacttaagaaagatcaactaagagaggcaggggttggagaaaatttgataagagttcaataaactgacttcattccaaccttccaatctttagtccatgttgaccttcaacccactgtatcaaaggaattagccaatgccatagcaaggtgacaaaccttacaaactctggagaggaggactcggtggggcttgaaggctaataaaatatacaaactttttttttaaagacagtaatgatcttggacttacctcagaaacattgtttagaaaaagatctagttgcccacatcttaaggaaaacagtcttgagtaatatgtaacatagcctgatgcaaactcaatcctgtcaaaataatctaatctctcctgatggagtgactagcccagtagatcaagggaagaagcaagacacaatttatattcggatttttacaaagcttttgcttccgctcctcatgatataatcatcaataaactgagaaaataggatctacactgcatagctatgaaatggcaggaaggtcatgcctggcagggcgctatcggtggaaaagtgtcagctttagagggagtataataaatggggctccaatgtgttcaattctgggcagtactccagtggacatttttcattaatgacctggagggtagaataattatcactgttattaagtctgcatatgagaccagacgaggaggaagcattgaggaagggcgggggggcagaggctggaggaagaggccagagggagtcaccagccacaaaggaatagcttatcagaattcaaaaggacctcaaaagtttgaaaaagaagctacaaacagaatgcatcttaggaaataagtacaatgcatgctattccttttccttctcctaacgtttaccacagctcactgctacagccttgacctcctaggctgaagcaatcctcctgcctcagcctcctcggtacttgtgactacaaggcacgtgccaccatgcctagccaatttaaaaatcttctgttaaagacaaggtcttgctttgttacccacgctggactcaaactcctaggctaaagcaatcctcccgcctcggcctcctgcagtgctgggattacaggtacgagccaccgcgccgggccttcctcctctctcctttcatgagctgtgaggctcgcttctcttaaaaaagggccacatttactcatttgataaatatacaagagatgctttgctgagttcctgagctactttgttaagcaatacagttctgctgtctaatatcacagaaagaattggcttactgaggaagaaatttaaaagaaaatgacaacatcgtctgagaagtcttctttggtcctggtccaccattttcccctctccgagtctgagttagttatttctcttaggtgctttcacatttctttcggccttcctctgtcacacaacactgaagtgtaatcaggtgtatttatttttctcccctctaaattgccaggcatgggccatggattctgcaccttggtatctccccagagcacagcacctgacacataatgatgctcaataaaagtttattgatttagaactaaatacaaattatacacataataagtggctttatgcaagtattttttttttaagcctagggatgccatcctgaaactcaaaagttaatgccctccctatagccagaaagtcaaggctaaaagtaaagagcagggcatcttctgcatatatggtaatttcatatgcggctatgaagtgccctcattcacatctacagaatgcgtgagggcagacggcaagactaagcaagaatgtcttcacggagaacgctttaagtgaaggaaacagaggagggtgagaaggaggggaagaccccacagaaggaatgttcaggaaaccaggggcggctgcaaacctgaagctgagaccaataggaagaccccagaaagggtgaggtcaacagcaccaaagacggcaaagaaattaaggaagaagacatacctgaggcggaaaccctaggtgacacgagcaagtcaaaatgtgttgaaattgtgagtgaaaatagaagacagccatccaagggcagagataaaaacaagggcatgagtttggagagcacaaaccatctgtgacgtagattatgcgatgatccaagtataaccaaggatgaggaagaagtgaggtccttcactggaaaagtggtgccatacatacatttacaaatagtatggattatacaactagtatgagatagacaaaggctacaaaaataataaagttaacttagaagaacccttaaccttaataagaggggagtacttccatggttgaaacttgttttatttataatgtgcattcacatagctttctggagaagagcgttcatatcaatagaaagtaacttagaacaaatgtgcaaattttgtctgaaactacctcttcttattcaataaatgctgttctcaactatagccaaatctgtctcagctttattgtggctccaattctggcagtggacaagaattgtcatatctcacatttaaaggtgacatcactttatataatttagttttttttttttcattttctcttcatttttattgagaaaagggacagtgagagagaaatgtggaaagaagatatagagtagaagcaggcatttgaaaatttcacatctgatataagctgtttcccgttcttcaaatcatgcctctgctgctgctactgtcataaatttaactggcttacctttaatcacagggaatggtaggctactgaaacatacattttccaaaataatccacaaaatccaaaatacacaaaaataaatattgagatgagttaggctcaaaatgtgatccagtctttcccaatagtttgtttaaccagcagggtcatttcaggcaactcagatgaaaggattcatttagcaattgaaaatgagcatccattagcagttacaaaaatttaaattctaacatttactcatcaaaataaaacaaaaactccaatataatcatgtcacattattatatacaaattttgtcactaatcatggggtcaaaagttagaaagtgttgcaatctttaaaatattcccatcagtttgagattatgggttttttttccctcatctcctgcataaaattattcctaggcaacttttaagtcactgtataactggtaccaacagtgttgatacaattctttagttaaagtcattaagtctgttttggaatatctgattccaaggacctaaatcaaggggtgaaaatgaaaaaatgcaaacatgcggctgattagaaaaatggttataataggccttactgctgttattattgaatgtacaagtgaaataaccattagcctgctttaaccactgaaaaacaccctatggtggtacttgagtgatttgatgcatttttgtacacaattgctgtgctaacagagcagacatttaccccataacaaaggaaatctcaaatgtaagccttagggtttacagcaattccagaataccaaaccactactaaggattttaaatgaaacccctgctgatctgtttactgattaaaccctttgtctcctcaaaacagtaacatcattcacaggacaaattattgataaattgcagaatgtcaaacaaagataagcaggaaattaaaaatccataacagacattagctttaggaaatgcacttaacagaatatgatcattggtctagattcacttttttctttgtgtattttaagatataaaggtctgcgagaggctcctattatcactgtatacagaagaacagaactgcttcagctatggaaagaatgagatgagccaagcactcttttgattgttgaggataatctataaacacaagacacaaagttgaccctgaaagtgatctcctctcacctcctcacaagggatggcaagctagcagtatcgttacagggcacaaaacagcgtttaggaaaggttcctaaaggaaatcattcttccatgcaaccatgttgccatggcaaccaaaccaatcaagcttcttcacaaaggcttttatgtcaagttctgttagcaaactcatatagaaagtataactcaactaaattaacactacatttgttaccctgttagagatggaagaaaggtacaaatcctttaaaaattagagaaataggcactctttccatatcaacatgttaaattactcaagttcagtctttttacataaacaaaagcctcttgaagtctcttctttaggaatagaagaagaaagggaattttacctagcagtacaagccctttccaaaaatagattctttcctcaccttctaaggaatacaacaacagaattcttgcatcttgctgaatcttttattgtcatttctttgcaaacctgtgcttcagatacatctgtgttataagtgtaacttacacggaagaaatcctagcatttaccactcagcatttttaaggcaagtagaataagtgaatcaacaatatgaacccctttgattaaagaatatttttccttcggtatagcatgatgaagctgtaatatcaattacggccttaaatttgaaggccattttatgttactgacatagtttcacactagggcaactccatttctatgacatttctcatgctagttaaattcacttcttaaaagcaaaacaacagctatgagcaagagctttaatgaaccttagtaatctgacactcagctccagagccaatggattttataagaaatggacaccatatcatgttgaataaatctttcatattcctatctttaattttatttagaaatagtaaaagaagttctatgttctcaagagtaaaagttttataatttagatgtagagaaaacacacccagcctggacaacatagtgacaccctgtcattacaaaacaaattgtttttctttttttaattagctgggtatagtagtgtgcacctgtagtgccagccagctccttgggaggctgaggtacaaagattgcttgagctcaggagttcaagaatgcagtgagctgtgatcacaccactgtcctccaccctgggtgacacagcaagcccctgtctctaaagtaaaataaaataaaacaaaacaaaacaaaataaaatataccttctatcaatttcatagaatggtaaaatccataaaatacctaataagcatactgattatgggagttggtagtgtgtctagcctctgtcctaacaaccatcttaaatttcaagtaggtttcttcttcttggacttcttggtagaatttcaagattcctgatgaccagattttgctccaaaacatttgacaactaagactgggttggaaataataaccaagataaatttggatcaaataaaactacagttagttgctcaggggtttttaaaaggcaaagcatcatcaataccattaaacataaattttacaacctgagcttccaaattgcctgttataactcacggcttagtgggaatattttcagggcattttagatagagttaaattgtaactcttgaatttcaattgaactacaattaagagcatctgaaacactgtataaatcaagattatccattttaatttctaggtgtttgatacatcagaagccaaaggtttaaagctttggaaaatatcactttaattgactttaaacataaaattgtatacctcatcctaattaaatgatagcattttacatttgtgtggccactggaaaatttacaatctatattctctgcctcaccttatttgattctctctacagttttagcggataggcagagagataaaagaagaaaatagggttaatttggtttaataacttatttataatactgcctttaacaataataatagtaagattaatcatttagtaaacacttacaggccaggtagtgtcctaagagctttcttcctcattgctaatgtcatgatcatatacaaatgtcttcaattctcacagtaattaaggtgaggttattctcattttacagattaaaacactgagactcagaaaggttaagcaatctggcaaaagccacatagtcaaaaagttaagtctccagaatgcaaaatcatacctactgaattagtattatattcatttgcctaagaacagaccaaatacttagatgtgcttcttacaagagcactgcttcttacgcacatatttaattgttactaattaatatttattgcatttataaaatttcaaataatttggctttggtaatcacgattttgaatttcaaatcatttggccatttttgatatcaacataaattcagccattctgaacacatagctgtttgttcgtacaacagatttaaacaattactcccgaagagttccccggtaacatttggaagaatagagaatctggtaactaaccaggaaaacgacatagcactctagtccactactagttgcaatgttcgactactgggttaaatacaaaatattgccatgtcagaaaaaggcataaaatgctagaaaatgatggtttaacaagagatcaactttcaaaattaaaaacataaaaatgtatccttaacgttgttaggatcaaaggaaatcactatctttggtgataaattaaacaccaagcacttactctgtgtcttgagtattccattattaagtggaaacaattactattatcaaagtttgtgacttacttgacatgcttgaataaataaaacatataaactatataaaagctcattctaatacaacatatgtgaggtagactgatctgtttcatattcatatattaacttatattttattttattatatttctctaatataaaagctctttggggcccagcacagtggctcacacctgtaatcccagcactttgggaggctgaagcaggcagatcacctgaggtcaggattcaagatcagcctggccaacatggcgaaacccgtctctaataaaaatacaaaaattaaccaggcgaggtggcacatgcctgtagtcccagctacttgagaggctgaggcaagagaatcacttgaaccttggaggcagaggttgcagtgagccaagattgagccactgcactccagcctgggcaacagagcaagactctggatcaaaaaaaaagctctttgtgaaacttggggcaattattaactttctacattacattttaggcactttcaataaaatgtgggagattgttagttaaagtcagattcctttgtgacacagcatcgtgaagttgttgatagccggaattaaccagataattccttcaactgacatacaatcagagagcacaaaacgagctgaaagatcacactggggctctcctgtgtcttgttctccttgtccacacaatcatatgctcaggaagctaagtattataaaagtatgacatcccctgacaattgagttgagtgcccttgtttcaacattcttaaagtagccattcacagcagacggcatcacttttgaggcaacatttcagacattctgaaatttcattctctgtttgtaagagcagagaaaaagatataaatcagaatatgtaacaataacataggaaactatttgctaacactttctatatatacatatatgtttatattcttaaaatatatgcatatctgtagctttaatataaccacaaataatacaggtgcaattctgatgtctactgcacagatgtgaaaactgaggcacacatagattaagtaatttaatgaaaggtcactcagctagttaagtggcagagctacttactgtactaggcaatctagctccataagccatcttttcaacctaaatttaatatgaggaagagagtctctgctctcataacagctttttattgaagagagtatatttaaatatacagaatatatttataattttaataaagcctgatcatattcattagttaattataaaatgtcagaaaaaatattaagaaagtaagtgtttggtgtttcatttaccatcaaagacagtgatttcctttaatcctatcaaggttaaggatacatttttatgtttttagttttgaaagttcaactcttgttaaaccatcattttctagcattttatgcctttttctggcatggtaatattttgtatttaaagaaatcaatttctcagcgaacgcctccttgaaattaaaatatatacatactacacaccacacacacacacacactttttgtgtatgtatatatgtctctggactcacacaagactcaaagagtagagtcacagaatacctctatattatgttccactatccctttacaattgcttaatggtgaaagttcttttctactccctacacgacaagtcaaggagtctacttatttttctaactcttaataatatgatgtcatacaatcattttaagttatcaaacacagtcccaattcagaaattagagtgcccagttcagcatattagtcgcacttgaaactttcaacttatagccacctccctttcccagctagggttggctatagaccagcatcagaaaataagtgaaaaaaggtatgatcagccccttcttctcctttttcacctcctctgatccctctgctcctcttgataggtattttcttgaactatggggtttaagtagtgagaaaaaggaaacaatgggaataagaaaattcttagatgatcacagttggtagctggccacatacatgctctctgggtttggcccatgtttacagccacctctctctctctctgtctctctctctctctcacatggtaagctcatggcttcttcagaaggcactcactcctggactcctgttacctgctgtgctgaatgtgggtgccatagtctaccccacgcatcactcactccttctacaacccctaggaattcaaggtaacttctactgcggtttgtttctttctcttagcagctccttggataaggcccaagagggcatccactcttgtctgcaagaaacatttagaaatccccctttcccctaagagtggaggccaatcccaatgcagtcacctcttctttcctccactttgtgagaaacaactaactggcctggctcttgactgttttagactttctaagtagaaataacaacatccatccaataagttccttcaacttcaggaaacagagtctcgctctgttgcccaggctggattgcagtggcacaatctcggctcacggcaacctccgcctcccaggttcaagcaattctctgcctcagcctcccgagtagctgggattacaggcaactgccaccatgccccactaatttttgtatttttagtagagacggggtttcaccatcttggccaggctggtatcgaactcctgacctcgtgatccacccacctcggtctctcaaagcactgggattacaggcgtgagccacccatctggcctgaaaactaactctttaacaaggcaaaagtctttaaatattctgtgatcatagacagttacaggatttgttgccaccactttggcaaacatgaaagtcactgtgaaagcagaaaacacatttttagtggttttggttttggttttgttttgcttagtaagcatttttcagtctccattatttcataaatgcacaaggggctacacccttcttatgtttcttactctgtaccaagttgagtcactgaaagtttcccccagtgatttagtatatctggtctctttgatttttgcccctggaacattcatccatgcccaggtaatgtctgccttagaaagggctctagtaccctaactgctatcaaagcaaactcagatagagaaataaaaggctataagaactggaaataaaatgttaaagtacaaaccaatataatcatgtgttctgacagagaaagtatactttaaattgtgcacagccaggcgctcactacaatttggaaattctcccagagagagtagaactgttacatttataccttggttggaaagttaaggacatggttgttgaaggctaatgttaaaacgctaccacaggagaagggatgattcactgagataaagtaattatggaagtcaaacacatgcttacaagtacagtatcaataacaatattattgaggacttatttgtgttatgcattatacctcacagccttcggttggggctattatttttatacccaaattagacataggaaaccaaagctaacagagattaagcaatttgcccaaggtcccgcagctgacaatggaacagaactggaatccaattctgttaaacttcaaccccctcccatcccccaaaaccaccagtgctgcagtcatttacttaagctacggcaatttaacaggttagaaagcagaaaggattaacagatttccattcctccaaactaagcccagtgttcacacagcccacactggaatctttcgaaaataacatttctggtcaagtcagtcctcggtatgaaatcttccaatgctttcccatctacagctgaagaaagtacagaggatctagtaagacatttaatactcagggttctgtttccattttactcaacagcccacaccccacagcctcttcttgaagccctcttctctcccggtattctactctactttaatatcctagttttcttcttaccacttgggcctgttctttctcaggctccttagaagtttcaccccctttgcctgacctctaaatgttcagtgttccactgaaccccttcttaaaattcctggatgatttcatcccttcccacaaagctttaattgccatctttggtttcaatgattcacaaacttttaactcaacagcaattgtacctttgaactacagaatcatgtaatacatagcccttccccaccttgcatgcttcatggaaaccttaaaccaatagtttccaagctgatttccttatccgccagcaagtttatatgccagccttccccatctcaagaaatcacaccttagctgggtgtggtggtggcgcgtgcctgtaagtcccagcagctcgagaggctaaggcgggaagatcacctgggccagggaggtcgagactgcagtgagctgtgatcacaccactgcactccagcctggggaaacagagtgagaccctgtttcaaaaaagggaagggaaagggaaaaggaaagggaaaggaaagggaaaggaaaggaaaggcggaaggaaggaaaccattttgttacaggaaaggagtcttgatccagaccctaagggagggttattggattttgcgcgagaaaagattaacggtgagtttgcagtgcaaagtgaaagcaagttcattaaaaaagtaaaagaataaaagaatggctactttatagacagagtagtcccaagggctgctggttgcccatttttatggttatttcttgatgatatgctaaacaaggggtggattattcatgtcttccctttttagattgtatagggtaacttcctgatgttgccatggcatttgtaaactgtcatggtgctggtgggagtgtagcagtgaagacaaccagaggtcactcttgtcgccactttggtgttggtgggttttggctggctcctttactgttaccttttattagcaaggttttcatggcctgtattttgtgctgaccttttatcttatcctgtgacttagaatgccttaatcgtctgggaatgcagcccagtgggtcctagcctcattttacccagcttttatttaagatggagttgctgtggttagcacacctttgacatttcccctctcccttttataagagaacctttgatcctaagggttgcccagggacaaagatctattttttgtaacttttttaggccaaataggggcgatgatattttggcctaactatgggggtctcttgcattcacggtagagaagagcttcgttagaaagtgttagtatggtaaggtttatttataacttttgagttttgacaaaaggtggtatctgtaagattagttaactgtttaataaaacattcagtaagcttgttttgtattcttatacaaagagtataacagtaatatatttcacaagagtaaagcaaaataagttattttaagtaaactaaattagaaggctttttatgaactgggcaactgttggaactaagctgataccgggttgtcagctgattgtaatgtgcccagaattagaatactgatccagatttttacattacttattccttttggttttttttgagcagcagttagagatcactggttggttcacaggaataagcagggtttgctgaaattgcagaaataagcttagaaacaactaatgagactagaatttaataacaagtatagtatagttcttgaaacgtagtatttttcccagttttccattttcactaaagataaattatggtaagactgatttgctttattatacttggcctgattatttgtataaagtgcagtaagaataattattttttacataggctttttaaaaattggctttgatggaactttgtttcatagaaggaattttagataagacttttttaaagctgagccctgccatgagtttgtacctttaaatatttatgagttgggtaaatttctttctttttgaggtcccaagataacttgtggtttctggacctgttagaaagtgatattttttatttggcacaggttagaaaccctgtatagggactgttttaggcaaggtatgtggccagttttctaaagggtttttattggctttacaagttaagtttgataacttaaaggaaagtacaccattttagttaaagccttggtaaaataaccaatttttaaaattgtgtcctgtgacaaaagaaaacagatgtttattgcactcatgtaaataactatattgtcataagaatgcttacaactagtttttaaaattctgaaaaaatgaggtagagagaaataaatatgctctaaatttttttataggagtacacttaactgttaaaagctgtaatagcttaaaagaaaaggttccttgactttgaaaaataaaagattagcaacgttttaagcaaagtttaaaagagagggttcttggattttggcaagaaagaattcatggtgagttcgcagtgtaaagtgaaagtaagtttattaagaaagtaaagaaataaaagaatggctactttatagacagagcagccatgagggctgctggttgcccattgttatggttatttcttgaagaaatgctaaacaaggggtggattattcatgcctcccctttctagaccatatagagtaacttccgacattcccatggcatttgcaaactgtcatggcgccagtgagagtgtagcagcaaggatgagcagatgccacaattgttgccattttggtgttggtgggttttggccagctcctactgtaacctgttttatcaacaaggattttatggcctgtattttgtactgaccttttatcttatcctgtgacttagaatgccttgtctgggaaggcagcacagtagatcttagcctcattttacccagcttttaagatggagttgctctggttcacaggcctctgacaattcacagataaaggcctgtatctgtcctcaatttcttcccaatcttcctcctcctccacacccttaactcaatcagttggaaatcctgtagtcattgccaccaccatctctcatccagactacctataatagcttcctaaatggccttcctatttctactcttgttacctcccaatctattccttacaaagcatccagaataatttatatattttttaaatccattgtttcacccctcagcctacaatccctcccatggtctcctattgtgccttaaatgaaatccaatctcattaccaaagccctgagccatcagacctcctgaccatttttctccaatcttaatcacttttgactcacccagtccaccaccctccagccctgctggcctcccttccgttcaccacacagttatttcctgccttttatccttcatacgtgctgataccagctacccatatccaactgattccttctcatccttcaggtctttacttaaatgtacaagaccaagattccaagactgcaggcaccatctttttttttttttctatatagtgcttatccaatttgcaattgtgtattcatccattattttactctcctgctggacggtaagccccttaatggcaagcatagtatctcttctgatcaccagtaaatgcccagtgtttagcatgatgcctgacaaacagaagaaattctacaaatattaaaatttagagccttgcgtggtctggtctctgacaacttctcccaactctctaaccccacacactggttctcatcatatctttaaaaaagcttatgggatacccaatgagcacgattccttgacacatgtttctccttctgcctgggatgctctttctccccttgtttaaactggcagatttcttctcactctttcagtcaaactctagtgtctttctacccctacacacacacatataacacacacacacactacacacaccctcatggttcagagtagacttgattaattcctcttctctaggctcactacacttctgataaaatattatcatactaaattgctaaaaaatctgtcctcctatcaatctcctttaatagactaactaagctcactgagggtaaggacaacttctaattcatatttcagtcccccaaacctagggaaatctatggtaaatagatacgtgactcaacccatcaatctatttgttattgaaaaaattttagttttagaccaggtgaggtggctcatgcctgtaatcccagcactttgggaggccaaggtgggtggatcacctgaggtcaagggttcaaaaccagcctgggcaacatggtgaaaccccatctctactaaaaatacaaaaattagccaggtatggtggcgcacccctgtaatttcagctactcaggaggctgaggcacaagaatcacttgaacccaggaggcagaggctgcagtgagccaagattgggccaccacactccagcctgggcaatagagtgagactctgtctcaaacaaacaaaaaaaattaggtttttgccacagaaagtaaccaaattcctttttttcccctcataaagtaatcagctcatcatttatatttcaaagcagagcatgcctttaacctatagggtatttatcatgtctcatcactcaaagatttattattgtttactagtgattattaaaatttatgaattaaactaaatatggatgtaatccaattaagacatagctaaatgaacttgaataggacctattgaaaagaacaggcctgaaatcatgtggatgagtatcttctctgaaatatctacatttttatattaatataatatctcaaagcacatttaattagtacttatcaccatcccctaaacaataagataataatatattcaatactgtgttgggcactgtttaatctgtttggcttatatgtatattattttaaaaaggaagtaaatcccataaaagtctacaggttatacaatccacagatgaagagctggatgcaatgattatgaagtacacagagcttgatggaaagagaatcatttctgtcttccaatggctaatttgaaactggtgatactcaaagacttgtgtttaaacatgactatgcacaatggactaaatgtttgtatctccctaaattcatatgctgaagctctaatactcaatgtgatggtattagaaggtgagcctttgagaggtaattaggtcatgagggtggatcccttgtgaacaggaatagtgctcttataagaagaaacatcacagaaatgacttctcactgccatgtgaggacaaagcaagaaggcacctgtctgtgaaccaggaaaaagaccccaaacaggaaccaaatcacctgacaccttgatcttggacttctggcctccagaactgtgagaaataatgtttgttgtttaagccaccctatctaggatattttgttgcagtagctcaaagagactaagatgttatgcttgttagtagtactctaaggcaggcagaaccccaaattatgagttgctgctgaattgataccaggttctgtagcagttgaagaactagttatcaaaaagtgagaaggtaactgagagtactattatctacgcatctctaaaaaacatatataataaattgttaagtccatgttttttctggattcattataaagctttaactttgcaacagaataacattaaatactccctataaaatttgtgaaattctcctctccatgtaaactcagacaattcaagccatggcagatttgttattattttaaaataacttagggtgcgttcatcttcacagcatatgtggacaacagtgttccataaaatgcagtacttgaaaaagaaacacatattcttggaaatactctatcacactgtgccagcaatgccatctatcatatgcatccattttaaatttactgttgagagctttccaaattaaatagataatcactactaatgtttccttaattgtccatgtaaattattttatttttataattgaagtatagcttatataagtgaattgcccgggttttaggtgcagctggatgacatttaacaaatgttatgtctacataacccacatccttatcaagatatacaacatttccatcaccccagaaagcttgttcatgtccttatccagtcatcctcctcttccctcactcccagctcccttccatcctatgccaaggcaatcactgtcatgatttttgtcactatagattagttttacctaaaaaatcacagagggaatcatacagtttgtacccttttgtttctggcttctttcacacaatatactgttctcgagatttatcattttgtgcatacatcagttcattacttttgtattggtgagtagctctgcattgtgcatttaaaacgtgacttttttggaaggttattataatcctatggaaatctttatcataacacacatcacactgggttagaatttcttggtgaactggacttttccccctgacttgcacacaggttgttgtccagcacttgacagagcatcaactacctcctgggagctcggttactaggaagatagtacacattaatgcatcatcctctagagatatattttgacagcacagaacaatgaaacaaccatagaatcagctgactggggacaaacagctcagtctaccactaataaccataatcttcagcaggtcatttacccttcctgaccttcacttttataatctgtaaaatggaaataacaataacatatcagaaaactagtatgaagattaaatgctattacttgtatgaaacctcttcattaactatataattctataaaacattattataatgtagctgagacaacagacctttcagaaaatatttactgggtaataccagtaaacaaaatttgaagattaaataccaaagtttgaatctgagtctttactgtgttggaatcaggcattgttctagtctccttacatttattaactcttttaatgttttaagcatcactatagcataggtactgttattatgttcattttacagatgagaaaatgaggcaaagcacataaaatgacctgctcaaggtctcacagcttacaaggggagagcctgaggtattaactcaagcacttgggttccacagtccaaactcttaagtgttttgttttaccccttttctacagcttgcttagtataaatttgcaaagattattttgaactctagcacttgagggaaaataatcaaaggattaaaagatatgagataaattttatagaaattgtaagacttctgggcactctcaaaagtccacaagaaacaaaaaatcttgatattaagaaacaagagggtaaacaagaaaggaaagtggagaatgggcttcagtcatcgaatcatggacagatgagaggtttcaagcacaattaagtgctctgtgaccaaacagaaaagtgaggaccatgatcatctcaaaactccttcaactccccccagtgaggagtgtgcagcgacacagtgtccaccctatcatgagggggcatgttcctcccagtcaatacccagcaaaggggaagcagacactacttcgctgaaaggaagactttttaaaaagagaaaacaagtgcaaatggtcattcgcacgcaaggatattcacaatcaaatccgtaatttggggaaagggcatacgtgatggtgaaatcattgcttaaagaaatcccaaaaccctactagagtgtaaactgttgcctcatttttctaacaattctcttcaattgattaattattagtgaaaccattataaggcttaatcagcaagtgatatatcagcatttagtatgaagtttatatttttaataacaaatatgctttagaatactcaaggactagtttttctgaggaattttgatgatccagcttcacctaagataggcacttagaaaatctgtggacttagaagggacatttggcatcactgaatccagctcctacacttcgcagacaagatgactgagactcaggaaaagggttttgtttttctgatacttgacagtaagagggagggttgcggaatggtttttattaaagactcccctccaaaactgtcatgaattcattcctgcacttgtttcagacattctcttttctgatgattatctttgttaggtctacctcttgaatcctaggagaatgtcaagaaatgtttaaaggtgagttggttaaaaatttaaaacaatctcgcttactctgtatcaaaatacacttggcttgcttccattacaccattatgaaactgcattaggagaccggactacacattatacagtctacatacaattaaatacattatataacatgctcagagaccagactacacattatacagtctacatacaattaaaaagcaaatcccaatccaattcaataaaaccagtcatttcaaatagaaagagaaacaactgggtgagcaatattaaagcttgttaaactttcctacaaatgtataataaaccctttaaaatgtaatgtcctgaatgaaacatatcatcttcaaatattaaaaaagaactcacatacaatctgtctctttcagccacagttagaatgaattttatcattctgaaaattctctgctattggtttcaacactgtatcacttttgtgagtcaactacattgtaaacactgcaaaacctcagagaaagtttcacaaaacaaagacgatttacatatactaatttgacaaaaactgcttccaaatcacaacgttttatgaagtccatattctatttctcctttagtgctttttttgacagttggaaatgggtacaagttgtaatttacttgtatccatttcctactttagtagtgtccaggaaaattatttgaacagcatgacagataaaaggcaacaatgaaaagtgtttgcaaccttctgagagctataatgtgcactgaatgcaaacagtagccggtgatttaaatatgtatgtgtatatgtgtgtgtgtgtgtgtgtgtgtgtgtgtgtatgatctatacatatgtctgatgactaccaagacagtacctaaatatatttaagaatcctgcaataaaaacgttatgccaaatggtgtgcattgatccagtaatccccaaagctcctggtctcaacctttaatttatcctaacagataactgctttgagaaaaacaatgaagaaaacagtgaagactgacagtgggtaacagtgtatttttgtaatcatgaaagcagaaaaacaaaaagatgtcaaatgtaaagcaaggggcagctaaaatcatctttttttttttttttttttgtcaaataacacttcacaatgtgaaaattatggggaaaataggcaatgaattacaagtaagagaaaaagtcaattatggcaattaccaaaacagccacacaacatttcagacatgcccaactgaacgaggtcacaatatacttcaagttatgagaaagagaaaattaaccagtgtttgcacccactatgtgtgttttgttaacaaagtgattttgattaagtttgtggtcacactgcaggatcacaagacttcacaaagaggattattttaaatgtgaaatctttcaactgtaaaactaatcatttctgaaggaggctggatattcaatatttctctaaattggagttctctctctctctctctctggctcttgctctctctgtatttctctttttcagattgcatgaggcttcattttttcataaacgcatacccccaaagaacaaaaaataatatctgaaatgaaaacaaatgcaacctttcacttcatgttagttgtctcataaatttaatatctactcttcattacctagaaagctgtaacatgaaagacattttctttcctattcttactttgcagatgaaaaaaaaatcagcaatacaactgacttgatatcttctgtgtgcgacccagaaatcttaataacagcattggcacatccagttcatacacaggccacagcaacagtgcttacagagagaaagaaaaaacatgagctttagaggttgagctgggaagtttacagcttttctcttctgactcattgtataggaagaccttgctaatgaaataaccatattggacagtattctactaccccttagttcccaagaggttattagcattgatttgagcatgtgacttttgaaacatcttcaggatgtttgagcacagctacttttgataagcctgatatataaaaagtaacaggcagagaaatgagaaagaatagagtccagtaagtagagatatgtattttaaatggtaacatttaattatctaagtttattcatcgctttagtagatgttacatatatattctaattagcctctagatttcaaagcaaatattcaggctgtaacataatttccaattttctttttttcatttttttttctcacttgttagggctggatctatgtatgacctggtccatttttcatattgaaaaaaattaaaactctactcagtgaatgatgcaatcttaataacaggcaccattcacaacattataaagttgaatgaaaactctctcctctctctctctctatatatatatatatacacacacacacacacacacacacacacacacgattctatatatattatatatatgtatgatttaataactgttaaaatttaggctttgaaaaacaactgtatttccagactggttgcttggtttccacctctctttaaagaaaaatgacagctatatactgtaccatttacaaaaattaaccaacttatggataaatgtattaaaaacaccgggcattttaagaagttacttcagatttttaaaaattcacctaacaggtagacatttagtagaattctaaatttttataatttctcacataattacacaaaccgttcagaaagcacaataatgcctagtctttttcactctcatttccagaaggaatcctggtagaaatataatgaatttcttcccttcatagtcacctactttcatttatttactattacactagaatgattcacagtagttgaattcaatagttcaagggaaaaagcctgtttttttccatgatattaaataattataacagacaaggaagctttcttacgtagatttatttttagatagatttttaaaacctaggtattaaaaactggttttattttgaaaattttcatatatcatatgaagtgtaaaaatctgatgattcacatgatagtgtttcttttttatagataaaatgttttaaaaattcagcacctatacaaaaatagtctcttttataacctgtttttgtttatttcataaaaaatgttattaacaactacttgttcacacatttaattcccaaaactgttctataaagggaggaattacggcaaaggtattaatactgacagcattaatactaataaaaattgattttttgactatcccatgtgtcaggcatactagtctttaaaagcattatctcatttaatgttcacagcaatagtatgaggtaggtaggtactcatattgttcctatttcagagacaaagaaagtgaggatcaaggagaccacacatcaggaatttaaaaaactgtttgacccacagaccaaaacaatgagctggaacatgtaaagacaatgatttgtaacaaacaccccaatgggttctccctctgtggctctgggcaaaatatataaacttgccatttcccagacttttcctatatacagtcagagcagaaaagcaagtgaaaaagagctttacgcaggcagcttagtgagtaactcctggggttattcagagcaaataataactcacagcatggctggtgcttttgcctaaagaggttggcatgactgaactgaggaatctaactgcatgaaaagagtacccaccatctgggtcaggcaaggaccccaggttaaagtcagtaatcagtaaagacagtggcatggattcaactgggccccatgcatcagaatcagagagtcagcaaagcaaagcatggggtggacgaagaaacgaaatgaccccagctcctggcatagctagacatcacctgagtttatgggtaccagctatagtcaagatgagaccaaagatcacagatggatctggctctgcatttcaggtgcgtgggcacagagaatgggatatgtctagaatggtagtctctacaaacacagctgaggagaaaatttgcttttcaaaagagttgaataacgcacccaagcaccaagcaccaaggtctctactaaactcttcttgcccagagagtcggcttcttagagtctcccttgaccacattaattaaagcaacagtgattcaacctcaccgcatacactgatagactgatttccttacagccctttgccctgacaagttttacttttgttttgttgttgttgctgttgagacaggtctcactctgtcactcaagctggagtgcagtggcacaatcatggttcactgcagcctcaacctcccaggctcaagtgatcctcccacctcagcctcctgagtagctggaaccacaggtgtgtgtcacacatccagctaatttatttttacttttattttttgtagagacgagggtctctctatgctgcccaggctggtcttgaactcctgggctcaagtgatcctccctcctcagactcccaaagtgctgggaccataggcatgagccacttcacctggcaattttattcttcataatactcaccattatggattcattttacatattattatatatctctttaacaacactctcccattagaatggaagcttcctaaggaagtaactttatatttggatggcctgctgcatcctcagtgcctggatccacgtctgtaacacagtaggaacttcataaatattggtttaattaatgcatacatatataccggtttaattaatgcataaatttcagagcaacatcgtccgaatgccactttttatgtcctagagttttgcgttttatgtgctgctgtatgctctattatacaaataaagaggtggctaaattggaaaataacaatataatataaccaaagttagtgaccttgaaacttgtgaattaattcaggcgtaaatactgctcaaaatgtaaaatttgagtgttttgatagtctaagagaacattgacaaagcaaactacaagatatgctctatttcacaaagaaagagagcccttggcacatctctaaaataccagagatactggttaatcactgaaaaacaatactcttcttggattgttttctcctgcctaaaaataaaaaagtttttaacattaggacatctactcgacaactgattatattctaagtataccaacaaaatccatcctaacaaaaaatagtggggttaattttaaaactctgacctttgatacacattttttaaagtaattttaggtcttaagttcagagtattaataaaaaccttttttttttttttttttttttttttttaagacggagtctcgctctgttgccaggctggaatgcagtggcacgatctcggctcactgcagcctctgcctcccaggttcaagcgattctcctgcctcagcctcctgagtagctgggactacaagcgcatgccaccatgtccagctaattttttgtatttttattagagatggggtttcaccatgttggccaggatggtcttgatctcctgacctcgtgatccacccaacagctgattagactagtagcagactcctccctagaaaagtaaacaacctttagaactagctctcttctaagaccaagtcccatctcaagctaaccccccaatacctaccattaataacccacccatccccccaccatttggggaagagtctagattacaggcgtgagccaccacacccagcttttttttttttttttttgagatggagtctcgctgtgtcacccaggctggagtgcagtggtacgatctccgctcactccaacctccgccttccaggttcaagtgattctcctgccttagcctccctagtagctgggattacaccatgaccagctaatttttgtattttcagtagagacagagtttcattatgttgcctaggctggtctcaaactcctggcctcaagtgatctgcccgccttggcctcccgaagtgctgggattacaggcgtgagccactgcgcctgacaagaacttattttaaaaacaagagatagcaaagatacaggaaacatgaggcatataaagattgtttttcctccagctagaaaataaattgagacaagattttggaattacaaaaactaaattttaattaaagtcaaaataggcattctcacatcagaagactaatctccttttctcttcctttttttgttttgttttgttttgttttgagaagaggtctcactctgttgcccagactggagtacagtagcacaatcgtggtgagcctcaactgcccaagctcaagtgattcttccaccttagcctctcaagtagctggtattacaggtgcataccaccatgcctcgctaaacttttatttttattttttgtaaaggtgagatcttgctatgttgcccaggctggtctcaaacttctagactcaagtgattctcctgtctcagcctcccaaagtgttgggattacaagtgtgagccaccgcagccagcctgatattccctttaaaacaaaatgaaactgtgccatttaaaacaaagtggtttcctttgtttgcctgttttataagagaaaagaagagatttcccagtataataaaagttgactacaattaaattatatgtaatatgcccacttcttagaacatgagtaagccccatgttttgtgaaaatatgaattaaggcttcttggtttcttattgaaaatgtaagagtcaactgaagttcatgtcaatgaataaacacaagaaagcaccaaagaaaaatctctaagaaaatcttaagggagaggggtccagcataataaaactccaataattgaaaggttatgatgactgacttaatcacagatgtataaaaaaattaagaagagcaagcaaaccagatacccatgaacagaaaccagaaacagatcttaaaacacataacgacttcaaattaaaaaaaaaagagtactgcaaatacttgggggaaggaaggacagttcggtgcatcgtttggggataaggaagtgacaaatttggaaaaaaaaattatttagaaccttgccttataccacaaccatatatcactagatgatttaaagggaaaaaattcacaatacattcctcttcttcaaatcattcatctgcttggaagtgtttcaattctaaaatcaactaacatactttttaaattcaactcaaaattaacttattggaggtatttcactgaactttgtaatattttctaataaactgcttgaaactgaaaaataaaagagagaaaacaacttattgattaaataacaggttatttagtttgacagattttttttttacattctatgtgtatataactcttggttgtgaatttattatatggtttagttggactttcttctggcaaaagagtaggtagtttgcaggataaaaataaatataatgatatttcatggtcagtgaatactttcagatacttcacctaaataagtttgaggatcatgtgactgaagaatggatataaaacagtaatgagagaaacaaaacaccaaaaacaaaatcagattgaaatcataggaaagaaaataaccttctaattctaaacataaaatgaataataagagagaaaaaaaaccatcaacagatttgactatataaaatgatgaataaagatcctgtatgttaaaaaatcattaaagtaagactcataaatgtaccaagacattttcagcaccttgtaacgaactgcaaagtttgttacatttgttatcaatatgactacagtcaatatgcctaatatataaagaacatgaactaatgaataaaaacccttaggcaaaggaaatatagagatttaattcatataacagaaataattacttcaagcaaacataagggaaaaattatcacttcagtaattaaagaaattcatattaaaccaataatgagaaagtgttttgcctattaaatgaacaaaacctagatgataattttcagattgaccaaggggattttatttatttatttatttatttatttatttatttatttatttgagatggagtctcgctctgtcacccaggctggagcgctgtggcgcgatcttggctcactgcagcctctgcctccaggttcaagcaattctcctgcctcagccacccgaacagctgggactacaggcgggcaccaccatccctggctaatttttgtatttttagtagagatgaggtttcatcatgttggccaggctagtctcgaattcctgacctcaagtgatccacccaccttggcctcccaaagtgctgggattacaggaatgagccaccacgcccggctgaaactagtattctcaatcattactggtagcattatgagcataatcagcatacttctacataacaaccctaaaaagaaataatgcaaaatatagaaaaagctacctctattaaactgttcctcaaagctttgtattgataacagtgggagaaatgggaagaagggaacaatgcccaacaaaagacaaacagacacatctagttcatgaaatattcggcagccattaaaagcagcagttatgatgaggcaaggttgtaaaaaatacatttatggtaaaatgataactgatgtactgaatagcaaattcaccatacagtacaaaggatcacaaaaattactcgagttagaacagtgtgttgttttcagataaaaggattatgagcaaaaggactataagcaacatatttttcctgtttctaaatattctataatgagattatattacttttatggctttgaaatagatgaataaaagttacggtatagaacggtaacatcagtatccctttacaacagtattagagcagtacacattagtagaactacctttggtttaaatttgatatggtttggctatgtccccacccaaatctcatcttgaattccacgtgttgtaggagatacctggtgggaggtaatcgaatcatgagggcaggtttttcccatgctgttctcgtgatagcaaataaatgtcacaagatttgatggttttaaaaagaagagttcccctgcacaaactctctttgcctgctgcgatccatgtaagaagtagcttgctcctccttgccttctgccatgattgtgaggccttcccaaccacatggaattgcaagtctattaaacctttttcctgtataaattacccagtttggggtatgtctttattagcagtgtgaaagcggactaatacaatattttctttcaaatgaccccattgttaatgcaagctatctcttcttactccaccacctgttgaacatattcaaatgggatgatttatatttctatgcctttccggtttttaatcagaatgtgaactaccactggggcttagtatgtaattcggtgggcctacagttacataaatttcaaacaccacatctctctgaaaaaatatcatgcccattcttaattttttttttacacataattaaatgattgaaaatgactgatcgccctttcagtgggacttagcaaggttttggcaccaattctatcaattaactacaatactgtactggctctggtactgcatcttctacagtgcatgtaacgatatgtacaagggacttctatcaacaaaggtcagtgtcatgtgtgaatcaccgggtttccttaactgagagtccccagtctcttttcctataatgacaatttcaagttctgtgttatgacctggagtgctgtaagccatggctacagagtggtgaggatgagaagatggactattaaatctttctggggtaaaatgtgtggctgtttcattacaactcctgccctatcataatactcctgtgaccatcaagatttagatctgtaattacaagaaggaacttgattttcaccctgattaccaatggagctggtatacataagcacaattaaaaaaccaagacttgaaaaatgagtgtcttcaagaggtgaatgttccacgcttttgtggattaacaggttcaaagtaaaccctctacttttccactttgttacaaggtgctgaaaatgtcaccaagcataggcacttctgtccttgcaatcaatcacctctggtaagaaaataaatgttataaacaaatagaaacaagctttattttttttaattaaaaaatgttgtgtgggggaagagtggacacagttcatgattctgagcaaacatgagattattatgtgccaaaatgccctcagcattgtataaatacaatcccctaccccaacagagatcttttgttaaagctataaacactgcttaatacacaaatgtattgtattcttaatcaactgcctttaaaaacccctacctttcagaaacctgtttttgtttattttgattataaaactggaggtacatacttagagtctcagaagtgacttaaaaaaaaaatgacatcagcctggcacggtggctcactcctgtaatcccagcactttgggaggccaaggcgggtggatcatttgaggtcaagagttcaagaccagcctggccaacatggtgaaccccatctctactaaaaatacaaaaattagccaggtgtggtggcggacaccggtaatcccagctactcgggaggctgaggcaggagaatcagatgagcccaggaagcagaggttgcagtgagcagagatggccccactgcactccagcctgggcaatagagcgagacacagtctcaaaaaaaaaaaatccaactattgctgcatactttctgaagtatttttttaaacaaaaataacttcttgtataacaatgagaatgaaaaaacaacaaaaaacaaaaacctacctaaaacaaaatgcaaaaaaaactgcaataaaaaataccagaacctgtgacgctccctgtaggaggtgacagaaatttataatgtgaaagaaaaagagaaaggcatttggaaacaattttctcaagttctgtgaccaaatgagagaccaggtaggagaaagggcgactatgttttcagataaaaggattatgagcaaaaggattatcagcaacatattttttttctgtttctaaatatcttataatgagattatattacttttatggctttgaaatagatgaataaaagttagggtatacaagggtaacatcagtatccctttacaactgtattagagcagtacattagtacattagtagaactacctttggtttgtatttgatatggctgttccattacatctctctagaaaccttatacttaactctcacctagtggtagggagactgtggagaggtagggggttaaagtgttaggctcagtactgtctctactactctgtctctcattcccaccaaactgtcaggggtggagtctggaagtcactcatctggccctagatttctttcagtgacttctagcaggttgttctgagatgtgcttgtcagcattaattacatgtgacattggattggcctgatctgtgacaaaattcaaacgcactataataaagcaaaagagcaggaggaaagatgccaaggggagactttgacggtgtttcacatccccaggatacccttcacatctccctcctgctccgtcggccatcctaacaaagacacacttgctctgcgctgcacatggagctttaagacagatctatctgctttggacagcccagtctacacctgttgacccattaagaacatccccattcactctcacagcatcctatttagatgttaaattacataatcaccctactgagccccctcttccaactatattgccactccttaattcctcccatacagctatgcagtcacaatggctgaagacaaaaatcacttggaaagcaacagaaaagactccctgggaaatctgagaggaaaggtggaactgatagtactatatttgttcctttatttgatttccatggaagtgtacttcacatcgggctggtacaaaatcaaagagtttgtctgtcattaggcaaaatgcacagaatctgttatcaattcactttccttgagaaggtatttttgaaacacagtatctttcacttacatctttcctgctagagtcaacgagtattctaactacataaatgctgtacaccttgattttattacatctgtaaccttgaaaagatcaaatgatgtttcagaatgatctggtagactagggctgtctaatacaacttagtgcaacacgggaaacgttctatgtcggtgctggttctatatcatggccactagctacatgtggttattaaccacttcaaatgtagctagcatgaatgtggttttaattacatttaattttaattaagtaaaaaggacaatgggtttcttaagttggaatactgggataaaaaagatctgcctcccgttctcatctcctgagttttgatgagaaatgtcactagaatcctcatcaaggcagatactgtctactatgggatcttcctccctcaaagagcaagcaaagggttggcaaggaccccatttctgcagtgtaacaaagacagtgtcaagcccagaaaggactggccttaggttccaaagaccaagatggagaggtcagctggagtaagaaagcctcttcaatttttgggatcttaggttcctcagcaaaacaacatgaggtttactctcaggtcctttccagcaccttttgaaaatttctaattggtatctgaaaaatggtcatcacccatgatgaagaagccagcatggcacattttacaagcagaaatgtgtttggttctctctcatccagacgtatggaaacataatgtaatctgtcactctagtacctaaatattccaaaagaagagttttatgcttaaaacatctaaaaggtcatttatttcccctttatctacattatacataataccatgttcatataggcttgtggatacaatcttttatctatggatttgcttacatcattatttctctcaacactagttgcaaagaacattattactgtaaagccctaccacatccatggtgtgtctttccttctgtataatgaaaagattattttgaaagattttcacaatcagaaaaggtaacaggcctcttaatatattttaaaaaattgttaatcacatttacattccttttactaagcatattttttatttaatatgaacaatagtcactgagcagtttggtatactttttaaaggtttctatcatttttaaaagccttgaaataaaatatcactcaaaatgaggccaagattatgcatattttaaaaaatttctcatagaaactaaccatctgtacaataatccattgtctgctctaccaaggtgatttattaaggataatgaagcatatgatttaatagctgccacaaatcctttttcaaggaagatgggtataaataatacaaaaagatggtccaataatagccaaatcccaagctaagagctattctatatgctaggtcacaggaaattacatgagctcaattaactgtggagcaaagtgaagtgtggctaggcagctaaggctctaacccccatctcctactttggtagttggtgttattatttaatgaaaccagtaagctctactatcatggtggaatttgagtagcttttttccacatgacaacataaagctctccaattaaaaatggacattaccggcacaagttttctaaaatcttaaaaatccagatctctaaaatttgtcagtgcaaattatacttgcactgacaagtataatagtgctttactcagccttatattcccacagtactttgcatttagcatagtttaatgtctggtgctttaaagaatggatgtataaatgggaacacaagtgagtgagtgaataaaatgaggtctctaaaatccttgcaggaaaaaaaaacaaaaacaaaaaaaaacacacaattctgtgttcctctgagacctggtcctaacagttaacaccacttatacttttgaaaaagtttgcaaggccagttgtcaagaggttatctcctttgatggcaaagctttccttcagtcagtgtcctataaagaaaaaaagtcgccaaatcgtacatgtcatttgaatacagtatttaaatattagctcttggttgcaacctgacatactcctctcctggctagctctggcgatattcaagactttacaaggccctgtgaaatcagtgaggcaaatttctaacaataggaaatacaagccatcaaatatgccagctgtttggcatgaaagacagcctggctgtgccttacaggcatggcacagccattcactgataagctggcacagccaatcctgtcccatgccacccagcaagtacatcaaaaacaagattagatactgcaaatcctagtgtctaagtaacactgggtttcagaaaatgtccacagctcaacataaacaagaggcccatgtgtgagacatacgtcactttcccccaaaaaaagtgtgtgcttcaccaggcacatttaccaccagcatattttcccactgcagttcctacggctcttgctcttgtgagtctggcttgccagaaccgagatcaattttattagataccattagtctctgttagggcggtcatttgaataacaacagattggcaagtataaaaccaaggcacctgttgtacatttggcagcctggatgaggccccttaaaacgaaaacaaataagaactataatcatgccaggcaattgcttttggttcaataatggccatgtgtcagaattaagtgcatctgggaattgctaccacagccagatgtaaaggcagatttgtcttgtctagtggcatatgagtagatacacacactctactgagatttggctttgtcctggtttggtaaggaactaggtaaatgaaacttcactcaaaataatataaaattaaaattaattacagaggagcaatagacaataccatcgtaaactgtagaacctaaacagatgggttgtaagatttgggccgtgaactaattcacctctgagttttctgggcacactaatttgtttacagaatactcaacgataacatcccaatattactattgcaccgagccaggccatgtagtaggagctggagatgtcactgggaataagacatggacattggcttccaggtactcctaataaaacagagtaaaaataagcaattacaatgcattatgatagacactatatgtagaatttattcggtattcttttagtgcccagagaaaggtacccagacttgggaggagggaaattttctaggaagagttgtcagctaagctatgccctgaaggaagaaaaaaatcaggcaaaaatggaagggttggggacattccaaatggaagagagagagcatgctcaaaattacagtagaaagagtcaatgtggtacatctgggaaacagcaaatactttagtatggctcaagtgtgtgtgtgttagggatggaaggagtggggaagagaaaatgaatatgagtatggcaaggtggcaagagacaaagcagaggaaaggacatcaaaggccaggtgccttttggtaaggaatatttcatgctttttacagacagaaacagggagccactgaaatatttgaaagcaaggaatgacgtgatcagatttgagtttcttaaagatcatgctggctgcagagcacagaagcaactacggtgaggtcaaaaccaaacacaaggagactgcaccccaagcatgagaagatgggggcctttcaacagatgatacctaataacatgaaaagacagtgaataatttggtggaaaggaagttagtatctattttggtatcctcgatataatacaagtgtaactgagagaaaacagattttgaatgataaaattcaaaattgaaattaatattttcctaaaatattttttttttggtacatataaatcaaattcaggtcgagtctgttaaatagtaaaagtcggattaaaataaacataagcagtcctttcttaaatcagtaactgaatatacataacagtatttattaaacttatcattcttaatttataagtattattttaaaatgtgtattgataacctaactataaaaaaaacccttgctacatattacctaaaaaagtacaccctgcttcatgcttctaggaagttatgtttatagattaactggtagaaaaacatatggctaaataggccagtgtatgcatgtgagaagcattttagaaacctgggcaaagaagacttaattgttcagatatcatgaaagccataaaagaccgagtaattttccatgtaactttattttatgtatcatgtctgatttaaaacttcggggtaccttcttgtcagagaaaaaataattttccaaatcatcaaacaaatataagatcctgtattttattatttataaaatcataatcagaaatagttctctgaggacttacagacaaggagaagaggctaaactattataaaataggttaaatggaaaaaataatcaaatcatccacccttattgataatgaaactaacgggtgaaatgaaaacaagagtattttagaagacattataattaacaaaagtttctcagataaaatggtatagggcaggctgccaataagcagaatgcatatataacagtcacttggcataattccatttctttgatgggtgactgctcttcagatatccctgctggatcgatagttctctttataaaaatgcttctgatttcttacctgttgggcagctatgaaaatggcagcctttttgattttaagaactattcttggtggaaatatttcatttaaacacttctgctccaggactgaccccagagctctggcagttgtatcactggcagaataggataaaattttagagctggaggccatctgcagaaaaaaaaggtcatcgaatcaaaacccctttggtaaaaaaatgtttttttcaatgcctccagtcccaagcagagaaaggaacagaagatactcttcagaaacggtagagaggcaacgtacttattaatgcttaagatttttcctttttttttttttttttttttttttagttttttgctttttgagacagagtcttgctctgttatacagactagaatgcagtggcacgatcccagctcactgcagccttgatctcctggacttaagtgatcctcccatctcagcttcccaagtagctgagaccacaagtgcacaccaccgtatctggcaaatattttttttttttttttttttggtagagacagggtcttgctatgttgcccaggctggtcttaaactcctgggctcaagtaatcctcctgtcttggcctccaacatagatttttcttgaatttgagtcaagaaagcaccatgtcattgggcgtacttgcctggacgatgtgagataaatattttttttaaaatcatgtcatatacaagagtgaggaggttaagagtgagtgaaacagataaaagttgggatgcttgacttaaaatcttgaccctatgttccatctttattacttttatctatgcaaccttgggcaaattacttaatctctccatggatcaaccctcttctgtgaaatgatgataataaaaccatctgacttacacagaatgttattttagacattaaacataatactaaaggtgaggtactgagcagaatgcctggcatataataaatgctcagtaagttttagaaataatcactattacaactattacatatcaaccactatgctatagctgtaaatttgagaaaattaatgaaatttttccccataaaggaattttaatttttacctatctcagggtcctgagcattgtgagaggtttctaatgaataattattcttcacattttatggtttcaattctactcaactcaaaaaaaaattttttttttttttttttttttgagacggagtctcgctttgtcccccaggctggagtgcattggtgtaatctcagttcactgcaagctccgcctctcgggttcatgccattctcctgcctcagtctcccgagtagctgggactataggcaagtgccaccatgtccagataatttttgtatttttagctgggactacaggcgcccaccaccacgcccagcttattttttgtatttttagtggagacggggtttcaccatgttagccagaatggtctcgatctcctgacctcgtgatccaccggcctcggcctcccaaagtgctgggattacaggcgtgagccaccgcgcctggtccataattctttagttcaactcaattcaacgaaaaggaatagcacttgaactgagcattagaaaatgagagaataataggatttcaatggatacaagtgaggacagctggtaagagaaaggagattccaggaacagtattggtagaactaaagaggtgcccaaaagcacagcctcctcaatgactgcagggaatgtgatactgcacaagggcagagtatcacagggctatggtgagggagaaggctagacatgcaatttgggagcagactgcaaagggctctgatggctgtgttgagtattgagcacttgatcaagtagacttgagcaagtttgcctttcataaagcaaaaattaggaagactcaaagaggagaaatgagaaaacacaaaaaccacctaagaagctgcgtatggagtgcagaacacataggaaaggtagaaatggaaaggaaataaagtgaaaagattacaggaggagaatctacaaaattgcctgaggataagaacaaaaggaagaaaagagatagggatgacaccaaggtttctgatcaagggataactcagatgaagtatgaagaaaagagaaatagatatggatggaagatagtattttgggtttacaaaatacaatgtttgggatacaggagagcctcccatttcccagtcatgtaacaagcagatagaaatgcacgtctggaactccagagacaagcgaggaaatttattttgaaggttatctatgtagaaattattgtttctatgagaagtggatagacatatggcaggagacagtacagatagccacctgaaaggggatatagataaaatgaaaataaaagagtttagaatggagatggagacatagatgccaaacatcaaatggagacagagttccatgttgatgaagaaagtgaatgtcaaagaagtaactgacaaagaacaacttccatccatggcatatttccaatggaagatgcttccaatattttattcctctagaaaaacatagttgcctcttttcttccccctccccgagaaaagcaaaaatggttacctggccagtaagtagatttagaatatttaagatacatccaacaaactactcttatttctagctagccaaataatcttgatagatctttttaaaataagacataaatcaatgtatctacaaaatcataatgagctatttcaaccagagaagtctgaattggtttttctctcaaaattctctaataatatttcagttaagttactactacaagtagttggaatgtgttttcacagggaggccaggatctacttgtgtagtaagaaatcattagagcatactcaaaatgtccctttagatgggatgggccaggaggaaggaagacggagaaaatttttattttaaacattgaaaacatatgtcttgttgacctataagcagacactggatcagcatttgatgtgtctagtctaatttctccctgtaaaattgtactggtgaatcttagggagacagaaggcagtaaattccttgcctccatcaatacatttgacctcagagcaaaccccacaactggctacaggcacccaccatccatcattgctcttgaaacctgatacttcagggaaggacagctgcactgggcaaaagtctaagcagctttctaagatgcactaccattaaagaaaaaaaaaaaaaggcacttattctgcttcagtattttaattaactgcttttctaaacatttcttcccccaaactgaaactccaaatcaaatatccccaggaatatattaataaaatttagactttagagagaaacgctctctttgtgcattctaggtaaaattatttctagcttttgctttaaatgctttctaagataaacaacataccgtgccatgctaatatgtacagactttaataaatgtgctaagcagaaaaagagagttctagcaactacactaattatagcagtacacacagagtgccaacaggaaaaacgtacacaaaacatccgtatccaacagatcttaatttttaagtcaagtggcaatcacttttaacaaatagctgaagacaacagaactctatcataggaactagtgttcttgaatatggtatgttcattacgtgacttctacattcgagaattatgtaaatttaaaatacaaaataagataaatttgtatgatcaaactggatattcattacatgtatggttattcattccctccattttacagatgatgaaactaagattctgaaatgttttatcatttcctccgagagctcacagataataagtggcagaactgaggcataaatttagttcttcctataagaactgaatgttcttttcactgtagcctaaaaagaaaggaacctgggtcgagattttgcaattctttagcatcatcttaatatgtattacatgcacgcatggttaaatgagaattaacaataactgatatccaaccatttatgaaatcattactaatacaacccttttagttaataaatgaaatccatctactaacggtttaaaaaaaaaaagatgtctcttgttacttgtgatccaatcattacagaggatcactttatgtatttgaaagtacaatttctccaaaccccaaagcagtactgagaaatgctgttttctaaatacaattcccaaatctcaatttagttagctactgctacattaaagaacatagctcaagggatgttgttaataaaaaaagaaaaagaaaaagacaattgagaatttataaatttaatcaatctcatgcaactggcagagttacgagagttaaatctagtaaatagccatgtggcaaaggtcactatgctcctgacattgttatctgaatgtcaaggaagaagcaaacttagcctttctggtcaatgaattcaaagaactaagagaaagccttgactcagatggctgctttggctcttacattttgttgtaaatgctggaggagccaaagtggggacctgccacgtaaaagcagccatttacaaaggaaagcaaggtttgctcgtcgcaggtgaagagggaagaacataagttgtctcaatactacttgcctgctggtatacatgacctactagcttacagacagaatgagctgtcttagctctccaaactgtcatctttttcatttagtttacttatctatgacacatagggatttgatttgaaggacagcagaggttaaaaagccatcaaaaagctcagttttgctgtctctctcttttttcccccttttggtaattttcaaaatgtcataggccaactgagtagtattaatatggtcctgttaaatgtattagcatcaaactaaaaataattaacaggaagatacagaattaatcattttgtgagggaggagggaggcactgcaggcattgttttagtccatttttttccctgtgagttgcttcgaggagcgtggcagtacacacggatgtaatacgtaaagtacataatgtctaagtcctaaaaatattttataaataaactgttaagagaaaaaaatgcaaactgttgatttcttgaaagcaaatgggtaatttattaagggggaaatgagagacacaggtcttcagtgtaatcttttgaactatgtttcgtaagaattctaattcattaattctccagtctagcaccattgtgatggcattattatttaggttacattaagtcagactgctgtaacatataagcatttgctctttgaccttcctaagacttatgacgcaaagaaaatgctgaacttttacatctgaggctataatttcatataatgaacaatcaggaagcacaagtcacatattcttttagctatctttcttaagggcttaattgtggagagttgaaatccatttttatttttttaaaaaagggagagaatttggacactttgtggaaacagatgtaagccaagcatgacattttaataagtgtcaccagctaccaattagaagcaaatgagattacccatatagaaaatgtatcccaaacaaacctatcctttggtagaaatgtcactgtgccatgaaattacagaagcttaaacaagtgatgcttgttcaaatgaaatttactgacaaattccttctaagcaatcttcttccacattatcagatttcttcagttgatgtgttacataggaattctcaatcttgtagttcacagagagaataactcttctctttgctctttcttggcaaatcactgataatataaaaaagaatgttttaaaacactggttttgcttgaggcagtaagctgcctctttgccatcacaagtaagcagctttcctaaaagatattttcaaagaaactgaacagtagaaagatgaaataacaacaaaaaaaggtaaataactccataaaaccaaaagagattcagactaaatttggtttaaatcacatgtaactattatcactttaagaaaataggaaaaagtaaagcattttttgaatactctgggaaaactggataattatatctatatttagcacttcatatatctgggcatgtaatacaaatcctgtatatttcgtgaccactaagttgagtacactacataaaacgtaaagtttattttcgagattcctagaaacttttgggaattaaaaaggtaccatgattaaaggctttctgcatagatattttaagtgtaaacctaagtctgatgctcctaggatcacaagttagagcacaagagcacacacacacttgactcttatactgcctgcaaatacacaatgaaactaaagaagggttgttttaaaataaaaggtaaactaaggaaggatagttttaaaatgaagtcatctttgaaatattcacctttcttgaaatgacacttttcatatgtgattgtgttaatgaattcttaattatgcatagaatccttttaaaaatagaattgtccaatggtttgataaatcaagtttggtctgaaggaaatctaatatgcaaatacttacagtgtactcttttacaaacagtcacccttgtcagtttgaaaaattgaaaatcaacgaaagaacagtttaagtatacttgacctcactgcctaatgtctctcaagattgccatggctggtcgatttcaaatctgtgaaactgacacttaaaaatgtatagtgcgtcttcagtccaggtccctcaagtgctaactaaactgtggtcacagcctcagattttctttccatacaaacttgtacagcgcttacaaagctactttaatcacatcatcaatctatgcctatacttcccttaaagtaattctgcttcatttatcttttaaccctacattatgcaaataacatccttatcagtccaataaagaaaagttattaatgttccttcttgtttatctttgtcatacactgagaactggaatcacatatgaatttgcaccaataccttttctcttttctatttttcacactctatatggaaaatcatagtgccagagaagccctaaataaaattcttgaaatagtcttcaatcattgtctataactagtatcagaatatgagttaatgtattaaaaaggaaaaaacaaaaacttgggggaatgcctacttgaatttttttttttttttaatgtctctctaggaagggtttgcatatgccataccaggatacctcctggatataagaacagttatacaggcccctagtggcttagcaaatagcagcagatgaggggattccaattcttagttccagactttgagatattctggatttaaataagtgtcaatcttaaaaggcaaatcaaatcactgtatttaatactttaagcagttttacatctatggttatctactctaacgcacatatattaaaataaattgctgcatttcattacttgagtaactgcacaactgctctggcccaagaagaatctgtgttacataacctacacaataaaatgtttaattcatccacctttttacatgtcatgcaaaaataatacattactcaactatattaaaatatatttgagagagacagtgttcctatttgaatcttattcctattatatattactgagggctataagaacagatgatttctatgcaaagtactatttaaaataagatacagataaaaattgaatgccacttttacaggagtaaaaatctaaacgtatttcccagtaacagccagtgatacaactcacattggagtccatctatttttaaagatctacaattaataacacccattaatcccccatccccttgctgtccttccttcacaaaagaaaattccaggcaggcacatttacagcttttagcaatttttaactggacacaatctgacagctgaattcatgaaactgaccagcttgtcaatttcacactttgaaagtacaataatagctgatagcatgagggtgaatttaagaaatctgccacagaattgctagctccattgaaaagcaaagtacagtacataattatggaatgtgggaggtagggaaaattttattgtccatttaggatgtctgtttccataagtcagacacggaacattgaaaatgtgttctctttttgctatagtgtctgtagcataaagcagaatatatgttcaaagtaagtaagatactaagccttttactgggtattattatattacatatacaacttaatcttaagttattatctctacagatccctttacatcagaatgtttcaagttttggtatatcatccttgttttactcaagttgagtggttggtgtgtgcactttgaaacagagaaaaaaatactgaaaatggtcagaagtatctatggttgaactaagtccccagagatgcgctacaggatggttagaaaagaatacaccaaaggataaagtccacatttgtagctcagtaaatttaacagcaaacctatttcaagtcataagcagttactagcctctgagaggttcaaactgtgtgagctacactctgttaagtcactggcactgtgtctttgcacatgtaaatatatatatataactttaagaggaaatacaaggagaacgagccctcaggaatcttcctagatacttaaggtgcaaactgtagatgaggctgggggattactctgagaattttagaaaacggaggagacatttggcaagtagcgtactgggaggcgaactggaaacaataaaagtggattgtgatagtcctggttttggagaatggaactactatctggaatcctggaacaccaaattaatgaaagccaagctcacacttggtgttcaagatttttttaagcataagacttaaaaactgacttcacttgctagtgcttttaaatgaaaatcaacgtccagagaagcaatgcaagttttctacacacccacataaaagctacaataaatctatgggaaagcaaataatctttggtttgttcgtggctttctttttaaattgtttcttacaactttgactcttcattataaaagatgcgttcccttccctacggaatgaatgtgtgtgttaagtacaccagattcccgcagctgaactacgagctttgattctgccacgggaaggtctcccaaacaatccccctcctctatggcagctgcgtagactttgattcctgctatttctccttctccccactagttcagaggaaagaaagaaaaagaaatcgccccctcaccgtagtcagccctccttaaaacagtaatccctgcctttaaaaaaggcggtggcaggatccctgggtaagggtggattgccccaccgctccaccatttgcccccaatactacgcccaccctaggaggagagagcgggggtcgcacaaatacacatacccggacacccccattctctagagtcgcctctctcccgggtctgaggtttcaggcgagaagtgaacccagcaggagaggacctctgcccgaggaggtccagaggagcaaactgtgcgctccggtgcccgggcgccgggctcgcggaaacgcgagcgtgtcgctctggctcgggaggcgccggcagccggagccgggcgcagggcgattccggagcagcaagaggggaagacaccgcggggcggacggggtcagttccagggactcacctggtcatgttggccccgggcagccgccgccaccgcctcccgcgccgccgccaacactttcctccagcgccttcgcgccccgccacggccgcgccgccgcctccgggcggccaatttaatcccgcggagcagcggccgccgccgccgaagcccccctggtcgccgccgccgcccagccctcgtgcggccagcccagtccagagcgaggaagtggaagagagtcagcgagtgagtccaaaaacccgaaatccagcatccaaggcagcgcgtccccccgccctccctccacccctacccccttttcctcctcctccgcctcctcctcctcttcccgggccgtcctcttggcccttctgagcccgcggcttccgcggcggtttctcctcctcccgctcctcctgctcgccctgcgcccgcttctctcgctgccgccgccgccgctgtttgtctcctccccctcctcctcctcctcctcttcctcctcctcccgctcctcgatgctccgccgctcgcggctggggggtccggggccgcgtctcctctcctccctccgcctctcctctttcctccttcctgctgcctcttcttttaaagcggattctttggccacaaatagcaactcggctgcccccctcggtgcctccctccccttctcttcttccccccaaaagtgaagcgcacgcgaggtaaccagaaactgaggctcgtggggggagaggggtgcgaggcgacgcctgggaaagggcccgagcagagtcgagggccgggaggtggggtggccggtgcagcccagtctttggacctggcttgaacctggtagttacggctgcagaagaggtggtttggggaggggggaaaattaaacgaaaaagcccaggaaagtcattggaaaggcttctctctttgtttccttgtgtgggtgatttctaaaatcctcgtaacgtgctggggatcccacggaattgctgtgctccagcgctgggggattgtgtgtgcgcgttgcctgcgcgtgagtgtgagtgtgggtgcgcccggacgcggggagagctgggcccgctgcgcccgctggcgaatccctgaatctggaccactgacccactgaaagggccagagagccggataaaggaggggcaggcaggagaggtgggtgaaggaggcaacacacacacacacacacacacacacacacacatacacacacacagacacacagacacacacacaccagaggagggggcggggtgacgtcactccccagcatccatccaccaggccagaaaagaccctctccaacagattcactcatctcctaagagatgcacacccgggcgcttcctgctctgcgtcccagcgcaaaggaggaaaaaatgctggtcgcgccctattgacagcagtgataatactatagggagcgtgctttgatgagacacagtttgtgtccgccccagttcaccttggcagcctccttcggggatgcttgtaggatccgctttgaaggcaacgaggaagactgggaagtactgaaccaaaatcttagtgtgataacttgttttgctttcatgccacttgcttttatgttgttggaaatgcagtgctcctcagcttctctgaaggacactataacacctcttccctagacaagcatccagttgttgggctatgcactcttcatccacacaacccaaggtgactaaggtgcactgtgtgtattgttagctaagagatggattttaaccttcttcactactcatagggtctccagcatgtggaaaaagtcggcagctggaagccaccattggcagttggcccatcaaaatttattagaaacttggtcagaaaggttaaataaagtaaagctagagctcaccagccacctccattgctcattctgtgttcaggccagcacatacacacaatacttatccctgcagactccgggctgtctttgaaagagcaaaggtaaacagacacccttagatttgacttaatgatccagcatgctgactgctgtctcaagctgcccatttgtttccaccatctgcatgctgtgctcctgaaagccaccgaaggattggtcagtaatcctctgccccctatgtactccaaaaataagtcacatattttttaaaggaatctctctaaacgaagtttagttttccagcaatttgggggtgggggaggagcatccctgcatgattgtctcttggctttttggttttgcttttttatggttagggtcatagtgaaaatcaggaagaaatcaattcttgtgcaagccttcaaacgaggtttaccctccaatcattctgatttcacaggagctgaaaagctgtgcagggatgatggacccttgccccctgtgacctaaggatggatccagaaatctcagcctccccataggtgattccacccaagatgtaaactcctacttggctttgtcattgccacatgtgcccccataaactggcaatcccactttcctcatccaaagttgcatgttagagaaacagaaagttttaaaacccctaatattcctttgctgttacttttgtgggaaatgtatcactctgcctgcagatctgacctcatttaagaagaacccagctggtaaatctgactgctatctgggaacatagttgaggatatatcatcttacaccactggtagtgatttaaactagcaagtagaaaagggacccagaaatcaggggatacagaggacagtacaagtaaatggcataagcccaacttttctgacactgtgaagtcctagatgttcttgtctctactacaaccaaacatcaaacatcttagagaaagaagtagggatgggtcaaggtgactggagagtctgagttattattataccaatgagactgagaattattcagggtgatgctgctgaaaaacgggagatacagcaaatagagaagccaaagtttctctgcacatctgagtagtaatggaagtgagactgcagcctgctacactcatgttaatatattcagagcagattggcaacaaaagagtgtcctaatgctgcagcatctagtaaacttctggactggtttaccatttggaaattttaagtcaaagaacatcagaagcaggctaatcttttgttgaaattacctcgtttttacaggtaaagaaacgaagaccctgagaatttaaaatcatccaactatttggtgccagaagcaggacaagaactcagacatcatgatccagtgccctccatcccaccagctattcatcatcacctccacattctggatcaaagaagccagttttccaacttatcaatgagcaatacatatagaatatttttaaaactccaaatacttttatgaaggaaaaatgaagcaataggacaagacattttcttcgtttccttccagctctaacattctgtgataaatagcacacaggagctttgctatagcactaccccctctagtgcataattcagcatacgatgagtatgagtctgttttggaccccatccaaaggagttagttcctagaagtacttggaagatttattctcatttatcatgaggcatcctaacaggagactaaaaataatcacgatgacaataatagtaatcagttgttacacttgtattatgtactaagcatcgtgctaagcatgttaaagttcacctgtttttgaaaaggcacttcatgaccttatgtgggttgcgaatctagtgggtcataaacaatttctgaaatgaaagaaaagtaggaaaaaacacagagtgcattatacatactaagttgttttattttttatttttttattttttttgcaaaacttcctttttgatcatgtggctagtgattaaaagtttggaagcactgcctcgtttccaatcttaactgccttgctagttaagtattattagccccattatataagtgaggaaacaggacgagagaggataagtaatttggccaagctgacacagtgagtggccaagctagaattttgaacctagatctgtttgacttcaaatccaatattttcacttctatagtgatgataaattattgaccaaggtatggaataaattgttgctaatcatgttttctttgtgaggactactggggtttttattaaatccagctaaatggagaaacacagcatagattcaagtgacatgttcggaagagagtgaggaatttcataaaacactaaatctaatatctaagaccttttcctgtaggtgttagcttatgtctaatacactttattgacttactgctaaatacataaatgaaacaataatagtttcagtcctcaaataacaatattcacttctacgtgtgtttctatttttatttcagagagtatttttcaaatttaagttatacagcatttctcagtagcttgctttggccaaacacagaactagcacataagaaagctaaaaggccaggcactgtggctcacacctgtaatcccagcacttttggaggccaaggcaggcagatcacttgaggtcaggagtttgaaatcagcctggccaacatggtgaaacccgtctctactaaaaatacaaaaattatctgggcgtggtggcacgtgtctgtaatcccagctactcgggaggctgagacaggagaattgcttgaacccaggaggtggaggttgaagtgagccgagatcacgccattgcactccagactgggcaacagagccagactctgtctcaagaataaattaaaaagcagccagacaaccctatcattcaaattcaattgtaaagaagaaaagaagatattaattaaggtgccatgctaaattttttgacccatgtagttctatggattctaccagtaacattgcatgcttaggtgtcattactcccattctgcagatttgaaagctcaaactcagaactagctgatgattgaaatcacctgttctgattccactacccaaagattctttacaaacaagtgggcttccagtagaaaaggaggcagctggagattttgagacatgttgtgcaatcatttatgctttctttttccacgtgaaaaaaatacactttccttttcttcaaggcagcatctcttcttgctgttaggcagcactgtcctctttaagaaaagaaatccacatcttcatggatgaaattggaaaccatcattctcagtaaactatcgcaagaacaaaaaagcaaacaccgcatattctcactcataggtgggaattgaacagtgagatcacatggacacaggaaggggaacatcacactctggggacggttgtggggtggtgggggggagggagagcatcgggagatatacctaatgctagatgacgcgttagtgggtgcagcgcaccagcatggcacatgtatacgtatgtaactaacctgcacaatgtgtacatgtaccctaaaacttaaagtataataataataaaaaaaagaaatccacatctttcataaagaaaggcctagaaaagccatacctcctccactgactgctctgttcagctgctgcacttcaccctcacctgcagtgtgtagaggacgttatggtacaatgctatttgctactggctctgctactggagattacagcatgcgactgtgacaatactggctctgctactggagatcacagcatgcgactgtgacaaatggatattcccattaaattctttagtagactggggcattccattaaccattggcactatcccaacccaagtgaaacactgggtcatttttttcttgtgagcaagaagtgaagggagaaaacaaaggatatactctaattacctttcctatttcttttttgttgcatgcattatgataactgtatattacacttatttataattaatatatgacaagctgtcagctaaaatttaacaggtgatttgtcaagaaggcccattaatgcatacattaagcagtggatttcagtgtttcctaacaaaattgtgtattggttttgttttttcattctatttagtataaacattttgaggccacctatctttacattttgcagcatttttaaaaaataaaactattgctaacataaatgggtgcattgttagttatatgaggtataaacacatttctgtcaccttaacctctaaatttgtttcactgaggaaacaaattgcctagtgtttattttaaagttttaactttcatgggttttgatacattttttaaattatatcttcagtaggaaaggcagagctgattagggaggaaagcaactgcagttacttatgttccatttagtgtttgtatcttaggtaagaaaattctgaaatgaaggaatattttaaaatacagaaaaagattaagaagtcaccagaaagctagtagttaatcattgaataaaggaacactctacagagaccaaaaactgatgaaacaggctccatcttgctgaatggcgcaagaatgggaaacacaatggaaatgaatcacagatagttgtgaggaggattctttgaaagaaggaaaactctgtttctctatctgtaggatgtcaaatcatgggacataacctgaaaaggaagttaaattttgaacttcaatattattatttccatggtcaaccaaaatttgtactgtttaagagaaagatacaaaagtactgcagcatttgtttaaaatttcatttgcacaagcctgactcttatctctcaagactcggacatgcttcaggcagttaatgactcacaatccactactctagagggtgctgaatctccttaatgaaagaatgtgctttaagattcaatggttaggaagagagaaataaacgagagtaaaacacgaagcacagcagtttttcaaagctagtaagacttctgcgtccaccaaccaactttagctcttacatttttagaaagaaagcactaacacagaaccatgaaattatttttaaaggttctttctaacagggtttcagaggatggtttccaaaaaactcactcagaagtgaaataccacacgttgattttcacgttgcagggagcgcattcctatgcagttcagggattataaatgaccagtggcaagttggtcattgtatcctgggccaggatctcactgtctccagatcttgctttgttttccatatgcagcagagtccccatgagtaactgggggtgtttccttgtgcattcagtaacagttttcaaaacagtgaatatagcaaggcatcaagactactatatttctgccacttttctaatgttttctctttgtcttatacttctgttcttgtcttacacttgtattaaaaacacaataaagaaaacagctttgtacaagctagtattttggccataattatacttttctctgtcttctcaatgaataagaaaattttgggccaggtatctgcacaaagcgtgatagaaataggataaaacagcacatcatctagcatgtagcctacatttatgtaaatctggttgatgtaaagtctgttctgttatcactttttaaaaataaatctatcattctttctttaatcataatacaaaccatccagggacagtccaaatttttcagaaagaacaaatttttcagtacaggaggcagcatttgccagtacaacaagaaaccagaaaacaagaatctgtgttggatcatttaatttctacttggtgtacatactcaatgtaatgttttcacagttgtttgagagcaggattcatgtctgattggaacccagagctcctgtcatagggctttaagcacaataggcatttcataaatatttcagaaagtaaaggaagggaaggatagaaataggaaatgaactggttgtcaggtgcacatcttacatgatacatcactgtctttataaagcctcccgtatagtccactaaatagaatgaatttcccctgctcctgggctctcattcttttccttttcttcttttttcctatctctctgtatttttattgtgtataatttcaccctattaaattgtgagcgtcttcacactcttctcatcaccaccaagcccagaacctgcactagaagcagatctcaaaaaaggtctgctgcaaaatatgatagcatgtgcttagataccactgtggcctggttagatgtcacgttaatattgcctcttattgagactgtgctgaaaggtacaacgacctagagtttggtcagagttaggcctcactaatcacaacacacaccaaaatgtcccagacaaagaataataatagagtctaacgggagtggatggattcgtagttccacggaacttttgatgagaatgattataaagtttcatgctttcctacaagaagtcaaaagaatttgatcagttcagtggacaaaaaatcctttatacttctaactggtgttgacattttcatttttaacttggtatattcttagatgaacagagcattcatttgcctgtaaacattatttcctataggaacatatattactggaagttatcctgattttcaaaactcattggccacatctccaaaattactagtaacactgaacaagtcttggagagatttaaaaggcaaaccaaaactattctttcccaactgtgtgattactttacatagtctattcatgttagtgcttgttttataaatgtagaagcaccattcctgcttggttatttatttgtgttcagttctttaagatcatgttttctttccttttcttaccaccaaaagcccatctttctaacacaagtatctctactgttctctggactaatacaataataatcttttgcatattcttctgctcccattgttttcctgattggccccaatctatgccccaacgtgctgcccaattaaccttaataaaacacaagttgattatgtaactcccatgctaaaaaaaacctcagtggttcatgattaagtacgtactttataactaagtgcaaatgttctaccagcattcgacatctaccacaaatggaatgctgcctgagcccatttttccattctaatctttacctcttttctaccaatagcctaaattccagcattgtctggataaaactatccatatttcttactcagccagaaagttttcttatgatcacctacatgttgaatacttatctatccgttaagaatcatctcatcaagtcagtttttttttcctgattcctctaccacatatgaatactacttccattagaatatctgattctttgaatctctcttgtactgaatattctactgaaattggataaaagataatagaaagcactaacctccaagatatatttaatgaccagttcgatccattaattggagtggcaaaatgttataagcggggagtagatggagttagtgggaatttatgcaaacttatgtttaatcacatattgaaaggcctctttatttaatcacatcttgcaagttcttgtgtcagataattgtgtttgggaagggaacaaaaaaattccaaagattctgagttaagaccaatatgaagaacaacagatgacggacactcttaatatctctccttccctccctcccttcttctctttcttccttctttcttccttctctccttttgttctcctccctttctttccttctctcagctttgttcattatccatgcaaggagatgaaatgaccctgactattaagtctttgtcctggagaagcacaaaagcaaatcaagtgaggcagatgttctgctctgccctcccccttggcaaagacacaagggtccagcagtctagaagcagactgttctgaaaagaacagttggcactcatgctttttacttttcctccctcagagagacctcctgctaggtgagtcccaggctctaagaaatatcctaccttaaatcaagcggaggtaagaaggaacaggacaactgttttattttttccttttcctttttaatccttgcacccaccgttctcttaaaaaacaggtcgtgttctaagacgatggatatcaaaactgctcagttttcagatatgtgctgggtagtgatgagaaattagagcaaatgctgaaagcaataatatttcatctgtgattcaatcttacctgtgccattcatagcacacctgccttttattaaagttatatttatacttgtttttctctttttctttctatgcttctgccataggccaaccttgtaaaatctttatggaaaacaatgggccttaatcttctgtgtatcccttgtgcacctgcagaatgtcctatcataagagtgtataatagaaccctgtataattgaatttttctagattacattgttgttgttgaacttaatgaaaactttatagggcacaagcacatcccattttttccagtttaatatattctatcatattgtctacagggagcatacttgtatttatcagatcaggagtccaaatgtttggacttgcaaacccgtagaatgatggttcaccaccctggttgtgcattagaatctgtaccaccttttaaaacatatgtgcccagcccacgcatactagctgaactggattctctgggagtgaagttctagcatctatattttaattcatttatttgtttatattttgagacagagtctcctctgtaccctaggctggagtagagtggcacgatctcagctactgcaacctctgcctcccaggttcaagtgattctcgtgcctcagcctcccgagtagctgggattaggggcatgtaccaccacacctaactaatttttttttgtatttttagtagagaagggggtgtcactatgttggccaggctggtctcgaaatcctggcctcaagtgatccactagccttggcctcccaaagtgctgggattacaggcatgagccactgtgcccagcctagcatctatattttaaaaatcttcccagtgactcaaatgtttagccaaagttggagcaactttgctttgtagctctagagagcacaattcgaaaatcactagactagattatctttaaagttgtttcttttttttctcccagctctaggattctttgtgaaagtgcttttattttatagatgaaaaagaaatgatcctttggctgaattccatttttaagtagtaactacaaatgagatgcagtccaaattttatatatgcctgtggtgctttcagcatatcttattgcttagttttcatgtatgcccattcatcccgctgctcattcaatcaaacctccactgtgtgtgaggtatgtgaactatgcactatcaagtcattctaagaatgtgggctatgagcaaggcacacatatgaaggaaaaccctttttatccaaatacaatacaaacatcctctaatgatttttattctttgcagtccaattaaaataggaagccatgccatcaaactagcctaaattccaaccaccctacctccaaataaatctgtgattaaaacaagaagagaaacaaaaaaagaaagaattggaaagattaaaactccctccttggaagcaaattgaaactagtcttgattcttgatgcctttgtgttattttcagaattaaatcaggaacaacaaaactactacttctgagagagaaagatattgcttgtaatttttggcttaaggaattcattttcttgagaagaaagtattcttggtgaactctaagaatagaaaactatcaatttacaactaggacacatggatttctccaagagttaacataatgcctaacaaataagaggtacagtatccacactctattagttaaatgttaacatttgtatggtactttataagtcacagagaaccttaagagatatcttttaaggctcctaataattttgtaagtggcaaaacactgattttatggctgacccagactcattgattgatccagaccctgaatcagaaactctgggccagctcccaggagtcagaattgttggcaagcttctcaggtaattctgaaaaccaccatgataactcaattcaaatttattgatttgttttattgctcccaggaaaatgatccagtgagcagattctggcatttcctaagaagctagcggcctttttccaggatttgcctttttctttcttctgtacttcttaaaaggaaaaaaaaaaaaaaaatcacaggtggcaccattttacctaaatctacaagctatgtaattctgctctgcacagctggtttattcttacagtcagttgtccctgctctgaagaaagcctctagctgctggcactggtaggaggtttgaatcctacccactacccttctggccataactaaggtcctaacagcctgcagagaacacaggcttccttcagcagtcagctgtaattacacgaaatttgtaccggacattgtagtacaaacccagcaacctgctgggacatttcaggggctttagcatttagttgggaaccactagttctagctgtcatactcagggagagaattggtcatgagctatttgtgttggtatatatctctttccatcagttaaaaaaaaaaaaaaaaggtttaaacgtaaaagacacagtcttaggtagctatcccctgccctttaaattatattagaacagcataatagctactttggaaatgccatctcatatataacatgaaaaaaagacagtcaaacagacccctcaaaataaccttttgtagaataaaactacagattttaagggaggagacaatgttgttttaaccttgtaattactcctaatccacacagagactggagagaagagtattttgattttatgtctggaatgaaatacacttgactagaattgaagatgcaagggggaaaaaaccctcaaaattaaaggaaaaggaaagtgtgtgtgtcaaccaccccatcttgctgtttctcaaactttccaaattcttttggttcaccaccccaaccttagtaatgccctcgtgtgtaacaaccctccaactattctggttacagttgctgggaaatttgtctgtcaaaagacgagaggttccaaagagttgggcacttttcttctcaggcaatagaaaacagggttataagacacagacatgaaacacacacacacacacacacacacacacacacacacacacacgggagttcagcacaccatgatgtgctggctcttttggccttaaggaagcattgcaggaggaggaagggtggaaccctcagatcacctgacctaaatggcccctctggctctctcagaactttaccctctgtcctgatagcgcttcaaagcgaacgggatattgggaaaaggacacaggcagtttgccgtatccttgggcatccaaaagggtagaaaggctttatgccttttattccctgcctgctgagaagaaaaagcagacatcccgtttgagaccactaggtgccccctcctttccctgttttctgtcttatactctttaaaccttcaaataagtacacgtgttgctaggttcataattaaagcgttggcaatgcccgctcccttgctttcaatttcatttgtacaaatgttcccatcattctttttaaaagccctgggcatatgttcaaaacatacaaccaaaacaaataaactgcataacctaagccaaacccaccaacaactggaacatccttcctatttgggaagactactctaaaaagctacttaattgcagtatattctgtgaatgaaagttcacggagctgaaaaatggaagtatttatgttagcatctgatcactaaggaaatgtggggcatacacataggccctagaatcagctacttaagattcaatggagtaaattttaccttgagtaacatctttagaaaatgaaatatttaggaaggaacagagttcctgtgggaaattttatggtagagttagacttcagcagactttataatttgcatgtgctgaggaagagtttatatttagaaccaagttcttgatcttatccagtgactgacttttcatgacctttggaagtaactttgatagcaaaattcctctctgtcatttacccctaaagctgacatgatcatagcagtgggagctgctatgtaaaaggccatgataagagtgaaaactttaccaatgagaaagactccaacgtgtaggcaaaagacaaaatttatgacaaattgattttaccttggtacagcaataataataataataatagcttaacttaattcaaaatttcgtgtgacatttctccaaaacagaataaaaagaactgcccaaatccactgtttgaagcagaaaggaaatgaagatatttggctgtagccagtatgtaattcagattggcatcattgtactggggcaccactgagaagaaatgtgtcctctgcaagccagcagcctgtggaaaccagccgcaatgcaatcaatcaacattgagggccaaaagctattgcttccctttctctcatagaacaaacagctcaagacccctataaagtaggcttatagctccaacaaaaactgaaaagtttataacaagtggtaccacctgtgcttatgtctcagcgtagccaaaataatttcctctcctgggtctcctatggcaaagggtgaggaatgtgacagtgagaatgcaaagaggaagaggtgccaacaaggagcctgtagagtgagtggattatctttgtgctagcagagagatcagcaagtctgtctcctttactctggagcaactgtgtgtgatatgatctcccatcccctatcaaaaaggctctgtcttcagaaaaacaaaagacttctctgctcaatgttgttctctcacatgattgagtatttttttgttaacaatgttgtattattacaatcctgtgtaaaactgggaatatggagcttgtattaaaaacacaataaagaaaacagctttgtacaagctagtattttggccataattatacttttctctgtcttctcaatgaataagaaaattttgggccaggtatctgcacaaagcgtgatagaactaggataaaatagcacatcctctagcatgtagcctacatttatgtaaatctggttgatgtaaagtctgttctgttatcactttttaaaaataaatctatcattctttctttcttatctttaatcataataaaaaccatctagggacagtccaaatttttcagaaagaacaaatttttcagtacaggaggcggcatttgccagtacaacaagaaaccagccaagttgctttggaggagttaagcaagtacatttcaataaggacccaaacaatccctggcaaccaattagaaaaacaagtcatcattgcattaagaaagccctcaaatatgagtgctgtcggtggaaaatagagttactcaccaactgaaaatgtttacttgaagtgagaattattttatggaaaccactgtgagttttggaatacttacaatctgttcaaattggtcactgtgtacagtgttactgcagcgatatgccctgagacttctaatctgtctgcctaatggagcaggtggtgagactctccactgagctgtcggctcctggagggcagggactatgtcttattcatcttacatcttgcacagtacccagctcttcaaagacagtcaataaatattgaatgaaggaatctttatatacatggcctcacttcttgaccccttggcatgaaatatcactaccccttcatctctatcctattgccctgcttaatttttcttctgagtgattattaccagctgtcgtgttgtatgtggttgttttaattatttctttaatatcttctttttccccaatcagaatataagctccccaagggtagggattgaagaggattgatttcccgtatacccctagtttctaggatgatacctggcacataacaggtcaattataaatatgtgttaactttatttttttttaaccaagttccctaagagctagaaagttttgacttttgaatgagtgctaaataaatagttttctctatctcttttttaaatttccttttcactgtcatctatttcatcttaatgaaggctggaaattatactctgagctttaatcaatagtgacaaaaagagagtttctttattatgtaagtggttgattttaaagaatgaaagcattgggggactaggtctcgttggtgtcaggcacgtaggtctgcaaccctgcagagaaatatgagtgacaggaaatgaagagagggaggtaagacaccaaatagtctcctggaggccattgagggtagactccatactaactgacaggctgtcccatgtgaatagtaatggtgcatttgtgcaccattttctagactatgtgtgtgcacctggtcattaaaacataatacggagtctctatcatactggacagaacacttgtgtccttccagactttgaggggcaaaactacatctaaaagattaatacataacttttgaacttagggtaaaaatttaataaaacaatgtaacacttgtttgccttgggcatttctacattgtccctatatgtgaatgaataacaattcccagccattatgaatagtttcattttactacccacatttaacggtaatgaaactgatggcccatggttcagtgacttgcccataacttgcatggtgactctgccaaatatgcacccttcaactgtaaactcagattttatttttcttttcaaaccaagatagaccaggacattctttgttcctcgtagatgttcatcaagtgtgactacagttgaacggactgttttttttgcaatttcccaacgtgggtatcaccaaatgaacctgggagagacaggaaagtggcctagttgcagagtctaattctgggaaaaacaaatgactgggaaaggtctgtcattggccttcccaatattgttccttctcttcactctgcacctcccctgagcatctcatactcttcaccctcatctcaatccccttggtgcctctggccagccaagtacttggttaccttgttctcctaatgactcttatctcttccctaatttatcataatggaaattgcattggagttgagagaacataatccctaattctgttaatagctgcatgtcatggaatgagctgttaaaacctccagagtcctgtttctttatctgcaaaagagagataattatatttgtttcatactgtgattgtgcagagcatggcaaatcacttacttgaaaccaccatgcggagcctggctcctaggaaatgtttgataaatgtgtgagacaatgtctagatatttattctgacctaagttggtggttccaatgaaactttcaagacagaaaaatgaagaacatttttctggtggatgcagaggagattcactcaggtggagcaagggaggcatagaagagaagtcaaaaatatagggctgtgctcatcagtggtagagtcttcaacctgcacaaccatacatggatgcattaaagagagtcacccatttataaaatggagataaaactaatccccctttaaagttttggggatgattaaatgaaagagtagactgacaatcactgatgtgttaaagttaattatgataaataacataattgcttatcactgtagctctttctcatggtgatgagaaagctctctggaagttctaggacaggcgtggtagcccatgcctataatttcagcacttcgggaggccgaggtaggaggatcccgtgagcccaggagttcgagagcctgggcaacagaatgagactgatctctacaaaaataattttttttttaattagccagacatagtggcacattcctgtagtcccagctacaaaccaggaaattctagtataatcacaatacacttaactcaagactagcagaataacattaggaattctttgtttggttcctttgtgcttcagttcatccgatacctaagaaattacaactatttataaccttatttcaagcataaggtaaacatctcaatgagtatttacaaaagaatatagcagaaacaggaagttgacagttataagataagcagatttagttgtatggatgctcttgtatattattatgctcaataataagcatcacctcatgtccttagataatgctaaacatctacaatgtataatatttcatgattttagagtggttagaggaacaagctttagacttagtaagagtgggctgaaatcctggctcagctacttaactgagtagctttgtgcatatgccttaacttctctgagccctgctttcctcatgaaggaggaaaaacagatccacttcttccagttgttttgtgacatggaaagatggaaaaacacacacacaaacattctttatgatgccgagacactgaattcaccaatcctgtagccctatgcctggaattcttacaacatagtgtctttattaagtaacattttgttggatttttctcttacttagaccttatcatatcctaactgataaatctctgcttttcaacacatcagtaaatgagcatataattaagataatagagcatagaattggcctgattttgtgtttccaccagttttgttctaatattctgtaccaggttaatccaaaccaagagagcctatctgagtatgtgtgtgtgtgttgttgttgttgttgtttaaacagctcatgagacatagctgtaaaaatttactcagactgttttttttaaatactacacttggggtatatattaggaatagtcatcaaaccaaataagctgatgaaaagcctataatatactaaatgccagtttacctttccttttaaacactggaaatagaccaggaatgtgattttctgtgggaaaaaatgtcatgagttctgaaaactccacatgcctataaacctcctttgtaatgctcatgcactatagtattccagggtaatcactttactacagtatcctcagaagaatttggagcttcgtcatttcctggttaaaggtttcattatttgctcctggcagaaatctattcaagaagaattcataggttcgtaagtctaagttaatatactctgatcatttaaatctaggaaatttaattgcaaaataactcagaacatttaatgttctttatgactgcagtaaaactttaccaagtgaccaggtaccctttgcaaataagaacttgttttccatatttgaattaaaaatgcaagtaagtttgcaaatgtctttaaaagttacacagttcaagaccatggtctgatattagggaaagtaaattgtgtttcaaatgtgtcctttaaaatgtatcctccttggccctttcctttaccaccctgtttttcttttttctttttctttatttttttttgagaggaagtctctctctgtccccaggctggactgcagtggcgcgatctcagctcacagcaacctctgccccccgggttcaagtgcttctcctgcctcagcctcccgagtagctgggactatggacaagtgccaccatgtccagataatttttgtatttttagtagagatggggtttcgctatgttggccaggatggtctccatctcctgacctcgtgatccaccagtctcagcctcccaaaatgctgggattaaaggcgtgaaccaccgcgcccagcctgttttacgttttaaatcatttgtatgagccaaattagaagaagaaacgtaatctgggctttattccaaaaactccaacatgaataacccagggtaatgtctatgtcaaattaatagtttattaaacgttgtttaatctacctgaataggtaaacaccttatttttacctgtgtttagaattttatgagacaccaatatctaggggacttttatagtgacagtttactttcataccgtgaaggaattcagagcaataataaattaacttattaaaaataaatagattctaatattttagtgagcatattatctttttgttattttggtcttttgatgtttcttattttctggcaataggtcaacttataaaagttcatatttgcttctatttacaaaatgatagaagtttatcaggaaaaaaatgcaaaagaactttcagatctccattaaacttgacacatttttcagcaacattttctaagaatgataaccttcagtgacattttacactcataaatgagacaggccaatagacaaagttaccagagtcatgattttgtcctttacccttttcccatttaaacactataaacaagtgtctgaggctcttctcagacaatccaattctccctttcttaaacatgaagcccatgaaggatgctgggtagaaatcgaggtgtctatgggcataactctaggaaagtgttgctcatgacccacttgaaatagcatggaaagaaagagggttgactctttccttggctgttgacaatcctagtcttaaggaggttgtcattctaccctcaagtatacactttatataattgagtttgaagataaagtgctttacagcccttagaagtggtttgtattaatcctctggaagataatagtttacattgccagatattacttatttctcaggaagtcatttgaaggaactgtatgaaacactgtgtcttagtgttcccaggagcttgatcattcgtaggagattggaaagcaggggaattggtccacaacatgtccttctgtgtaattcttcattccgggcacagacaatacttggagggaaataaaatgactactgtacccattgtgctctcagctgcctctgtaactagccagacaaattaaagagacagaaccagtaagtggggctaaggtgggggatggtggggaacaaaaatggaagaataaaagtaagtaagaaggggtggcatatgcttaaggagaaaagagaagtgctctgttgattattatcaacagaagtgctctgattcttctttctttcttttcttttttttttgttttcttttgagacagagtctcactgtgtagactagcctcgagtgcagcagtgtgatcaatagctcatcgtggtctcaaacttccaggctcaagcagtcctcccacctcagcctcctgagtagctggaattacaggcacatgctaccatgcccagataacttgttttttatttttatttttagaagagacgaggtcttgccctgctggtcttgaatgcctggactcaagcaattctcccaccttggcctcccaaagttattgggaagggattacagcataagttatcacacccagcctctgctgatttaattatctgtgctttataatcccttttggggtgcatagcataagaaagaatggccatagctataccctggtgactctggttagatgtcagtcctacacctcacccaagctacagttggttgcatttctgtgttcaccaggctttcctggtcagtaacatgaacttttactctgttgatactgtggaacacttattttactctgggtgagaatggaatagtaggcctaagttacacgcattcacacttcctttaaacagtacacctttctgtattccagagagaggcctgggtccccaagtatctataggcgtatgttgtcttttcttgggcccagcatgagctcaggaaaataagatctgttagctgagagatgggtgatcgagacactgatgggaaatctccttcaaagctatttcattgttcctgttatcctggtttcacagaaaataaatgtgctgagcattagtggagagggtcagtaatgagtactgaccatacaatgtgattgggcccaataggcttggctctgcattcattttttcattcattcattcatacttttctccatgtatttactcaaatgtccactgagcttggtaggcactgcaaaacactagaagcacaatgatgagaaaacaaagacacagtcagatcgctggcccattatcatggagctcattggccagtggcagtgagtcctggttgttattttagtattggaggtccctttatgattaatgtctactccctatcccaattgtgaattatagatttatcaaaatatcttaaacgttttggagggaagaatactatttaattttaatgatttgaaacagaatcctggatcttagcgttcctgctaactgctttccatttggcataacaatcttgcattgggaaagctcattagggtttgcctcaactttactcatagaaacacaaacggagagaggctggaccaaatctggaagccaagtgtccagtcatccatttcctgagactgctctaagcaccccacacgtgtttctaggtacactaaaatgtgtaaggagagaagagtgatccttccagttcacagaaaaggagcaacctcttggcagaaagtgagcctttttcgtctccctccctgactccttaagtcagagttttcaatttaaacatttcaaccatctacttgttaccctgtttacagaaaaacatacatcctatgtttgctgtggggtctgaaatgtagcctttcaaataacagctcagggattcctgggtgaaaagtagctaaaccataagaaacaaaggtggcatttttttctcagtcatagccctgagaaaacccacaatatattctgccagttatttacctagtgatatttgatataagctgggagggtagccatgtttataatcactgaataaacagcatataaatggcaactgtctgagagataagaagggattgtaaatcctctctcaagttggtttttctgaggaaggcttcaatgctaggtctggcgcatcctcccttagtgttacctgtggatatctacaggcacttgcttctaccttttctctttctttcacgaagatgatgatgaagcacagcatacgatcaactcctccttactgattttaacgccattatttttattgagtaaaattctaaatgttcagagctaactattactgtttaatctgagggtgcctattgggagtaatgaaataacattacattactgcaaagacaagcaaacaagcaaatagaccaggtatactgcaccttttttttccctttgccaactcatgctgttattcctcatcttagagcatgagcaagaagcgattattcatatgtataacaacacatttatccaagcacaaataaatagaattaaaatattttaatgtagttggtttcatttgcctataatattatctctatggtgttttcttttttatttcttgagacagtgtctgactctgtcatccaggctggagtgcagtggtgcaatcttggctcacagcagcctcaacttcctgggctcaagccatcctcccacatgcacactaccatgcccggcttattaaaaatatatgtatatattttttgtagagacagggtttcgccatgttcctcaagctggtgtcgaactcctgaggtgaagtaatccacccacctcggcctcccaaagtgctagaattataggtgtgagccaccgtacctggcctcaaaggtaatttctgatatgcagcagggatttttaattcttcatttcttctgtcatttatacattctgcctataatatttattaagcacttactgtattccaggcactgtggatacaatgggaaagaaatcaaatgtatttgttccctgatctcacagaactaacagtctagtgacagatattattcctaaaaagttgtatatcagtcaaatctttataaattcccattaataaccaataggaaaacttagtcttaaaagaagttttccatgaatatttttgtaaggaactcacttctaatatatccatttggttaggtcagacatattaggctttattcaagttacgtacatttttcctctcaaacatgagaatatcttccttttacaagatttctgtaaataattacaatgtagtatacagttagttctttctgtaatggaaggggtttactatacatcacaatgtactgatatatttacagtggtataagtttaagtaaaagacaggcatacagacaactaaccataattcaacgtacgtgtttttctaaaagtgtggaagcatagtatagtggaaagagtgagaggtggggccattggagacagagtttttaaaagcttttaagacctgcattttaaggacaaacagaattgaccagagaatggaagaagcagcggagaaaaagaatgacagtcacagagatctaaaaactcatccagccatagttttctctgtagcagttttgtcattcctctaatggagagagatcctcagttacctttctagacattcttctggattcttaatgagcttcttcctgtcttcttactcggaggaaagaaaggagaaggaaggtgccatttagctttctcaccaagaaccatgttttttcctgctgggtgggattgggctgactgttgtcaaacaggctggtagaaaaataagtggagaagagaagagctctggagtcctgaggatcatgtctcagaagtcaaccagagagcagataaaagcagtctggaaaaagtgtgttagagcaagaaccaacaaggtcttctcttttttcctttttccctttatagcatctagaagaatgaacacccaaagaaatactgtcgactcattgactaaaaacagagtggtgttcctttcatttcatttctcctggattagatttatttttatattgatcttatagtatctcactttaaacttacagctttggaaaggatcttaaaaatggtccaatccaatcttcttgttttacagattgcaaaattacagatccaagcggtgaagtaatttgttgtagaccacagttttgtaggcagggaaagctgagaccagaagccaggtcttctgatcctcacaaaagtagagaaatagatgagaaaatgtgtgaaaagtacctagcagagaaccagaatctttataggttcagaacctttatagctactcacatttgtagcatctttctcctcctatggccaacagaaaccaaactgagggactgtgattaagatattttagagggccatgtgtggtggctcatgcctgtaatcccagcactttgggaggctgaggtgggtggatcatttgagtccaggagtttgagaccagcctggccgacatagtgaaaccccgcctctactaaaaatataaaaattagccgagcatggtggtgggtgcctgcagtctcaactactcaggatgctgaggcaggagaatcaggtgaagccaggaggtgtaggttgccgtaagccgagatcacaccactacactccagcctgggtgacggagcaaggctctgtctcaaaaaaaaaaaaggtattttagagcatgacttctgaagtcaatctaaagtaataggcgctattaatggaagatacatgtgaaaattggtcaaaatcatacatgcacacttgcacatacattgcatacccacacatacttttttccccccacagtgaatactggtctgctgtttgaaattcctgtcaaatgccttaataataccaattatattaataatcagtaccactaattgagcatctactatgtgtcaggtattgtgccaattggattacacatattaattctaattccacaacaatcttgcagagcactgcacaaatgataataccaatggccatggtggttaaataatgttaaccatgggctaacaactatgatagcaactatcgtaagggtctagatgaaagctatagaatattttcaactcctagatttgttctgtgtggagtaagtagagagaggtgatttctttcttaaaatccttctcagcacaaatgcctagacacttaagccagcagctgttctccttagacattcattggccagtgttgttagacttaatcagtcaggaccataaacttgggtaatttgaaaattgaacaaagggcacagatgacaatttcttccaaacacacacctgctgggaactatgagtaactatccctaaggtcagacttaattggatttagatctaaatgcactctgacatgttgattattcactgcttgaaagtggaaggaagaaaaatgctgaggtgagaggtcaggagtgtaagctttcctctttctcccctgtgcttctgaagagaccccgttgaggactttcttttatacaggtcttgtattttcatttttcaaatcacttgcaccacctgaatgctttggtcctaatcccattcccaacccagatctaacagagtggacctctgtatcccttctggagccggtccagtaatggatattagagcctaccaaaggcagagcaaaatatctggggatatacattcaagaatcttcacaattattttctcccacagaattttaagaaagtgaagagagacactattagaaatgataagagtattgggacgaatgggagtgaatgaattttcatgggcaagctttatgttgcctcatttattttccataattcttattcccattttatcacaagtaaaattcttatccccattttaccaaaggagtaattgaggttcgggaatatgaaagcagtcatttaatgtcatgctgcagtaaacgcagtacttattcaaaacctagctccatctgattccttcagccagcactgagagaatggctatactgagactgtcatggcaggttaaacattggatgagacctattagggcaaactgggagaaggtgagtcctgagttgcaagacagagaaggaaaaggatgatgctcgattgcctgttgctgtttagtctaacttctgagactgcaggcattgggaagcctggaagcaggagtacaacttggttgaagtggaaggcacaggaaaatgagtaacccagaaggtagaataaggtgaagagaaaaatctaaataattcaagagaatgttctttgagtttggagctggactaagtgatgagactagacatggctggtggaggcctcaacatagcagaagagcaaccagggaaccaaaaggcactatggagccagagagtgggagggagcagactagactagctattccgaaagtttctgttctggaaaggaaatatagctagttgacttctgaaagatagtaagcaatgtttctgcagtaggcaaattgaaatccacaatagaaaggtgagtttgtagcaaagagaagggctacattttgatgtttactggactgatttgccataactcacctgtagttttctattctttgtttatgaaccattcattcatttcacaagtatctgtggagggcccactatgtgttgggcttgctgtgggcactggaggttacatactgcacatctggattatagaaatatatcaagtctccatggtaggaaacaaaaagttatctcctggattccagtgaggatgatgtaaagctcatgaccatcagtgagggggaatacaacgtagaaatttagtgcttttgagaatgggatggaatcaattagcatgactatgatagtgcaagtgaagtgctgattgtgttgaataaaatagaaacagacaagcctgtgctctgagaggaaacagaataggaaatgtgaatgagattgataatgatgataatagttcccatttggagaccctactcttcttggctgtgctaggtcctttacttattcaccattctgcagtaaaactctgcgaggaagttattattaccctcattttatagatgaggattagggtgaccaatcatccattttcctgggactaaggggtttctcagggcatgggatgtttagggataaaactgggagagtccctggcaaactaagatgattggttaccatagaagaaattaaggctcacaatgccacaagtaaaggacagaatctgaactcatgttcaagattttctgatgccaatacatgtgtctttccattataccacacagcctctttttttttttttttttttttttctgagaccaagtctcgctcttgtcacccaggctggagtgcaatggtgggatctcggctcactgaaacctctgccttccaggttcaagcaattctcatgcctcagcttccctagtagctgggattatgggtgcctgccaccacacccggttaatttttgtatttttagtagagatggggtttcaccatattggccaggctggtcttgaactcctgatctcaggcgaaccacccaccttggtctcccaatgtgctgggattatcagcgtgacccaccgtgcccggcctgcctctgtctttagaaaacctgaatgtacccatgtcagatcaaatgctttctataattatgaacatagagaacattttatttctagagccaaattatttccacgcgcttaattgtgttaagtttttcactgccacattcttaacaacttgcatccatatacgacctagcagatttttgatgaattgcatccttcaacagaagaaaaatatttactatgacacacctttatggtttttagtaatttggttataatcccaaaggtgattggtaggaaagaactcaaaaagagatttgtgtctacaagacaccaacatctggaagaaaacgaaatgaaaaacttaagtccagctgatttgttcataagccagacatattgatatttggggacatctggagggctgattgaaatttttgattttcatacagatgttcagtgtcatatagacacagggataactacacatgaaaagatatgcttaatggtatttcactaactatgtaattgccatagttatgaaagggaaccctttcataatgctaatgtctgtgcacagcatggagactcaccttattggcctatgctgttatataaattatattttatagcatatggttattatgttccaggacatagattttgacccagatagccatgtcatgatatagatgttatggattttgaaattaattaccttatagctctttttgttttaagttctagttggttaaatgcagttaggaagaatggggacatttacttgatttctcgagttttcttaaataacaaacatttaaaatgcatggtttaaataattcaagttttaaaatgatgtcacattctaactaaatatagtcctagggctgaattttttctgcagtcagcaccccctaccccttgactgttgtgtgaagcagctgcattatctacattttgccaagtaaacaaactctgcaccgtgcaatagtgtttgttgtttgctaatgtgctggtggttaaaaaatgcttaaaaactctaattatacatttccatataatacagaggcgttgtcaggccatgcttcattcctggaagatatacacacacaaactgcatttctattttgttcggttcatggtagataccgaataaatattttgtaaatgactaaaaaataatatgaagcttaactgattacttcctaggcactggacattgggctaagcatttaaagcatatggcattactcaatccacaaaatcatcttctgaagtgactttcttatccccattttacatgtgagttaactgaggtacagaaatattcagtaagtgacttgcccaaggccacatcatctagtacatataaggcaaaagtggcttttgaacccaggtttgtcagactccataacgcatgctattaaccattattttctgctgcctcttcttaaagtgagtatctcacggcagagacctaggtggttgagacccccaagactggtttaaggccactgtcaaacacagacatgcacagatcattttattcctatttcattaaaaaccatcgtggcagtgagatgctggctcctgcacatagatggaagaagtaacaatttttatacaaaccccacttgtacagatccaaaatgattcagtcactgggtgagcaaaagttgttttaagccaaatgacacctgtaaagggaagttatgtcaccactctttccttttaaatctgaacttcttacttactggcctggtctgttgcaaacatcaatgtgtcataaaaaatacgttgccctataaatcacatctctcctgtaggagattacaacatttttttattgcccatctaaagctcttgaagttttgtttcttcaaaacctatcctagttacaaagagatgagatttttacttcaaaggaagcagtaatgaaatctacacttgcagaacacaaaactacctctttaagagttttcaattgttgatatgtcactcagttttgcaattgccatttaaaactttagaatacacagaagtgtccaccttctatgattatttccccgccactttcagcaatgtatgcaaacacatcagcgctttgatgtcaagtcttatgtttcctcactggaacttacaggaagaaccatctcaattcttggaaaaccacagcttccagtgcatttaacatgaaacacattaggaaattcattatatatacccacaaacgtggggattttaaatcaaatagctgcgtttttcaatgtgaaaatttaaaaggaagaataattactctcactctttaacagaataatcaagtggtattagtttccttttgctttcgttaaagagtgctcatcactccatgacatacacaaaatgacaagcatacaatggaacttacaagtgagatcatcttacttctgaaaagtggaaaaacaacaaaacaagagtgctcatcaagtactatgtgaaagtctatgtttatgtaccaacatagtaataccgttcatttacatggctatttatagttttaaaagtgcttttacatttattatataattgggtgatataatctggatacttgaaagcataccagatataccttcacccaatggttttcttaccactaaattcaaggtagatatgcttttcaggcattgccttgactaaaaaggtaacatgaaataaactcctctagtcccatatagattttagacaaagaaaacaaaaagatgacaaacattgtctccctcgtgtgaaaccaaaattcataagaggggcttttatgaaaggtttcccaacagtaccagactacaacctaacaattcactcttccaagattaagtgcttcaccttgagggttatttttatggctgcttctaactgtggtgcttcaccttagccataaaatatcacctcagagggatgagctaatggtgtgtgtgaagatgtttctcctgggaaccgtcatgagtgagaaacacaatcagggaatagcatgttgcatgcaaagcatgtgacagaggagtggagagaacacagactttggagtccaactatcttgcatccaaaccaaggttattgtacttattaacttgaaggcccagagcagcttatgtaacaaccctgagctttattttccttatctgtataatggaggcagtaatatcctttccttataaggttattgggaagatgaactgtaatattgaatgtaaaatatttatttgttgctcaagatattaaataataaggatattcattgcccatctattattagacctgtgtccctcctattgcagttttccaggcagaaacccaagagggtataaaccaaggaattcattgcagggaaatgaagaggaggagaaagctttagtctaggatggcttcccagattctgacttgggcatctggatgattttgaagatgatatttactaaaaccagaaatacagagagatggtagaatgagagtgagaaagagaatgagagagagtagagagagaaagagagagaaattgcgtaatatgtatgtcttgttcacccctgaattctcagctcctagcaaagttcctggcacatagtaggcaatataatagatatgtgttaataaataaatgaataatgagcaaatcatacactgagatcacccagcctaattcagggcccatatatatttaaaattttttattttatttcagtaatgtttggggaacaggtggtttttggctacatggataagttcgttagtgatgattttggagactttggtgaactcatcacctgagcagtgtacactgtgctcaatgtgtagtcttttatccctgatcccccacccacccttcccccaagtccccaaagttcattgtatcattcttatgcctttgcatactcatagcttagctcctacttaaaagtgagaacataagatatttggtttcccattcctgagttacttcacttagaataatggtctctaactcaatccaggttgcgtgaatgtcattatttcatttgttttatggctgagtagtattccatggtgtatatataccacattttctttatccacttgttggttgataggcatttgggttggttccatatttttgcaattgcaaattgtgctgctataaacatgcatgtgcaagtgtctctttcatataatgactccttttcctctgggtagatacccagtagtgggattgctggatcaaatggtaattctgctttcagttatttaaggaacctccacactgttttccatagtggttgtactagtttgcattccctccagtagtgtaaaagtgttcccttttcacagtgcctatatttgaattagatatatgatcaaaataaatatatgtcagaatattctcatcaaaaatatataaatatctaacttggcatgtatgccctttatcaagggctacaataaaagacttgcatagcaattcaaatgaaatggattgagaatgaaaaatacagaagggtaacattacctagatacatcaggaaacagtttcttttccaggcttaatgtgctaggaagtaagagatactactgttttccatctcacatttctatctggatgtgtacaagtgtaagaaactattggcctcaggcaagaatcttgtcacctctcataaattcatagtgcttccccttgtctccgcctgaagacttgcaagtgacacagaaccattcaccagctagacttcatcttttgggtcaggactgaatcaatgtggttagaaaaagtgtatgttaaacaaaaggtagcctggacctttgcatggaaagatctttattttaatgtacttattagacagctattttcagattcccttaaatatatccattcctagaacaaattttcttcctattttgtggtatattttacttttctctcctttgagagagtcttgtcttccataccactgtaggcaagcagataatctatctgctatttatacagtacatctatttttccaaaagcattggtctctaggaagcaaggtgctattataattgcctattttcatttgttacttcatcatgaaagcaggctaaaaatgagggcgtgagaaggccacgttcagcagctgcctgtctcaaagaggaaatgggcaaaagaggccttttcagtcatagaccaggttcagctgccttttaggattactgatgaggtaagctttatcattttaaagtgtaagtaagtcatggggtttttgaagtgaattgtatcactttaaaaataaggatcaaggtctttggaaaatcaattagcccctgtatttgaacagatgggatacatacacctctctcagaacttctgtgctttgaattaatctaattttttttttttttgagactgagtctccctctgttacccaggctggagtgcagtggtgcgatctccactcactgcaagctccgcctcccgggttcaggccatcctcctgcctcagcctcccgagtagctgggactacaggcacccgccaccacgcctggctaatttttgtatttttagtagagacggagtttcaccgtgttagccaggatggtctcaatctcctgacctcgtgatccgcccgcctcggcctcccaaagtgctgggattacaggcgtgagacaccgtgcctggtcaatctaatttttttttttttttaaggtaagcgttctttaacatacgtggaaaagagtgatctttaaaaaacaatgctaatacattaaagagccatttgttatatgcacaagttagcagcgtacaatttgatacaaaattagcaactgataattctgaaaaacagcaatttcttcttactaggaaagccacacaatggcctgaattcttctccctgcaatggacgcagcgatggaggcaggatatactcatacacctgacatggcaaaattgggccaagtagtatgttaatggtgccctttgtcatgagtaaatgcattgaaaacatttattaggaattgccacagagttctaggaaccactggaagcaaaataaagtcattctgtgactgcttaaaatcaccttgggaatcccagcagtcgtggagttgggcagatttaggtgatctaaatcaacgtctatgtctcttgtataagacttaattttatctctgcttttctgagtgggctaaaaatccttgtgattatcttccccttcttaacgtccccttatgaatgcttgttttcttcttattcgttcacatactctcccctttctactccctcccttcctgcttttcttttctctgtgcttgaggtttgggagatgaaaggaaagaaacagaattccactccgggcttcttctgatcctctgctgaccccagccctaacagcatgggagagttcagtatgactaactcctccatccacgctgcttttcctcagcttgtgatggaaattttgttcagaccagtgtagaactccttggattctggcatatgacttctctagcagggagtaggccatttgtgccgatggatatggggagtcagtgcaggaggaaagaggacctttcttcatcatcacagactctgaaccactatgttagaactggaagggactccacagaaatccttgcccaatttatttattcatgccacaaacattttccaagaatctgtgttaagcactggggatgcagaaatataaatcctttagaatctctcttattatggataaatataataataatacaaagttgaatatatatatatgtgtgtgtatatatatgtgtgtatatatgtgtgtatatatgtgtgtatatatatgtgtgtatatatatgtgtatatatatgtgtgtatatatatgtgtatatatatgtgtgtatatatatgtgtatatatatgagtgtatatatatgtgtatatatatatgagtgtatatatatatatgtgtgcgtatatgtgtatatatatatatatgtatgtatatatatagacaaagttctacggaagctcagaagaaagaaccactagttccaaggttgagaggagggaagattttaccaagtagtggacatgcaaaggcccagagaaataaaagcacacagataattcactgaaggaaggaagtgtgagagtataggcatgaagtctatggaagtgaaataagataaagacaataaagtgagtcatgaaattaagatgtcattgataatcttgacgtccatgttggtggaatagttgaatccaactatagtgagacatcaggatatgagaagaaaaactaagttttctaagaagtttgatggtggataagagatgaacagtttagacatttaattaggatgctgagtaaaggaaaaaaatatatatgatagaagacatttgaagagttttgttttgttttgcaaataggaacggaccaagagagaaaaaaatctgatgggacaagagaggttaaaacagaagcatgttcctggagataataaggaaaagatgtgaacagattatcatttaatggattagcattgtattgggcagcagccacctttcattatcaggagacagaaagagataaaaatctgtgttgccacctgcaaaatacgaagggagagtagagaagggagctgagtgtggaaaacaaaaggcttgtagagaaacagaaagcgaagtgaccaagaaaggaccatgatgctcaagctcaacatttccagtaatcagagaaacaccatttcactctcagaaaattgacaaaacccaacaatccgcaagcaaacaaatagcaatctgacaatttcaagtgttggcaagtgtgtggagcagtgagagctcttatggctttttgctacacctgctttgagagcactttggcacaatgtggtaaagatgcaatcatacttccaggtatgcagtgggggacctcttatgcatgtgcacaaggaagatataacctaagtggccatcaataagatacacatttgaaaatgtggtatattaattgggccactcttcagaagttaaaatggactagggatgcatctatcaaagtggaaacacatttatgacacaatgttgagggaagaaaagctcgctgtagaatggtatgaatggtaaggaactatttatgaaaaattcaaatcccacagaacaattttatatatcattaatgaatacatctgcatatgtggaagtaaaaaaaaatagacaagaaaagatatacagctcaaacatattgtatctctcacattgtattttgtaaagcacacccgaagatacgcacacaatggaatatcaggcagcaataagaataaccaatctaggccaggtgcggtggctcatgcctgtaatcccagcacttttggaggccaaggcgggtggatcacctgaggtcaggagtttgagactagcctggctaatgtggtaaaaccctgtttctactaaaaatacaaaaaaatagccaggtgtggtaatgcgtgcctgtaatcccagctactcaggaggctgaggcaggattattgcttgaacctgggaggcagaggtttcagtgagccaacatcaccccactgcattctagcttgggcaacaagagtgagactccatctcaaaaaaaaaaaaaaaaaaaagtctgcaactgcatgcgactgtatggataaaccttgcaaatataaggttgggcaaatgaaaccagacactgacaaatacatattgcatgatttatataaaaacaaaagtccatgtatcctgataggagtcagaatgtgggggttggggggtgcttagaaactgtaagtgggtatagatgtggtcatacatgatgcttgtaatgtcctatatttttatctaatttttggttgcacaggtgttttcaacttatgaaaagtcattaaactgtacacttagtaaatatttagtaaactgaacgtatgctatattgcaacaaagtgtgtgaaaatgccatttgaaaaaggaaagtagttttggggtaaaacggcgtattaacatttatttactcttggttgatgggcttatagttgtttttatgatatgtccttgttgttaatttagaatatttcatcacaaaaaaggaacacaggaaccaacttaaattaagaattacaaatagtagatggcaccaatcaacagagagagagacaacacacaatttggagcccagagagcccaagagatctgcttgtggcaaaaccgaaaaaggaatcaagtctcttcacttctcactgcaatgcagtgctgtcttttgcatatatattgtcacaagctttatcttttcactttttactttggaaactgattcaacttctgcctttaagtcttgtgcagtactcttacactgtgttagtaactatattaattaccaattaaagaactttgcaaccctcctagcagctgtagatatttttaaacatggggatttgagctagttgaaagaatgacaatgtttccttttctgcttttcagactttccccaaagcctctatgagactattttataagatacaccaggataagatcaaagcccttccaagagggtctggcattctctatctttttggttgccaaaataaaaacataagtcaaattcaacactattaatggataatatgttcccactctctctgtccttttgaaaaagagactgagagttttactttggaaattcagtgatagtgagtttgattttaaatacaccaaagagttggaaactatcttttagataatagaactttcaaacagtgtggaagatttttcagggaagtccaacagacttcaactcactatgaataaataaaatcgagaataaaatgtcctttgtagcatgctttctcctctccccgatatgtgtgcaattcctgtgccctgcattcgctttttaatgctcagataatcccaggtttttaatccatgtcacttcagcatgtcacacttgattgcagaatttggggaagacaatgagtgctgctgaaatgtgagacactcctccagactttagtttactgtgtaaagacaggtaggaagagccttctagatttaactctcatatatcataaagctaaagcaacgagaaaactatacatttcacattaaagttgggcatttctcttcagagagaagttgagccgaatagcacttgttaattccgaggttcagcacactcctaggagcctgttaatatttgctgccccctgtagtttgctcttgtaaaaatccttaaaaaatcaagagagctatttaaaactccagttgctcttttaaatctgacacacttgtggaatttcatttcctatcttttttcagtccaactccacacatcagagtgttgacatggggcaagacaagggaatactactgtgagcagtagtgatttcatttaagtgaataaactgggggaaatgattgccttttaaacatgcagactatattgcacggagaaagcctgctcacataaatataattttctttaaaaaggcagaggaagcttctgttaattgaactactttctcaatttcctattgccttcagaattggttatggacatgatttccattgtctccaatcacaatagcttctaataacattaagcttaaaataatacagaagaacaggacagacttgtggtttgttcatttgctgaaactaatatagatggcagaaattttacccaagcttaaaatagcataaaatagcatatagaacacaaaagtcaacactggctcaatgatgaatgaaatttcattataaagaatcacaacctaacatctaattttagtaaaaattttggaactagttattgccacaaacaaatgctggggcagaagataataaaactgtttactttatcaatagattaatgaagaggagtaggtaattctgagataatatcatcccatagtctgtgtgacttgaatagtttcaggtttaatttcatgattcaattggcctgcatatacgtaactcccagaaagattatagatgagtgcaattaatttgtacagtgctaaagcttcccacaggcacataaaacattccctttagttcctttagagttaatattacagattcaggttatttttcatcagaaatgaatcccaaagttgataattccaatcaaattggtaaaaataaaagcatacctacagttgctttgagatcaagaaagagaactgtagattagttctaattttatataggtaactgaagtgaataaatgcctctttctaaaaagataaaaacaaattaaaggcttttgataggagaaactttaatatatctacaatactgtgaaatacatcaggataaattatgtttgctgatgatcattttcattatgaaactcttacaatatagccataatatttcattttgttgaggtagagacagaggccaaaatctatcaatcaaggaatatttattaaatgcctgtgggttccctgctgaagggaatatcgaacaagcgtaagttgtagacactcatctcaaggtacatgcagactgactcatagctaaatgagtgaaaagacaataagcataagagaagtttacaaagagatgtttttttttcgtagcatggtcagaaggtatggattgagctgggctggaatttagataagaagacagatgtgcaggttgaagggatcagaaagtgcttctgagggttgatacactaagtgaagctttgaggtaagctaccacatagtgatggtgtctggctaaaagcagacacagagaatgtgtggaagattttgaacctggacctagagagttttgatatccccagagagggccttcgccatgagctgtctgcaccagtaaaacaacacagacaaggatttcttagtgggacatacctccaggggaacccaggactcagtaccaacctgaacaatgctttcagggtaccctgatggaaagacctggccagaagtaaagagcctcctctgggaatctggtaaagacgttggcaacctgagatatggggggcacacagctggaaagaatgctgagttggataaacatttgattccttgtcactttcttactgtgtgaacttcaggattggcaccaaacttctctggcactccaactctttatttacagagtgaggattagtaacaccccatctgcctatatcatggaaccttagcgaaaagcaaatgagataatatggcaaaagtactttgtaaactgtaagatgctacataattaaagatttgcatcaacattcatgacacattttctctgattcattagctgaaatatggtcaccattaaccttcttccactcttccctattaattcatttccatttctcacttctctgccctagacactctctttcctgaaagtttcccctcctcatcccttgtcagtcttctcatgccctcaactcttatgtatgatttgtaggacattatccatttttactcatattctcttttatataaggatgtgtgcctctcagtggcattatcaactctgagagaaaatgaacttttttttttcttttaaaataactatctgagagccccaggaatctcctatacttggaagcaaagagttggggatagaggggaaggagaagaaaactgaaagtttggtgatggtggcagaggaaaacctaagtacaaactgaccccatcccaggtagcctgactgttctctcattctactcttggtgattatttatacaatgtaggtggcaatccagatttctattttatatggattgaattgaataactacaaaataataatgagttaataaaagtattgcattacattttacatatataaaatagcattcaaaaactaaattaaaatacagaggttgagtgagattttatattttctacatcaactactttaattgagtatctaatccataagacttggcacgaataagatctcaatgcaacttttttcaaacctcaggaaacagcttaatttttcccccactgatgacaaatattgttcaattattactaacactggtatgatgggacagaatttggaggaccatgcatatcagacagagaagtcatctgtgaaaggtcatattaagtaggggaaataaagtgatagattttattttttaacaagacatgtttgttttatatataaaaagactattttcatgtttcaatcaactcactgacaaaagcaaaaatataactaggaaggcaaataggcaataatggaacataagtggagtattttaataaaagtgacttcatgaaaatttgtcattttggattatctgcatcagtgatccacctatcaaatgtctcccttcataaatttctgtatcagataattttttctctcttaaagagagctgcagagctaacggagaaccaggcaagataaaaaaaagattgtttatctgctgggcagggcttataaagccatcttgcatttgctacagaggcctaatccaagagcaccgtaattatcatttctgaacctgggtccctcaactggcatttctcctttgacttacaacacctgaaaactaaaggtagcatgccctctttaacaaaagtgagttgaacataatggactctgtgttcccgtatttttaaaattgactgtgttctcaaacattaattcaagcagttgcacaattcaagggatgggattgtgtctccgcatttttgttgttcaactagagatcggcatatctcccagctatgagtatgcataaacagcaactgcaggtaatacttggatggtgtcagaaaggtctcaaagcagaaattttctggaaaagtgcactaaacagattgtttccatttttgctccccccatcctgcaagtggtagctgtttcatggcaaggagcagttgtgggaaggttgttgagggtggttttaaaggaaacagcctgtgtttagactggagtagttgcctggaacccacaaaagtgaacgtttctcctttcacttgcatttgcaatgtgtcacaatggggattgctaaatttcgcccagatgctagtatatgcatgttttaggtatccttgtgggtgagtgcttggcagtcggcatgttgcctttgagagtagagtaaaatgagagaagttcatccggttaaaatctagacattcaaagagcaacaagtatttgttaaagtttttagaatgggagcagataaacgatttggaaacatgaatctttgtggaaaaacaaatccaaattattccaaacatgcttgaacacatcttctttttgagatcatttttctttcttaaattttttactaaaatctttggtcagtgtagatgtgtatcaaaactgcattgtcaagctgagtaatggactattctattcaacgactgttggtcatttttaaggccgtgagcggacttatatgacatactatataaataatttgttaaaatgatatttcataaaataattaggttcaaaggtattaccttggtgaaaaagcaccattagaaagtaatacaaatatcccttttaatgtatcaaaatgtatgtttaaaggaggcaacaggttatcataccattaaaatatttgtgcacaggaatgaagatattgacatttaaagaacatgatggcaaaataatgttttggattttgctagagttttcaagagttttaattgctcatctaaaaactgtaataaaatggcacaatcataaacaataaagaacaaacccaaattttgtattgtaaatggagtgaatggtccaaactgttcattttcagaactacactattattaattttaaaataatcagtccttgggtcaggtcactgtttgcccagaatttgaccctgcatggtggtgctccaccaattttccttttggattacattgatatatttaagtaggttggggatggtcatgatgctgtagtaatgatagtatagcagtatgagtgacataaggtctttctgtagaatcttcaaaatgctgagaaagacagtcttgtttgtagtgaataaaccaaattagcactgaacacacattaaatgtgggggaaaatggtcccaaagaatttaggattgcagttgtaaaacaaatgcttggtttagcataagatttcagcaatgctttttagtaggcatattgatataatatttttggctttgaaagccaaaactgacagctttatagaattccatccaactttaattttcatttttcaaaagtaataaatgtcttgctgacctaagtacaggtaagtacatgatgatagcattgatatcagtaggctttatcagattggaaaaggggatatagaaaaaaggaggaaaaggacagtatcaggacacatgcaagaagggcatttgaacagttactaagaaagggcaaaacacaaggaacagaaaaaggagaagccaaagagttttcagtgagcttcatgggttcattggagctcaacagctctgcacatatcctgcagtgtataccacgacacaaatctaacatttgcatcttctgtactctgattgtttctgatgggtaagagtctgagctcagaaagccacctaaactggctgggaaaagttccagaagagaaagaaacaagccaatggcaaaattccctttcctcaattatgacagtgaactatttccatcaatatgaatgactagtcataaatattaatgataatggtaaaaatgatacatttgtagagcactgttaattttgcacatgtgtttacatctattgcctcacaacagcagcatgcgataagtagggcaacacttcttatctccatttcacagatgaaaaacaaatgcaaaatgctccatgaagtttaagtaacttatccaagctctcagcagtaaagtagtgacagagcagaggctggaacgtaggtctcctgattgccagcacttagctgttccccttctttctctggctactcccaattaattagccatgctagtgtatcctaaatcagaaaataaattacttgaaatgagtgtaattgcatcacattattcattgtttcagatgagcatattctctttctagatctcattgctgtccttggtctgactttataatttccttttgttctctaacaaaaatagtcatactaatgattttcatacatataagatgatgaaatccttctctgaaattccagacacaggcataggaacaagtaccagctctctggctttgtgtcaacaattctggataaatctattaaattctctgaatcttaattttcttacttgaaaaataagggattcagatagagtgttccagtcagcctttttctacacaattgcacatacacacacagatatcccatatgcataatctctattcagttatttatgagtctattactgtattatcatatactatgcacatattgacataatattaatctcatttaggcttccaccagagtttctaggtatatgtgtgtttatgacactgtcatgtgacagaaactgttgctactcaaagtgttgttggtagaacagcaacttcactgtgaccttagagatgattagcaatgcacacctcatgacccaacccagatttattcaactggaattggcatttttcttttcttttctttctttttctttttttttttttttgagactgagtcttactctgttgcccaggctggagtgcagaggtgtgatcttggctaactgtaacctccgcctcctgggttcaagtgattctcctgcctcagcctgccaagtagctaggactacaggcaatgtgccaccacacctggctaattttttgtatttttagtagagacagggtttcatcatgttggccaggctggtgttgaattcctcatctcaagtgattcacctccctcagcctcccaaagtgctgggattacaggcatgagccaccacgcccagcctggaatctgcatttttaacaagatgtttgatgatttgtatatactttaaagtttaagaaacagcaccatagatcataagcttgtaggaaaaaagaaaaataagccttggcaaatctgtccaacacatggtatacggtggttaaaaaatctatttgaattttcaaaatgccatttgaaatctttacaatttcagtcttcaaaatcatcattcgaaggtaatcataatttctatttctgttaagatttttcagaaggttaatagtagtaatgaagggcttaggtgctttattgtttgttttgttgtttagtgaaggcttcacaagtttttgggaagtaaggaaaatgaatttagaatgaagataaaaatcttattttgttcaaattatcttgaataatgaaacatcaaatagtgaaaatctcaccacgtttaggaatccaaatctgttgtgaaacttgcttaaggccacgtaataaataagtggcttagggatctatcttattctttttttttttaattcaaattttattttagattcacaggtacatgtggacgtttgttacctgggcatactgcatgacgccgaggcttgggatatgaatcatctcatctcccaggtactgagcatagtactcgactattagtttttcagcctagccacatgctattacactaagcaactgactgactcaggaacatattcaaagaaaaggtccatgattggtagaaaaagtgtgaagccaacttttagtcatccattagcatcattatcctgtctttaaagtattaccattcctgctaatgtttatttttccaggttgtatgtcctcctggaggaggtatgcatttggattaaatcaatcactttcaaaagcttcaaatcagtaggtttgacaaaaattttcaacaacaaggatgaatgttgttgcactgtaagtaacaattttgacatgaagtatccccaaactattttgtaaacctccttaaaataaaaacgaataaaaatatttcaatgctacatattaatgaattatagtaagtaattatcttctgtgggctttagtttccttatcagtaaaactaacaaactgttctgattctctacctttaaaaaattatgggaaatttgattactatttaaaagactactctgtaaagcaatatcctacaagtgaattgcataaagttcatggtaataatggttgacttaaatattgttttatgttccacatatttacatatttatatccctccaatttattttgaaaaatggctcaaggcagtgtctcatagtagatttgtaaagcaagaagtctaaacgtgttcacttacatgtggaatatattatgatattatgattcgattatttattttttcaacttcttattctgaaaaatttcaaatttacaaaaaagttgcaataatgctacagtgaacactgacattctcttcaccaattgtgaataatttgcaacaaatggtttattgctatttattttctttctttcctaaaacatttgtgagttagttttagtcatcgtggcactttacctttaagtaatttagcatttatctcctaagaactactaggacattctttcgtataaccacaataaagttttagaactcagtaaatttaagattgatatgatgctcttatgtaatatatatccatattcaaatttcctgtaaaaattgtatagctgcttatttctcaaacttggatccaatcaaaagtcacacattaggccagatgcagtggctcatgcctttaattcaagcattttgagagactgaggtgggcagatcacctaaggtcaggagttcgagaccagcctggccaacacagtaaaaccctgtctctactaaaaacacaaaaattagccagctatggtggcgcatgcctgtagtcccagctactctggaggctgaggcatgggaatcgcttgaacccgggaggcaaaagttgcagtgagctgagatcacaccactgcactccagcctgggtagcagagggagactcttaaaaaaaaaaaaaaaaagctacacattacatttagttggtcatgttaaatattatttgcaaaacacataatcgtatattactgtggtctgtagatatttttctaaaataacaaatgtacttgggaaaatcttatatttgattgtacactcataatgcatgttttcatataattgaggtaaaaatcaactcaactaaatttcatgtttctgatatataaaaacacacacacatttttccactgaaatgagcatgtttggacatttttggtttgcatacacattaaaattggccgaagatgtaaacttgaaacttggcaagattgtaagaaaataaggccagagttagaagaaaaacacttcaagatttaaatgacacaaatgattagaattatgagtatacaaaaatgaaagagaacattgtctacctttaaggtcattctcaccagtcatctctgattgggtggctaaaagtcaagatgaagctaaaggatttatgtaacatgcaaatcaatccaatgtttatgtttcagaaaaatcaagcagttccaaagtaaagcattctgtgatgattttaatttggccatggtttgcatttctgttcctgttttcatagatatgtataaacttggcctttcccttggccttcttcccgtaggctctcagtggttgccctcggaagtgctattttctttctgtgtacattatggccctccagatgcactgcacttcctttgaatgtgcaaaaaagatgaggactataagcacacatcagaggataaagaattagccagccggacgtcgtggctcacatctgtaatcccaatacattgggaggttgaggcgggcggattacctgaggtcaggcattcaagaccagcctggccaatgtggtgaaaccccttctctactaaaaatacaaaaattagttgggcatggtggcgagtgcctgtaatctcaactactcaagaggctgagtcaggagaatcacttgaaccagggagaccgaggttgcagtgagccggaatcacgccactgcattccagcctgggagacagagtgagactccctcgcaaaaaaaaaaaaaaaaatggagagagagaaaagaattagcctacccttcttccattgtaggctagcttggaataatttgtcttgacacaggatatttcccaatccaacgagtttattcacaatgatcctaaggaaacaaatcatgtctgtgttgctaacttatactacacattaccaaatgcaaaaataaatatcaccatagaccagcttcatttggaatgccaaagtttaagttttccaagtttagtcttaagtgagcatagtttagctttacatttcattttcatatgtgtagataaatctgtacgtccaaagctcagagagacacatggcaaatatttcttgaatgcaatgaatgcaacacaaacataatgaattaaatatttgtaaggacctatgccctgagtttggaaattttcctgactagatgataattttatccttttgagtgccattaaaacaaacatctttttttcctccttatagtcatggtttatagaagtttaaaagtttgatagcaaggagctaagcactgtttttttaagcacttgtttgagcaaattaactctaccttgttccaaattcttttacaattagtttgagtgacttaagaagagagtgcactgtagatagattctgactttgtcatttttcatcagtgtaactttggggaagttactttgtcttgatatagttcagttttctcacctgtaaaacagaaattaattatctacctcaagaggtgatcaaagaagtaaatgagataatgctatgatacactgacgtactacattgtaagaaatatttaaaaattaagacatcatcctatacaaaaatgtaaaaagtaaccacttgcaaaggatttacttgtaaaaagtgctgaaattccactaatagtgggaatctgtggcattaatgcctggggttcctcccatttgtccctgctcccttccaccttcctctgcttgtcactaagacaattctattatgttggggagctctcccaacagcagctctcttagcctaaattgtggtcttttcggcagactatatgactatccagacgtttaacagggagatccgaaaaatgagagcaccatggaaggtcttgctaaactctacacatccccggctgactgcaagctcacacaaaggcagaggagacttgagagggcccaaactttccatccatcactgattgcctggaaagctgtgcatatgcaaggggaacctggaagggcccagtggaaagtaaaagttaggacagaattgaaaactgccgaaattttgcatatgtttctcaacccacatatgtatctatcagcagatgacatcatcaggcatgctagcaactgcatactacaatagagatagattctgcaaattaaatccaggaaaaatacttataaacacaccaaataaacaacaaaaaataatagaaacaattatagctctcaggaaaaaaaaatccaatccagagctgccacaatatgttatctaaaatgtgaatttgtcaacataaaattagggataggcaaagaaacaagacaatatgaattctattcaggaaaaatagctatcattataaacatgttcaaggaataaaatagtatttaaagaaacggagaaattagctaggcatggtggtggtcacctgtaatcccagctactcgggaggctgaggcaggagaatgatgtgaacctgggaggcggaggttgcagtgagctgagatcgtgctactgcactccagccaaggtaacagagtgagactccgtctcaaaaaaaaaaaaaaaaatatatatatatatatatataaagaagaaaaatacacagcattgaatcaacaaatggggaatacagataaagcaactattaaaaacaactagatggaaatttttgtgtttaatggtacaataacaaagatgagaaatttactacatggacttaatatataataagacgtgtaagaaggaagagtcagtgattctaaaaagagatcaacagaaaatattcaatcttaagagcagagaataaaagattgaagagaaatgagtatagctccagggacctgtgagataaagcaagtgtattaatatacatgtaatatgagtcccagaagaaaaatacataaaaggagcagaaaaaattgaagaagtaatagctgaaactttatgattttgatgaaaactatcaacagatccaggaagctcaagtacccacaagtagaacaagcactaagagagtctcatctagaaacagtatggtcacacagttgaaatcttaaaaataaagagaaaatcttgaaagcaggaagagaaaaatgactcaccacatacaaggaagcagcagcacaattaatagctgactttttattacaaacaatgggggccagaagacagcagaatgttgtaatgaaactgctgaaaaaatgtctaccaagacatcaatattcagcaaaactgtctttcaaaaatgaaagcaaaataaagacattctaaaataaggaaagactaagatgtttgttgctagcagacttgcactgtaagaaacactaaaggaatttcatcaggctgaaagaaaatgacattaatgagtagctaaaattcacaggagaaaataaagttattaaattcaaaagaattgaaaccattcaaagtatgttgttttattataattaaataagaaatcaacaacagaaaaaaattgggagatacccaaatatacagaaattaaacagcacatttttaaataacccatggggtaaagaagaaatttaaaaaagaaattagaaaatactttgaactgaatgaaaataacaacacaacatacaaaacacttaggaggcagctaaagtaatgttggaggctgatttatagctataaacatctatattagaaaaggagaaaagtctcaaatcaataacctaagcctccatcttaagaaactataaaaagaagaacaaattaaaccccaaaacaaacataagaaagtaaattgtaaagatcagcttggaaattaaagaaatataaaaataataaagaaaattattctttggaagcagtaagaaaactgataaacctttaactcgattatccaagaataaaagggagaaagtaattactaaaatcaactacagaaagaagacctatcattattaatgctacagcctcataattaaaaggctcataatttgacatgaatatgaaaataaattatatataataattatgtataattacatatgatataaaatatataattatggaaaactttaaaacaaattatgcaacttagatgaaaaagacaaacttcaagcaagatacccagtagcaaaactgactcaaaaagaaaaacttgaatagacctacaaaaagaaaataaattcagctgggaattaaaaatcttctcataaagataagcccaagatcacattgtttccctagtgaattatatcaattcaccatttttacataaactccttcagaaaatagaagacagaacactcccaaactcattctatgatgctggcattatgctgataccagaaccaaacaaagacatcacataaaaataaaactttaaagcaatattgcttgtggacatagacacaacaatttttcacaaaatattagcaacctaaatctacccacataaaaatgaattatatatattgatcgagtgaaatttaacatacaaggttggtttaattttctatattcaattaatgtagtaagccttgacagacaaaagggcaaagccatatgatcatttcaataagtatgaaagaagttttgacaaatcaaacacccattccagatacaaactttcaacaaactaagcaaataaggatttcatcaacctgaaacaggacatctacaaaaattctacagctagcataatacataatgatgaaaacggaatgcttttctcctaagattgaaaagaagcaaagacgtcttttattcaagattattctggaaccatgtaaacatcaaataaggtggaagacatagagatagagatagagacagagatagagatagagatagagatagacagagatagagacagagatagagatagggatgggaacaggaaagggagatggagagagagatattaaaggcaaaaaaaaaaaaaaagaaagaaaaagaaaaattggaagtaacactgtctttatttatagatgacatgatctggcatgtagaacatcttagagaatctaccagaaaattttatgctatagtttaaacagttgtcctctccaaaacttatgtagaaatttatttatttattatttatttatttatttattttgagatggagtctcgctctgttgtccaggctggagtgcagtggctcaatctcggctcactgcaagctctgccacccaggttcacacccttctcctgccccagcctcccgagtagctgggactacaggcgcccacaaccacgcctagctagtttttgtatttttagtagagacgggatttcaccgtgttagccaggatggtctcgatctcctgacctcgtgatccgcccacctcagcctcccaaagtgctgggattacaggtgtgagccaccgcacctggcctttatgtagaaatttaatccccaatgtggcagtattgagagtggggcctttaagaggtgattgggtcatgaaggatctgtactcgcaaatggattaatccactaattaataattgggttaatggatttatgagttatcaccatgtggaactggtggctttacaagagaggaagagagacctgagctagcatgctcagcccctcaccatgtgataccctgcactgccttgggactctgcaggaggtccccaccagcaagaaggctttcagcaaatgtgctccctcaaccttgaacttcccagcctccagaactgtaagaaataaatttcatttcttatcaattactcagtttcagatattctgttataagcaaaagaaaatggactaagataatctactagaactagaaaacaaatttatcaagattacgtaatataaaatcaagatacaaaaattaattttatttctatgcattagcaatgaacaatccaaaagtgaaactaagtaaaaattatgttcataataggataaaaacactcagaaataaattgaacaaaagaagcgcaagccttgtacacagaagactacaaaacattgctgaaagatattaagaacatataaattaatggagagacattccatattcatcgattaaagacactattattaaaatggtcattctcgttcaaacttatctgtagattcaacacaatctgaatcaaaatgctggcacagcatttcaacacagtcaaaatgctggcaggcatgtttttgtacaattttaaaatttatatgaattcaaaggatctaaaatagccaaaaaattgaaaaagaacaacaaagttgaaggattttcattattgatttaagaacttgctataaacaatgtggtattgtcctgagaagagacatatagaccattagaaccgaagtgagactccagaaataaaccctcgtatttaaggtcaattgatttttgacaaaagtgccaaggcaattcagttgggaaaagatggtcctttcaataaatgggttgggagaactggatgcccatgtgtgtgtctgtgtgtgtgtgtgtgttgtgtgtgtgtgtgtgtgtgtgtgtgagagagagagagagacaaagagagaatgaatgacaacacttttgatacttacctcaaactccacacaaaaattaactcaaaataaatcatagacccaaatgtaagagctaaatctatactatttttagaaggaaacacaagagaaaatgtttgtgatcatagattaggtaaagatttcttacatatgatgccaaaaacatgatccataaaaatttttaaaaagcaataggtgaacttgagcaaaatttaattttttttctgtttaaagggtggcattaagaaagtgaaaaatgacccacaaatgaagaaaatatttgcaaattatatttctgatagaggaattatatccaaaagatataaataactcataaacttcaataagataaacaactcaattaaaaatgagcaaaaggcttgaacagacattttatcaaagaagatatatgaatgattaataaaaaaattctcgcttcgttagtcattagataaatgcccattaaaactgcaatgcgatacaaccctagtcccactagaatgactatattcaaaaagactaacagtaacaagtactggtaaggatgtggagagagtggaatactcatacattactagtggtagtgaaaaataacataccacttcagaaaaacattttgacaattctgtaaaatgttaaacatagatttggcagatgacccaggaattccactcttaggtgtttacccaagagaaataaaaatatatgtccatgtaaaaatatgtatgcaaatgttcatagtagcattattctttatagacccaacgggaaccaaaccaaatgtccatcagttggtgaatggataaacaatgttatatatacttggaatggagtaataacgagcaatgaaaagaaacaaaccattgataaaccctaaaacatggatgaacttcagaaacatgagaagtgaaagaagtcagacacaaacaaaatactacacattgtatgactcagtttatatgaactttacagaaaggacaaacctacggagacagaaaacagatctgaggttgtctgggaccaggttgagaatgggaactgactgaaaacaggaacttttggggtggtgggaatgctacaaagcctgattgtggtaatagatacaaaaaacattgaattgtacacttataatggttagattgtatggtatgtgaattatacccctataaagctattaaaattagagaaaaggttttactaaaaataaagacaatggattaattcaggaaatgtataattttttaaaaaatatattcattgtttagttaaataaaatggaaattaagtgtggagctaaattatctgagttgaacttttggcttgttgaatttctgtagaaccctggtaaagttgccacagctaaacctcaggttcctaaatggtagaaacagaggtgtaaatacctatgtccctatttgaagtcactgttgtacagctcaaatgagatatgaaactgctttgtgaggcataaaaaactacacaaatgttaattataatgatgatgattcttcccattaatctattttgaaaagtcttttaggttcttaagcttaacgatttatgaatttataccccgccattttgagaagttcaataatatcacctttgtaattctcttttcttctcttcaacataaataccacagaattttctttaaaaaaaaactttatgaacatgacttgaacattacctggcacatgtagtaaactttaccttgtgtgtgtttgcaataattggcaatgggataaaaaagaaaataccatgtatttcataaatatttgaaaggtaaaatgtgagtattccttgttgtaagataaaacgtgagtattccttgcctttggagttactatttttagaatccgcctttgtaagacatattactgaagacatctctctgttggatattcacaaacatatcaaaggtaaaaacctacataaaaaataaataaagcattttgcaacatccatttgtttatatcaagcctcaaaaatcaagcaaagtatattatttacagatgaggggttctattctgagtctgcatacatctggcatagctcatatttttttcttaatttaaataaaaaagtattataatgagtgacttccatttaattgctatacattggtattctgacctaaatttaggaatgcgttttgcaagaatgagcttcttattaaggcaaactttccctaccccattccccatactttcccttacctttcctgtcttccaaatgaagagtgactagaaagagtgaagaaattcatgctatcaatattctgcaaataaacgtatacttattggtggacaatgaagatgagactggaagtcagtgaggtattgtgattatgacctgctttgggggtagatagtcttggattaaatcctggaccatctaagtattacctgttcatttatttgtctattcaacaaatatttactaagtactcacttcatgctagcattgtgctaggttctgccaatgcaatggtgagtgaaaagatacatggtgctgttattctcagagaacggtcagtttggtcatggattcagagattaattatacaatcagactaatgaatacgtactaaaattgaaagtcagtgctctgaagaaaagaagcatgattcatgcagtggcatgtctagggatttgacctctagagtggatgattttaacacctttctcttctatatgacaaaattgttttcaataattttaatgtaataatgattaacaattactattttaattattctttaattttaaaataaataaggaagaatgcatttgaattttgaagatattactcaaattaagcaaaatattttgtgtgaactaaaatttgttcttaccaaataacaatattacactttgccatttgttctgttttgccatttgaacttttaaacagaaataaaaactccaggtggtcataaaggattgcagaactgaagcaagtcaaattatttctttcacttacaactactgcactatgattgtttatttaaaacttactctttaagctcagaaatatgtagagtgataggggtcgagataaatctggacctgaagcaagctgtaatgattgggaactgttatagaattataacagtttgaacatatttgaacaaatatgtgtagctgagtccatgttgagggctgacaatgtaactaggagttctacaaattaacttccacatagaatataatgcttacgaaagcataattttaaacaatttgaagtgtacgtgaatattgaaactcaatagtttagaatttagaccaacaaaagatttattcaggagagacaccatttagaattgatgatttaaggtaccaataaaaagcagactaacatttactggattttattattgtttttagatcctctgcagacaacacacccctttattgcttacaccctggcagactacttctaccatcctgtccttagtataccagatatgtgatgaaagcatgtgaataacaaaaggaactaaatcacaaaacatgtgccagaaccctgtacgagaacacatgttcaaggaactataaaacatctagtgtggtcagtgctaagaaagctctctaagagaggaaaatatgaaagcagtttgaagacatatatacacaaaactatccagagtctcatatgtcatgctcaggattttcatttttatcctaaaaacaatagaaagcctttgcaagtttcatgatgaagaaaagggtgtgtgtgacgaggaggcatcataatgagatcaacgttttgaagaatccacttccactagccacagagaatagtttagatgaaaaccagtgtcaatgaaggtcgaagatgctacaacactaatataagtaaaagacagaactctggtggtgaccattgaatttaggtgatgtgatttacaacaagaggcatatatagaaagtaagatcaacggggattgtggaccactgcatgtattagtgggggttctccagaagatcggaacaatgtgatatgtgtgtgtgtgtgcacattcgtgtgtgtgtatatatacaaacatatttacaagtatacacacacacacatatatgtgcatatacatatgtatcccaagagctacagctggcaagctagagacctaggtgagctgatgcggcagctgtagcctgaatgtcagcaggattgagaccaaggaagagatgatgtttcaactcaagtccgaaggcagaaaaaaatccaatgtcccagctccaggcaatcaggcaggaaaaaatttcctcttagttgagaaagggtctacttaggctttcaagtgattggatgaggcacatccacattaggaagagcaagctgccaattcaaatgttagcttcatctaataaaaacacccttagagattcaccctgaataatgtttgacccaatatctgggcatccggtggcccagttaagttgacatacataattaatcatcactttggacacaggaatgaaggagaagaaggtgtttagaaagatccctgtctttctgatgtgaacaacttgatagctggtggttacattcactaagctggagaacactaaggaagcccaaggttttatatcaaagatcagaaattttatcctggattttctgagtttgtgatgactcagtgacatctaagtggaattatcaatggatatacagtctgggactcagaagagaagtttggtttagaaagaataatgtgggagtcaacagcatgtagatgttaatggaagccatcagcacaggtagagagggaaggaagaagggggttactgtagaggagagagagagagagaagtcctaaaattaatcattggacaattatgacatttattatgacaattatgactggatcagaaacatgaccctgccaacaaatctgaaaatcacagtcagaaagtagtggatacactatgagaatattgtataataagcctaaggagaggatggggtaagtgggggcactgaaataaggggtgttccctagaatatggaataggtggaagagtaaattagtgacgatgaactggaggtagtgtgtagagaggccttttagaaaagtttgactatgaaatagaacagagatttagagttgtagattataaaattctcagtgatatagttgtaaaattatccttctttactaaacccagtgaaatctgcttaatataatcaaaagtagcaaggtagctcacatagtgctcaaaaaatgcatttgaatgaatacttccttgaatgcctgacatcattccctctagaaaaccattcacaactcatgactttacattttttgtttcaaattggaaacaacgagctataaaatgaattctattaaatgtagtgaattacaagaaatatttacatatatcaatgcatgtagcacatgactaaatctttctcataaaacctcctgtggtatcaaatatccaaagcaaacagtgcacataaaccacagggttcaagcaaattctgcatataatcgtgttctctttatgaggcctcatgggataaatgcctctcttttctctctgcacaaagacttgtttttgacattttctttcttttttttttttttttacaatccccattgtataggcaatgagaatcacataatagattatttcttcttcttcttcttcttcttttttttttttttagacaaagtctcccttttgcccaggctgaagtgcagtggtgtgctctcggctcgctgcaacctctgcttcctaggttcaagtgattctcctgcctcagcctcccgagtagctgggattacaggtgcccaccaccagcccagctaatttttttttttttttgtatttttagttgagacagcgtttcaccattttggccaggctggtctccaactcctgacctctggtgatccaccacctcggcctcccaaagtgctgggattacaagtgtgagccaccgcgcccggcctacataacagattgtttctattttcctctttgctctggggcaaggaagcacaggtctaagctgtggtctacttgtaacaatcagaaacaggaaactcagagcacggtttgtctacatatctcatctctggtttctttttacttttctctcctttctttttaatcacccctattttctcagccaatctggagaactcttgttgtcctctgtatttttgcaatatgctctaatttttctgaatataatggactataaatataaacaaacaatcctagcagtctatacaattctgaaggatgcacctataaatgtgttgcactgctttattccagaacataattaaatggaacatttgctaaaatggcatgattcagacctcaaggtttattgctagagaccatttgatggaaaggcagtaaaggatttgcagtttcactttaaaagtttatttttcatgtgtgtgcatgtgcatgcccattctcccaccacacctgtgtaactgttaagcaagtttctctcttcaaggatgggaggtgtatttttaacaagcaagagacattaagggggatttcgggcctcagaatcaacagcgtcacaacaagctttcaattaaggggacatctgttgggaatacaggggaacctctacccaaagtcagttgctaatcacactcacctgctcgagcagccagacagccctatgcactgagaaaggttgcttatttcctccatgctcaatcacactgcattaagtggccacctgggcaatgtgttagtgcacacctgctgaccgacccagtctaacaaaacatactgaaatcaaactcttaaaatagagagaaagcagatcctctcttggcctagaaagggagacagaacaagcaaagtagaaaaggcccaagactggaagtacacaatgaattgtcagaaaattagccttacctttggaactttttgttagcatggtgcactgttttttaaacagtggatttgagggatttttagcagtaaaaaaaattcagccctttcacttttagaacatcagcatttaaatgatatcagaccaaataacagcctcatctgtagagggtgatactgagcagcactacgagagagagagtgtgtgtgtatgtgcgtgtgtgtgtatgtgtgtatgcatgcatatatagtgattacttgtagcctatgttagaaaacatattgcacactttccttctctggatgcataaaaggtgcttttcctaaaacgtacaattttgcttaactagatgccaactgttgggaagaaatattgtatatttcagatatttctattcggatactttaaaggaatcacccaaaggctagtttatgacacaatattgtggaccaaactttctctaacacaacagattgtattactatggccatttgcacgggctaatttctatctagtacaagtcatatttgttgctttttgtttgcttgatttttgtttttaattaggaatggtctgttaacaaacctcagaacacctacaaagttcgactgaaaaagaccacacatcgtagggaacataagtttatttctgaggatttctaaacccacagtggatgtatgcagatcctttttaccactttattatgctcttctctataatactgcaaagtcaagaaggatgagagctgttatctaactgcagtttaataaatttcaacctgtaatcccagcactttaggaggctaaggtgggtggatcacccgaggtcaggagttcaagaccagcctggtcaacatggcgaaatcctgtctctagtaaaaatacaaaaattagctgggcgtggtggtgcacacctgtagtcccagtgactagggaggctgaggcaggagaatcgcttgaacctggggggtggaggtgcagtgagccgaggctatgccactggattccagcctgtgggacagagtgagaccctgtctcaaaaaaaaaaaaaaaaattcaaccagatttatctaatttctgttggccaaactccatgcaatatttttttctctagtttatttttcttgtttagatacagacttgctctattattatagttttcattctaaaaattagcttagcaaaacctgctgattaatgagggcattgtgtgcactgagaatgctgtgtcatgcagaaacatctcacttttcctattttttccatatacagatgttcatcttaggtataatcacatttatagtgttttggaatcactaatgtgtatatatttatacatgcatgtatacacgtatccaactgcagtcacgcatgcatgcacacacatacatgtatacatgcatgcatgcatccatgtatatgcacatctatgcacaatacatacacatgcaagtgcacatacatgcacccatacatgcatacatacgtgcatgtatcatgcatacatagatgtacatgcatgtatcatgcatacatagatgtacatgcatgtatgcataagtggatgcatgtgcatgcatgtatgcatgtacacatgtatgtatacgtgtgtatgcatgtattgtcttgttacaatcaggagtatatatatataatgttaacaagatgacatatatatgtgtatacatatatattttaaaaatgaggctgggtgcagtggctcacagctgtaatcctagcactttgggagaccgaggtggtcagattgcctgagctgaggagtgtgagaccaccccgggcaacacggcaaattcccatctctactaacataccaaaaattagctgggtgtggtggcaaacacctgtagtcctagctacttggggggctgaggcaggagaattgcttgaacccaggaggcagaggttgcagtgagccaagattgcaccactgtacttcagcctgggtgacagagtgagactccaaaaaaaaatattaagacaatattttttcttaaatactaaggaggcaatgtatttggaatgaggaaaaacattgaaaatatctatcttggtcatatttttatagtttgatcaaaatgattaataaacaaacccagcccttcctctaagccaggggtatccaatcttttggcttccctgggccacactggaagaagaattgtcttgggtcacacataaaatacactaacactaatgatagctgatgagctaaaacaaaaaattgcaaaaaaatctcataatgttttaagaaagtttacaaatttgtgttgggccacattcaaagccatcctagaccaatgggctgcggcccatgggccgtgggttggacaagcttgttctaagcatttacacgcaattgatataagacagaatactaaaacatgacacaacagagtctattattcctaagaagcttctccattttcttatttatttatttatttattattttattttgagacagagtctccctctgttgcccaggctgcagtgcagtggtgcaatctcggctcaccacaacctctgccgcacaggatcaagcgattctcctgcctcagcctcctgcgtagctgggattacagacgcacgcccccacgccaggcttacttttgtatttttagtcgagacagggtatcaccatgttggccaggctggtcttgaattcctgacctctggcaatccgcgcgcctcggcctcccaaagtgttgggattacaggcgtgaaccaccgcgtctggccgaagttattcttttctgtctcaaaccaggaaggtctagaaaacctgccactggaatctgtgaggctattcattgacacattagaagatagttgtacattcaaagtaggaacagaactattatctataccagaaacatgaacttgattctattttaggcagtgattcttcctgtgttaaagcttcctgaacttgctctcactcctctctcacacacagacatacctcacacacatgactatccaatgattattgtgcatatctgctcatcagactcacttgggaggctaaaggctaattcccagtaccagtttctggacttattaaatctgagcatgaggatgtggggcttatgaatatgtattttttcaaaagttttcgcattttttttttcttttttgagacagagtctcactctgtcgcccaggctggagtgctgtggcacgatcttggctcactgcaacctctgcctccctggttaaagtgattctcccaacttaacctcctgagtagctgggattacaggtgtgtgccaccacactcagctaatttttgtatttttagtagagacagggtttcaccatgttggccaggctagtctcgaactcccgacctcaagtgatccacccaccttgacctcccaaagtgttgggattacaggagtgagccaccacagctagcctcccaataaattttgatgtggtaagtccagcataatcttgggggagccattgcaattaatatatcagctttggtaaatttaaataaacagtccaaagtgcattggaatggatgagtgagatctaaaactggacacagaagaagaggaggcaaaataaaaacaataaaagggaaagttggcaaggaacaaagacagatagaatcccagtctctcttcacaaaggagaagttattacgctagtgagaagggattagtggttaacatcaaattcatactgttaacaggcagagaattcgtgtgtagtttattcttttaaatcttcatgttaatacttattaaaaggattaaaaggatgtattttgtgcctttgtatttttctcagcaaattttcttgactttgttttttttctctattaagtccagtgttaatatatatttttgttacagaaatttttctgaaatgggtggacccaactgataattttcatcaataccaggactttcagaagagagctcactaggatattacttacacaatcactcctgatgaggaataggcattttttatgccaaatatctacacatgcacatatacacacatcatgctaaatgaaccattactccatggtcgtatcccttacctcctacgaatatgagaatacaaaggtcatcagggaaattcttactttcttaacaatagtcataataacattccatgtcttagatggctcttgtttattgtctttgccatccaactgcgtaggaactgattcagaggcctaataggcagggatgcagtttgatttagaatgaccacttccatgtagttttttaacttcttctaattttattttttttgagacagagtctcgctctgtccctctgatgctctgtctgcactggagtgcagtggcgcgatctcagctcaccgcaacatccgcctcccgggttcaagcaattctcctgcctcagcctcccgagtagctgggactacaggcgtgtgccatcacgcccggctaatttttttttttttttgtatttttgtatttttagtagagatggggtttcatcatcttagctgggatggtctcgatctcctgaccttgtgatccacccacctcagcctccctaagtgttgggattacagtcatgagccactgcacctggcccaaagatttttcctttcttttcttctctcgtttctttttctcttcttcctttgtttctttttctctctttttgtctgtctttttttttgttgtttttgagactgagtctcgctctgtcatccaggctggagcgcaatggtgtggtctcggttcactgaaacctccgcctcctgggttcaagtgagtctcctgcctcagcctcctaagtagctgggattacaggcgcctgccaccacgcccagctaatttttgtatttttagtagagacagggtttcaccatgttggccaggctggtctcgaactcctgaccttaggtgatccgcctgcttctgcctccctaagtgctgggattacaggcatgagccaccgcgcctggccagcttctacgtacttcttattttagaagttactcagcaccgagagcaagcaataaaacgagtcataccaaaaagctacattcctgtctcctaagccccaaccacactccactcctgtggcccgtggtccaaacagaaaataactggagaagatgaggaggtcaaaggatcagggaactaagtaagcattatgtgaattcaccagcaagacgtacagaatgcttgtgtttacattgtttttatggaactagcagaataaaactgacctattttaaaaatgcaaaaaaaagttactcagagccctttaaataataagtttaacaatcttaaatctctttaaaaaataacaaaacttaggtaaactctccaagtattgtccatttcgttgatattctgtttataaacacatgctacctaccaaacggcaatgaacaccaggacatgtggctctacgtgccagatggaggtaacacacctcgagtgtaatggctttgaaacaatgcagtgagtcatatgtgattttaagctctgcctttttgagcaaagcattgtaaaaattggaaaatgcagtctatatttgaagcttccaattgttttaattaaaaaatcctttaaactgtattataccatttacatagctaaaaagattgaactgctttgcaagccattatcatttacaaaaagaaggcagtcattttctaaatttagaatgaagaaatattttaattttattattatgtctactatttgtcttcataaggcgcagtcccaggggcctaagctacgattaaatccagcactcactcatcacacctatgattcagtgcttctgagaaagggagtttaaataagtctacagtactgaaaaaggatcaacattggcaaagtatcaacccaaaatttttaattctttaatgcaaaaatattcttgatatttttccttaacaagcactatttcaatcaggtatttattgaattctcaatagttcctcagctctcttcttggtacaaggagaggtaggaagaaaaatacaaaacctagtccttggtgggatagaaagagaaaccactgagtacttgcaacatgtcaaattcactcttaggtgctcttggcatgttgcatcaatttgcggaatttagagtttatttggggaggcaaatattcttcttgtaacaatcagggaatcaaagtggtacctgaatttcacagaagctgtcaactcctttgtcttgtcttagcatctccccacctcacctccctagacagatgagtccatggaggcctctccatcattagcaaactcgccaactcctcacttctacttgcagaactgatcttgtctgtagaaggaaactgttaatgactctgcagcgctgtctcatcatccctacccccatcaatttctggccattcagtagggcttggcatgagtcagccacccagatgtgaactaggctagaacatatatttcttggaatatttctctgatttgcttttcttgaaatgtgacagtgcttagaattcatgaaatttcaaaaagctgggtaatcagaataagcctatgaagccatcatttacaacatggttgccatttgcttatgctgctgatgattgtggtggaaatgaacatcatgacttgcttggtcccatatgttatattccgtaaatactttgagaagtcctgagagctcaggcaataaaactagagcaattcttcctgctctttttacagccatttaaatgttggtactctcccaggtttctgtcctttgtccgattctcttcttacattatatttcctctgtgtaatctaatctactccctgactctaattactccctatgtgatgatgcagccaacgtcttgactccagcctgagcatttttctgggtacttgtgtccttttatgcagctacttattggtcaccttcctacattaaagggtgctcttataggcagggatggtgtaggatggctccgaggcaggggatgcaggggaaggtacattctccactatatagtctcccaggtttaaaataatgcaactctaagaaaggtgaaaaatgtcaaaagcaagtaagtcacctacataatttctgaaacataagacacagctgtgtttgttctgacaggaaaaaaatttcaattccccgaaacagaaaaacaaaacaaagaaaacaaacaaaaaaaaccaactacaagttgctaagctgtgcccacccccaccacccccgccaaccaagatatttttcatctgatgaggatggttacctctgcatggagatcctcaaaagactacatcaacgtgatataaatagtctaagccagtatcttggatgccatcctcaacttttcctttacgccacacctctaggcaccgagtactgttctgttcagctataaacacctcttgtctcctttctccccctgacactcactgttagagaactgctgtaattagttcaaggagaacttaattcaacgcctcctcaatttgtcagctggactattgcaatatttttttttttttttttttactgatctcttgctttcaagtttgtccttattaattaagtacattttccattctattgagttaatatttctcttgtttacaatccttcatcaattctctccttttcaaaccagaacccaaactacttaaaatgacatgaaatggactttaggtctagccctggtatttatagaaagtaccacctcttgccatgcctcatcacacgatttctagtcattcccaagcttcttgcaggcccttaacatgacgtgccctcttccatcatactccatttgcccaaactgcatcctctgactggaataccttttcattttcctgctgccaaggttttatcaactcagcttctacttatccttcaaaacttatttcagatgttaccacctctgggaagccttccttgatcaacccaatctgtataggttgcctattacacaatccattgcagtatcttatgcttacctcaataaaaatgacaataggagtaaaatataataatatttattgggtaaacactaggtcctaggcactgtgatagcattttagtaaattttatctcgtagagttttctaatactttatggtaagcgtctgtccacttcatggtttctcctatgtgaccctgaactctagaaaggaaagttctgtgttttaactgaaaatttcttattcacagagcccaactcagtgccttgttcactgaatggtttaaagtctggaaaggctgggactgtatgttctccatggaaaattccctgattctttccactggaaataatcattcccatgtctgaattctattctgtcaggatttgtatttcttccttgctcacattaaatatttttatgtatataacttggctgcccttcaggcaggctgtgcacttactgagtgatctcttcttgataattctttctgaaaacatctctaagcatcttctaaaccatttgaaattcaacttgtaaagactattcaaatcttccctttcttatatttaaatgttttaagtattaagacaatctaaggcagaaaacatcatttgagcccagggaataatgatgagtcagtttacatttctttcttttagagtgtggaatttttgagctcaaagggaactacaaaatcatgtcatccaattgcaaccttttgacagaggaggaaactgaggtccagacattgaatgatttgtttaaggtcacagagcaagttagtagctacatttttactagctcttaagaacataaaaaaaaggcaaaattctaatttaacagcttgaaataagagtcctacctctacaccttctcttttctaagacatgcttcaacattgactgtttttctcatatttatttatttatttttattatactttaagttctgggatacatgtgcagaatgtgcaggcttgtaacataggcatacatgtgtcatggtggtgtgctgcacccatcaacccatcatctacattaggtatttctcctaatgctattccccaacatgacaggccctggtgtgtgacgttcccctccctgtgtccatgtgttctcattgttcaactcccacttatgagtgagaacatgtggtgtttggtttcctgttcctgtgttagtttgctgagaatgatggtttccagcttcatccatgttcctgcaaagaacatgagctcatcctttttttggctgcatagtattccatggtgtatatatgccacattttctttatccagtctatcattgatgggcacttgggttggttccaagtctttgctattgtgaacagtgctgcaataaacatatgtgtgcatgtgtctttatagcagaatgatttataatcctttgggtatatacccagaaatgggattgctgggtcaaatggtatttctgtttctagatccttgaggaattgccacactgacttccacaatggttgaactaatttacacttctaccaacagtgtaaaagcattcctatttctctacatcctctccagcatctgttgtttcctgactttttaatgattgccattctaactggcatgacatggtatctcattgtggttttgatttgcatttctctaatgaccagtgatgatgagctttttttcatatttgttggccacataaatgtcttcttttgaggagcgtctgttcatatccttcgcccactttttgatgaggttgtcttttccttgtaaatttgttaaaattatttgcagattctggatatttgccctttgtcagatggatagattgcaaaaattttctcccattctgtaggttgactgtttactctgacgatagtttcttttgctgttcagaagctctttagtttaaataaatcccatttgtcaattatggcttttgttgccattgcttttgatattttagtcatgaagtctttgcccatgcctatgtcctgaaaaggattgcctaggttttcttctagggtttttatggttttaggtctaacatttaagtctttaatccatctttcattaatttttgtataaggtgtaaggaaggggtccagtttcagttttctgcatatggctagccagttttcccaacaccatttattaaacagggaatcctttccccattgctttttttggtcaggtttgtcaaagatcagatggttgtagatgtgtggcattatttctgaggcctctgttctggtccgttggtctatatctctgttttggtaccagttggttactctagccttgtagtatagtttgaagtcaggtagcatgatgcctctggctttgttctttttgcttagtattatcttggctatatgggctctttttttgttccatatgaaatttaaagtagctttttctaattctgtgaagaaggtcaatggtagtttcatggggaaagcactgaatctataaattacttgaggtaatatggccattttcatgatattgattcttcctatccatgaggatggaatgtttttccatttgtttgtgtcctctcttatttccttgagcagtggtttgcagttctgcctgaagaagtccttcgcatccctcgtaagttgtattcctaggtattttattctctttgtagcaattgtgaatgagagttcactcatgatttgactctctgtctattattggtgtataggaatgcctgtgattttttgcatgttgattttgtatcctgagactttgctgaagttgcttatcagcttgcagaaattttgggctgagacgatggggttttctaaatatacaatcatgtcatctgctaacagagacaatttgacttcctcctttcctaactgaacacacttgatttctttcccttgcctgattgccctggccagaacttccaacactatgtttaatagaagtagtgagggagggcatccttgtcttgtgccggttttcaaagggaatcctttcagctttggccgattcagtatgatattggctgtgggtttgtcatgaatacctcttattattttgaggtacattccatcaatacctagtttattgagagtttttagcatgaagttgtgttgaattttatcaaaggccttttctgcatctatggagataatcatgtggttttggtcattggctctgtttatgtgatggattacatttattgatttgcgtatgttgaacctgccttgcatcccaagtatgaagccgacttgatcgtggtagataagctttttgatgtgctgctggattcggtttgccagtattttattgaggatttttgcatcgatgttcatcagggctattgggctgaaattttctttttttgtgtgtctctgccaggttttcttttatatatgtgtatatatatatgtgtatatatatatgtgtatatatatatgtgtatatatatgtgtatatatatatgtatatatatgtgtatatatatgggtgtgtatatatgtgtgtgtatatatgtgtatatatatgtgtatatatatgtgtatatatatgtgtgtatatatatgtgtatatacatgtgtgtgtatatatgtgtgtgtatatatatgtgtatatatatgtgtgtgtatatatatatgtgtatatatatatgtgtgtgtgtgtatatatatatataactattattatactttaagttctaggatacatgtgcacaacgtgcaggtttgttacatatgtatacatgtaccatgttggtgtgctgcacccattaactcgtcatttacattaggtatatctcctaatgctatccctcccacccccccccacaccacaacaggccccagtgtgtgatgttccccttcctgtgtccaagtgttcttattgttcaattcccacctatgagtgagaacatgtggtgtttggtttttttgtccttgcgatagtttgctgagaatgatggtttccagcttcatccatgtccctacaaaggacatgaactcatcctttttaatggctgcatagtattccatggtgtatatgtgccacattttcttaatccagtctatcattgttggacatctgggttggttccaagtctttgctattgtgaatagtgccacaataaacatatgtgtgcatgtgtctttatagtagaattatttataatcctttgggtatatacccagtaatgggatggctgggtcaaatggtatttctagttctagatcccggaggaatcgccacactgtcttccacaatggttgaactagtttacagtcccaccaacagtgtaaaagtgttcctgttttcccacatcctctccagcacctgttgtttcctgactttttaatgatcaccattctaactggtgtgagatggtatctcattgcagcttgatttgcatttctctgatggccagtgatgatgagcattttttcatgtgtcttttggctgcattaatgtcttcttttgagaagtgtctgttcatatcctttgcccactttttgatggggttgtttgtttttttcttgtaaatttgtttgagttctttgtagattctggatattagccctttgtcagatgagtagattgcaaaaatgttctcccattctgtaggtcgcctgtccactctgatggtagtttcttttgctgtgcagaagctctttagtttaatgagatcccatttgtcaattttggcttttgttgccattgctttgggtgttttagacatgaagtccttgcccatgcctatgtcctgaatggtattgcctaggttttcttctacggtttttatgggtttaggtctgacatttaagtctttaatccatcttgaattaatttttgtataaggtgtaaggaagggatccagtttcagctttctacatatgcctagccagttttcccagcaccatttgttaaatagggaatcctttccccatttcttgtttttgtcaggtttgtcaaagatcagatagttgtagatgtgtggtattatttttgagggctctgttctgttccattggtctatatctgtgttttggtaccagtaccatgctgttttggtttctctagccttgtagtatagtttgaagtcaggtagcgggatgcctccagctttgttcttttggcttaggattgacttggtaatgcgggctcttttttggttccgtatgaactttaaagtagttttttccaattctgtgaagaaagtcattagtagcttgatggggatggcattgaatctataaattaccttgggcagtatggcccttttcacgatattgattcttcctatccatgagcatggaatgttcttccatttgtttgtatcctcttttatttcattgagcagccaggtttacgtatcacgatgatgcatgtctcatgaaatgagttagggaggagtctctctttttctattgtttggagtagtttcagaaggaatgttaccagctcctctttgtacctctggtaaaattcggctatgaatctgtctggtcctggtttttttttggttggtaggctattgactactgcctcaatttcagaacttgttattggcttattcagggattcgacttcttcttggtttagccttgagaggttgtatgtgtcccaatttatccatttcttctagatgttctcatttatttgcatagaggtatttatagtattctctgatggtagtttgtatttctttgggatcagtggtgatatctcctttataattttttagtgtgtccatttgattcttctctcttttcttctttagtagtctggctagtggtctattttgttaatcttttcagaaaacccgctcctggattcgttgattttttgaagggtttttcgtgtctgtatctccttcagttctgctctgatcttaagtgtttcttgccttctgctagcttttgaatttgtttgctcttgcctctctagttcttttaattgtgatgttagggtgtcgactttagatctttcccattttctcctgtgggcatttagcgcaataatttttcctctaaacactgctttagctgtgtcccagagattctggtacgttgtgtctttgttctcattggtttcaaacaatatctttgtttctgccttcatttcattatttacccagtagtcattcaggagcaggttgttcagtttccatgtagttgtgcgcccacagctaccctttcccccaggtgctctgtcgcagggagatgggagtttgatccataagtccctgactgtggctgctgcctttctttcagagatggcctgcccagagaggaggaatctggagattcagtctggctacaacagctttgccaagttgtggtgggctctgcccagtctgaacttcccagcggctttgtttacactgtgaggggaaaaccacctactcaaacctcagtaaaggtggaccccccctccccactaagctcgagcatcccaggttgacttcagactgctgtgctggcagagagaatttcaagccagtggatcttagcttgctgggctccgtgggcgtggaatctgctgagctagaccacttggctccctggcttccgtcgcctttccaggggaatgaaaggttctgtcttgctggtgttccaggcaccactgaggtatgaaaaactcctgcagctagcttggtgtctgcctaaatggctgcccagttttgtgcttgaaacccagggccctggtggtgtaggcaccagagagaatctcctggtctacaggttgcgaagaccatgggaaaagcatagtatctggaccagagtgcaccgttcctcatggcacagtccttcatggctccccttagctaggggagggagttccccgaccccttgtgcttcctgggtgaggtgacgccccaccctgcttctgctcgcccttcatgggctgcacccactctctaaccagttccaatgagatgagcagggtacatcagttggaaatgaaaaaatcatctgtcttcttcattggtatcgctgggagttgcagaccagagctgttcctatttggccatcttgccagccacaaccttgaggtttttttttttttttttttttttacataaaaggactctagtataacatacagataataatttatccctttcttataccaagtttaagcattttttctgaatgattttaaagggattggctgtagcttacatgagtacattttatcttggataccaataacatgcttctcaagtccacagacaaagaatgacttgaatcagttttctaatgcatgtgactgattttcattcagtgagctaatggatacttgatatatttattctaacctaatacagtttttcaagtgactataaagtattttaatgcttctaactatagaaatatttgactcaatgtcatcacctgatatactacctcttagtctttcagccaagtctattttggggttcaaatgacatcagaaaattccagaggggtatggagggacaaaaacacgtttggtagcattttgaccatctttaataataaaaatcatgatgcaagattatatcttaatcttttctactattaatggtcaaaagtttaacagactttaataaatcacaaatctagtattccttctggcaagttctccatatagaactcctttcccagtaccaaaacatatttcccaaccccagaatatatttccttttggggctgggaaaggaaatgaaagattgggctctaaaacttcagatgcttaaggaaggtaactaattctattcctcaggactcttttggcctcagtcaccatctagcttccttctctcacctccagatgtgcaaatggctaatgctgaactgataagagagaaagagagaattggtaacaaataaacacttgttgattgagaagatgagataatatggaaaaaaagaatggaaagataggaagtgatttggtacctaaacaatttacatgaaaataacataaaattaagtgaaggcccatcctcctaaattcagttccaacttgaactaccgaaatcaagccctgcagacaccaggtgtagctggtacctacattccccttcccagctttatagaggtgtaattgacaaatactaattatgtgtgtgtgtgtgtgtgtgtgtgtgtgtatatatatatataaatatatatataaatttatatatatataaatatatatatataaatatatatatatataaatatatatataaatatatatatataaatatatatatatatgggaaaccataagatgtcttgatatacattgtgaaatgattaccagcatcaagctaattaatatatccattacctcacatagtttgtggtgagaatgtttaagatctactctcttatttctagtataccctagagtattattaactatagtcgccatgctatacatgagattttcagaatgtattcatcctgcataacggaaactttttatccttctactaacatctccctgtctctcccactctctagcccctggcaaccaccatcgtactctctgcatctgtatgttcagctttttggattccatacgtaagtgagattaagtagtatttgtctttctgtgcctgtcttatttcacttagcataatgtcctccagtttcatccatgtagtcacacatgacaggattttcttccttttttaaagctgaataatattccactgtgtgtatacatatgtctttctgtgtatatatacttatatatacacacacagagagatatatgtatcacattttctttatccatttatctgttgataaacacagactgatttcatatattggctattgtgaataatgctgcagtgaacataggtacacagatatcttgaaaaggaagaagtaaaattgcctctgtttgcatatgacaccatcttacatatagaataccctaaagacttcaccaaaaaactgttggaagtaataaaaaaattcagtaaagttgcagaatacaaaatcagtattaaaaatcaattgcatttctatatactagcaattatttaaaaaagaaattaagaaagcaatctatttacaatagcatctcaagaacaaacaaacaaacaatacaaccttaaggataaatttaaccagtgaatcgaaagatctgtacatagaaaacactgtggtgcctacctttaaagtaagtgctttggggatttaaaataccagcaaacaagagattcttaaaatatcatccaaagagaaagtctacttactaccttttttcatgccttcacaaacatactaaatagatcccgaggaagcctaacgaatgaatgcttcattcacataactagttttatctttactagaagccctggaggagaaggcatctgaacgtgtgcagtttgcttcactggggaaggccccccacagtgggaaattacatgaggcttaatgcagtatgaaatgagaaagcagaaaaagatatttttcaaaaggccttccaaagaacaggatagtgattcttactatgagtaatttcattctcttctcataatccccctttccctttccatccaagagtgagtatacagtttccttttggggttacatcaccaatttgaaaaagattcacaatccttgtgtctccaaatattgctggaagtcccatgcatgaagtgaatcttgaacctttttcctcagttttaatatagctttggtgggggctagggtgctcttggctacatggcttgacattttttccatcaacctccaaagacgtgtttgtttcctctactctgacacattatctcggataacagaagacatcttcaaatcaattgatggaagattgagagaaagagaacttcaggtccaggtgctgtggctcatgcctgtaatcccagcactttgggtgactgaggtaagtggatcgcttgagctcaggggtttgagaccagcctgggcaacgtaggaacaccccatctctacaaaaaatacaaagattagccaggtgtggtggcatatgcctgtagttccagctcctgggggttggcagggggtggtgcgaggtgggaggattgcttgagcctgggaggcagaggttgcggcagtgagcctagattgcaccactgcactccagcctaggcaacagagcaagaccctgcctccaaaaaaaaaaaaaaaaaaaaaaagaagatgaaaaataacttcatctaatttttgagctacccaatccttattgtgaaagacaagcgatttagtgtttgctatatgcagcaactataattggtttagttttcagtagttcatctctaaggcagccttgctttgaggaactggaaacttcaactgactatttacagggaatagaaacaatcactacataggaatgaaaatgctaagcttagtttgcctgtggtaaaacattcgtaatcatttgatatcattggcttaattttataagcctgttctaccactgagtgattctgttttcttactggattttggctatcataaatgtattgctagatattgaaaggataaaggtttatatggtgaacatgggataattcaaaatggtttcttatacagaattcactttgagatttacatgaatcaaatgcaatagaaaaataataatattactgagtaatttggattttacttactaatccattcttatcaactcatctagtaagaggagcacttttttggtttatttgtttttggtaacaagtaagaaataaagtatttggatagatgttacagacattaccactttctgatggcgtgtgttccttctaatattagagaatagaaatggtagtttttttaccgcatcataatgtattgactacctgagaaaaatgttgattagctatattgtgttgagtaacgttttcttaaaaagtctccaaacaatttgagacagtcacggtgacattactattatcacctgatgagcatcacaggaggcatgaaaatatagataagacagtcaggaatcaaagaacgtgcatgggatttacagttagtcacatacagagaaatgtttaatttcacatcagttcacatcagattccctttcttataaagccacattttcagaatcacagttgagtatggtgaaaataagcagagattagggtttcaaattacctataatctgcattcataagtgctctagttcacccagaaagaaaacacttggatgactgtcataaatcagttccaatgttgttcatcatgcctctccattctctcctctgtgcaccccgcagtctagcattttagcaatcttagtccctcagagaggccctattccttttcacctctacagctttgcattgcagcttggaatgtttttctctaaccttgactttttcacccttgctcatcattcaagattcaaagtgcaatatacaaatgcttgaactttggagccttcctcctccttcttacaaaagcttacaattaaacaactgtgtgcttttctttaatctttggcattttattctatccattattattttagaacactcagagaggagaattaaagggtcaagaatcttgtggctacattttgttaactgattccctgattcaaagtataaactgaaatatgtattttcactgaaaattaggtcaatatgcaatctgcttttattcatttattcctgagttcccactatgtgtcaatttctgtgatggcactagaaaataaatacaatttagtcttactaaatagacctagttttatatggttctcaacaagtttacagtttagaaaagggaggcagacaaatgaacaattttaataacatgaagtattgcaaaaggaactactgtaggcaaggaggttttgtaataatttacaaaagtacagggtaaccaatttgttgatggcaagatgctgtgaagtatgtggatggtagagctattaaaagtgcattatctataggagttggcaattgattggattttaggggagagaaacagagaggggagaagaggagaagagaggagatgagaagagaggagggagaagagagaagaggagagaacacaagatgacagaaatgaattcaaaacacagctacggtttctgagctgagtgaaaatgccatttaatgtaagagatgtgacatataatcacataataaatatagcaatcatacggccaaaatataccccattaatccgccttgctggctcctgagcatctttgagcttgtcagggtgtgtgccttgatttctggtttgggaatacatttaccataatatttagtatagcacatagagtatttaggttcacacctcctcataattgcaggtcggtaaaatgccactgttcaatctgatagcatttaatagaaggacacaaatgaaggctcctggtgacctttcttagggaacaaattcttttagtacaaagggtccactaagaggccaagaaaaaaaaaaagtcagtaccattactctgaagattctaacctttccccaagacactgtctttgtggacacattttctacaaagcaaatttgagctaagcttccctaagctttcagtaaagacattagcttagttagcatattaattaagacaagttcaaatgccctcttcccttcattgccatgtaataattatatgctcagcatttgtccagctcagttccattacgtaaaagctgtctgtctgtctgagcttgctggcactcatagtcctgccctaaaattactgaagtatgttaatgttaaggattcctggacatcggatgttttatttattttttatactatgtaattgaattttgaatgtacattatctgattaaggatttagaataccgcaaggtctttcagaatctcttaatgagaatgataatgtcatattattcatgctgataatttaagtctattgtttattgccactgaaactctttctcacccccttagaatggagatactttccattactaccactgatgtttatttgaacagctcatttaaattctatgttctgaattgcttgcaaggaagaaaatacctagaacatttttaaagactctggaatcactctaaagtctttttggattgagatggggaataagtacataaaacatacagacagacagatgcatactcttaacttcattttgaaagatacaaagttctgtaacatttactgtgactctataatttattagaataaagtattattttttctccaccaaagaactatgtaaataaaatgtatagcattgctgcagacaatatttattttagcttttcatctatgtgtatgttgatatatacataacacacacacacacatcagcttatttccaaatgtgctctgcactgcaaatctttccaaatctaacttaaaaggcaatctgaaaaagaatatctttaactatttctttccttttataaagggttttgggagacagctaaggatatttttatctttccttctaaagtgttaaactatttgaacaggttaaatagaaactaaagcaaatcaatgtaataaatactgatgataatacagacatggatgttcacttagtgttgtacttggtgatagttttcttaaactctttatttattctttattttttatttatttatttttcaaaactaaagttttctttagaaaaacataaattaacatgtatatttttggtctctttaaactcagttaatctttttttaaccagagtagcaaggaataaaattagaataggttcaaatattatcattttaattgtagattatttctgtatttaactacaaataagtttggaaaaaaaaaaaagaagacttacatgcttgtgaaggcaaaggttttcagactgtagaatgtcctatatttcagtctgtcaagacctgagaggctctgaactcagtcttcaggctacatggttcaatccctgataccgtgtttgcacctgctaaattctttccccagaagactaaattgactaaggcatttcacacatctctctctctctctctccttttttttttttttttttttgagatggagtcttcctctgtcacccaggctggagtgcagtggcgcaatcttggcccactgcaacctctgcctcctgggttcaagtgattctcctgcctcagcctcccgagaagctgggattacaggctcctatcaccactcccagctttttttttttttttttggtatttttaatagagacagggtttcaccatgttggccaggctggttttgaactcctgacctcaggtgatccacctgcccttggcctcccaaagtactgggattacaggtgtgagccaccgcacccagcctgcacatctcttaaaaaggttatacctaatacatcaatatctgaccctaaattaggaattttacctcccacctgggaactttctaatgtaatggttgacctgctggttggagacactctccatctttcccaagccaataattctctgaaatacatttgacttcactacccctttcagtactgttccttgggtagatcctattctcttctcaaaactaccattgcaaaacattagtgatgatgatgatgatgatgatgatgatgatgttcacaaggccaaccatacctttcagactcattttatgcctagatttttcatgccttgagcccaagttgcaccacttaaaagacttagttcaaagcaagaaattgaaatgaatgcttatagactaaaggcatggcttccatcttgaagatttagacattatcatggcacagcagtaataacccatcaggaactcctgataaacccatctcaagaaatcatttgtgatatttttcctgaccctcccaccaagtcaggtaaatgaactttatgctctctttgctcataaacacatctattattctaaaatcaagtttaaaaagtaaaataaaatttaaaaatgggtaaatgtatctcctcaaccttgtgaaatcaataaggaagcatttactaaaatgcttactaaaacactaaagtaaaagctttactaaacaagaggagtgtatttgcaactagtttcaggcagtttatcaacaaaattacacacgtatgtgaaatacacatatacactatatataattttgaattgtatgtatataattttataacatatgtgtgtgtgtatatatatagtgattttaaaaatatttctcagaaaaagagcagtatatgggtcctggctccactaatcctagctgtgagaccttgggtaagtaacttaacctcacttaatagcctactttccttttttataagacaaggaaatagttccttggagtattgttgggtggagtttaaatatgcacatgtaaatttaaagtactacatccatgaaaaataaaaatattatatttcacaaagttaaaacaactttgagagaaagctgtcagtgagttaaagtggctgaaacagatctcacaaaaatccagcaaaaatacgactttcatcaagggcttttaagtagttggttaacgtaaaacagataataaaggtcttgtttgtttgtttgtttgtttgtttgttttgagatggagttacactctttttgcctaggctggagtgcaatggcaccgtcttggctcactgcaacctccgcctcccgggttcaagcgattctcttgcctcagcctcccaagtagctgggattacaggcgcccactaccatgcccagctaatttttgtatttttactagagatggggtttcaccatgttggctaggctggtctccaattcatgacctcaggtgatccatctgcctcagccttccaaagtgctggaattacaggcgtgagccactgcgcctggcctataataaaggtcttaatgcaacctgctagcatgattttgatcatttgctgaaattagagtctggtcgatactttacccattgccagcaactatttttttcttttttttgcccccctgtctatcatcttgtaactagcaagcactttaacaatatacttttttctggtgcaattgttaggtttaaattcttttattaagctgttctaaaataaaaaacatgcaagttatcacttttggccagttccactgcttcccgttttacgtgatgaggtgtactgtttcacctcgtagttgacatggccattacaattagatctggtgcacaggagagaggaaaacaaaatgaacttcatcagcaactggacttgcagttagtgatgagatcaaacacttcactgagtgtggccagggaaaaaatcctactcaaagagaaattaaaataacagcagttaagggttaacgctggaggaaggcaaggtaagaaattccattgcagttattaaaagacttccaatttgattaaacatgacaacaacatacaggggtcaaagctaattttttttttgaaagggaagaaaaaaacatcagaatgcaatgggcttggatgactctgatttcctttctatgcttgttcttgatcagcttgtttatttgaattctgggcttcagctttattataaataattcctcagtcacaattttttaaaaaaaatttctttgcagaagaagccaaattatccttgtttgcagatggtattatcttacacttggagaaacctaaagactccaccaaaaaattattaaataagtttagattgataaacaaattcagtaaagttgcaggatagaaaatcaacatgcaaaaattagtagcacttctatatgccaatagcaaataatctgaaaaagaaatcaagaaagtaaccttatttacaacagttacaaataaaatatgtaggaattaaccaaagaaatgaaaaatctctacaatgaaaactataaaatgctgatgcaagaaactgaagaggacacaaaaaatggaaagatattctatgttcatggattgaaagtatcaatgttgttaaaatgtccatactacccaaaacaatctaaagattcaatctctatcaaaataccaattatattcttcatagaaatagaaaaataatcctaaaatttttatggaacacaaaagactcagagtagccaaacctaccctgagcaaaaagaagaaaattagaagaatcaaataacctgacttcaaattatactacagagctatactagccaaaacagcatggttctgagataaaaagagacaaataggtcaatggaacagaacagagaacccagaaataaatccatacatctacagtgaacttatttttgacaacggtgccaagaacatacactgtggaaaggacagtttcttcaataaataataaattatttttaataattttatttattttatttattgattttttaaccaattatatttaataatttatttttaaccatttattctgggaaataataaattattttccagattatttcccagaataaatggttctgggaaaactagatatccacatgcagaagaatgaaactagaaccctatctcttgccattaaaaaaatcaaatctaaattggttaaaaacttaaatctaagacttcaaactatgaaaccactaaaaaaaatggaagaaactcaaagacattggactgagtaaagatttcttgattaatactccaaaagcacaagcaaccaaaacaaaaaagggcaactaggatcacatcacattaaaaagcttctgcacagcaaagggaacaatcaacaaaatgaagagacaacacatggaatgggagaaaacatttgcaaactattcatctgaaaaggattaataaccagaatatgtaaggagctcaaacaactaagtaggaaaaaaaaatctagtaatctgattcaaaaatgggcaaaagatctgaataggtggttctcaaaaaaagacacaaatggcaaaaaggaatatggaaagatgctcaacatcactgatcatcagagaaatgtaaatcaacactacaatgagatatcatctcactccagttaaaatggcttttatccaaaatacaggcaatagtgaatgctggcgaggatgtggagaaaggggaatgctcatacactgctggtatgattgtaaattagtatactcactagggacaacagtatggagattcctgaaaaaattaaacatagaactatcatatgatccagcaattccagtgctaagtatatactccaaagaaaggaaatcagtatatcaaagaaatatctgcactcccatgtttactgcagcactacacaaaatatccaagatttggaagcaacctacgtgtccatcgacagatgaatggataaagaaaatgtcgtacatatacgccatgaagtactattcagccataaatgagaatgagatcctgtcatttgcaacaaggatggaactaaacaacattatattatgtgaaataagcctgccacagaaagatacattttgcatgttcacactcatttgtgagaggtaaaagttaaaacaattaaattcatggagataggatgacggttaccagaggctgggaagaatagtggggttggggtgaaataaggatgattaatgggtacaaaaatatacttagatagaattaataagatctagtatttgatagcacaccagaatgactacagtcagcgataatttgttgtacattttcaaataattgagggagtataatacaattggaatgttcgtaacacaaagaaatgataaatgcttcaggtggtagataccccctttactctgatgtgattatgacacattgtatacctctcaaaatatcttatgtcccccataaacatatgtacttactatgtactcatgaaaatttaaaaattttttaaaaagaaaattacaaaaagggaaagaaaaccacagcaatctaaaatcagggaaacaatttactttgctaaatcaaattttaaggttgaactctggatcggtttgtgttactgtaatctctcttgaatttatcaaacagaaaatcattcatggtaacttaattatgatggaactggaaggcatagatacttgtgaatctcccacttaaggcctgaattattaataggtttctttatttagaataaaatatatatttggaaaaaaatctctttccttcattgactctcacctcccgcctgtaacagagcagtcaccaagacttgttcatcttttcacttttccgtttttactctatttcaaattcttttcttcctcttcatttctactgctgtcctcactttattactttgcacctggctatctactgcaattcatcttgctcgctagaatcctcctaaagcattccataaagatactcctacagagtatctttatgatactctcttgaaaaaagacacaataaacccttcactggcaattgattcagattcatgctctacaccctggtattcaaggcctctctcagtttacctcactgtctttttcctgttttatcattgattatttggtaatggattccacaattccatctacactagcatctatacataccacactcatctttgcctgtgtacctttggatatacagtcccatctagctaagatgcatcctcctttccatcagctaaaccaaattctatacttccttcaagtctcagtttaaaacccaattccttcaggaaaccttccttaaataagccagtcaacaattacaggtttacattaaagtcatattcaagttcttaattcctgtaatatattctcctcacctagaaacacttcagggtttctcaaacttgttcccctaggaaagtcctcctaagccatgttactcttgtagaaagagcatgagatattgatttaattcactcatacaaaactaggaacatccttgctagcaaaatgtaaatacatacctgtctattacacaatataaaatggtaaccaagagcatttgtgttcaagaaaaagataaccagttattaacatcacttgatagccattcctaaatttttacattgacaattacttgtttttttgttccttcattttagtgtcagtttgtattctatgagaaaactgatagtagtcatcatggcttgagataaaattaatcaaaagtcttaaaacggagaccacccccccaccaccccaaggaggcagcagtatataggtttcgagggttttgttggagtactggctcttctttgtgtgcttggaaagttactttacctctaccagcctcattttatttatgggagtaatacgaggttaataatactggacctgggaaaggattaagtgatatatgaaaatcccttattagttagcatactcttggtagctgtagctgatgggctttagcagaagcgcacaggtctctgttcaacactcttgcattcttctatccccaaggaagtggagtactgctaatgggggattcttctttgtctgatgtaagggccaaggaccagggagtgcagtctctttgttttcttttatcttcctttagagtcaaatgttaacagatccccaggttgctctctttcaggagcctggagaaggaaagtatcatgcagggtcttctcatccctgtctcttgctcaattactgtgaccctttgtccctttttttccccccataatttctattttcataattttctctttgtctctatcctatttcttaagtctctctctttttctattggtctctttctttctgtctctaactgtgtctctttattgtctgtctgcctctgcatctctcttcctatttctgcctatctttttttttctttctcaagctttctatctctgtctctctgtatttttttttcttttctttttttttttttgtgtgtgtgtctcgatcttcctccggttttatttatctcttactcctttaaatgttctttattatattatttgttattctcttctactctttcctaatttcaatgcagctttattttatttttaaaaattactatggtaggttgggcgtggtggctcacgcctgtaatcctagcactttgggaggccaaggtgggtggatcatgaggtcaggagatcaagaccatcctggctaacatggtgaaaacctgtctctactaaaaatacaaaaagttagctgggcatagtggtgtgcacctgtagtcccagctattcgggagactgaggcaggagaatcttctgaacccgggaggcagagcttgctgtgagctgagatcatgccactgaattccagcctggatgacagagcgagactctgtctcaaaaaaaaaaaaaaaaagaaaaaagaaaaaaaaaagttactatggtaaggtctgagtgttaggtttagccttagaaaaagtaaccagtagtagtgatgttcatcctcctatgtttcaaggacattcactctgcccttggataggaaataaattcttcttagggtccagatgaactcctagagttctgtgcttttgttttgttttgttttgtttctgttgatgggtaggtggtacaatatctcagcaaataattcatttttggtttgctttatgtacatgttctgtattccttccatggatctcaagaaaagattactactgtgacaggatacaacagacgtatttttggcaaaataatggtgatagcttatatttatgaaacaaaatgtgccagacactattttaagtattctccttttattggctcatctaatcctcacaaatacatcacgaattggtattactagtatcattgcatcgaggttcagtgtgttgcctaacatcatacactagtaagttatgtccagaccttatacccagagtctgggctctctctctctttttttttttttttttgagacggagtctcactctgtcgccaggctggagtgcagtggtgtgatctctgctcactgcaacctctgcctcctgggttcgagcgattctcctgcctcagtttcccgagtagctgggactacaggtgcatgccaccacacccagctaatgtttgtatttttagtaaggatggggtttcaccatgttggccaggatagtctccatctcttgaccttgtgatctgcctgcctcagcctcccaaagtgctgggattaccggcgtgagccaccgctcccagctgagtttgggctcttaaccactatgcccatgcatcttcaatagtatttattggttgttaggttgttattggtatgtccattgggtttaaaatatatatatatatatatttatatatatatttacatatatatatatttatatatatatttacatatatatatatttatatatatatttatatatatatttatatatatatatttatatatatatttatatatatatttatatatatttatatatatttatatatatatatacacacacacacacaatgaaacgacatagctgttatttaattttaagagtgggacattttcagatttactttatagaatacctccgtagtgatacaaattaagttataaaatatgatatcttttaataataggacacgtaatttttttatccgtcacaattcctgctagattagatgcttcctacttatggagtgagtgactcaagaaacacaaaaggatggatgaagccataattctggaatatttggaaggtaacagatgatgtgatagaagtaatttaggccacagaagattgactagacaagtgttcccagttatttttttctcagtctgaacacggttgtaagaatagtatagtaagatttgtttctattggccaggtgtggtggctcacgcctgtagtcccagcactttggcaggcagatcacctgagtttaggagtttgagaccagcctgactaacatggtgaaaccccgtctcttctaaaaatacaaaaattagctgggtgtagtggcgggcacctgtaatcccagctactcaggaggctgaggcaggagaatcgcttgaacccgggaggtggagggtgcagtgagccaagatcatgccattgcactccagcctgggcaacagagcgagactccatctcaaaaaaagaaaaaaaagaaaaaagtattgtttctatcatgaaataaaactaattggtagataaaacatgtgaagagtggtagaaataatttatgatatgaaatattgtcttattatttttaaagacaacattttacctaaaaataacttcctttcacttacatgaacacagtgtcatctttactgcttggttcatagcttaatctgcatgaaaacccttagtaggaaaaacagtaaaaatgcagctggattagtcataaataataatcacttccatttacataacgcctttgaaaggtccctagaaactcgctaacttttgaagtcatgcatcagattacaaaagcaaaacgttttgctaatgtgatgttgaggttacaaatttaaatacattgaggtcaccaaatgcaagaggtttggttctcattatgacatctcatccacataaacatgctattgttcttaatattctttatttaataattcaactgctactgaaaatattttgtctatctaagtatttagcacaacaaaattgaaacattgtgggattgttgtcttctacgtgttgctttttaaaattatagcataaactcggtccaatttgaattttgattgttgcctacagttatgaatgaaatgaaaatgctgatccagaagacaaatagaaattttatctgctcacttcagttacttttatttgcctattccctgcattcaagaatgaagaaggcacagaagggagagtagtacagggagattgtctatcatgtttgaaatattgtgttaggtgctttgcccatgttaattcatcaatcgtgttgcaattctacaaaataggtattggaatgtctattttacaagtgagaaaatgtctatttacaagtgacttggccaacatgaaaatactaagggaatgcaaatctaaatttgttagtttctaatgttgtctgccactcctctcactagatggggtagggggaacaacctactaagtatctctacctactgcctgccaatttctggaatcagggttgtaatttagaaattatgcatggttgtgagataggtcatagagaaaatgcaagggcaaaattttaagtgcaaagttaaaattttccaacatattcctcacaattgacatccaacattttaatttaggaacatatggagaagggtatgtgagtccagttgagaagaaagctgtggggcaaaaccatctgcttatatgcaccaattcagtcaccttctgaaaaaaaaaaaaaagcatgatgcagtttatccaacaagttcacatagcactgggttaagaaggtttctcaaataacagagctctctgtaatgaaaacatattttcagatgtcataacattgtatacaataatatataggactctgtatataatggagcaagtatccattttttccaatagatagaacttcccagaatcctatacactattaacacttagaattatgtttttctttttttttttttaaatagagcttgaaagaatctaagagcgattcctgacccactctgaaccttccagaaatgtgaacactaaggccagagaggttagttgaatggttaagctactacatgtcagagccaagactagaacctgggtctacctactctacttgttcagattttattgccagtttctgaccacggcaaatatactgtgcaaggctatttcagagttccagcatgctttacaatagaaaaatatttcagaaacgttttgatagttgaatcctatttgggataagctggaagagttcattatttaaagatatgtttttggaatccttttagtaagtaaagagttttacataatgtgaatattatctttcttattttaaggctaaaagtttatgtggttgtgttaaggcatttgtttaggaaaaagagtgtgtgtgtgtgtgtgtgtaagagagagagagagaggaagaggagaaacagaaagcaattaatggtagacatcaactacttgaagcagttttccactgtctttctggtatactacacttctctattttttttcttaccacatggaccactccttcttaattatttctctgctggatcctccttttttttttttttttttcagtcccgtaaacatagaaatgtgccagggctcaggcttcagtctttcttctctttcctccttaacatgtaggttatctaattgaagccaatataatctgtaggctgttaacttcaagcactgaactttctactgaaatctagattcatgtagctgacaatatacttgatttttctactttgttacctagtagctgttttacgttcagcatatcacaaccaaattcttgatcttccatctcccatctcctatgtctaatgttctttattgcactgctagtcacccagttactcaggccagaaacctttaaattattctggactccattctttcattcaggcagttagggaatcttgtctgatttactttcagatacagtacatccagggtctaacttcccaacactatcaccacagcacccaagttcaccccaagttcttgtgtggaaaatgacaagaatcattttgtttctctaattccacatttgtcctgcactctccattcacacagcagtgaaaattttctcctgctcaaaattctccagtgcgtttctaaaccacacttgaaatgaattccaaagaacttactatggtgtacaatgctgcttccctaattcattcttcggtctctgctcaattgatttctgaaaggccattcatgaatatacataatatatatacacatatataaaaatatatatgatagagtagtcttcccttacttgactataactatttaccttatttctctctgattaatgttctctgtatataattccgaattgcctcccccactaaaataatgtgagtttcatgagggcagggactttgttttgcttacttttttgctttgttttgttcacttctacacattaattaccaacctctaatagatatttgttgaagaaacaaactgataattaatgtatgttcttacatgtcaaatctcatggaccttggaacacacagataaaaattcagcatattaatataagtaattgtcatcaacgtactgcattttatttgcactattctataaaggaatgcacagggcaatttttcttgaattagcaacacaatctgtatgttttacctttacccttaaaccatatcaactaaacataactataaatgttgggctgattttaacatgtgcgtagatacacatagtcacacattatcccaaattaaggagcatggggaaatgaagatttctttgatcccagtggcttccgaataactttaaatggtaaagatggagattctataatccaggagcttcaagaaaactaattcaacaggttgtaggtaaccaatcaagcagggggcagaggtatctttacaggaagaaaaaatattatttatttggctcttaacggtattgaaaaattaagattttcatgaaagattgaattctaggtagaagtgatcatgtggtaaaaaataataaaaaggtgaaagaaagaaaaggaatttaaacagttgaagaattttttttgctcactctcaatatgatataacctgaagtcccaagattcatataagcaatgaaagcataacaaagaagaatcaattgatctttcactggcttctgtccaagcaactttcagtatatgttaggttatacctactgcaataaaatgtttgcaggcccagaaatctgtggctgtttatcttgttcctccattccaacaattttataatataaagcaacgaattatattttagaatagtttttttttttagataaaatatatgcttttggttactgtaggagatgtgcaggatgctatgggaactcataacaagggtgactaagcagtttcctgtggcacatttgtgcaaaagtgtgagtgaaatgtggagtttcagaaaggtatatcccaggagaagggtcgctacagctgagaaatgagaaatgcccagatagataactggctgtccatatgcagaagaatggctatccatatgcagaagaatgaaactggatctctacctatcattatgagcaaaaattaactaaggatggattaaagacctcaaactataaacatcttcacacagaacctaggaaataaatacccttcttgatatcagccttggcaaagaatttgtagctaagccctcaaaagcaatggcaacaaaaacaaaaattgataagtggggacctaattaaagagcttctgcacagcaagagaaattatcaagggagtaaacagacaacctacagagtgggagaagatgttcacaaactatgcatctcttcaaaggtctaatatccagaatgtataaggaacttaaataaatcaaaaagtcaaaaacaaataacccagtgaaaatataggcaaaagatatgaacagacacttcttaacagaagacatacaagcaacccacaaacatatgaaaaaatgttccacatcactaatcatcagagaaatgcaaatcaaaaccacaatgatatgccatctcacaccagtcagaatggcttttattaaaaagtgaaaaataacagatattggcaaggctgcaaagaaaaggggacacttatacactggtgggaatgtaattagtcctgccactgcggaaagcagtttggggatttcttagagaacttaaaacagtgctataattcaacccaggaatcccgttactagttatatacccaaagtaaaagaaatcattctaccaaaaggacacatgcactcatatgttcattgcagtgctattcacaataggaaaaacttggaatcaatccaggcacccattcacaatggactggctaaagaaaatgcagtacatatatatcatggaatacaatgcagacattaaaaagaacaaaatcatattctttgcagcaacatgcatgcagcttaaggccattatcctaagtgaactaaagcagaaacagaaaaccaaatactacatgttctcacttataggtgggagttaatcactaagtacacatgaacataaaaaaaggagcaaaagacgctggggactactacatgggagaaaggcaggaggcaagggctgaaaacctacctattgggtattatgcttactacctgggttacaatttcaatcacatcccaaacttcagcatcacaaaatatacctttgtaacaaacctgtgcatattctccacaattctaaggtaaaagtcaaaaaagagagaaagaagaaagtggtaaacatggaaaaaaaaaggcatagtacaataatgcaaaacagcaaaaacaaaaaaccactcagctaaagagcctgagtagtgggcttgggctgtggagagctgttccaatgagaagtaacaggatgactttcaaaaccaacatattagtttgtatgcaaagaagtccctgggtccagttttgatttcattgctttctgttttcttgggcatttagatacatgatcatggttttctctttaggtatacaatgtagataaaaacaatggactcaaggtctcaatgtaaagattgcattgaagaaaaataaacaatttgagtaaatattgaaaataatctgtgcaaaaactatagcttatcttaaagaaatctaccaaagttggttatcactacagatgcaaaatatagacaaccatgttctttctcagattcatcttctgtagtcttgtgaaatgtctgtccactccaggctgttgtacttttaaaatgatattgaaaaattaggcagcatctaagaaaaaagcaataaattgatggagaggaaacttgacataagattaaagagtttacattatttggtctggaagagagagagctgaagtgggatataataatactcttaaaaaatatgaagagctaatattaggaaaatgtaggccagctgttctttagctccagtgaggtcagaatatgaaaaagttggctgggtttgttgaaacatttgagagaaagccttgaaagtaaaggttacttatggattcctggagacaggagataggctgtcttcttaacaggagatcttcagataccatctgcttggatagatagagatagtcctactcagaggtgtccctttgtgctcagactataagctcgtagactcaattattctggtatcacagctatcaataattggtaaaggacagggggagagctcatttggaagacaatcaccagcataaatgctctgctctcagggaaatggaagtgccctttcctgagttccctctatggtgtgctcttcgttataagcttcccttgagcctttcacagaatgaggcttcctctgagaggctatttctgttttttattttttattttttatttttttattattatcttccatagaagcttattttcaaaacacaaggcaaaaagaagtctttaaaattctttgtcacattttgaaacatcggaatttgaaatctaaaatgtatgccttttaattaaaaaaagtctttcacacacatctaactcctgtaacatatatagtgctaactcattaaatcatcttaaatgtaactgtcctttgctaaagaagaaaagaaactcatgcgttcgacctacatatagcattcatttgcatatccatgcatatacacacacaccttattttacattaaatctgtctccatactatttatatttatacccatttgctgagtccaaatatatctggccatttttgaattccatcaagtatcctttagaaagtattcttaagaagttatacttggtaagactttgcaacaaagctgaattatggtggaaatcctatacaaatgctcaatctttccagcagcaataaattacaatgtcagaaacataaggtgctgacctcccagtgtgaacaaagagtgtggggtgagtgaaagggataaaactcttgattagaaatatttttcttgaagaatacagcatttatgcagagaaacagccatgaataaagtctatcacctcctgatgtttatccatataaagcacaaagtgatttttcttcaaggaaagaaaaaagaaaaataaaaaccatccactttggactaatacttaacattattcatgtttaatacacctgatgactataattttacattgtcttttttcctgtaaacaaatgaagacataatctatttttctttttctttctttctttcttttttttgttttaacaaagaagaagcaaatgaacaatcctttgagtgagaaaatgttctgtaagtttagaatacagacgtgactagtgggctatgtgtaaatttctttgaaaaacaacagcacactgcttgtgctggattgtatttttaaaagtcaggatcaaggattggagctatgtaacatgcttcacaacaggggagcagttatcaagctcctgaactccaccaaccacgacagaagcagaacatttatttcattctgttcctgcctccctccctctaaaaaatcccaataaaatatacctgcaataggagaggattttcacagaaactgaacccaccatcatctatctcagtgaatcttaacccttgatgcagtttgcttttataaactaccaatcacccaggccccactcaagactaattatttgggaggcctaaacattgctattttttgaaactctgcagatgattctaatgtgaagccaggcttgggaactcttttgacacccactttcatgtccctgcgttaatggcagtaaggataactcagtgatgtaagctaactatttaaatcctgttgtgagattcttctcttcctttaccactgaatagtccctttactacatcagtagtcaaatcctttccttgacaaagctgcactatgacaatagatgaatcttgactctctcctggctaggtttcatcacacacagggattttcctttcatataactttcacgtaactttcatccttttattatctaaatatagtccccaaattttctggggctacctactcctccagaaaaacactcagatttttaaaatagagcattctaggccctctgtaatctggcttagagtttctttccaagttgagaatgctttattccacagcatggatcttcatttttttttatagccttgtctacattcagtatttccttactgaacgccttactgaagcctactttctttaatttttccttctgttctgtttttgaaatgctgactctgctcagccaaaatcaaaccctgtccactataagtcaaccatgcaagcaccctctcatcaaatcactgtctttagtatttattttgcggcaccatacaatttgcatttattgcacgattccttgtatctttaatcagttttgctcctcatgctattgtaagctcttcaaagacaagatgtacatctcatctgcagctgaaagcacctggcacagtgtctcacacatagtaggcactcaatactcatttgttaaaggaatataaagtgattaaatggcacagagcttacatgatctcatatcttagtggcctaatgctgagtatgcaagtgctgggaagtgctgtctgaattccagtgccagaattatatttatgaggacatatggaggacaaaacagaaaagaatgctatagtcccaaatgaaaaaaaaaatatcattctcagaaaaagaagaccattctttaccttagagtgcatttagatcttcagaagatcacaaagaagtgatgaaaagtaataccttagcaggggaagaaccattagttacatgctccttaaaacgtaatgctaatcatttgttctgtaaatgaaacttcaataatctttattttaattccagcaccctgagagaccagtcaagatccctccatcctgcaggtgctaaatgtgtgcttttaaatatgagacgggtgccagaatttgctctcaaaatggaagaagttatgtatctggagactcatgatgcctcatttgcttctttgtgtcctgcttgccacttctctctctgtctgaacaaggaagatgtggggacacaaatgttccatatacttcttctccctaataaggaaaatttctactttcctcctagaatgaatttagattttgatacagcatctgattgaattttgatgtttagccttttcaaaaaaatcaaagggcatgagcataatattggtgcagttttgagaagatgatagtggtggaccttttgccctaatctctggccatttagaattcagcaatgtgatggcccagaagaagacccaggaaaccagtcatgataaacccattatctacatcaatgattgactcagaaaccaaggactaagccaataaagcttccgaaatgacagtaaatatttgagaaacggacacatagttggatttgagccaataaggtacagaaggaattgagcctagttatttctaaaacaagtgtttttcctttttccaaacttttataagaatttcagaagagaaagagtctctcagcatttctcactggacatgcctgaagaagcatgtagtcttaattgctactgacatcatcccataaccacaatggaaaaggactggagatattgtctgagaggtaagataatagagaacagccattggatcaaattccctgaaagtccacacctccttctagtcttcctactatgtgagccaatgaattttgttttaagttagtttgagttgattttcttatcacattcagcccaatgtaccttatatgatcatggcaactgagacaggtcctcgaggaagcacgtatctgattccaaatgccaaacacactcactaagccaagacatacttgctttcatattatcttattgtgacaatggctattgacacaacactggctttaacacaggaatgccttcattcattcatttatcaaatattcattgagcacccatcatgtgtaagacacagtgaaagatggcagaagatgaaccctggaaaagtttttatgagtgctatgagtgtttggaaggacagcaggatgctatggaaacataatggggaaacaacttacagtgagggctcaggagaggggatctctgagaaactgacttttacttcaagatttgatatatgagttgaggagagccaggaaaatagtggggaaagaagaaataatacatgtaagtcctggacaaaaaatggagtgtaatattttggagaatttgaagagctcaagtggagagagagtgagaggaggagagcagcgatcagaaatcaaaagccttgagaatcatcatggtaggcattttgggcttcatccaaagtcttgaaacatcacaagtgcaagtatcagatgatatatcagaagattaacatgattttaaccatttgcatttagtagttgtttaaaataaagtctatatttagatgcagtaagttgggaattaattttaatgaaagaatcattgagtatatcctttggaaagcagctatatttcttatcaaatcctccactaagccagatggataaagtttcatgatcttgaaaacttttgagtgctttagaatatttaaaaacaagtatttttctccagggcatgtagacggagttgctaaaacattctcagttttataaaattagttaaattagagcttgggcatgaaaatgttattccaacagtattcatcgagtacctcacctatcatgtgacaagtgtacaacatcatctttctttccccagtcacactgtgcacatgttcattcatttaccaagtataacggttgattttacagaaatttaccaatattgtagggttaaaggcatgctttcagaaattagatgccttttagttcatattcccttggaaatttactagctgtgtcacctgggacaagtcacataacttctctaagcctcaatttccttctttgtacaatggtgatagtattagttctaggtcatgagttttgtcgtcaggaacagataaggtagtacttattgaatactatgtgtggaacaaggcaaacactgagaaatattagttattatcattagttatcatgattgctaattcataatacagttagaaatgtgtggagctgcagtgtaatggtagaataactgggctgccatacttaggaacctctggtatattcagagagagaagtggtcccagtaacagggacgtgtactaggacattgtgctttgcgtaggcagcaagatcagtaaaagaaatccaggccaaattctgacatgggtacccagaaatctgacatccaaggttcaaagtgcagttggaagatagaagaagatgtcgtgcattaaaaacagagctgaagatcaaatattgaagtattgaagaaagcattctagctgccctagctccattttaaagatctgttagtcctgaggcagtgactcttcagtctgtgggagaaataaaggctcaacatagactctggctgaagccagagacctactttctagcttaatcctgacattcataaactattgaagctggcaaattatgtgtcattttgatgattcagtttcctaatcagtaaaatggtgataattataagtggtttgtgtaccacacagcattgttgggttattaaatgaggtaatggataagaaagcacttagaaaattccaaggtactatatgaaatcattaataaatctattcattaatatttatgaagttttatcttgttcctgggattgcaatacaaagatgaaaagaaaaattctattgctttaaggcactcattgtctactagggagtcaaatatcaacaatcaattacaattaatatataataagtagtttataatataatgaaataccagctgccacaaagacatgcataaggttcagtaaaatccaaagtggaaggaacacctaagttgcctagggggacaggggaagacttcagagaggagctacattgcaagcttatatttgatttatgactgcgagctttccaggtggacaaggaaaagaaaggatgttccagggacaaagggcagatgtacataaaacacaatggtatctttgtggattgaattagaaacaaaagttgcaagtaaatcaagccaaaggccacttgaggtcttacattctttccccgtgtcatcatggtcatttcagttgcagaacatgttgggaaatgactgaccttgatcctggaatactcctcccatttggcctggttctgcacttctttccactaggtcagagttagccttgcacccgcaaatatcactgtctctagtagtcaacagtgagcatgccctgtgctctgacttccaccaggcacatgttttacattcatcaaggcagttcttctgcatcaaggttgaggacattaactgagcaaccactgtggctgatttcatcatttgtgccccatagctgaacagaaggttttagtttccactgcctgctaggctacttaacccttctaagcagaaatattcagacaaagaagcccaactgttactataattttgtcgatgtaaagacatctgcatatgacttcacagcatctggcactgtttgaaacacagaatccaggactgcagtttccatttctctaagtaccccatgtgacagtttagaaaacattcactcaccatgacagcatgaaaaccccacttccaaacaaagcaaaataagaaaaagtatgtattctgcagcaataattatataggaatatatatgaaatttactgtatgtggaaaaatccagtcaatgcgatgtcatttcatgtatttttaaatcatctcccctttatgtcaacatgggttctcataaagtatcttttacattggagcatgtaaaaagagccatttcttctttctaatgcatttaacaaacttttatttagctcttgttatgtgctaaccatcctgttggacaatgggaacaaagatatgagactccttcaaggaaggtaagacgtaagtgaaaaaataattacttggtgagaacaagtcatatacacacgcaggcatcatttcctttgcagagccactgtgtgtggttttgatgaggtggtcagtctaggtgctctgccctctgaacaaccctgacagagaaagcacatgattcagagaggctaatatgtgccaccttgggactttcctatgaaaacatgcaggacagattgtctcttttcacatggattggaaggtgggaagatggtactttggatgtgattttggcagtcatcttccctaccaaatgactaaagataagacatgggggagggaataaaaaaggagaaaaggaagaagagagaaagagagagagagagagagcgagagcactcttaggacatcatttaagctttgtatcaagggtgtccatgtaaaaaattgatttatcacttaattacaaatttgtttctttgatatctgaatgtggggtactaaaattaccatattctaaaataacaaattagctgagtcaaggagggctgaagagaaaattcatctcttttatggggaatttggttaggatgaagaaaagaaactggttaatctacatgtattacgttttaggactcaagctaccaaaggtaaagctttgaaaaactattacaggcatttcttgaaaacagtatggaatcatctgataacactgaggtgatatgaatactcctttaaccggcaatgtggctcttaggaactgatgggcatgcacatcaggatatacacaaaagatttcccagcagcactgtttgtaatagccttgagctagaaacaataaatgtccaccaagagtaaaatgtataaaatatacaatggaataccagacatcaatgaaaatgaataaactataacaacatttacatggtagccttactgtcataatgttgaaagatagaagctagacataggaaatgcataaaatatgattccattcatttacagtataaaaaaggaaaactgagacttgtaatttgggaatacttgatgaaagtaaagagaagcaaggaaatgattatcagaaaagctaggatatagttacttttcagaggacattagtggtttggaatcaggaagtaatacatgggaggattttaggtattattatagcaaggtttaattttcaactgggtggtaatacgggtgttcacatagagttactcatggaattacatttatacatgttttatgcattttgtatgtgttatatttcacagaaaaaaacataaacaaaacatgtagggatgttggattctatcaaaaactttttccatgtctattgagatgaccatatggtttttgttttttaattctgtttatgtggtgaatcacatttattgatttgaatatgttgaacaatcttgcatcccagaaataaagcctacatgatcacaattaactttttttttttgagacatggtcttgcactgttgcccagtctgaagttcagtggtgccaacatggcttgctgcagcctcagcctcctgggctcaagtcatcctcccacctcagccttctgagtagctgggctacaggcacacatcactatacttggctaattattttttgtagagatggggtcttcctatgttgcccaagctggtctcaaattcctgggttcaaggagtcctcctgcctcggtcttccaaagtgctaggattacaggcatgagccattgcacccagcctaaattaactttttgatgtgctgttgagtttggtttgcttgtattttgttgaggatttttgtgtctatgtttatcagggatgttggcctgtagttttcttttttgttgtttctttgccaggttttcatatcagggtgatgctggcttcatagaatgagtcatagaggagtccctcctccttgatttcaatttttggaatagtttcagtagaattggtactagctcttctttgtacatctggtggaatttggctgtgaatctatctagttcagggctgtgtttttttttttttttttttttttttgctgattcaattttggaacttgatgttggtctgttcagtgtttcaaattcttcctaattcaatcttgggagattgtgtgtttccaggaatttataaatttcctccctattttctacttcatgtccatagagttgttcataatagtttctgaggatattgtctatttctgtgggatcagttgtaatgtcactgttgttgtttctgattgtgcttatttagatcttctctttttgtcattgttaatctagttagtagcctattgatcctgtttatccttttaaagaaccaatttttggtttcattgattctttttatggatttttggtctcaattttattcagtttagctcaattttagttatttctttcattcttctagtttggagttggttttgtcttgtttttctggttcttccagatatgatgctgaatcattaatttgagatctctctgactttttgaagcaggcatttagaactataaactttcctcttaccactgcttttgctgcatcccagagattttgttttgttgtgtctctgttttcacttacttcaaataattttatttctaccttgatttcattgtttatccaaaagtcattcagaaaaaattaatttgcatataattgtgtggctttgagaaatctttttggtattgatttctatttttatttcactgttgtccaagagtatggatggtataattttgattttttaaaaagtttattgagacttgctttatgaccaagcatgtggttgatcttggggtaattccttgtgaagatgagaatatatattctatggtgatgggtgcatgtagatgtctattaagtccagttggtcaagtgtcaagtttaagttcaggattcctttgttaggccaggcacagtggttcatgtctgtaatcccagcactttgggaggccgaggcaggcagattacctgaggtcaggagttcgagaccagcctggccaacatgatgaaaccccttctctactaaaagcacaaaaaaataattagccagttgtggtggcacatgcctatctcagctactagggaggctgaggcaggagaatcagttgaacccgggaggcggaggttgcagtgagctgagatcgtgctactgcactccagcctgggtgacagagcaatactctgcttcagaaaaaaaaaaaaaaaaattcttagttttctgcctcactgatctgtcagtgaagtgttgaagtcccccacttttattgtgtggctaagtctttttgtacttctagaaatacttattttatgaatctgggagctccaatgttatttgtgtatatatttaggatagttaagtcttcttgttgatatgaatcctttaccattatgtaatgcccttctttgtcctttttgctgttgttggtttaaagtaaggaagattccttaaaatcgtaagtgtcatctatgacaaacccacagttaacattataccaaatgggcaaaaactggaagcattccccttgagaactggaagaaaacaaggatgcccattctcatcatctctatctaacatagcatcagaagttctagccagagcaattaggcaagataaagaaataaaaggcatccaaataggaaaagaataagtcaaattatttctcttcactgacaatatgatcctatagttagaaaaccctaaggactctgacaaaagactatgagaactgataaacaattttagcaaggtttcagaatacaaaatcaatgtacaaaaacaagcaacatttctatacaccaataatgatgaagctaagagaaatcaagaatacaatcccatttataatagctgcacatgcacaaaaatacctagggatacatataaccaaggaggtgaaattgaagaacttcagaatactgctaaaaggcatcataaatgacacaaataacagtccatgcatatggattggaagactcaatattactaaaagcaatctatagattcaatgctattcctatcaaatttccaacatcatttttcacataattggaaaaaaactgctaatattcatattgaaaaacaaagatcccaaatagccaaagcaatcctaagcaaaaagaaccaaaccaaaggcatctcattacctgacttcaaactatactataagtctacagtaaccaaaacagcatggtactggcacaaaaacagacacatagaccagtggaagagaaaaaaaaaagcaacaaaaaacagaaataaagtcacacacctacatccatctgatattcgacaaagttatcaaaaataaccagtggggaaaggactccttctttaataaatggtattgagacaactggccagccatatccagaagaatgaaactagacccctatatactatatacaaaaattaactcaagatggattaaagatttaaatgtaagacctcaaactataagaatcctagaaaaaaacctaggaaatacccttctcaacatcagccttggaaaagaatttattactaagtcctcaaaaacaattgcaacaaaaccaaaacatgacaaattagacctattgaactaaagagcttatgcacagcaaaagaaactatcaacagagtaaacagacaacctacagaaggggaaaaaatattcacaaactgtgcatccgacaaagatctaatatccagaatctataaggaacttaaacaattgaacaagcaaaaacaaacaaacaaacaaacaacaaaacaacaaacaaacaaaataaataagcccatgaaaaaatggaccatagacatgaacagacacttcttaaaagaagacacacaggtggccaataaacacataaaaaaatgctatcatcactaacataagagaaaggcaaatcaaaaccacagtgagatactatctcacactagtcagaatgacaattattaaagtaaaaaaaaaaaacaatagatgttggtgaggttgtggaaaaaagggaatgcttatacactgttggtgggaatgtaaattagtcctgccactatggaaagcagtttggagattcctcaaagaacttaaagcagaattgctatatgactcagcaatcccattatttgattggatatgaaatgaaaacaaatcatcctactaaatggaaagaaatcatcctaccaaaaagacacatgcacttgcatgttcactgtggcactatccacaatggcaaaaacatgggatcagcacagatgccccattaacagtgggctggataaagaaaatgtggtacatatataccatggaatactacatagccataaaaaaataaaaaccatgtcctttgcaacaacatagatgaagctggaggccattatcctaagcgaattaacacaccaaatcaatcttggaggtcaataactaagaacgtggtatcaaaaaacaatagaaaattaatgagtcacttagtatatggtattgaaaatgattcataacatgcaaaaaataaaactgaattcttactgaaatatacgtatgttatttatcataacagcaacatttatacaatgctcagtatgtacaggcaggcactttttttaaattaaagttttagggtacaagtgcacaacgtgcaggtgtgttacatatgtatacctgtgccatgttggtgtgctgcatccattaactcgtcatttagcattaggtatatctcctaaagctatccctcctccctccctccaccccacgagaggccccggtgtgtgatgttccccttcctgtgtccaagtgttctcattgttcaattcctacctatgagtgagaacatgtggtgtttggtttttttttccctgcgatagtttgctgagaatgatggtttccagcttcatccatgtccctacaaaggacatgaactcatccctttttatggctgcatagtattccacggtgtatatgtgccacattttcttaatccagtctatcattgttggacatttgggttggttccaagtctttgctattgtgaatagtgctgcaataaacatacgtgtgcatgtgtctttacagcagcatgatttataatcctttgggtatatacccagtaatgggatggctgggtcaaatggtatttctagttctaggtccttaaggaattgccacactgtcttccacaatggttgaactagtttacagtcccaccaacagtgtaaaagtgttcctatttctccacatcctctccagcacctgttgtttcctgactttttaatgatcgccgttctaactggtgtgagatggtatctcattgtggttttgatttgcatttctctgatcgccagtgatgataagcattttttcatgtgtcaggcaggcacttttctcagtgttatttatgtattacctcattcagttcttaccataatcttattgggttcattagtactaccaaccccattttacacacaaaggaaaagttatttaaaggttaagttatccaaattcactggattagtaagtgaaggagccaagactgtgaatccaaatagtgtgatttcagtatcccttgtcttaattactatactgtcaatgcaaaattataaattaaacagtaagtttgtgtgacatagatatgagaaagtaccttccaaacaaaatccaaaaagcaagatcattgagacaaagaaagaatggattttgtaaaataagaattaaagatttttattcactgaagattgaatggaaaaagttcacaaaaatcagatgatagcttggtagagaaaatttaatttgtagtgtctaaaactgacaagagatttataattagattattaagcaagtccgattaattaagaagaagatagcaactcgattaaaaaataagcaaacataatggacatttaataaacaaaaggaaccactcctcctcctcatcccattcctccctctaaaaccatttataatgaaatgatgcccaaattcatatcgttagagaaacagaaactaaaacactgacatcacttttcactcatggtattaacgaaaattaaaaagccgaatcgtgccaagtgttggcagggttacaggtgccctcatcaaattcctgtagatgttatagactgagacaaccatcttggagaatgatctggcagtcctttggcaaattcagaacatgcacagactatgaccatcaaagccactcctgagcatatattccatataaacttttcctcaaatatgaaaggattcatatgcacagaagttcattagtacattgtttgtgttattgaagagttagagcttgctaggtaaatgtaatagtttcatattatacaagactataaatcagatcaaagcaaaggtaacatacatccagcaatatggatgaaatttcaaaacaatgctgaacaaaaataagatacagaatgagttctatgttttataaaaaagtatgcaaataaaacttattagaatattggctattaggggagagaaatgggaatggggaatgaagaaaaaagagaataaataaatggatggatcgatgggtaaataaaactgaccaatattgatagtgagccatcagaatgaggagtatgatctcatacctttgcccctagggtcaagaaaagtataaaaaagtaataagaaagcaaaatcaacaaaagacccagactttttatagagtttacattctaaagcaggagatagatatccaactactaattacaacattgccttttaaattactattttgattagtgtcatcatagatgaaagcatggtgtgttatgagaatgtaataaggtgtaaaagaagattagtatttatctcaagtagaaaccactagatgagtgtttgtgagatacaggaaattggactaggagttaggtacttattccacccaattttaaaactaaagggtatgtggagttgccatgtgttcagtttataactagaaattctagactcgtttattatttttgtctagaaacaatatatattaggcaaatttgagcatgagtgttcttgctcattctctaggctagtgctatgggcttatcagcataatttacatattaaataaaagagcataagccatatcatctgtatatctgcagaaacactatgacagccctacacagtagagctgaaaatagcatcttttcaaaaatagtgagttctaaataatctctgtttaaagatgaataaccagaaagaaacttggtcttgacttgtgaaaaaattctgcaaaaccaaagaaagagtccatcatccaaaagattataaaaagtcaaccatctaaaacttgtttatttaaggaaacagcagaaaattatttttaaaagtgataatcaaatacaagaattcatgaattctatgagacagcaaaaagagacaaggaaacaataagctattaaaaaagacatagaagtggagaaaagaaaaaaccactaaaaaccccaaattacaactaaaaatctgcttcagagcacataaaattgacattacaaaaactcaaatcagtgaggtcaacaccttagaaactctttcaaaaccaacctaacaaacagaaaatctaagttcaagcaaaattttcagttgtttttgataaagcaggacaaaataaaaccaaaacacatggaagaaaactaaaagatgcaatacaggtagctcatctgaagacatacttctgagttgaagagagctttgagtgtgcattttacaaaacaaaacaaaacaaaacaaaacaaaacaacaacaaaaaccaaacaaaaaacacagaattaaccggagatatgttctaatgaaatctttaagttataaaagtttttaaaaagcctaaaagcattttcatagaaattcaggatatcaacaaagaaacaaatatcaaactgtcacaattcttttcttctataactttaaaatgttagaaaacaattcttcaaatgtgtcacattatttgcaaatatatgtaattttcaacgaacattttaacccaagtaatttatattgagtcaaattgttattatatacaaaaacaagaaatactttattagatataagttaacttagaatttatgtctttactgaatatcatgagccaaagacatactttagctggccaagatatagacacatataatccacaattgagaaaaatgagaaattaaaaaaaaccccaaaaccttcctgcctgttcaaagtcaatataatacagtggttaaatactggcttgagcttgagttcacagcctggctcctgtaattacttgatttctttgtatttcattttctttatctgtgagatgggaaggacagttatgcctaattcacaaagttattgtgaatattaaatgaattgatataggtaagtgtttaggatgaggtctgctacatagttaaagttcaatgaacatgatctataattacatgtttagattctagtggcaaactattgaagtttcctcttttgtaaaatttgtatggggaaatcatcctatctaacgagatgacagacaatgaagtcaaacaataataatattaataataattaaatatttattgaacaattaatatgtggcaagaattatatatatattactttatttaatcctgataataaatctgaaaagtaactactattattattctcattttataaataagaaaaataaggccagaagaataagccatttctaaaatcacacagcttgcaagtggcagagctaggataattcattaaagtatattattcatattttcctacaccagatttgaatcaagctatactatctcattgcatacctcttttactttaaatactcttatcacaaaatttaaattatttaaaatagcatacaattctgtggcaggctagttcagagggaaaaagatatttaaatggcctaacatgaaagaactcaatccaggagacagttctgatagcattacctcacccaatgaccaactaacctcacatatgcatctatgatattataccttaccatatgcgttcttgatatgtctctctttctctttcagtagactaatacgggactggtgtttaataaatgcatgttaaattttagttgagagccactgataacatttcctaaagaaacttttcaataactctattagacatgaataaaatacaaaagaatgacaaaaatatcgcaaagaagacgttaacacatcctgattcaaaggatttttccccaaaagtcacatttaacatttccccaaaagtgacatttaaatgaatcaaacatacatactaattgtcttagaatacatttacaattaggaagaattagtgtagaagaaaaagaagaaagggaagaggagagggaaggagggaaggaaaggagataggaagggaagaatgaaagaaaagaacaaattaaatggaagtgaatatttattgaggactgttagtcaataaccttgatattaatatgcattatctcatttaattcttataaaaacacttcacggatgcaaaggatttcctttttcagtaagaaaactgaaaaccaagacaggttgaaaacttcctagtgatgcttataaccaagtacagacttttgttttaatctacatttttcccaagaacatttaatgaatggaaatctaccaaggtttgcaagctgtcctgagacataaatatgtgccatagataaatggtgacaacattcaactaggaaacacattcctattctagttaacttgtttttgagtggatcaatgttttagagacgtttaatagactagtagataaaatttaagtttctttctgctttcatttgcaggcatattactcttcattgactgcccccagggagaaaaaaaaaaaacactttcatagctgaaagatattattgagaagtatgtgcattatgattcaaattaaagaaattgccttttaaaaatattcagctttgattttagacacaggtgtcaaatgtatagatttgttagatgaatatattggacccagggtgtgagcataatactcaataggtagtttttcaacccactccctcctccttctctcctccctctaatcaactgccaagtctatttttttccatatttatgtccctgcgcgctcaatgtttagctcccatttatagacggacacacaggatttagttttctgtttctccattaatttgcttaggataatgacccctagctttaaccatgttgctgcaaaggacatgatttcattcttttttatggctgcgtagtattccacagtacatatgtatcacattttctttatccaatccaccgttgataggtacctaggttgattccatgtctttgccattatgaattgtgttgcaatgaacatatgagtgcatgtgtctttttagtataatgatctatattcctttgggtatatactcagtaatggggttgctaggttgaatggtagctctgttttaagttctttgagaaatctccaaaatgctttctacagtggctgaactaattaacattcccaccaacagtgtataagcattcccatttctctgtagcctctccagcatttgctgttttttgacttttaataatcaccattctgagtgatgtgaaatggcatctcattgtggttttgatttgtatttctctgatgattagtgatgtagagcattttttcatgtgtttgttggctgcttgtatgtcttcttttaagaaatacttctttgtgtcttttgcccacttttaatagggttgttttttgcttgtttaattgtttacatttcttatagattctagacattagacctttgtcagattcattgaaagtatgttctcccatactgtaggtggtctgcttactctgtccatagtttcttttgttttgcagaagtgctttaggtcccatttgccaacttttgtttttgttgcaattacttttggggacttgtccataaattctttgccaaggtcgatgttgagaagggtatttcctaggttttcctttaggatttttatagttcgaggtcttacatttaaatctttaacccattctgagttaatttttgtacgtagtgaaaggtaaagatctaatttcattcttctgcatgtggctagccagttatcccagcaccatttattgaatagggaatctttttcttattgcttgtttttgtcagaaattgcctttaaaaaaattacagttctactagtgtaccaactcttgggtatactcctttttaattttattttatttattatactttaaattctgggatacatgtgcagaacatgcagctttgttacataggtatacatgcgccatggtggtttgctgtacccatcaacccatcatctaggatatgctccttttaatgtgctacttttcgaaggccaaggagctattttcaggatggcatctgttgccatcagtagaggaatggccatttcccttcactggattatctgaattgaccatgtatactgcttacgtttattaatcctctttaagcctttgcttactctatgtcatctataaccgactttagaatcacattaaaagaataaagatgcagacagtaatagtatatactattagtatataatagtatataccactaatatacattaacataccctatgcaccaagaaagatatttgggccaggtgtggtggctcacacctttaatcccagcactttgggaggctgaggcgggtggatcacctgaagtcaggagttcgagaccagcctggccaacatcgtgaaaccccgtctgtactaaaaatataaaaattacctaggtgtggtggcgggtgcctatattcctagctacttgggaggctgaggcaggagaatcacttgaacctgggaagtggagattgcagtgagccaagttcctgccattgcactccagcctgggtgacaagagcaaaactctgtctcaaaaaaaaaaaaaaaaagattttcagagactgtttatcaaagtagtttgataacatgatgaagggaatggatacatattgaatatattcttgtgtgtaaataaacttctactttacccatgtaaacaattttagtcattaggagataccaaaaagtaaaaatactgatgatgttattgattcctaatgataattaaacaatcactttgtttcaagaacatttctatgtactcctaactctgcttttcagttgaagaaactgaggcctaggaagattaggtaacttgtgtgaagctggtaatatattattccattgaaaagaaataattgattcatttaatctctatgtacatataattacaaaaggaagatctaccttgtctatttaattacatggtatatagtaaaaatattcaaaatgtttagatatgttttttgaaatctgaaattaatgttatattaatgacaatttcaggaaaggactgagttttttcctatctgcaaagaataaacattgaactatgagtaagcctcataaaattacttatcttgatgtatgtatttattcagtgtaataaacattttggataaatatgtaactctgatactttttagatatattaaaacattttaaatctcacatatttcctgcagaaaagatggaaattacagaaaactatattgagaaaccatatatatatatatttgtatatatatatacacatccaaaattgatattaaatgataaattttctctatgctagctttcttacttagcattatatcatgacagcatttgtacttcaaaaacatgattttcattggttgcttaataatatatagatatgttgtaattaatttaagtaatccctcatagttgtacatttaatttgcttccactttgccattactgtaaaacatctgtaagatgatacgtttttgccttcactttgaaatatttcctcaggatacaactaagtatttttctggggagtcctaataaatgcaggatttacgtgaatgtcattatatctcacttcacttcccttctttttctgcacccttgctatcttttgccctatctggggaaagttcaccatattgtttgtgtttaaactatttgatagttagggtaatcactactgttagttttgaatctttctctggtaattagtacagtgttttgcacatagttattaagaaatgtttgtggaataagtgacctagttcatgatagaactaggacctaattaatacttccaaatatgacttggtaaccactatcaaacactaggcttcatatgttcttttgctgtgccaagttaataagcaaaaggattatctgagtgataataattagaagtccattttagcaactcttctagtaaataaaatggaaaaacatatataaagtttgtgcttccacagccaatacaagtatttgtttaatctggactacatcaagtatttcctagacttaaaacaattgcataagattgtcagtgtaaagaaaagttttgtctaattcaattttggccttgtgttctttctttttctgtactgggaaatctaaccattgataacatttgattcatattttccttacatcctctctacagtctgatttttaagagccaaatgtgaattttaaatattttcctctcagagtaacgtaattggagagtattcctaaatggaggtggatattgttgattttttggagtggttaaagcagtacactgtacttgcctgttaaggtgaaggaaaagatgctgttttttctacgaggatgatgttcctatttttatctctaaccctgacttttcttcaaagcttcagttctacttctccatttgtctgttggacatttctaccaagatggccatttggctctgcaaaaaagagccatccaaaaatgaactctttaaatcacttcccaaacttgcttctcctgagatatcttctgttacgcatcctcttaaccatccatcaatgatcagttaccaagtcctgtcgattctgtgctggtaatatctctgatatctattctctttcctctattttcccagcaacttcaaaaattcgggcctctattagtctctgctggtttaactgactaatttaccgtcttcaaattttaaccttttgcaaaatttatcccactaagtcttgccagattcacaatttcaaagcataacttggatcctatcatccctaatcaaaatactttaaaggcttccaagatctcttaaagtcctgacctgggatattctcccctctatgatctggttctatttagtatttctaaattatcttgttctagctctcttcatacattagttaacctatgcctcatttaaactaaattattggctgtttcccataagggctctatgtgctgttattgaaactatcaattctttatgaaaagttccctttcattctatcttgtcatacagtcatcatcttgaaccctcgaggttttgtttaaatgtcatcccaaggaaattttactctctattttaataattcataaaaatttatctatactattctgtaacaaggagaatttttttttttttttttgctagtcctcagttgtccctttgtttagaagaatcccctggtacacaacttagagatagaaagtgaggtgccaagggcatatcttggaaggagacagtaaagagagttttaaattaacttatcaaagaaatgaggagatatttagggctgggaaagactgagggaggtagaaaatgtaatggaaaaacgtaatatagcaggtcttacagagaaaggtggccagtaaaatactctcagttacaaatatccaatattcaattttaaattgtttatactgttgtcttttacatgcataaatgccttggggtgtttcattttgtttggatttaaagtaatccaagcaaagtgttggcagggagaagaaagaagaaaagcattctaggagatgagacaagtaggagatgaaattccaaggaaacagaaactggaagccagagtgaatttgaatccataagccttaagtaattaacgtaaattttggggaagggaggtccttgccattcccacacaatgtggaataagaagcctaagctggatttatctcagtctcaaagggtagcaaggcctcagctgatgcatggacaacattcttcatcgccaacttactttctgctggcattatggttgttactgtgtaagtcccttatcagttctgctggagtacaaatgctctgcactaagtacccaccgttgtactttgtaaagcttagcctggtagttttcacatattgggctctcaataaatatccacggaatgaactattgggaaactatgaggaagatttaggtacatggagtcagcattattagggtgcctctatgcaaaattgagaaaggcgccctctttaggcagactcagacctatcagagttagctggtgaaatgaccaagtgcacgcagccttgaatcagggtaagggtttcgtggatgcagcataagctggagctgaaacttactccccaccaccccacttctccaccttggcttgtgccaggcacaagtataacctacatagccttggacggcaatactgctttggagggagagacacaaggaacaatggaggaaatagtagttgccacatggagtcttaagtaatgctgctaagtgaggctcagaaaacgaaaaggacctgattttagagaagcaaaagctactatatcttacctgcttcactttactgctaatgattcctgaaaacgtctaacactttgcaaggcaatgcacatgtagttatttagagttgactttgaacgacattcatttgaatccaatgaggctgccatctttattctttttttaatgtttacagtcatggttactttaaagagtcttgtgaagttgaaaaatctcaactttggcaacagacccaaacttgtaattcatttcttgtatgtttctttttaaaggttaaaagcagttcagttccttatgtacaggcacacaccaggcaagcctgaagttgtttaaattcaaaagattatttttcaaatttagataattttagataattcttaaaagcatttatagctaacaaaattattatgaaatattcagaagttctctgaagtattcctaaaaaactgaacaataaacctaacagataataatatcatgatataaaagtctattggacattgggcttggcaatggttttttttggatatcacaccaaaggctcaggctacaaaagcaaaaataaatgaaactacatcgaactcagaagtttcttcacaacaaagaaaataatcaccaaatgaagtggtaacctatgaagtggaaaaaagtatttttaaaccacatatctgataagggactactatccaaaatttataaagaactcttacaatgcaatagaataaaaacaaatgactccacttaaaaatgggcaaaggacttgaacagacatttctccaaaggagacataaaactggccaacaattatatgaaaagttgctcaacatcactaattatcagggaaatgcaaattaaaaccagtatcagatattacctcacaaccataaggatggcttttatcagtaagacaagagataacaaatgttggtgactggagaaaaaggaacattagtacactgttcatgggaatagagattggtacagccattatggaaaaaagtatgaaccttcctaaacaaattacagcaattcctcttttggacatatacccaaagaagatgaaatcaccactttgaaaagatatctgagctcccatgttcactgcagtaatattcatagtagccaaagtatggaaacaacgtaaatgtctgtagatgagcaaatggatacagaaaatgtggtgtgtgtacacacacacacacatacacactggaatattattcagcctcaaaaaaagaaggaaatcctgccatttgccataacttggatggacctaaaggacattgcattaagtgaaataagccagacacataaataaaaatattgcatgatctcacatatgtgaatttttttaaaaaaagaagtcaaatacacagagatagagagtgaaaccatgtttatcatcagtgggggtgggggcgaggaaattaggagctgtgggacaaaggatacaatgtagcagatatgtagatgaacaagtttagagatttaatttacaacatgtggactaaagttaataaaattgtattatattagggatttaaaaaaataagtagattttagctgcttttgtcataaaaacagaaactacgtaagatgatagatatgttaatctgcttcactatagtaacattttactatctatatgtatccataataatgtattgcaaaccttaaatacatacaataaaatttatttttaaaaagtctattggaaaataacattaggtttctagaaattttatcaacattctcaaggatattaaagttatctcagaaaattccccaaggacaaactgagagttacattttcctaaacagatggaatttttccattagagaaatgactctggcattccattaggaagagactgaacaatgtgatcataaatatatgtagccccaaatccctaccttgaatgatagaggctaaactttccaaaagtgaattctgtgcttatagctatttctcaaagccaatccctggggacttacggtgtacatttatgaatcatgtagggcaaagggtggttccaaacaggaaataaaagagaccatgaacggataacatatgcattttttcaggccaaaattccattgtttagatttgcatgaagataatgggtataaaactgacattgacatcagcctcagcattatgagtatgggcctcctaggagttgaagctgaaagctccccataatctttgagcagcatgctgaattacttgtctccggcacctcgctaacggaatttcttatctttcttttattttcaaaagctcagtgctttcaggatgctgatctaatattggggttatttgtcaccaaaatcagtttataaaatgtattttgttcttcaatgaaaacacatctgctgtatacctaataaagagctcagcatagagattaaaaaaaaagaagctagtactacttatttcactgcttttattagtgggatcataattatttttaggaaaagtttttaatttaaggggatgtctacacactaaataaaggattgttaatatgctagaaattattccaaaacatatgttgccatttgattcagttctttagtctgatttttttttaagtaggtatcgtttagtaaagtcaagtgtttacactgaagggagttccatggagccactggatttggattttcaataagttgaaaagaatcatgaaaacatttgcaaatcatctacttggctaggaatctttgtggagtgaaagtggtgcaactgtatgtggcaacccagtgcttattttttctgttaatacaataaataatagctaatctagaaaaaaaatgtatgagcaaaaaaggagactgggctgggcacacagaattccatttctgaacttcaatttctttttctcctccttataggatttttttttgaggactaaatgagataatatatgtgactatacataatataattgcaaaatactatgcaaaaaggcaatgtgattatttggctttctaattttctacaaatttggaaaataaaattctcttgctagaaggaagaaatagaatggcaaaataatgttaaaaatcatttgtctttttgttgtttggaatctcttttctgttgattttccactgactctctaggatgatttaatctcgccagagcaaaaggtagatcactttttaaaagacttactataaatgaaagttaaggtatgggtaagaaaatttgtaacttaatagggacaaaagtaagaaaaaggtcaagaagtgaatggcagtgaaaatagaggtatttcaaagtgaaattaacacactgaatttaataatttcacattgttaaaagaggaaaatattactacacaattatcaaattacacatgtgatctgattgacttagtactgaatggtatttcattgaaatgcacgtattccaatggctcattgtagaaattatataaactctccttccattgtatgctctgggtttgttccaaagaccatgcgttagcttcttttagggcataaactttatagattttaaacttcatttatttccctctataagtctcataagggaagtctttctctctgttttcccaacaagaataactttttatcttaagcgaatgcttccccagcaattcaatactgaaatcagcattttaatcactgtaaatggattcttccacatttgtaccatagtgttcaaatatggcatctaagtatgaatcttacttaaaaaaaaaaaaagagaatgaaaatatgacctaaagggaaaggacagaaaaaaaaataaaaaactccacaatcatcatcttataaatttgtttttataacttctgggataaagggtttctaaaatacttctatctcacctatctagttcattcctatctgcaagttcactattttctttttctagattatcaattcatatttagcaacctgcatgtctttagaatataaatatagctaaatattatttattttccttatttttacaatattcagaactgcttatattcagaagctcctttttgagactattcacatgtaaatcactacccagcaaacattatgtttttggctaataatgtagcttccataagataatgtggtctctctgcatagggatacactctagggctgacatttgagattgttgaagtggatcatcaattaacctcacttaacaatgagttgaatcataccatgttctattactctttaatgtactgtggaaaaaaatctatttgatgggatacactttttctttttttcataaatcattttttctttagtctgttttcatcatgagttatttaacattttagtggcttttcatcacactagtaatattgtgattagcaataattagaatggccaaaattaacctacctggatgtgaatgaaatcaaccttctttatatcatgaaaatttcattgagttattctagcttgaagagatacagatgaaaataaaatgcttcactagaaattatattagatgacaatgtcaaataagtagggaaaaaaacctctgatgccagtcaaaaatatactcaatttataattttccacccttacctcttatgttttcctgtagtaatagcaagagtctcaacccgagttagtgttcaatacgttttctcttaagtgacttttttgtgtttaggaaatgtgttatttattttatacattttcttccccctccccccgcttttgttttggagaaaaagtctcactctctggcccaggctggagtgtaatcacacatcactgcaaccttgaacttctgggctcaagcaatcctcctgcctcagcctccagggaagctaggactgcatgtgtgctccaccatgcctggctaatttttttttcttttttactttttgtagagacagggtctcattatgttgccaaggctgagctcaaactcctggccttaaagatcctcccacctccacctcccaaagcactgggattacaggcatgagtgcccagccaattttatatactttcttaatctcatctttactataactatctaatctaggtattatcattgcttttttacatgtgaaaaagaggttcaaagaaattaattcatatttttagtaagttttatatctgagtcatacactcagatcaaaagaccaatattttaaaattccaaatgaacttcttacactgcaaatatatttctaaatagtggcaatttctatactataacgtatatttagtatgtgtgttttctacttaatatagaacatcatttaaaaactacatgtgtatattggaagagcctattttttaagtcctaattgcagtgacatcataaaaacaatacaaagacatgtaatttttattgagtgagatattaaatgtattaaatacagtttttattaaagttaaaattttaatttatcaatctactttcaaacattttataaatttttagtacaattactggcatttaatgaaacctggatcataaaatgtgccctaagcggaaaggtaaagaacagaaatgaattgttttttaaaaaataaataagtacgatgaatctttaataacaagaacctccaattttgatagttatgcttcctctccacatatatcaatataaaaaaatttaaattatttgaagcttaacacaaaattataaagcatcatactgatggaaattgaaacctaaattatgagctgttctgaaacatacaataaattccttgggatgagacgacttctagaagcacaagcaaggaagcagtggtaaaatccatttttcttctgacttctcaggcacattaggctaattccagaaatagattcagtcagttggcaagttaacctctcactcttgtcacagaagtcatctgcagccttgagtttaactgttttctttcttcctggtcttggtcctttatgtagtagcccagtatttatggtgccacttgggaaatttatctatgataagaatgtacctctgaaaagcatttattttacaaagcttggatgtgggaatcatatattacataaaatctctttaattcttttaacatggattcctttttctaccatggagtacactaagtcactcatttgatggttttgtgtttacaatcttatttgctcaggacccattttatttgggctttggaaatgattgaatcaagttggaggaaaatttacttttgatccatttaattctaacctttcttgcaagctcaatttttagaatctagttcaatgggctgaaagaaaaacatctcgcaacagacagtttatttcttgtgcgatcagaaatgctaacagtaaatatgagcatatttactttaaaaatttagatttgaaatacatattgtttagaatttcagaagtttttaggagaacaactatcttacataccaaggatatactaggcatatgtatgcatttataaatgttgttgataaatactattttgtggcagaactagatgattggatgctttattcaatataaaaatttttatgtctcatatactgtaatgaagctacaacttatttaaaacacattctgatacttaacctttaataaattattgaataaccacgaccaacatagatccattaatacaggttgtaatagctaaaagcaatgacaggtaacattcgtgtggaatttactgtgggtcctacttcattctgaaaacctggcttatttaaagagtttaatcttccaacaattctaaatacagtatggttgagcaatttgctcaagattatacacgcagggatagtcactcagtggttccttccttggacatgtaaataaaatttgtgtgccttttacaaaaaaaaaaaaaaagattctacaggtgttaggtggtaaagctgggatacatttcctgctgtttccagaacccaacgtctatgagaagttatatatgctttgattaaatttcctattttccacaatatattgtgcacctatagcctgaggttaatgaagttattgaatgcctcttttaaataaaatactggttagaagattatgttcatgcacacctaattaaagcaaactctcatgaaaatatccactgaaaaacaaaattacttttcttcttttccattagctaaaatatacatttttgctctatcatttccattatttctttcaatctactgtgttcatcaaatattagctataaaagcttttttacagtagttgatttaaattataaaactaactttttgagtctgttggaaaaagcttggaaggaccttgataattcagttatgcatggattagtgtgcagtaataccaaccttcagtgcaagctctgcacttaaactagattttatagcatgagttgggtgcagaacagtttttgattttgctacaggtatctgtttctcaactgtctatgaactctccagaagaaatccaaacattattgttttttgatggttcatatccacactttgacttcatttccaatctaaatagatattattttttatttatggaagtgatgtagaatcattgcagaagggttaaaaatgtagagaagaaaacagaaccactaaaatacaaatcaagagttaacagttgttttcattttgtataattttttgtgttttaaaatatatatattatatgcatatatgtcatatttttttcttattttatatacctcataaatagtttagtatctttacttttcattcaacagtttatcataaaaatctacttttgttaatttaaaataaatatatagagttatacagtatcccttcttatgttttgacaatttttaatacttagaaccattcctatatttagccctcataaataattgcggtgaacatcttagaacacaaattttgtaaaaactttgaaaaatatatgctcactttttagcctgattaactagattgggaagtgccagatacaaatgtgtaagcattttaaatgtttttgcatgctaatatcaaacgaattatttctactggcagagtttgagagtgcccatctcaagccactcttgcagttattgaagttttttttcagtcatcattatttggtgtttgaaagtgatgtactactttaacaattgtctgtctctgaggactaaggaggctgaatatttttatgtgtgtattacatattaaaatttcttttcctgtgaattgcttgcttcctggtttatatttgttatttgcaacccaaagatggtcactaataaataaaccataaacacatgtctcttagaaggttaagacatcactggaattcatccacctgtagcatgttgtcaaaataacctaagcttgaagtgtattccccatttactaaaaggactatcacaggaaagatatttattatatatttatttgtcattagtagcattaggtttctgctgacatgtttcaccagatgtgagacgattggccagggtgaaaggtatgtgtgagtgtgtgggtgggtatgtgtggtgggtggagaatgaacctcattagggttcaggatttcggctttcttaacagcatcttttaacacaaatatttccagcaggagcatgcgttgcagtacattaacacaatgattactatgctaatgcagctccatcttagctttcctcattcctttttgcagttttagaacaggcataaagacaataggtggtggtaatcatttggagagaagagaaagaaaagtgctgtgttcatgtgtgttttacccaatcaccaaaatttttgatcacatgatatgtgccaggtgaaatattaagtgctaatgtgtgaatgcgtttgtgggtctttatgtatgtgtgtgcttatgtggactagtggtttagatttggggtgatatatacaataacacaatgaatgtggaagtcatttaacacgggtagcaccacatcagcctttaagaatgaagttgaatgaagttgaaattgtgcaacagagagaagttgaaaggaagaagataaacaaaatttaaatggctgtgataaatatatttagttggaaatgtctaatataaaggaaagacaggtaaatcaggactgaaggtctaatttgggaatcctcagtttgaaggcaatagttaaagctataaggctgaatgacccttgtaaagagtactgtggagaggaacaggtagctgaagatggagcaataatggtagaaatatgagggaagtggagtgaaagcaaaagggagagagaggccgggggagatgtaaggaggaagttggggagagagagagagattagaaatgtagatgcttcccaagaatagtacaggtatatgacagctaagataggaaggcatttcaaggaggtagttgtagttcatattataaaataaaaatcaaagatagtacccacaccctcctcttggactgaagaaagtgtgactattggtggctgagtaaaggcataaaaaacccaatttcaggtcatttaatatctaaataaaatgattaacttaccgttggccatgcataattgtatttaagatgtttaaataaagaaatatggagtccaattaatctgtttctttaactcccatcaattgttgcagtgacatctattagggctatttttctttaagaaaaaccgtaagaaatcctggctttaataatcaaagctatggatggtatctttgattagtgttcattatttagggtcagataataaaatgcttgatttaataactttatttgttgatgtgacctgaaattttatgttactggagataaaaacaggttttagcagttcctctgttgatgggctttatttccaaaaagaaatctcttctattaatttacatagaaatgatttaacagtgtaatccctccattttcattaacattacgatttttttaggctctccttcaacacattgttttatgggaagaattaaattttgctcctgtgtctctttcattacacgaagtttgttttcatttgtctgtgttgtggtgttagttggaaatttaatgtgcttttctcttgaaaacaaggagacaccaatcttttcttctacacagaattgttccagagaagtaatgtcagtccttagagatatcattcagaagaaaattggcatgaatgaatgtaaattgacgcattcagaattgggaaagctagattcagtttattctttactatacaaatgtttacataagttcttttaataatattccgatgaatttcataattaatattagtagttgttttgagtcacactcaggatttcaactacctatgtctcagtttttttattattgctatatgatagttgtatatatttttggggggcacatgtgatattttgatacctgtacacaatgtgtaatgatcaaatcagggtagggatattcatcacctcaaacatttatcttttctttatgttggaatcattgcaattctcttctacttgttttgaaatatacaacacactactttaactataacttccctactctactattgaatactagaactgatcccctctaactgtattttcataccccttaaccaatttctcttcattcctccttccgcttttgcttctcagcctctagtaatcaccaatctattctctatctctatgaaatctattttagctcccacatatgagtgagaatatgtgatatttgttttactgtgcctggtttatttcacttactataatgacctccagttccgtcaatgttcctggaaatgacaagatttaattcctcctatggctgaataatattccattgtgtatatataccacattttccttatacattcatccaatgacagtcactgaatctcggttttttcatctgtaaaattatgtgactaaatcccaccctgattttaaagggtttggaaaggcatgaccaatatttaagatatagaaagttcactctttaaaaaaattataagcgattcttacttatgtctttatttgttttatgctcaaaagatagataacgtgctcctaagaattaagaggcacagtgccagaaaccgtgaagctttgcaaaaagaaacattaaggaaattaaaaagaaatcatgatttaatcttaaaatgaaataaaattgcccatataagtttacgtctacattttaaattacaatatttactcagacagttctctttataagggctataaagaaacttatttgaaaatgaactatcataaaaccataataatctagacctcatttaatcagaatttgggataacatggatacatttggacttgtcttttcccattatttgtgaagaaggtatttgttaagcaaacttaacagtgccacaaaactttaatatctccaagtacttccatgcacactaagagtacaagtttacatggaaaatctgtgtccacattcaactggcctctggacttaaagatctactgaaagaagagagattgcaacacactaaaggagcaagggtcccacttagaaatagccattgttaaatgattctgcatcagttacgtggaatatggtgagatataatccatttggtgaaaaagttcataggtttacagaatatgtgcatctgcttgtaccgaacatgtaattcacagagagcagggactgaacttatcaactgtgtaggtagcacatagtaggttgttggggctcagaaaacaaaataccaaagtgaaagcctcagaagtggcctcagaagctctttctctctgaccctcccctgccctcctgtccctggcccctcattctgccccatggcaagtcacagaaacaagaatacctcttccctcaggtgagtcatagaaactagaactccttttccccaaagccagccaaaaaaactaaaaatattattctcgccttcccctgcctttctgtgtaggagatggccataaagaaattgatgtaccttgtttgatagtagtcataagacccccattctggagagaggctgccccatacccaggaggaaggaatgcttcagagaaaggccaggaagaatctgaacagagaagcctttctgggtttcctaagtcagtctactgccgtaagattatactcttttggtccaagcacattgctacatggctgcctatacttcattgaacctaagcataaaaacggattgataggccaggcacagtggctcatgtctgtagtcccaacactttgggaggtcaaggcgggaggaccacttgaggctaggagtttgcgaccagcctggccaacatggtgaaacctcatctctaccaaaaataaaaaaaaaaattagccaggcatgttggtgcatgcctgtagtcccagctactcgggaggctgaggcaggagaatcacttgaacacgggaggtggaggctgcagtgagctgagatggcgccattgcactccagcctgggtgacagagtgacactctgtctcaaaaaaaaaaaaaaaaaaagttggttgatagttttccctgggtcatttgatcttcatcctgaaagctcccatgtcacataaaactaggattaaataaatttgttgtgcttttctcttgttaacctatcttttgttataggagtgtcagctgtgacccttgtaatgggtaagactttcttttcaccccctacaaggtgctcagtaaatatttttatgaataaatcccttgccttatttaatttccgttaactctaatctattaatgtttattgaggacttgtttagcaccagataccctcagtcctgtatgaaggacttgtgtatctacatattcctagttcatttgtgtgggagtaagatgaaaaacacaggtaaatagaggcttagatttgccacaaaatggatcaggaaaactattttccttaatttttttctaattgaaaggctttgagtaacacattagttctgtgcaatttgcctcttagggtaattttaattagaaggtaagtttgccctgtccatcagatcaatagtatttttaaatagctaattatacatttgctagttcataattaagatttggaaatctgcctatatgtcttaattcagagaaatgctaaattaaatatgtccctcaatgcctaatttgttagaatacttctaaagaaatggcaattagctaggactaaacactaaattttaaagttatttttataagagacatttgccatagtaatatagaattgtggtgttcagaatgaaaaaaatgaagaaagaatgttctggaaagagtttgagagtgagaaggatggtgaatttatagcccaaattatcctatattccacatttaccttcctttaatagtctcctgtttggcggcccaaacaaggactctgatgtctgatgatactattatgacagacaaatttgctggtggaaataactatttaaccctgaatggctatagaaggaaagaaatattctaaaatgtcaagtgtaaacatatcaaactgtaagagtgacaccccaaattgacacccttctttctaaggaaagactttttcacactggtttctccattcttgaaatcttgctgataacttacattatactactaaaataaagagtgtgatcaacctttgttaaaagttaatttgtaccctggtgtgcagactggaggcaaggaatgggggttagctaacgtttgaagtactctaattgggactattcccagcaggatggttgctcagaggctctcactctagagagaatgtcactgtaagaccttcggctattctattttacttctcattaatactagaggtttggttatttagcacaacgaatattaggcatgaatttttatggtgagatagggttcaagatacatcgattactataaaataatatacggctactttgagtcttgaacaaactgtgctcaaaaatctagtgatctcaagagcctacacctttcaaaatattgcactggatttaggattttctaccagtcctttgcttaaatatttatcagaggattttgttagctggttctgactagagataaattatgccacgccttaagtgaaacttaagtgcaaggagcagttagagggactaaagggacagaaactgaagacctcatcaagcttggaggtaatatggctgtttccatgccagcattcctataaatatttgttggtgaggctgattttggtttgcaatttgctttcaaattacaacacactctataagattacagaagacaggacatacagttttgtcttcctgagccgttggaattctcttgactaactaccaaagatggctacagttgatcaaatagtgttacataatcttatctcagaaatcaatcagaggaagaataattatgttttatgtcatatgttttatgcacagatagggacttatttaaagtctcataggtatggagtaggggccattcccttggcccagagaacctggctctaaggttagaaccattgtcctctgtttacaagctgtgagccccaggacaggttgcttaactatttcctcatttgtagaatgagtttaataacagtatctatctcttactgttgttttggaaatttaaaggattaaaatatgtgaaaattttggcttataaggatgtatacagcaaactatagctactattatcacaaaatggacaccaatgtcttgtgctctccctactttgtgtagcgtttttcccattaacaattctgttgaaaatttgtttgtttctacttctttgtctgtctataatgtatgtatagtctgagcaatatgagccatatgatcaaatgactaatagaatgcaatgatatatttggatcaaaattttcctaaaattttcagggaaaatcaactaagatgattatatttttcctgagcttaaatggaagaaaatcttatgtatcttagaatttttgagttcagttctgttcaacacagtctactaattctattgctttgctttattcatgcaagtcctgatgaaggaagagtttctcagacttttcagcaaagaaatttttctttctttatgaaatgtttattaagcacctgttattacacactgggggacccgaagagttatacaacagctcatttataaaacctagcaggagggacacaatgtaaacatgagcaaatgacaataaaaatttcatttgaaataaatgtaatatttgataagtgttcaagacatttagaggagggagtcatcgttgcatcccaataattttgtgaacaagcactgaattggtacatgtggaaggattcaggaaacttttacccacaatgtaggatttaagcaacactttgaagaatacataagattcagaaagatgctgagtagaactagatggagagggagttcaatgaacttaaggatctctgttctagaaacatcttcccctctttctgtctcagtctccctccctcaaccaactcacttattgctttaaataacttgcttaatttgactttgcattcgtactgaaattctaccaaatagggatgcacttgaaaggaatgacatggtcagcttctcatactatgatgtgatttagttagttctttaatgacaattgccaggtctgtttgtagatagttccttcaacaatgcctagcacaatgcttagtaagcagtacatgtcaatgaaaacaggtttcttttatttggtttctttaatcaaatgaatttttactctaacaggttactgagatcaataggacaattattcaaataaaagagggaaacaaagagcaataaatttgagaatatgaaataattaagtggctagaaagcttagagggagaagaaaagggcagtgggaaaggattttgccaagaatggaagatcaggatagataagatggtgagcagaaattaagacaattacaattacggttggagggggggtgttgtttgtttttgtaatgagtgacacagtgagggaaggcaagggaaaaagcatgaataaagaagagtgaagaatttatgttgggtaatattgggagataaatttggaaaggtagcacaagcctgtgctgaactgtggaggatcatgctaaagaatttggatttcatcttatatgcaactaaaaatactcttagttgttctacttatatcctactgctcaaaattaagctaaagggaactttgcagatattctgcaacatttggggaaaaatggcagtgattggtgtaattttcaaatctccccaaatctgccctccttccatagttgaagcaagtaaaagacataagagcaagtaaaggaaacataggagacatgggggtagaaaaacctgttcaagaccagaagaatggaatgagagaagctctacatgaaaatttataaatttattagatatataactggcatttttttaaaaggaggagaaacttaatagatataacaaccaaatgcaatattttagacagtgaaatttggacctgtactaggaattaggtaacattaaataattactttattggttgtgataatggcattatgctatgtttaaaaatccttatctgttagaaatacacattgacctattcacaagtaaagtgatatgatgtctgaaatatactgtaaaagaatcacattttcctcatcctccaagttgatattaagaatataatattgcaatatattgataacattgaaactcgctgctgggatgctgactttcattattctctcttcttatggaggtgtttgaaaatttccacagtgggtcactattttacagtttgacacatgaaggtgtatggggctcttacagaactttaggatttgacaactctctctacaccctcttgaataagcattattcaagagaccatttccatatcaattaatgtccagaacattcatacagagagttgaaatcgggttcccctatcatagagagtgccactggcttctgctttcctaccagagaatcagagcagagctcattcacagaagtttcaggtttcacagtgttatatactggttcctaaaaattctatttaggatacacaatactagtttatattttaccatgttatgaagtataaaagtctatttccatgagctgaggggcaaactgacacaatgtgacattacagaaaaagttcaaagagcaaagtctcttccttttagtaaacgtacttctagtacaatatatctgtagcaattaataaatgatcataaggagttacagttgtcataatggaatgactgaaccataaaatattgctgatattaattcaaaataggaatgctattttgaaaaacagtttggcagtttcttataaaggtaaacatacactttatatgcaacttaaaaatgccactcccaaaactccaaggtatttacccaggaaagaagaaaacttaggttctcacaaaaacctatattcaaatgactacagcaactttaattcataatcactccaaactgtaaacaatccaaaattccttcaactggtgaatggataagtgaattgtggtacatccatacctggaatgcttttcagttaaaaaataaaaacaaaaatgaactactgatacacacaacaacatggtaggatgtcaaatgcaatacactaaatgaaagcagccagagtcaagggttacgtaatggatgattacatttatatgatgttctggaaaaagaaaaacgtaggggcagcaaacagagcagttgttgcctaatgatagaggtggagaaaggcattgactgcaaagaggaatgaagggatctgtggggtgccttaccccatttgggctactatagcaaaatatctcagactgggtagtttataaacagaaatttattgctcacagtaaggatgggaagtccaagaccaaggcaccagcagattcagtgtctggtgagggcctgttcctctcagacagcaccttctggctatgtcctcacatggcagaaggggtaaacaagctccttcaagcctcttttataaggacagtaattcctttagccaaacaggctgagcctcatggcctaatcacctccccaaggccctacctcttaatacttttacttaatacttttggggttagatttcaatatatgaattttgggggatataacatttggaccatagcagagggtgatggaatttttctatatcttgattgtgatattggttttatgattctatgtgtttgtcaatacacagaattacatgctaaaaagaatatattttatgtatgtaacttacacctcaatgaacctgactaaaaataggtttaaacaatctaaaagaattcttcctcagtttcctgcactagagtctcatttctttccttgtttctttatttgtgaaaaagctcaatggcagcataatattctatcatttggacaaactgtgactagcaaatattttttctatttgaacatttaagctatcttttaacttttcattattataaataaaagtcagatatacaggcacaccttgtattatggtgctttgttttttctgcttcacaaatattgtgtcttttacaaattgaaggtttgtggcagtccttcatcaagcaagtctatcgacaccattttctcaaaagtatgtgttcacttcatgtctctgtgtcacatttaggtaattttcacaatatttcaaactctttcattattagcatatctgttatagtctgcgatcactgatctctgatgttactcttgttatctagttgttgtggggcaccacaaaccaagttcataagagacagtgagtttaactgacaaatgtgagtgtgcgttctgaatgctccaccaaccggccattctcccatctctctgcctcttcttgcacctccctgttcgctgaaacacaacaatattgaaattatgcccattaataacctataatggcctcaaagtgttcaagtgaaaggaagagtcacacatctttcactttaagtcaaaagctagaaatgattaggcttgatgaggaaggaatgtgaaacacccagatagctgaaatctaggcctcttgtgccaaaaagctagtcaaactgtgaatgcaaaggaaaaattcttgaaggaaattaaaagtctactccagtgaatacacaaatgataagaaagtgaaacagccttattgctgatatggagaaagcttcaatagtctggatagaagatcaaaccagccacatttcctcaatactaatccagaccacagccctaactctctttaattctatgaagtctgagagaggcaaggaagctgcagaagaaaagttggaatctagcagaagttggttcatgagttttaaaaaaaaagctgtctccataacataatagtgcaaggtaaagcagcaagtgctgatgtacaagctgcagcatgttagctggaagatttagctaaaataattgatgaaggtggctacattacacaacagattcaatgcagacaaacaggcttctattggaagaagatacatctagggctttcaaagctagagagaagtcaatgcctggcttcagttcttcaaaggataggctggttatcttgttaaggactaatgcaggtggtgacttttagtggaagacaatactcatttaccattccaaaaatctcagggcccttaagaattatgctaaatctaccctgcctgtgttctatgaatagaacaacaaagcctggatgagagcacatctgtttagcagcatgacttaccgtgaatattttaagcccattgttgagacctactgcttagaaaagaaaaatttctgtaaaaacattgctgctcattgacaagcacctagttacccaagagctctgatggaaatatgtaaggagattaacactgttttcatgcctgctaatacaacattcattttctagcctatggatcaagaagtaatatcaacacttaagtcttattatttaataaacacattttataaggctagagctgctatggatagtgattcctctgatggatctgagcaaagtaaatctaaaaccttctggaaagtattcactagtctacatgccattaagaacatttgggattcatgggttaaggccaaaatatcaacattaatagtttgaaagttaatggaatttggaagaagttgattccaatcctcacagatgactttgagaggttcaagacttcagtggaggaagtaactgcagatgtggtgaaaacagcaagagaactagaattagaagtggagcctgaagatgtgactgaattgctacagtcccatgataaagtttaatggatgagcagttgcattttatgcatgagccaagaaaatgattgcatgagacggaatctactcctgggaaagatgctgtgaacattgttgaaatgaaagaaaggatttataatattacacaagttagttggtaaagcagtggcaggatttaagcagattgactctagttttgaaagatattctaccatgggtataatgctatcaaacaccatcacacacaacagagaaatctttcatgaaaggaaaagtaaattgatgtgcaattgatgaagcaaacttcaccgttgtcttgttttaaaaaaccgcaacagccaccccaaccttccacaacccccagcctgatcagtcagcagtcataagcatggaggaacaaccctgcactagcaaaaagattatgacttgctgaaggctcagatgattgttagcatattttagcaataaactatttttaattaagatatgtacattgttttttaagacaatgctatcaaacacttaatagactacaatagactgtgaacagaacttttatatgctctaggaaccaaaaaattcatgtgacttgctcttttgtgatattgctttattgcggtggtctggaactgaacctttaatatctccgaggtatgcttttaaaaataaataatcagtattatttcctctacagatgtgttaacatggctgggaatatttcgatagtcctttgtaactgatattgctactttgtttttccaccagagccaggcctggtggattctacagaaacaagaaaaatatgctcaaaacaatcttaattttcagaaatgtagatttctattttgatgaccgcagtctgtagattgagctttgtggaacagggggatggggtgttgacagataaagaaaaataaatcctctcaacaattttctaaaagcctggctaaactagggtcaaagtatctgagaagcagtgtaaatattccaatgagtttcatttcctgatcagacatattagtttccatatgccagagtcctggtggcaaatttacactctgtccaaatgctgcttttatgggtaactggaggctctgtgtgtagcttcagcatctgtaataatggttttgcacaagagatgtgtctaacaaagttgaaagtatagataatttcattgattgctttaaattccaccattggcgctgcatgtggagctgcgttctgaatcactccagatgcacatccttttagaacggcagtcctgctaccatccaagtacccataaaggtctttaattaggtaatctccaaatagcaacagcaccatcctctgactttattaacataaaatctctcttttgcaaagctctttcaatgtgcaataggggagaattcctggatgaagatgggcaggtaagagtaaagagagaagacagaaatggaaatgacaaaacagataaaagcagagtaatattgtggttcatcttgaggtgcttgttataacttcactttaagaaactttaacctattaacctttttaaaaaacttggcctctgctaaggatctgcatcactaacaagaacatttatttattaagactctctgtgtctaagcatttttaatgacccccattgccatggcaccatctggacacctgacattttaaaaacaaacatttcagcataattgatgaattctaccttagatggctattatgcacatctgactgctaaaaaacaggcagctctcattccaccaaattaaacctcgccaagcagaaatatcacatagaacaatttaatatgggtgtattatgaagaaagcttaacctgaagagaccctctataacaataaaggtgatggattcacaaaaaacaaaccacaagaaataaccaggtggattttggccagagtatactcacaatggagaggtagcagggagatgtcagtattgcacctgagtcataccttaaccatacaaacagctacagcaaagcacgcacagccagcaaatgacccatccatcgaacagccatgattatcctgccttccactataagaggacataccctttgctaatactctctcaaatttctgttgattgtggagaaaggtaggggaattaattaaaaaaggcaccggttactaatgaagcacttttgattcatgcatccatttatttaacataatcaacagaaacgaatttatatatgaagtactgttctaggtcctggggttgcagcaataaacaagaaaatttccccacatgtttacacttaagatccccttggagcctggggaaggtttagcaggagcctttgagctatctgtgcatttgtgaattaaatattacttttcgtcttgtatggatcagggaaccaagactctgacagattgagttacctgtacaagtttacataactagtaggttacagaaatagccctaggatttaggaccccaacatagctcagttttgcacaatcaggaagcttgcttcaggtaaacaccttctgcctcatttccttcaggcacctctagataaatggcaccacaggcttctttaggttcaatacttaaagctctggatcgggttcaaaaatcagagttttaagagaagttggtggaactcagggctcagaggttcttcatttaatttcagctaggttaggactttgagaggttttttggactaccattgtgagctacattgctgctctaggaaaaatacatccagagttctaaatgagtgacttacaaatcaacttttggagcctactaacccgctcttttgacttttaactctctgatttctaacatctacttttccatgcaagtttccagctcatgccatcctaaataaagtagaaactaggcacatatttttcttctttgattcttcctatttctttcagaattgttctcatgcaataagcacctatctagtttctgcccacctggcttccaatatgcaataattgattactaccactagctccctgtgtgtgtgtgtgtgtttggggggttggtgtcgggggtgggggggtgttgggagttcaagcccttatattacagcattctgaaactctaatcaaatcactctaatcatcgtaacaaaagattttttccctgttttacaagaatttttaacatagcctgattcataataccttataccatatattatctagaagataggatatttatctccagagaaatggtaaggtaaagagagaaacaaaatattcaatataaaaaactatttacccaagatttttcagaaaaatcacacttgtagatcttaatattaatgaggcactgaagtatattaagaaatgcaacgtacaaattaacataatgaaaagaattaaaagaaagctaagtaatgatcaagtcattaggcagcccatactaaagaacaatttgcagaatcaaaattcaacagacggatacaccactattagtgaaaaaattgattattctattatataaacttacttttgccatttttagaagttatgcctgtttcttttataattaattatgtgcctataatggtagagaatttatagtttagataaacctatacaaatagaattctccacaccaacaataaggccctttatgatgtctaatttatattacttgatattttatatgtaactagatttcttttttccagtcttaacaacttactttttggcctcaatctggttactgggcttccgcctacttctttgcacccaaatttgtgtcttagaaatttgcttaatatcctaatccctctaggaattgaggaagttgttcttgcttgaccagctctttccaggagattggagccctgctcattgcacccatcaagtaagggtcaccacaatgtaccaacgcttccttgtgctatctccctccttagattttactttcagtggtatgttggaccaagctcttactggcttgcaatagcctgttgttaaatgttcaacaattttgtgagtgggactactgctggaaattaatcaccgtagaagtatttaacccaaagaaatcatgaaatgcttttaatgcctggagagctgacttatcaacaaacacaccactggatcatcgcccctttcagaatacgttaggtaactctgtttggatcccctgaccattaactattattgaaaggtttattttatataacattctactggactttgtcccagtactttcagctggccttacttgaaagtaactgcctcaccctagtaagacagtgtggttctggattctggttccttcagtttttcctctattgttctatgagcaactaagacatgaacagctgaatctaaatccctaacgctctgaatactctaggcagtctggctgttgcatctgagcctgtccttttgttacccaaagcctccctctgctggccccaactattaaaatatgcctacttgtgttctaccctctcaaatgcctattctcctttagtatagacacattttgaatatggttttagaaatacagactccaagagaggtgagctaagacatgactggtctatgatggtgattgttggctggatctcagtgttcattttggatgtcctaatttaatgccagttaaacagtcatctaactctagcataaaggctttttagcaataggcagtaagtagattgtgaatgacaggctgagctgggctttgatatcattagcaagcatgttggttgcttacttgctgcttcaaatctattctccttaatgcccattctgtgttttcgaactggcctgtgatagctggaaaaaggctcttctcttcttactaagattgttaaagacttagctctgttagtaaaatcagaaaactcgcaatctgtaaatgcctgataacgtcactacacataggaacatgacaatgcatcaactttcatgtgatttgttgtcttttaaacaaattgtctacttcttagtcttatggccattgcattcctaaacgaactcaatctctggactaggtctcatctcactataaatcatttgctgcattgcaaagaccaatactgagtattcttgtgcttatgtttctcctttagataaatctttttgtgttctcacagactctaaccccttatagactacagttttgttgtttgaaagaatttaaggtaaacagcttttgtcaatcagaactcctcaaattattgtatgttttgatattcagtatcatttttagtggtataatctgtaatttaggaagcatccacattatttcaactcattttaaattttaagaatatgccacaaaaagatttgaaatatctccaaggtatatataaaatattttaaacaaattatcatataaaatataaacctcatacccttattctcttcctacatttcaaccatctcaacacaattatttttggaactatataatcatgtcagtttaaaatcacctatatagtataaactctctggaattcgaaaattttggcacataacactctgtggctgtttttttttacttggctcttgttggctaagatgatcaagatccggaatgattgcatcccatttaattcttcccaaatgtttctcttcctgacattctttagccatatggatcattcccattttcaaaaggtgaaaaagtaccaggaaaaattaatttatgtttggatgatataaccaccctgcaaataaagagaatgagggcaaaactgcctgcggagggcaaaactgcctgtataccagaggtaggactgaaaatcaaacctcccctagagcccataaaactcatgtcttttggtatagcaagagcagaggaactagtaagtgtacagcactgagccatagctcagattcaaaacacgtgtgtataggaaaaacaaacaaaacaaaacaaaactccaaactgggcttattttcagtgtaagttttgttcaattgaccagggcacggggaagccaaaaatgagctaattttcagtgtcatttgcattatccgccaggtgttaaactcattataggccatagcatcatttgctggaaccagccattccttcattagccatgctctctttatgccctctagtgcatatattttgaatggaccttcaggggaaagatccaaatagttttgctatggctatagtctgtttccactggtagaaatggaagcaagctcaactagcttagaggagcttaataataagccaggcaacaacaggtattgacaactttctatctgatcagttcattgctaggcattttgaatgatatagaagaaatgcaaaactccatctgagtgacaatttgctcctcaataaaatgcagataaaacagcaaccaccttgcctgaatgttgtgaaaacaagaaatagcatgtgtaagtggaagtagcatggtgaatgctacatatgagatgcctaataaataatgactgttattaatgataattaatttataattctcatgagagaggaacatcatcatgaaataattgatgtgccaaacaaggaagtatgaaattaatctgcatcctgaatgaaccacccaactttcacagatcatttaaaaaggggcctgcaattacactcttctgatccttttggttaaaaggcattctataaaaacctaagtataagaagactaaaattctgctgctttcagctgtagaggatgatgaaattgtacccaagggtgccttttaataaagttcactttattattctctaatgcattttagcaagcttcactggctataaccatgactttcttaaatgagagatcctttttcttttcagacgaggaaatcaagatttcttatcataattggggatgtctggagggcagacttatactctgattgttcagtggctgggctactattctagaccagttaactggcttcactaacctataggacttgctatagaaaaataaagccatatatgtgatgattatttggaaaatatacagttctagaatttcctttaccagagagcttctggggctcctgtctgaatagcctggatttttttttaaattttcttatcataaattaaataattttgatattcatagaacaaaatgcatcaatgaacccataagatggctgttgtctggtttagaatgaagcacagtgcaactgattcattgaagacttctttcacttttgtgtctgaagcacatgaatttagctgttaaaagaaagattagaggtgtatccaaccgatgatgtaatgtgatttttcaacattaaagtctgactctattattctaggtcctcctatgttagatgggctatgagagcaaatataatggtgcataatttataaatttggattctcctcctcttttctttttgttcttcttcttgttctcaagaatgaacaaaacatatacttttaaaaagaaagtctatttatgttaaggaatagacaaggcacaaatcattcattcccttggtatttacaaatttaattttaaagactaacgttattctgaatagtcactgatccccagagttttatctctgtaagtgacttcttcttaaaatggagattgaactctaaatttgcaattcccattgggctgcaattaccatatttattcacataacctacctgttatttttactgtgaaattgggaaatgatattacgtaagcatctgcctgctggtctaaccataattttagggagtattactgatatcataaatcagtttccctgatattttaaaaaagtttcatactttggcatagtaagaaatctaagataaagattaattggagttcaaatgactccacagatatttttcaatatgttttttctttttttatagtatggaaaaaaactctatttaatgaagcagtacttgtccattaaagaaatgattttaaaaaatattggggggtcatatttacatttaatacagctagataaatgtagacagtaaatctaataactctttcttcctctgtcccaacctatagcaagatagggtagagaaaatggactatttgtaacatttaatgatttgcctatttatagcaagtaaaaagtaagttcagcttatcttaacttctgactgcttggttattttaaattataaaattaaaatactgtgtgtgctcccatccacacatcttaaggaaatcaaaatgaaaagctacattaaatttcatttcaaactgtgatgaggttatgagtagaggtatatgtagaaatatacagtaatctgttttaggaaaatataaaaatttaatttcgatagacttcttcactctacccttcaactctgaatcacttgattttgttttccatactagatgactttgtgctaactggtagcccaaagatggctaagggtgacaagaggaacaaggagggtgtagtctccattaccctccaaagcctctaaaattaataaaatctaagagaaaaaatgtgtttttgtacaactataccttcaatacaagtccctgaagaattttaaaaatatatttttttttatgtgcttgaccctattacttttttctaaaatactccaataaaccaaatacaaacctatcaatatttctttctaatcactccaaaacagctaaaactttccatcaattccattcctttctcagagaccatcatgcctttaccttcctacatcaatctggacctgttgctttagatacctatgtatagttatttttctgggaattccatttacccttctcccgtgtttgacctcctgttacttggatcctttttttttttttcattgtggtttacaccccccaaaggttgcttaagcatatctttcagttgtttctttctttttttttttacaccataaatatataatttttatttgtctgttatacttaaagctaaaaagatatgacccattttagaaaagtgttttttttttttgtttttgaaatttggcattttttttaaattttattattattatactttaagttttagggtacgtgtgcacaatgcgcaggttagttacatatgtatacatgtgccgtgctggtgcgctgtacccattaactcagaaatttaaaaaaatctgctttagaaaaacagatacgaaaattgataaagaaagatgacaagatggcggcttttcatgtttttaacttttaggatgtttacttatcctatgttctagccaagaaagccacagtccatgagagtctgttaggtaacacaggccttctccccttcattttatttatttatttatttatttatttatttatttatttttgagacagagtctcactctgttgcccaggctggagtccagtggccgatcttggctcactgcaagctccgcctccccagttcatgtcactctcctgcctcagcctcccgagtagctgggactacaggctcccgccaccacacccggctaattttttgtatttttattagagacggggtttcaccgtgttagccaggatggtctcatctcctgaccttgtgatccacccgtctcggcctcccaaagtcctgggattacaggcatgagccaccgcgcccggcctccccttcattatttagtgaaaacgcattctagtgtgtcaatctgacaattctatggaaaaaaaggatggagttaactttgtacctattatgctgctgacctttgtttttgatgcaagaaaggaagtgtgaagaaatcaaacagtagaattctgggttaaaatattccaactgctatttaacataattttggcatttgcaaagatttttaattcgtctccttagttattactgggatttgctggtaatatgattttaaatatactctgttactataactatttttgagaacccttgtaaaaccttatgtttttcctctctttaaccataatattaattaaggaagcatgtcaggtaaagcataaggacaattttgcttaagataaattttatatcattgagcttgttgtaaaaacaaggggaaaatctgatatcatataaatacacttaaatgaagaactaaagtagtgtttggcataacagcttcagatgaaatctatttgaaagacaaaacaaacaataacaacaaaacccatataatcaggctaatgtatgtataaaaatagtagaacttgctctaaaagtacaaatcattctctcattcacctaaaattttatttaggatttttttttccaatatctatctcaatattttgtttgatatttacaatgcactttatatacacagcatcaaaatcttaccaaaaattaccaggaatatgatatgcttaaggagagagaaattgagaattaataaaagttgactagttctaagtcatagaaaggctagacttaaccccaacagaattgaaatattgggttgcagagctttcacaatcctaaaggtagtgtctaaaggctccacaaatttcagcagttctttctattttattttattttattttattttaagttccagggtacatgtgaaggatgtgcaggtttgttacataggtaaatgtgtgccataggggttttcagcagttattttaatttaaaactggaaaggaggaaaagtatatgaagataagaagcaagttggtatggagaaaaaaaaattagaactgtaaaaatttttatgagtgcttagaaataagaaacaagtagaatgatgatttgtgttagagttaatataatttagatgtagatgacattggtgtatctgtggataaaactggaggatttcattctgtgatgtatgtgccaatttggaaatattctagctcacatctaggcataaagcattttttggatgctttggccacataacgagtataaggacagattgcaaaaatactagataataagctataatttatactaatcttcataaattctctccaaattttcactagcctgctttcaaggagttatgagaattttaggttgacttggtgcctctacggagggatcctgagtaattttttgctccgtacagttctcttaggccttccctttaaagggacttggagttacagaaatgtcctaaacatgaccagcctgacaaagatggaaatttttaggagttgccttaggggaaactacaattgtgaatggttagaaaatcattcaagatttcagcaattcctcctacaagtcccagatttctgaaaagaggccaaaatctgaacaaattcagtagatggttgatgcagtttctaaaacaatgttagaaagtaacagattcaacatatctttgaccaatattttccaagcctaaaagaaagtaagacacaatggatagaaatcagactatgaacaaaagttagaattttaatacaaatgggacaacattatccataagactttttgagttactgatgcacattgacatgctataggatattccattctcaccttttatccccctgctctgtgtctggtgagttcaacatttattgactgcatcagctaggctctcttgctttgtggcttcttgttagttcaggtaatgggaaataccagcagaatattagaagataaaaggaaagaggagttctgttatttatttccctggctctctatctgccagtgcacatgttttcacatgttgcttttctgcacttgaggttaggttcttactgagtggccctcttcaacagtgcagatctttctgggttctgataaccttatcaagccaaagtgtggaagttgcttccagttaacccaggatgatccttgatcctttcatcttgtccatccctctgtaaatagtcaatttattaagctctcctctattaagaacactctttttgagtgtgccatcagttgctgacaagatcttgggtgataaacatgcactggattgtcatgtgatcatttttacatgtgagatgggctagtgattggcagacaaatattatccgcttattgcacaacagccaccaagggcgtcctcacgaaagtatgaataaataccattatttttaaattttaatgattaatattgattattttggtacagaaaacatttcctatggcctaggattcatatgtagcatgctcataatttagattgccctagttaaaaatgctatgatatgtgtatcctggttaccttagagactgtgtctcctaagtagagagtggcaattctagtctgtaggggtgctcagaaatagtatctgtttttgaactccaggaagatacaaaagtggggggagtcttttcaggaatcatcagtcatagcttctcctcatttacatggtctcacgtatcccaacactctcttttttgggggaaatagcttataattcatctattattctcacatcctggaagactagtaagcctggagcttttcatttaaatatcatagaattaagtggttatttgagaaaacagacctatggataaatatatggtaaaatacatattaactgcagcatataattacataggatataaggatataattacctctgtggttgttataggccaaacaatagtagagaagtgaggtgtacattaagaaaaaactgtgttattcaaaggcctaagactcagaatgcagtagcaaagaaagagggtcacatgctattccctgccagagtagctaagaatacatccctattccctgaagattctgcctcttacaataggaaatgcccattgtacttcagtggtactttagtaaactagtataatgataactctacaccctacagctctttcaacaaatatttttcattttccttagtgagaacaaattaagatgttctttctctgatgtgattttcaattctagttcaaagttaggatttcagggaaggccctggcactggttcttttgatggtatctgttgtggcaaagagactctaaggtctttcctttggtctctttctcctggtgtccagattgtataatcctgtcccactgagtgtgggcaggacctgtgacatatttctaaccaatagaacttggtaaagatgataggattttactctcttgattatgaatcattatataagcctccaccttgctatcagtctggtaataggaagtgtccctttccctttctgactttaaagaagcaaggtaccatgttgtgagagggcctatggaaaaagctatagtcaaggaacttcaggcagctcctggagctgagagtagcctctagccaacagccaaagccaaagccctcagtcttacagccacaggaaatgaattctgccaacaacttgagtaaacttggaagagaatccatcaccagttaagcctccagatgagaaccaagccctggctgacacactgcattcttgcagaggacccaactaagacatttcctaccttaaagtgagagataataaatatattttgtgttaatctgctgagtttcttacaatcatagaacactaacaaacctgcccaatacgtacttagttaataaacattgactgagtgaggaccataagccaagcattattcaccatatttaagatgactgtagaagcaagaaatccatgcatgaaagggagttatgtaggcaaattccataggcggtataagtgtctaaaaatatcaaatgggtaagatgctttcctttcacatgcagacagggaaaactatttgcaatgtctaatgactgttctactttaagtggatgtgagaacaaaacagactttgaaggagatttacagaatagtattgaaatttttttatcaagttctatcaattaaagtttgatgccatatgtatgtatttttgccattctgccatccaggataagaaattgctattttctgccatatgagggtgtatattcttgccactatatcctgtaacatcaggcagagataaaacttcacaaaactcagcaatgctaaaagaaaatctgtgacttgcctttgtattcactatctactggcctacatctctagaaatctatatccaatttataccagacagttggtcacagtcttaggtgaaattttcagcaaaattttgagtgtctaaattttttgaatgaaaaaaataaacacaacagatgacactaacaggggcagaaagaaaagacgttaaagggggggatgcagatagcacagataatcttgtttgtttgcttgtttgttttttaagcaccaatgctatttgaaaattcttgctagctcttatttttttttctgttttttgttttttcaatatctgaggcattgggggtttacatcaaagtaacaaaagaatgactgaactccgatgaagcgtttctgaagcaataattaatatacgaggccaccgacactagaattaatcttgaaaaccactctcaaggtgatgggcaaaataaatgcgccatgggagtgcccccagaatgctgcactgacattgttgggtcctatcattgatcattgatgatagcaaagaagcgatcagtcacaaggcagaactaataatagacttcaaatatggaaggaaccttacttctatgtttggtaacagtccatgtttaacaaatagtgtttttttgtgtgtttgtttgttttcttttgctttgctttttcctgctccaatggacaaaagcaacaagtctctttctctttctttccgtgggataaaagaccttgctatattctctgtatatatgcattgcaggcagcattggagggcagttaattaactataatgaccaagtgtatgggcatttcattgcatacagaagcaactctgccctgattcaagcagccaagtcgactcaaaactcaggaaatgcttacgtataacaggtatggggatgtacccactgttttttccagtggtggtgaaggtgccattgtcaacattggtttaatccttggagtcccactaattaaaccatttctttctttcacaaaagggcctctactggcctgaaagtatcaacgtgcaaggtgaggttcccagataaaatggatcttttgttgggtgcatcttgcagtttaaccaatctcactataagactggactctgagtgctccctcactcttgaactcttggctgctgcatttttgtctacttgatatcttctgatgttcataataagtacttgttgtagataacaccatttttctataataagtaaatcgtaagctctatgtaatactcagagaggaatagtatctgtttttggaattaaagagcaaaatgaataactgtttggtccatgctattacctcgtttttttttgtttgtttgtttgttttttttttttttctggaagcatttatttgagtttcatgagcaaagctgatatctttgaataaaacttctccacgatctttcattctcacaatctgaacagaaatgtgcttatgttgtgtaaattagattccttttattgtgtaagactccaaagatttgtcaataatatttttgcttttagtcatgcccttaaaaatgtcacctaatagtacagctttttactttgaacttttctacatactaaattcagttttataaaagtgttaatatgaacgatacatatgtgattacctagagtgaataagatcacaatcaatccagaagaaagcattgtgtttgtctagagattccttgccaggaataatccgaagaggaaatatgtgtgtttatttatggtaataacaatacagctgtccagcaatcaagttaacttgactgtcatctttatcaagcagtatatttacatgggagacaatctgaggaaggagaaatctatattgtgtatgaacatgatgaaatgtatttctaaacacattgagcctctaatttctgaagtaagatgactacttaaaacacgatgtttagaaaggggtagattatacattgacacacttaagactcaatcatttcaacctttctccaaaatcactttttcaacattatttattctaaatatagaatacaatatttatttcattgaaaagggataaaagaccttgctatattctgtgtatacatgtatttataagtgtgtgtgtaggtatgtctgtgtacatgtgagtatatgtgtgtataaatgagtagagtaagaattacttatggatttaaaaaaatgttttaactatttaaaatcaatttgtgtaaaaaaagaataagccaggtttattttaactaaattaactagatagcttttaaaaaaattaaacaatcaatcaatcaatcatgaatgtgtcagaggcatttaaaccagagcaactccatcttgaatgggggctggtaaaacaatgttgagacctactgggctgtattctcagagggttaaggcattctaagtcacaggatgagataggaggtcaacacaagatacagatcataaagacgttgctgataaaataggttgcagtaaaggagctggccaaaacccaccaaaaccaagatggccacaagagtgacctctggtcgtcctcactgctacactcccaccagcgccatgacagtttacaaatgccatgggaatgccaggaagttaccctacattgtctgaaaaggggaggcatgaataatccactccttgtttagcatatcatcaagaaataaccataaaaatgggcaaccagctgccttcagggctgctctgtctatggagtagccattcttttatttcttcactttcctaataaatttgttttcactttactctatggacttgccctgaattctttcttgcatgagatgcaacaaccctctcttgggtggggtctggattgggacccctttgctgtaacaaaataatttattttcatttctttctaatgacttactttttcttaaagaagatgaagagaatggagcctcaaaaggactgttcaatgtacatttggatataataattaccatcttccctgacttcagcaagtatacgtagatcaaccaccaatttttgaccataaacagaaaatcaggggcacaaactttgttgttgttatggaggtgaggaatgccaataagtagaaagaaagtagagttgggtcttctctctgctaaatgatcataggaatgcagaagaattgggccttaaagcacaggcagcaggacttgaggaatttgctgttaactgccaaaggaggaaagagttgtaggattaaaaaacatgctcactaatactttcccacagagcttgtccaaggcacaactctgagactgccttactgcagcccctttcagcaggtgtcaccctccttgggaagcgaaattgcttttcctctccctcaaacatttgtcttttatattagatgttttctccacaccagtgtggataaaattactgtgacaattttcccccaaatagttgcactaaaaatactacatttcactgaggaaggcagtaaaatacatttgtaatatacatgggctgtggaacaagttctgggttccaattccaattctttctcttttctctttgtgttacctcagttatattactaaccctttatgagaatcatccaaaaatggggacaaacagatattccttagatgattgatttgagatttacatgagagaatatatgtaaaacaaaccagcctagtactggttaaaatcggggagatggtcctagttttattccattagaggaatataaggcacccacagcaggatattcttatgaggctacactccagatccagagcaatgaggctgatgactaaagcttcttaaatggtcgtttgacctaccccctaaatgacttaaaaaatgataatgttgaatcacaagtacaaacaactgtagcagtctttgcaaagtcatttgggtggcttcacttgcagggagctagaacccaagactccccagttatgtcatccagcaatgttgaccaagttcaaagtactttcagaatgacaacttgctcaaataccgtagcaatcctgtcactaggcagtattctcattttaaacatgaaaacattgaggagcaggaagataaagtggctcttaatggtggtgctgggattttactcagtattttggatttagagtcaatgggcgttttctcttttgcccccacagagctctactctatggttataaaaaacaatgtatggtggcctagtagtgatgtgtattatagataatgaatcataaataaccaaataattttctccaagacactgcgactattagtaagattatcatcgcaacaaagaccctttgttgcgatgataaatgattaatacataatagccacccaaacccatgaacaacagcaacaaccataaacgaacaaccatacttttccaagtgctgctaaaaaggaatttttacttgttttatctttatgccaatgaaaagaaaggtcatcttgctgaatttttatgattcattctttggatagaaaaactcaattctacaggttccttggtaaatctgtgtattacagttgagatcagcaccactgttaatctttcctttgccagcaaatagcaattacaggataactacagggtaattctagggctttgtgtctttgaacgccggagtaatttgaaccattctaactgtaaatttgaattgtttaacatatgctttccgcagagtataaatacattttaatgatttatttcacctccttaaatgcacaattttcagttttttagaatcaagtgatttcataaatatagaaagtttagaacactagtaaggaaacttgaaataaatcaagaaacattttcttcatttaaacatggcttaaattgagcataaaacaaggttctcagaaacatcgaataattgcatgatgactagaatttttttctttttcaatgaaatagataaaaatattcaaggcttctatttataaaccattcaagttgtagtttaaattacgtaaattgtcaaataagtgaaaaagcaaaaatttaaaatggaactttcttctacttttaccacttttttctttccctttctcttaggcactatttattgaatatcgtgtctctatatttagtttccagtctctacttactactttgtatttgttccacctctcttttgtttcttccaaatatttacaatgaagtgcaagtatatgtaatctatttgtttactctatttgtttatttttattttttgaagatctgtcgtctttcttctttattattttcagttcttcccttactcatttgctttccttttgactgcacttcacactttctctttcccaatccattaactgaagattccctcataaccatcccaacacatctcattccactattgggtggttgttgtattgttcatactctctggtgttaacagaatcatggttccacacgaggtggagtttggggaaatgaatcaactactcactgctcactaacctactccattgataggctagaggtcacactaagacaatttttaaataaaacggtatatcttataaaaatcatcgtgtaaaaattcagtctatagatgtgtatttgctcttccacataaaaacatacccattatttaggacttgaaatttcactccatctatatacataaagacataatatttttgtgtctgcctactacatacagaaaatttatgtatattttttaagactccaaataatttgaaagtgttgaacgttcacttttattccttatactccataataaaatttctaacaattttaagctacaacccacagtagtaaagaaacactattaagcaataaaataaataaaatgtgaaagccaggcacacaacccagtatgctttaaatcttacttgttctttagatcccacgggtgttcaccagacgtctccctaaacaaagaagaaatgtgacaacaattaaaatgtgaaaacgatgctattaaaatactgctcatttaggtgatgcatgtttatattacttagctagtggaaatgtcaaattccaacaagaagtgaaattgtttgtattttggcatttcctttcacacttattgttgtaaaaaagcaacttaaaatgttccttttaaagcaacaagaagcaaaacatgttatgattgttctggaaaaagaaatgatagttttaaaatatttaatgtatcccctaatcaaaattatatgtagtagaaaagaaataacatacagaaccatcaagtatcattcaataaaaacaaacttgtgctagaaaaacctatgaagaattcttacaaaagggagtatttcttgtgttgaaaacctttgttaagattttaattccttggtaaacatacagaaagcccattgagtttctttgaacaacatcacaggatttttattatagaaagacagaatctaccagactatgataataatgttatcaagaaagaaagaaaaagaaagaagaaagaaagaaagaaagaaagaaagaaagaaagaaagaaagaaagaaagaaagaacgaaagaaagaaagaaagaaagaatctgaattttaaaattaggctgagggcttattaaacttttaattatatacctcgaagtttggctgggtgcagtggctcatgcctgttatcccaggacttggggaggccaaggcaggcagatcacttaaggtcaggaattcaacaccagcctggccaacatggtgaaaccccatctctactcaaaatacaaataattagccaggcgtggtcgtgtgcatctgtaatcccagctactcaggaggctgaggcaggagaatcacttgaacccaggaggcggaggttgcggtgagccaaggctgtgccactgcactccatcccaggtgacagagtgacactccgtttcaaaacaacaacaacaacatggaagtttattattaatataattttttatcaacgttgagaaagatacaagtccatgaaagtgttgtagtgtttcgggagttttataatttataagtaactctaaaaactgggcaccgatgttggcattttctcagtgattttcattgaacttgttcactttttttttctttttggaagagtggaaatgaagaaattaacctggactctatgtgaatagctgaggcaagtggagacattaattcatttgtgtaaattcctagaaaataacaactgatcttgagttacataaagctgatcagtggtgctctgcagacatgggaggagaagagaagagggaggtattaaaagggccataaataaacttctggagctgacggatattattgttatcttgattgtgctcaagattttaaaggcatatacatgtgtctaaactcatcaaatggtatgctttaatgcatgcagtatattatatgataattataccttaataaagctctaaaaaagtggaaggatgtgaaatatatatttaatgtagagcatgaaatgcatgtataaaccattcaataaattaatgagagttggtactcttgcgatttttgttttaaaagattatctgtttgctgtgtgatgactagatggaggagacagtgattggaagcggaggtgaaattttgtaagaaagcttggaccaccataatgacagttgacataaaagatgctggattgattcatgatatagttagaaggtacaaagaaaaggctggttgaggcattgaatgtgaaggtaagacaaaataaggaaccaagaatgatggccaggtttgtggcttgaacaactgagtgcacgtgctgccattttctgaggtggtaaagactgagaatataataagatttaagtggaatacaagaattccattttgtacatattatatttgaaatgcctgtgagacaatcaaatggaaatgttaagttgggtaagtgtttctagaagccagaggataagtctgagttacacaactgattttgagaattgccagcatatatctaagagagtgagtggctgtcatgaagtggaagcaaaggtcattgaatgagaatagataaaagcacccagagtcaaggtgctagatgacgtatctactcggatgtatatatcctctaaataaccagaatgagagtgaaaagcggttctaggggccagaagctaattttaattatttcttatgtttttttagagactactttctaatccttacgtttgaatgttcacaatgtaggcaggacacaaaaacataatattttagcaattaacctaatgtgctgccaatttaacctttaaattatcctcaaaggtctctaaatgtctaattatttaagaggtattttaaatcacttcatctaaagtacatctcttaaataaacatatcttttgttacataaacaccttaaaaatcaaattagaaatgaagtacagttatgtgctgcataacatatcagtcagcaatggactgcatatatgacagtggtttcgtaagcttataacagagctgaaaaattcttatcatctagtgatgtgatagctgttgtaatgttatagcacagtgcattactcatagcacatacaattatgtatggtacatcatatttgattggtacaaaagtaattgcagtttttgccattaaaagtaatggcattagtacttgataataaatgatcaatggtattaatacttgataatcaatgactatgttactggtttatgtatttgccatactatgctatacttcatgtcattattttagagtgtactctttctacttaaaaaaaatgttaactacagaatggtctcaggtggtattccaaaataaggcattgctgtcgtaggagatgacagcttcatttgtgttattgcccctgaagatcttctagtgggacaagatgtagatgtggaagagagtgttactgatgactcttaccatgtgtaggcctagactaatgtgtgtgtttgtgtcttaatttttagtaaaaaaaagttttaagtacacaaaaaatttaaaaagaaaaaatgtatagaatgataatacaaagaaatatttttgtacagctgtacaatgtgtgctttaagctaagtgttattacaaaagagtcaaaaagttttaaaaagtttctaaagtaaaaaatcttagcttacaatgagaacacgtggacacagggaggggaacatcacacactgggacatgtagcggggtggggggcaaggggagggagaacattaagacaaatagctaatgcatgcggggcttaaaacctagatgaccggttcataggtgcagcagaccatcatggcacatgtatacctatgtaacaaacctgcacattctgcacatgtatcccagaacgtaaagtaaaataaaaataaaaataaaagatgtaaaaaaaaatgttagcttacagtaagctaaggttaactgattattgaagaaagaaaatattttaaaatgcatttaccgtagcctacgtgtgcagggtttataaagtctatagtaatgtgcagtcttgtccttgtcctccatattactcactgctcactcgttgattcacctagagcaacttccagtcctgaaagctccattcattgtaagtgtcctatgcaggtgtactattttttatcttttataccatatttttattgtaccttttccttgtttagttatatttagatacacatacactggccaatgtgttagagttgcttacagtattcagcacagtaacattctgtacaggtttgtggcttaagaacaataggctataccacataccataagtttgtagtaggttgagccatctaggtttctgtaagtatgttctgtgatgtttgcaccatgacaaaatcgcccaaggatgcatttctcagaacgtattcttgttaagtgatgcatgactgtatagagctttgctaagattttcaaagaagtcaacataatttgcagaacttgaacactttttctttgcaacatgtgcatggaatatgaagaagctgtaatatgatttgctgaaagtagctgcaaaatctatattggaatattcaaaaatggttgcttttacatattcgtagagatcagccacagaaacagagcaaacaatattggaattatagtgtattattatagaaggaaaataaaatgtagaaatttcatggctggcatgactggtatttttcaaagtaatgttcagcctgagaataaaccatggtagatttggttttgttggtttcccttggctttgaacattaggggatgtttggaagtcaacatcccagatttttgtttcttcttttgtaaagtggaacctatacaaataacttcatggggttttggtaggaataagtgggataaagtgcacacaaatgctttgtacagtgtaaagtactatagactgcacaaataacaccatcacaacagtaagtgagacatcatagctaaatgtgggacttgatattactcaaaagaaatattcagtgaactgaatttgtgtactgcatttaatttcatttagaattttccaagttgttactaaggcccagaaataaatatcaactcttcatatattgattaaataaatgtgcattacgtttttctttctttttactttgcacactttgctgaatatgaatttttggcacacatgataaacacaaaacgcctaggacctgctctttgtggattacttggaccgaaacacaattatgaaatatgatttttccatttccattcttctatttacacttagttgcttttatttaatcttaaatttcaacttttattttagatacaaggggtccatgtgcaggtttgttacaggggtatatcgcatccagctagtgagtatagtacccactaggcagcttttcagctcacatcccccgctctccctcccccgtctaataatccacagtgtctattactcccatgttcatgtccatgtgtgctcaatatttagctccacttataagtgagaaaatgaggtatttggtttcttgttcgtgagttagtctgcttaggattacggcctccatctccatccatgttgctgcaaaggacatgattattttacttgcttttttaatcttacaatttactttcttttcttcttttctctatttcctgtgatattgcacagctttctcattatctcatcttcggttaagattaagtcattaatcatcattttatacctttttctaaaaataatacaaatttttatttttgtaaaaataatttaatataatcaccattgaaatttacaaaatacattgaagaaaaaagacaaaaatgaaagtcattcaaaatcctaccactgagagacagctgctcttgacttttgggtatacagctacccagtctcttttctatgcattaatatatattttataagttcattaatagtgctatgttctcttttttacttactcttccatgagtatttttaaataatgtgaatgttttcctacaatttgtttagttagtgcatagttattttaaattttaattttatggatgaaacataatttgttagacctgtcgaaaaggctattgtcgattctttgtttttttttgtttgtttttttttttttcctgtataaacagccttgtgataaacatccttcaggctatatatttgcatgaatcatgattaattccttaggatgaattgctggatgcagtcaagcttgcatattaaattacaaaaattataatatctattgccaaattatactccaaaaaggtaataacatttatcactcctacaagcaagataggagagttccaacttctccacactgaagctaatagtagatattatcattttaaaatttttgccaatttgataaataaaattatatcttttattattttaatatgtgtttctttggttaccagttctgttgaaaagtttattttttcatttgtgtttattagtttctgaaatgctccttcatgtattgttgcctacttatctattagagcacatgtcttctataattacttgtaataactttttatatattaaggatattgattataaacataaagatttgatttaaaagaccaataatgagtttaacattttcagaattaacatatgccaagattcatcctaaaaaccaagggaaagtttaacagcttttttacttcaactagatgcaaaagtgattacaaatagatgaataaatttaagtaaagttttatgcttcatttttattaccccattttcattccaatttgaatcaatgttgcattcagtttatcgttgtttagtcccttgtaaattttttggattgtttacatagatatatttttattcactagtccatcagttatattttactttttcccttgaaagtgtgcaaacatttttcattgctttattattttatgactttatttttcctttattaccctgaaagagcaagatggtgggactaagtttttcttgacattttttctaaagagggaggctttactggtatggctaagattaagacaagagccagtctgcagtactatctttgtgaaagactttcctatgttctgataagctgaccaatgctttgtcttaatgttgatgtcattgtatagaatgtgacttctttgagctcagtagcaaaattgtgaatgtaatcttaagggaattcatgagcagatgtgtattcctgtgtatactcctctagactttgacttagacattcttattccctgataaaagactagaaaacccatggagcttcaaagattgtaaactagctaatattcactagtggttagtgaagtatgccacaccaacaatgaagagaactgaaataaaatatcttactttactataatgctttataatctgttcactatctcatgtaacactcacaataatttgggagcgggtaaggaagatattgtaatggaaaaagcatgagctttgaggacatattaatagtcacatgatcttggggaagtcaatctctcaaaaaagtcagtctccttttcagtaaaatagattaaaaaaagaaaataatacttatctttcataactgcgtgattagaaaaaaatgtaatggatatttagcacttaatatttacctcatcatttatttattcaacacacatatttgaacatctaccatgtgttcttttctagacactagaaattatagtccgctcagataaacattttatgctaatgggtaacaggtaataaatgacaaagaaagaaagaaagagaaagacagttggatggatggataatttcagtgagaactaagtgccatgaaaaaaataaaacagggtattgtggtagtgaatgggcagcactgggtaatgctacagaggatagtcaggaaggccttatagagatggctgataatttgagctgagatcttaacaaaagaaagaacagccatgccacaaggaaggggtaaagacctctagaaaaagcaataaatgtaaaggctctggcacagggaccagctttagtgcttgaagaacacaaatgtgtccagtgtggctgcagcatgttgaggcatgaaaagcctggtttaagacaggtaagagaggaggtgtaggccagatgttagattatgtaaggctttgtaagtcatggtaagttgaccatagtaaggtaacagagagctaccatgataataatgaggaagacaataaagatcaagcctattatctgttagacagtttaagaaactgggtctttctttgtctaaatgtgacacagcaaggtagtcatggagtctggtttcctgtccagggtttgttcagttttattttctgtatgttttgttgctgcctataatagtaatgttttttcatcttttaagcccgaagttcattcctgctcttgattttttttgtttctatttctttttaaaggtatttgccagttttctgcatcgacattaatgctgaagaagcatttacaagattcagtagctttatgtagggattagatctctgaaattcaaactgctttattttcataagaactatgattaacaaacacctttatagctttctcattctctaccgaccccattctccaaacctcttttctctaagctggactctcctactccgacattttagccttatcagccaaagaaagcaagtttcaattcacattccaggaaggaatctccccagccagagcttcatctcttaaacttacttttgtctgtttgagccttctgcttgagtgctgatttctttctcccagttatggcttttctccttcactggatactcccctctctatccttggctctggcacctgctatgtctggtgttccgcccattactatttcagattgtacttcagctttcttgcatgacatctggcatacattctgaattttgtccagctcatttactaccttccctctctgtttttccaggtggattttccaaatgtaacgataaaccaagaaagaatttgttcccccacaaggctctctgcctgcatttaaattagcaataatcttaattttaagaagaatagatagatatacaatgtatatatctgcatgttcagcttttatccatttgacaatagctgttaccatggaaaatgcacatgtacactatacaaacactgtaatttcgtttgtagtgataatggaagtttctaaaaatactgattgagtttaagaatctttctttttctaaattactctcataaatataaattttggattttagcatcaatattattaacaggaagagtatagtataatattaagtgttgatgtggggctttcaaccaaattaatttccctaattccagttattgtactgcatatttgtatcataaaaatcttcaggacctatctatcaagaggtcttaataaaatcagagtacatttgaaaagtcctatcacatatcattgaggtgttatgggttgtaatggggaacactcaggcttaaagggagaatagggtgtttagtgatggtgaagtttgttatctctaagtacagatttcatttattttacattttacataagatctgctttgtcaaacttatcctaaatttttatgttattgaatcatgcccttcaaactaactgccatttggtctactaacagttcttgtcatataaagtggtggtaacataaaagaatcccctgtgatgaaaaacatattagccacatttagtttttttagcctgtacacaaggactcatttctttaatctgtaattctctgagtgaaatctcatcaagggctccttgtgtaagtaaacatataccccaccattgcatttaccattccctgacaaagcatttgccacagcctttcaacacatccacagagtaactgcacaaaacctccctatcacaaactgatgttggttatcccttatcaaatcactttttccaacacgttcttttatcaaaacttctaaatatgtttctgagaattcttccatactgataagaaattcagacaatatttgttgaagctcactaaattatgtcttccgtaatactattatgctcaccatattcactatatttcagctatcaatattctcaccactccatatataaattgcagaactaaaattatagcaggtcacctgactttctatttagtttgtgttacttttacatttctgatatttcatttatccttctaaaacaggaatgtattacattttggaaaataaatctttactaaaacccagaaacctaaactaacaattaaatttgtgacagtacagtgtggtatcatagtaattgatatgtaagacttgattaataaagtctatttatttaatcctatagtaactccattttctcattactccatcaacaaatatttactctgtcttctctatgaaagacattatgctaagtgatatgaggtacagagagaagaattagtcttcaagatattggcagtctggctagggtgcagttctcatgcattaattacagaaagtagcacatgggaaatgccagctgagtggtacagctaatgcgtctcatgagatgaaatcatagtcttgtgatgactggggaagtttgcccaggcgagttagaatttaagtgagagagccttacatattattagtatttaattacgatcgaaggagaacagataaaaaaaagtagaagcataagcaaggaatgaaaatggggggcatagagtattttgtagagctgcgttgtccaatatggtagccactagtcacatatggctacagagcacttcaactgtggctagtaagaattgagatgtacaattgtgaagattcagtatgaaaaataatatgaaatatctcattcatattagtcattattatctattaaaatgagaatgttttagctatattgggtaaatataacaatattattaacactaacttcacatatttattgttacattttataatatgactactagaaaatttaaattatatacacggttcatatttgcgacttgcattatatttctattggacagtgtcaagctattgagtaactgttggaaggttgagattattaaatacgtatttttaagaaaaggaatcagactaaaaagtgctgattggttaggaggggctagagattagaaatttaaaaaatgataacctactcaaggcaccacacatgaggtgacaagggctagataaagcaggtggcaatgggaaaaattgggtagcagtgtacacttttttttgtgcctagctacttgcactaaaaaaaattattttaaattgttcctagtgccagagacattacaaaagaagactttcagaataattaacaccagtgactaggcatggagacaggaagagggagggttcaaatatgcctgagactgtaaactgaggaggcaaggagaatgatgatggaatttgatgagaaaacctctttggtgaggagagggttataagtcctggaatgtacggtagtggtggagagctgaggatgattcatctctcagtggaatgaagagtgtaaggaacaggtaggtggctgagtctgatataatggtgggacatccaggagaaaatgtacttaagacttcggtaaaatggatgtggagatcaggggaatggttaaattgatgaaagacatttgatgaccaccttggtagaattgaatgtggaattcaagggtgacagcacgatttcaggtggtgactcaatggcaattctttgatgcagagccaggaactgaaccatgggaaatactgacatttgatggttgaaaatggatgatctacaaagataaattgatcagtcaagaaaatgggaagagaacagtgtgggatcatggagcctaaggaagaaaaaatgccaacgagaaagaactagctaacaggaaatctatgaaaggatgtagatgacattttattatttagcatcaatatactacctgtcaggaatgcaaccctcaaccatgaaatctcagaaacagcagatgttccatgatttgtcttagtgcctttggatcacatgggccacacttgggcttttttttttttttttttttttttttttttttacagatatctttattcttttctcattcactagtaagtatacctatcaaataaactttcttctgaagaagctcagacttattgtttactgtagcatttaatacctgcgtcctcaatcaacacttaccacagacagactgatattatcttttttgtgtacataccaagtctcctaacttgaaagctatgtttttgtactccatctggctgcctctctaggattgcccttactgcttaaaatataccatgcataaaggaaacagagccaatagagaaagatttagggctaaggttagcaggaataattgatctgggctgtcaagagtcacggttctcccaagaatccatatgtcatcattgttttttttatttctccaccagtttttatccattgtttttctgtaggacctttattgttgttagagagtggaatccacctttattaattcaacaaggtgctaagatacttaaaaggttataaaaatgaatccaatatgtatcctgtatactctagattgcaatttatatacatgtttacatgtctattttccatacttaaatctaagatccttgaggaccttagattcattcatatggttcttattcatatgtagtggtggagttctgaggatgattcatctctcagtggaatgaagaatgtaaggaacaggtagatggctgagtctgatataatggtgggacatcaaggagtgaacgtacttaagactttggtaaaatggacgtggaaatagggggaatggttaaattgatgagagagacttgatgaccatcttggtagaattgaatgtggaactcaagggtgacagtaagatttcatgtggtgacttgttgatgggtctttgatgcagagccaggaaataaaccatataaatacttactagtattatattactaatgcctgaaaggtccttggcacctagtagactgtcaaatcacatttgtttaatgaatatagtcatgtgtcacttaatgacagcgatttattctgagaaacgcattgttaggcaattctgttgttgtgtgaacatcatagagtgtgcttatacaaacctagatagcatagcccactacacaactcggctatgcggtatagcctatagctcctaggtcacaacgtgtacagcacgttactgtattgaatactgtagtcaattgtaacagaatatttgtgtatctaaacatatataaccatagagaagggaatgtgttgcactatgacataatggtgactatgacattaggagagagaaaattttcagctctattataatcttaagggaccaccaataaatacgtggtccatcagtgactggaatgttgtatatataaattaatgaaagtgtgaatttcttcttgaaggagactgtagtgaagacaaaattcatgcacaaataatcagagtacaaataggaaagagacacctgacaaaagtactcagataaaaacatattaggagttaggtgaaagaacaaaaaatgcctcataggataaatgggacacggcttcctggacgtgctggcatttgagcaagggcagaaggatggtagaattggacagtcaaaaaatggggcattttactaaatggaagactacctattggtcttatctacagattttgattcttttatatttattaaggataatcacatatttttcatgtctggttaggttttatttgaactcctgtaatcttttttttcattataaaaagctttttttccataaaaaatttcttaaaatatgtagccacacagccgagttttattttaaggacaacagcatttttacctcctgttttgcgtgagggtctgtgggttgtaggagatgagaaaagagagttcccagctgctacagctcaacaaagcccctaaaaatgatgactgcatccatttccacccaacgccacattctgaaagtgatctttttgaaacgaggattgcaaatagctgcagcttctcaaaactgcaattgcttttcatggtgtggcattgctgtcttcatgctgacacagctctcagcactgacaccagcctgcctatgagccgttaaagatatttcacttccaacaataaatataaagagtattatacaaaaacagagaggccttgtttttaataagctgaaatggatgaaatgggcagtcatggagcaaaaataattatgagggaaggaaatggagacaaaaattaatgcctctccctcccttgcccccaaggactgcaggcaatgttctgtacctgtgggtcatgctctgaaaagatgcataaatagaggtgagaaattggtgctagaaaaaaaaaatatgattaaaaggatgtgacattttctgcatattcaatgtgctctgctgggaagaacttgtatagttcagacaaggtttgcatcccggctctggccctcaccagggttttatatttttccttggctaaattgcttaatctttccaagttcaagttcctgcaaatagagcttatattaatgacttcttagggttgcagtgaagatactgagacaatatctataaacctagctggtttgtacaaatatcttggcgtcttcccttccagccggccttcttgtcccttccccatgtgcactagggaaacctctctgtacgggactctcagaccagcagatacacttcatattattgaaatgtgggctacattatctttcactgcaaaaatggtactaatcacccaccatctgtagtgctcatgcatgtacttatcctttcctaatggagatgcgtttgtatgctgggatgggcagctgtactctttccctctgttctcccttgaccttcttttctcatttggctcactgggtatagtccatagacatgacacataatttggcagtaatcatatcagtgttttcccacagtgcatcccttttccaagaatgtgtgacagagttagaaacaccaaactttattgctggagaaggctttggaaaatatatgatccaaagtctcataaagaggaggaaacacaggcctaagaattagctgacttgcccaagacatgaggaaagttaatggctgggttcagactagaatccctatttccgctgctccactcagagctttccaatcattcccacatctcagaaaggggaattcttccagctttatcagaagaacatccaaccgcagtacatacaaatattaaatgcaaggctagccacatgagattctataaaaggattcatcattagatgattctgatggtgaatatcttttggaaaatactagagatagatacttcgaaaattatttttcccttttttgattggctgcaattctgaatgtgcctgtgtttaaaccaacctctctactgctctcccctccccttctctttctctgtctctctctatctctgttcttttattctctcttgggtttagttacttgcccaggtggtctcatttaatgattacactatctcaggcatgaaacaccatgactttttgctgttgggactgcagtatgtaaattgacttgagtcaattgtacctgattttctaaattgcctctggtataacaattctcccacccgtaataacccattgaaatcaaacaataggattgattaaacattcctcactcagggggaaactccattaattttacctgaataaaaactgcagaacagtgcccattttggggtaagtagtatacaaaattctccaggaagcacagtagaaataaacttgaaaggcttaaatattactctttagccacagggaatagaagcaaatggaattttatttacaagtcacatgaaggaaaacaaaggcatacttaagtgagtattgcacagtgcaccagatttggcaggactaacatttactctggcttttcttctgggacagagcagtagaatataggtgaatcctggaacctctagagctctgttaggaatccatatacagcgtatctgtctccaggttgggattttccaatttcatgccacaagtaaccacttgttatgagctctggaatggagtcccagctcttccactcactagctgtttgatggtggacaagttatttaaattgtgagtctgaggttttcaatgcctaacctgggtttaaaatacctgcactatgtgtctcccaaggttgttgtgaacatcaaatgaaactatgcaaaacaactgatttgaagacggttaagtgcattgtaaacatggggaataattcttatttgaggtagtctttttttactgagcttgtacataattctataagataaagagctcagccagtggtgacggccttttcttccaaatctaaattcatatgtagtggctgcagtgtagtcagactgtggagtcagattcacccgtgttcacatcacagctccccatttactagctctgtgtccagaggcgagttatccatctgcccagactcatctataaaatggggatagaaataacacctacctcacagggctgttgtgagactcagcaatgcagtgcatgggacaggaacaccactcaatgaatgctacttattaatagtagaaaataacttcaacatgcaggaatattcatatggtgcctttctctgaaccaatcaagaactttcagtgcctggtgcagtctgaaatcttggtctgagttattcagaattctcatctctttgcaggagggacttctggggacctgtaagagaactaaggtgatattgtggctcatagagtctggattcctagatggtgagcttttggagtgtgggattggattttttgcatctcactaaatatttgtattcatagtgtctagcatagagtctggcacatggtgtgtggtcctctgctcagtgaacacttttgcatgaatgaaaaaagaaatctttgcctagtgtaaggatgtaaaggaatgaaaaacaggaggcttaattcctcctgcttaaaataagagctattttcctttcctccctttttgtcagaacgtgtactgtagaaaacctgtatataaagtaccttctctgtctttttgaaatgtatctttctagacagtaaataagccttctgtcagctttattattgaggaatgtctttctcaaagacctgagagtcatctctttgaaatgtaaatatcaaaggggaaggtgcccccatcctacaattttccatgggaaggcaggagcctaacatcagcttgcgccatgctccaagttataaacctccctcccgtcatagggtgttccccccaccccaaccccacccgcttcctctctcctctggatacacccagttagctaacatagatggtcacctcaattaccaggtaaagttaagatagactttatgcccaatggtgctgtcaagtcctcttacttgaggactagttattgttcatcttgaaaatatgtgtgtaattgggtatatttgcttggctatataaaagggtgtgattttttttttctttctgtgcactttcttagtggagtggctgtaatgcacatgacagtctggtttaatgcttattcaacaataaaggtgtttctttctctactgcatttgtggagagaatttctgggttgggagaaacatattgaaacatatagaaagatatttgaagactaatgctagtagctgaagtgttaatgtttttaaatactaatgtgcttaatcattcttacctatttatttgtgtacctataagcattcaactaatgtgcctacctcttttgaaacttcactaggttatttttcaagtgtgtaagatttaagactttcaactgactgactcactaataaagattattctccttttgccatccaaggaaagtcttgcttcaataatcataaattcttattggcctctggataggattgccctcctcatttgcaaattttcagaaaattaaaaaaaaaaaaaaacttggcaggttgtatggaaactagggatttccagaacatttcctaaacaaaagagtaaataattagtgctcttctaagtagaggaagaatttaagacagcttacataaataaaataaaataagcaagtgaagacactgagacaaaaaggaagtgattgttaaaaatatagggtcttaattgtcatagccaacagcaacttaaggatacatgatattaaatataatgtaaatcctagatgggattctggaatagcaaaagggcattaagtaaaaattaagaaaatctgaatagaatatggactttagttaatcataatgtgtcaatagtagtttattaattgtattgtaataaaatgtaccattttaatgttagatgttaatagaggaaactgagtatgagttataaaggaactctatggcggagagggagaatagcttagacaaagatgctaggtgaaaattctaaaatgtattgtttatctttacatccataatattaagattatatttaatagtttccttcctcctctcctgtttgtccccatttcttacctctctcccctgatacatatatatcccaccctgttaatgagatctcagcatgcctcttggttgagcctgctcaagttttgacaggaacaaagcaacagaacacatccaacatcaacaactttgttcattctgtattttctcatagttcaatgaactgggatgcttccaactctccttaaaaatgaaagttaaattggtttgaacacaaatgcacaaaaacgtatgcttccacagtgcaatctacaaggttgggtactgggttaaaaataaaatttcatctacacaatggtatgtccatttaagaaacccgttaataacaggaagtaactcactccgtgcctggaatctggaattaaatctaggccaaactacagagcctaacaatgtgtatctcaggctaaaacaaatccagaatgtgggagttggaaaggattttagagataatttagtccaaatcctccattttatggtagggaaactgaagctcagggaggttccctgatttgtcaaaagtttcgcaaaatgtatgtttatatgtcactttaatcctataaagagtctgaggaaggactaaaatagaatgaacaaaggatatagagacaatagtttgtgttagcaaacctcaccttaatgtttcaaccattaagatgaccttctccagggtgaacttttcagcagtactaagctttataaatataatggatggcaaagatagtttgctctaggacagagcacgattacatggtaaaacttccgtgctgtgctctaaaaattactctctcaaccgctaattgaactctgaggattctttaccaggagagatcagttttattccataactaagggcttaaggtaaaagtacccttggaatgattctctttgtctttcccttctttacaagatttatcagatggtacagaaaggtgtccagcaaaaatggccacagggaaatccacagatcatcataggattaagcatttaagtaagctaggaagagtggaaaaagtaggcttttcaccagggccagattgttggagggtcttatttcagggcacctggaagcacagtgaaagccactgattttcactgtgctgactacgtgagcagggacttgggaagcaggaatgtgtggtttagcatctggtttgagccatgcaactctgggaaaactaattaacttttttgaaatttagttcatcatctataaaatgagaataacttcacagagttgggtagaagagtgaaattaataaaataaataaaatattgaaaacctacagcaaatgctaactacagatttgttcctttcccctttctacattcctactctctcttccatgtctggattcaaaatcctctaggatgtatatatatttccaaatagtcacacaatgtaagctgaataagaaatcaaaaaaaagattgtgggtgagcaggtggggagaaactgagaaggcaatgtatgtttgatagcacgttaaggagcatgagcccagatgggcagctgggacctaccacaggacagtttggtctaggctggctggtccatcgcctttccttcgtctcagatgtattcattttactttcttcagcaaaattccccccacttcgctgtacttctaaacacccccacatagaaataacagaggctgataatactgaacatgtacacgaacatgtatacaaacatgtacacaaactgagcatgtacacaaacacaattcttcactttaagtggggggctaatttaatatatgttcaatgtttgtgataacggtttttttttttttttttttgagatggagtttcgctcttgttgcccaggctggaaatcagtggtgtgatcttggctcactgaaacctccgcctctgggttcaagtgcttctcctgactcaacctcccaagtagctgggattacagatgcctaccaccacgcccagctaatttttttgtatttttagtagagatgggatttcaccatgttggccaggctggtcttgaactcctgacctcaagtgatcagtccgcctcggactcccacagtgttggcattacaggcgtgagccaccccgcccagcagataactatttttttttaatttaaaaatttttccctcccaggaaggttttttgttgtttgatatactgagtaccacttacttttgtaaaagcttttgctgtattttcatgagtattacttgtaaatagcatagggtggtggtgagcacccctatctcccacaaaatattaaagtagaaaataaaacaaggttgtgttttcagagttaagctatgaaacaaaaaaagaatttaagcatagctgtatacatttcatacaacaagctatacacatggatagctatacaaagctataccttaaacaggaagaatgacctccaggctaaggccaaacctggaatataattgaagttatttgtatttatgaagagaacttgtcaatcagaaggactgttagctagcaatggaaatatgagatgctgagaaacaaacattggtagcggaggaattcctaccccatttaagggatgggttcactagctttagaacccaggtatgaaatccatctgcagatctaattctgcagctaattagatctgcagtgaaggtaggtgtactccacatacttatctcgatgactctaatcatcgaacacagaggcctacaaactaaggccagtgggaccaaatccagcccaccatcctgcttttgtaaataaggttttttgtggaacacaaccattgccatttgtttacatgctgtctacacctttctgctacaagagttgatcagacacagttgtaatagaaactgcctggtctataaagccaaaaatatttactatctgtccctttacagaagtagttattgacccctgataattcagccaacttgccttgatttcatgctcacccaacaatattttgactcaatgttgtttgtttattcctgagaatattttgtactgggaaagtaagagcttgcagaacagtaataagccaatatattgaaagttgtatctttttaagtgatggtagaccttctgtgtagactaacaattacaatatctgagctcaaagctggtgggctgacctgttgactgtggtgcctacccccaatgtattgtcacctgggcctgtttggaggtcagcctattttctctgtgtaatgttggaacttcctgtgcatttttttttttctggcagcatttaaaaaattcctactttacagatgaggaagctacaattcagagaaaggaaaaataaaactaatatttattgaggatctactctgtgctaggctcacagatgttccttaagtaatgccatttaatctttacaagcccatgcaaggggaaagggctatgaaactcaagtttatgctttcactgatgtggaattggaggcttggaaaaggtaagaccacagtaatttgttagcaaaatcaggatttgaaagcaggtgctcagattcagatacttttacactatggtattttcacatgacatatactgcctggcagagtcttctggtgatgggcttaagaaagcaacaccatatgccttggtcttttcctcccaccaaggtgtactgttgttctttagtaaacatgaattaagttagaaaatcctagagattttaaaggtgtagaattttaaaacaaattctgcacatttatattggagtgtagaatcttagccaactaatttacatattcaaccgcactcttgcatagagaaattggtgccaccacagcctgtgttcataaataacagttcccgaagaattttttttttcataactggttttgtacttgaagtgatttaaatgttgtactttgaaatcattgtagcaagaacatattttagaatttctaaaagctgaacagaatggaaggttatctataacatgagcataatcacagtcataatatctgtttaaaataaaatgctgaagagaattaaatattcccttcaagccaaactcaaatttcaacacaaaatagattgtagacttgcagctaatgttgcttgctggggcccattctttaggagtttagagcctttgaaaagcttttgtttattattttttcagtgctaaagaagaaattccccagcttttagaaacagaactggtcctaccttctcacacaatgacttgtgcactgccctgagcttgatttgtaagtgttctacctgagtgcacttcttgtcttaactacactgaaaactttcagatgacaaattgtaggttgatggcactgaatttactgctatgtaaatgctatgactgtttcataaaaatatttgctgatgtattatattgttataagatagaactttaacaaaaattataaatgggggaatatatatgaaaatattaaaaaaatataactctcattcataaagacttccctttttctttaacttttattttaagctcaggggtacaggtgcgggtttgttatgcaggtaaacttgtgtcatgggggtttactgtacagattattttgtcactcaggtattaagcctagtacccattagttatttttcctgatcctctgcctctttccaccctccacgctctgataggctccagtgtgtgttgttcccctctatgtgtccatgtgttctcaccatttagctcctacttataagtaggaacatgcggtatttgattttctgttcctgggttagtttgctaaggataatggcctctagctccaaccatgttgcttcaaaggatatgatctcattctttttgatggctgcatagtaagaattccttttcttagtttcacccttcattttctttaataaggaaacagaactataccctgaggaggcgtgaactcaaatgagtaaatacattcacaattaggaattatttggaaaattctactcacagaaagttagcactggaaggcatctctaaaaccacctaactcaacccatgatccaaatggagtacataaatcttagaaacgtccagtgacatgctcgagctggaaggaacaactaggactcctaaatcccagctaatctcctactcaactgtactggctatctaggaaaaataaaagtttacatttcccttagaattatttgaacaagaagtctctaaaacacaagaagttaatttaggtctcctttgtcttggcagaaaacggacaatatatttcttagaagggtgatgatgtgacataaatccaattcattctggcttgagcatgaaaaggagtttattggttcctttaactgaactatgcatggtctggctattgtgactagacctagaaactgaaatgccattaggttctctctttccacaactctcttctttatgtattcttatacactggttttattctctctgaccggttgtctctgtgagtctgcaaccagagctttaggtaactctaggtgtcattcttactacctcatacctaaagaagaaagaaaatgcttccctaccagttttactgaagaaaatcctgaggggaaatgtggatgggttccggcaagatcaaataaacatctctaggtcaaccactatggctgcaagattgggactaggacaattccaactgggatcacgtgccaggaggcaggagaacagttagactggcaggtcaccttggagtcacatttgaagtatgagagatgcaggtctccccgaaaattggggttgtcaccagagaaaggagaaaagatgtgccaggcagggaaaacagcaggtgccagatgagaaattagagtcacttaagacttgttttgccctgagagaaaatactagccacttagcattttttcttttttttcttttctttttttttttttttggtctattcaacatctgagcctccttaggaggcttttagggaatcatgtatcttatgacctctggtggcagacataatccattttctactgaccatattctaaagaagttgaaaatgccagatacttggtttcccagcctcctttgtaagtagggcacaggaacatgacctagactcagctgatttcctggactttgagtcagggattattgataccaatattcagttcataggcaatggtagctgcagtatctggtctggggtggcaacagcagcagtagtgtaagttgggtatccgacactcatgggcagcaacagcagtgttctaacaggactggacttgtagtttgaagctgaaggcaatcttatctgttaccaaacttcatttgctcctgcacattttaaaacttggttctttatagttctcttggtgataccatgaactcccaataaatttacaacaaattagttctctgcttaatcaatctagagtgagttagtgtctgtggctcacaacaaagatacataaattttacatacttctgtatcctagcagaggaaagctctggcatcattctgtgttgttggaaaacttaattagtacatctcctctttaagaagttttgattaacatcttgtcttatattaactgtaggtcatttttaatacctgatgctacatcaacccacattaaagaattttaagagcacctttgttagtctataccacctacctgtagataggtgtcaccattattaaacaatacagggttcaatatttgtctagtatttcattatcaggatgacctcgaggtcaccataaccttttctgttttgtccttcagttctgctaagggaaagacgccaataaatagttcactttcaactaaaccatcatggagaaggtgccactctatctttaaaagaaaaatggtctgactttgaatgccttagaaaatgaaaggaaaatgagtaagtagaaaaactaggctgggcacagtggctcacacctgtaatcccagcactttgtgaggccaaggcaggcggatcacgtgaggccagatgtttgacaccagccttgccaagatgatgaaaccctgactctactaagaattcaaaaattagctggaggtggtggtttgtgcctgtagtcccagctacccaggaggctgaagcaggagaatcgcttgaacttgggaggcggaggttgcaaccagctgagatcgcaccactgtactccagcctgggtgacagagtgagaccctgtctcaaaaataaaataaaataaaataaaataaaataaaataaaataaaataaaataaaatgaaagtaaaataaaatagaaaaactaaaacttcagtgatagacttttaatgccaagtcagcattcaatttaaataagagctaatgttactcttaggaagtctgatgtattagtgttataactgtgtaccttaaacttccacaaagacaattaagttggaaaaagttatttttatatgacaacatgaacttccattctgtttttacagattcagatggaaaataaaatttagacttgcattgctaaggaatggcagaaaagtgttaaggctaaatatcatctgaaaacactcaacatgtcaccaaaggttttatgaatttatcttctctgagctttgtttgtttcaaaaaagaacacatatacacatatttgctatggatagatgtgattgaccactgtgagtggcccatgttaatctgctacaaatatttaaacatgctgcttgggcaggtcctactgaggacacttttgcagcaaactcagtaatatgagattcctcactgcctcctagcaatacatgaaccatagatgtgttggttgcttgctcattttgtgaacactaactagtttaggcatttctgtttcttccatggcaggggcaagtgtaaaaagagtggctgtctaactaaataacaatgacactgttaaataaaagctgcactttagagaaagcacatcctaacttggaatttatcaggacctatcaagtcaatacaaactgactatgctgggaacttgagtcattttctgcttaaggagaatatgcagtaattaccctttaaacattttctcccaacttcttcccttttaccttttttccatttatttttctggaaattaattaccatttagaaggaatgacaggtatttttgagccttgagagaaccaatgaaatagttaccttgaatatactgtcataatggtgtgtctagaagcacaacccaagacagcactagtcaggccatttgctgagaagcacttaggacaataattttgcttataaaacagaatcaagataatcaacagaaacaagaaacaaatgaatcaaattaaggttcttgatgacagaaactcagctaaaccattcaaaaatatgatgttaaagaaacatgattgtcatttccaaccaactaactagacgtgttctgttatggttcaaattaggagcatgaaatacactttacaacctaggggattttagagcacttagatgaattacaagtgacatatgggagctcattaaaggaaggtgacgttatgaatgcccagagagcttgctggaaatcagagcttttttcaaaaaggcttcaagggtcagtcatgttgattagaggatgctcttcattcttatggatgaaccatttctctttagcacttctcagttatcacagtgcttgagtgttggccattactgaaagtttctaagtcgtgagcatgtgggagggtgggggtaaggtgggtgaagggtcgggggttgtggtttgattttgacaggcaaacaataaaagctattgaagagtaagacctcagtgcagcctgtttctgctatttcacccaaacttcaaggtaacagttgaagttgcaggagcaagaacagcccatggttgcttctatgttatgaaggctgtgtctgtaagctgagctttgaatgacacattatttcctctgtgcaccccaatctattttctgcctgactaagcttataaaactctgcataaattctcctctcagactgttccataatcctgtgaacacattgtcttcctgttcattccttcagccagcaagcaccagctgttgggtcctggaaacattttatgttaaggaggaaaaaaaagtagatgatcagaaagctgtaaaaactgcaaaatgcttgagatatgcagactttttagggttgtgaatatttgacctgcataaaagaaatgattaggcttccatcaatcattcctctgctgaacactctgctgagatcggtttatccagatgcttctcagctgcctcggttctgcacagtttgtaaactaatccagttttgtttgttatgtgctagagaaaggataaactccaagctgaaaaatatggacaaagatataattatcttaacataacactcatgctttatttttatgtaaaatgtcagaaactttattatctatatctttcagcttccaaaagaaggtggaagtcacttgataatgtctttctaattgcttgaatgcacacttcatgcctcaactccacaggaaagctagttgttataattagaagttttataaagacatagtttatacaaattacagataattacttaactaaaactccagtctcttgccatcttagaagatatccagcaacatgtgatttaaacaataggttaaagtggaagatgtggtgattatattgggaaggatgctcaattgtttttataaaattttctttaaaaattggtagctgttatcgtgaactgaataagttctgtttccatttggagacttaattcaggatatatctggaaagacaaagcatatctacactccaaatagtttaaaaagaagagcatttatgcacattttgttactaacgtcttcctattccttttattgataatttttagggaggaatgaaaaccagtcaaataggtgatattactctatgataggggtcatataacttttttattaaaggaatagatagtaaatattttaggctttgcaagacatgaaatctcttctgtaatcatgcaggcaattttgttattgtatttgggaaagcaaccataggcaatacataaagcatgagcgttgatatgtatcagtatatctgtttacaacatacccttagctagtatcatactgaatgggaaaaactgaaagcctttcttctaagatctgtaacatgacaaggatgctcaattttaccactgttactcaacatagcactggaagtcttagctagagcaatcagacaagagaaagaaataaaaggcatccaaattggaatggaaaaagtcaaataatccttgcttgcagatggtatgatcttatatttggaaaaacctacagattccacaaaaagctattaaaactgataaattcagtaaagttgcagaatataaaattaacattaaaaatcggtagcatttctttatgccaacagtgtacaatctgaaaaagaaataaaaaaatactgtttataatagccacaaataaaattaaatacctaggaattaaccaaacaagtgaaaaatctctataatgaaaactataaaacactgatgaaagaaattgaagaagacaccaaacaatgaaaaaatattccatgtttatggattggaagaatcaatactcttaaaatgcgcatactacccaaagcaatctatagattcaatgcaatctctatcaaaataccaatgacattttttatataaatagaaaaataatcctaaaatttctttggaaccacaaaggaaccagaatagtcaaagctatcctaagcaaaaagaataaaactgacagaatcatattatctgatttcagactatactacagagctatagtaaccatcatagtactggcataaaaacagacacatagaccaatgcaacagaatagagaatccagaaacaaatctgaaaacctacagtgaactcatttttgacaaagatgccaagaacatatactggggaaaagacagtctcttcaataaatggtgctgggaaaactggatatccatatgcagaagaattaatctagacccatatctccaatcatatatgaaaatcatgacttaaatctaagacctcacactataaaactactaaaagaaaacattggagaagctctgcaggacattggtctgggcaaaaattttttgaggaatacccacaaaccaagcaaacaaagcagaaatggacaaattggatcacctcaggttaaaaaccattctcaaagcaaaggaaacaatcaaaaaagtgaaaagaaacctcacagaatgggagaaaatatttgcccaatcaaaaatgggcaaaatatttgaatagacatttctcaaaaaatgcatacacatggcaaacaggcataagaaaaggtgcttgacatcactgatcatcagagaaatgcaaattaaaactacaatgtgatatcttctcagccctagttagaagggctgatatccaaaagacaggcaataacaaatactggtgaggatgtgaataaaatggaacccgtgtacacttttggtggaactgtaaattagtacaatcattacagagagcagtttggaggttcctcaaaaaactaaaaatagagctaacacatgatccagcaatcctgctgctggggtatatacccaaaagaaaggaaatcagtgtattgaagagatatctgcactcctatttttattgtagcaccatttacaacagctaagatttaaaagcaacctaagtgtccatcaccagatggatggataaataaaatgtaagacatacacacaatggagtactattcagccataaaaacaaatgagatcttgtgatttgtgaaaacgtggatggaactggagattattatgatacatgaaataagccagacacagaaagactaacatcgtatgttctcacttatttgtgggacctaaacatcaaaacagttgaaatcatgaacatagagagtagaagaatggttaccgggggctaggaaaggtagtgggcagtggcagtggggcaggtggggaggtagggatggtctattttaaacagagtagaaagaatgaataagacctgctatttgatagcacaacagggtgactataatcaataataactgtaaatttaaaaataacttaaggagtgtaatagaattgtttgtaacacaaaggataaatgcttgagggtatagataccccattttccatgatgtgattattacacattgcatgtctgtatcaaaacatctcatgtaccccataaatatatgcatctactatgtacccagaaaattaaaagttaacaaaattttaaagtcacctatacaaaaataaaaataaatatgtttacaaaaatacatggcccacaggccagcacttgccatcccttgctatataccaagcatccaatgatctggaaagcaacactagtcattatcactgtcttcaagacattttaagttttttgcttccttgtaaaacctaaggtctagcagaccttctcaaggaacattctactgaagagttaagccttaaggcattcagtggaaggaatagggaattttcatcctgtgcctctagaatggaagaactgagaaaaatgttatcaagtcatttctgtaaggcttaattttctcatggaaccctagttggaaaatccaagaataggtgctttataaaaactgaattgcaaaaagtgcagttttggtgtagtttgtagtggctcaagttaaccaacctctttatttgaagacaggacaaaataaatataaatatttgtctttcacttctggttcacagatttgccatttcgctagatttaacagagatagtaaatgtagaaaacatgactatagagttgagcttatgggatgtggaggttgctaaggggaatagcatattttcaaaaagtcatttttttttagcaaaacgttccgatgtttatttgtaggtagttatgactatgaggagtgggcatttgaatagcagtgtagaggttgtggggttttaggtctatacctcaggaacttacatgcaggccctataccacagtagtaggagaacatctaataatactgagtggctgcattcatatttcagagcactctgtaatgatttgagtcctgccctggatgaatttaaaacaaccatcttattgttagaaatcatgactaccaatcattaacattacctccatttcaataaaatgaaaaagaccccaactttgagattagaaacaagtttgtaaagccacagtgacattaatggttcctgagtcacttcccattttgatctatgaggtagcaaggtgtggtgtgagtctttgcaatgggaaggtagtcacactgaactgggagcagaagacatggtttcctgccctagctccattacttatcatctatgtgtgcttgtgcaatttattgcccatgcaatttattgccgcacgaaacctctgttttcttatctccaaaggctataaaaatattgtcctgccacaggacagaggcataaatgacaaaatacattagaatactttttccctttaacattattttattgaattaaagcattgttcaatgtactgataaaactagtcgataaaactagtcatgacactgaaaagtatgcaatgcaatgaaggaagatgaaggcagtaaagttcagaaatgttacaccataaggcatggagaaaacgatagggcatggatttgaaccatggacgtttccctttccccattatattacatggtctctcaacaatcaaagacaatgtgttccctgtccctacatgccaagtataaaaacctcacccttttaaaatgcagtagtctccacttatctgaggtttcacttactgtggcttgtgttagctgaagtcacctgcagtttgaacatattaaatgaaaaaatctagcaataaaaattgtatacattttaaattgcatcactctgagtagagtgatgaaatctcagacagtcttgctccttcctacctgtgacatgatgcatccatgctatacatgctacctacctcttagtagctgtctaggttattacgttcactgttgcactattataacgcttgtgttcaagcactcattttatctttattaaagttcgttgttataattgttctattttattatcatttattattgttaatctcttactgtgcctaatatataaggtaagcttaatcctaggtatatatgtataggaaaaaacacaatagatatagggtttggtactatccacagtgtcaggcatccactggggtcttggaaagtatcccccatgaataactactgtactaaaacaaaaattagatcaattacgtatagttaatttgtgagcattactttttaattttttccaacaaagataatgtagccttctgcttcctaagtagggaatttttctaggctattatatagtcttccagctatcagtcattctctgtacatattctatatttaacaatataagtgagcaataaataaaattatagattttaaaaaatcatgtacaccacaaatatttacaattacatctgtcaattaaaaaatctaaaaaaattataaaatattatgaatatgcagcttaccagttttgtttgtttttaaacctgaaggtggttatttaaagtaggcccattttattaaatgtgatactttcaaattggccaacatgcattgcctgaaatgtttcattatgcagtacaacctatttattcaggtgaaagtatacagaatattgcatatctctacatgcattgatctaaatgcaaatgtagttaaatgtgaaatccaaccttggtgtcatttagtgttacattcagctatgaaaatttaggagcattctttcttcattttttaacatagaaatccagaaatcaacagcaatttcaggaaaaacttgcaaaaatgaggtagaacattttaaattcatatgcctaagccatttagaaagcatttttgcaggtataaaataagttaatgttaggttgtgacatggtcattaaaaaagaaggtttgatagcttctgtagaccatgttcacacagaatttaaaggtaagagaaaggcaaaggctttaggtttttatttcacccagttgtaggactgactaaggtgcttataccaaattcatttaaatcaaattgttcagggaaaatttctaatcctgcctggtcaaaattctatattcctagtctcattgctctattgctacaaaacaacatcataatgaatctaaaataaatgcagcaaatttgaaatctgggcatgggatttaaggcaactgttttacttatcttcatccatctggattgctataacaaaaataccatagactggatggcttaaacaacaaacatttatttctcatagttctggaggctgggatgtttaagatcaaggagccacacagactcagtgtggtgtggtgttgttacagccgccttcctggttcacagatggcaccttctcgctgtgctcccacatggcagaaggggcaagggagctcactagggtctattttattaggatacaatccattcatgagggttctgcccttattatctaatcacttcccaaaggcccccacctcctaatatcaacatcttgggtgttggaatttcaatatatgaatttggggaacataaagatttattcataacatcattgtatgaataagaatattggaatccagtaaggctaaatgacttatctgtgaccctaatagtagattgaatacaagatcagaacccattcctttgtgtcccatacatccttcctttaacattagttccttgaggtaaagtgttgttcaatgtatgagtaaaactatagggtcataacactgaaaggtatgttagtgcaatgaaggaaaatgaagaaggcagtgaagttcagaaatggtaagtcatacagttaagagaaaattataaggcctggacttgaaccatggactttccctctcccattctgttacatagcgtctcaacaatcaaaggcaattgttgatgttccaattcactggattatactgtccacataagtacaaagctgtaaagaagtcactgattcccaatggataactttacagtttgtaagctgcattaggaattttatgtcacttgaggcacttgtttttttcatggcaatacaaaataaaatcttctaggcagaataaagtagcattgaaagtgaatgggggcatcctagccaactgaatgtgcctgtcatctttccactaactatctacagcaaataattttacgtactgaaacattctggctaacttactcatgtgatgagctaaatgtcctctgaagtagttttagatggtgaatgacaatttccaattggaaaaatatagtatcagaattttttcctatagaacaataagctttatatcttagatataggggtataacctaagcatattcatttttgcttcctgaaaaatagtaacatgtattaggttgaatgtttgcaaaatgtttgaatatcagcagtttcataatgtttaacataatagtataacatagtggtttacattatgggatctgttcacagagggctcagagtccaagtttagttctaccacttaggaatatcacatgatattaatagggctattaagaaataatcattaaaaattttgaatccttttgttagtcatatgagtgctgaaaaatgctagttgttatgatggccaatgatgatgatgatgatgatgatgatattattgatgatgtctgctctatacaaataacccatcacggttgagtcaatgggtttgaagagctgatgtattttgaatttcctgaatacaatgactgtagaaaaaagaagatacttatacaaaattagcttaggaaggatcctaccatagagccttcagagagcacagcctggtggacaccttgatttttgacttcttgactccagaactgtgagatattaaattattaaatttctgttgctttaagtgaccaagtctgtggtactttttacaatagctctaggaaattagtatatatttaaataaatgttgtcaaataaaaatattagcctgggttgtagtgtgagtgaaaattggatgttattgaaaatgttgattagcaggctaggttttttggcagattaggtttagaaagtaattctaatgcacttatggtacaatcttttgttatggattgaagccaaaatctaaatggataactagacaattttcaaaaagaacatgagataagaaaatatcttttgttaattttcctattaaaagattccccctaaattaaggaccaatttggtaatatgagtgagaaaggagacaattttttccctttaagattaaagtcaaacaacaataacaatgataacaattaaagtcccatatcatgtattgagctcctggtccatgcaccaaatgtctcagacattgtgtgaagcatttgcctgcatcattgcatgtaatcctcacaacaatcctataaggcaagttctgttaccatctcaaccatctcaattttacatagtgcaaaattgggactcagaatagttaaatcacattctcatcaccacgaagttctcattgtcacgaataaatgaggaattcaatatattgagacacttgcgtcttgttcatgttttaagagtttagccaaaatttgtttcaaaacatctgagacttctctggaaagcttaaaattttttggtattattcagtgagtgcttcttcctgaataaatgaaacattgaaatagtagatataaaattatcatgacgtttaccagtaatatttatgatgattcctacatctagaccttcatgacttgctaaggtcaagcctctttggaaatacatggaaacagtctgtgctatggccaggaccacacaaggccaagggtgtgagggtcaattctgagattctcttatgccctgttactcaaaaatctccatgaaatgtgctccaaacctgttttgagcttggaactattcactattatatttttgctcacttaaacaaacattcattgatcatatactggtgtgtttgccattgttgtgtgatttggtaactcgaaggcaaacaagaatagatatcaacccttgatgagatcacagtcctgtaggtcaagtaggagagaaaacaaatgatttcaaaatactgttttatattctctgctagtgttgtgcaagggaacacaaagaagaagactggcaaaaatgtcctgagagagctaatccccaacctgagtcttgatatatgatcgggatgtctatataacatgatattcaaccccatctaccagtcacaaaaatctgaaaattaaggagttacatatttgcaaggactgaaacttgtcatacattgctggtgacagtagatattggtgcagctatatggaagagtaatttggcaatatccagtaaaactgctaatacaaataagtgacaatattttctagatgtaaacctagacaaaccctcatatgatatacaagaaaacatgtataaaggtattcattgcagcattgcttataagagccaccatcagaaaaaaacatgatgattatagttaacaatattttatgttcttgaaaaatactgagagtggatataaagtgtgctcaccacaaaaatgataaccatgtgaggtaatgaatatgttaattagttagatttagtcatttcacaatgcacatatacttcaaaaactatgttgaacatggtcagtacatacatctttgccagttaaaaatatatacgtaatgccagtctcatccaaaagtgccctcgtgaaaataccaagaataatgtttgactaaatatcccagcactatggcccagccaacttggcacataaaattagctatcacaagagtagacacaggagactagttaataaaaatggttgcaataattcaggctccaattcagggcctcaaaacgtagtaaaagttgagtatatatttgttaatttgagttgattcaacagtgactttaaaatgtgagaaatttgtgcatatgtacacataaatattttatatatattttatgtattttagatgtattttataactaacaatatataaatgcaacatactatctattaatatattttatatttaactagattaaatatttaatatatttaatgtatttatgtattatataaaatacatatgcattatatatgttatatatgtgctatgaacactagtctggtattctcaatgagttctcatcagctcattccaaagatattctgcacatggtttattctgctggacttctctatgtcatttgttttatgttctggtgaacagttttggttcataatgtctggcagaatatactagagtagttctggacttgccacaaaaaagactaattttgatagtaccaagtgaacattattgttgttttctagactattagttgttttctagacttctagacctcagtatttagaacaatctacgaagaagacaaaatcatctgttgagtctaccactgcattgactacaggagagctaactttacaaggaataatgcgtatgtgagaaaagatgaacatctattaatacatttatggatgatcagaaacatcaggtgcttaatcaggagaagtacataaaacatcttaacctgcatcctcaaatgaagcaaagaagccataaaaaacattttgagatagttatgcttgacctagatgatcagccctgcagtaacccgcatagcacagacctgatcagtgtgaagtaagtgctgaccacctaacctgcagttttgaattcctcatctgatcaagggaatgattagcatggtcattctcgaagtttattctccagtttcttcttaatgtggattaaattgacgttgatggtaaatttgtgccaatgagcattttaatctcataagaaaagagtggtttaagacttcctaggaccatttcactttcttactgggcagtaatggttttttgggattttaggctgaataaggttgtgcttataagccattcaacgacactaatcttctctaccaccaagtcttccatgtttggcgtaggcctgtacactttgctgcatttctttcttcactattatttggcacggaaaatatatttattaaatcatatttatatcagattatttttaagtgaacacatttctggtatgcatattagggatagaaaaaagaatccatcaggatgatgcttacattgagactgcaataatatttttcagaaagttctctgtgcaccaactctaccaattaggaacttgatgatcttgctagatcatttatgcttttgcagtctcatcttaatttttttctctttcctcaggggggatctgttatagggtggttgtgatgattaaatgcccatgagaagctcttcataaaccttaaatagctatacaaacatattaaatagttggcattatagataataatctgattgcaggaaacagaagatcaccttctctaatatataaagattatttttcactcagtaaatcaatgaacaagttaaaatacattcaaaagattactctgccacacaattaaaagcagtctattctttctagggactgtcagtcttggcaatgatatattttttttctaagaatcgaagtatatttgagctgaaaggggccttggagaatatccaattcaatgccctcaagccccacccatctccattttatcataatgtaaaatgtattatgaacataaattaaaactttttgggtggtttaaatggattttactttgaaaactatatgttaaaatggatttagattccactatgacaaaaatgaagcctgaaattttagatttaagaataagaatcacatttcctaaggattttttgttaaatgatgaatgaaaaaggattcagagagaaagttgatgggtagatctgacatgttaccgtaataatttctcgtaaagtacatccacataaataagatatatggccattatcaagtaatatgagaaaggtgtgagggtgagtaaagctgctgagaatgtagaaaacatcaatgagattcccaattcttggttatctatgagctttttgtgcataatttagatctttaattccaacattttcctactgccactaagcatgcttctgagtagctgttatcagtcaaggtatgtgcaaagaatggaaaataattataatattagcacaagacataattagaagtataaatattatataaaaataatcataggctacaatcattaagaagaaataaacagcttttactattcacaccttcttttgttataggatttcctgatatttataacgatttcaatactctattgtttagaaaggcaattctaaaatgagattataggaaaaaataattcacaggactccttaaacacttatttacttgaccatgtttggaaagagaagtcttccaaataaataagtatttaaatattgaagacagaatataaagagggaattagggcttgtacttacgactaggttttttagcaacacagcctatgatggagtcacaatttcacctatcaaccgagagaagtaagttggaataaagcagtgtcttatgcaatgtcacaacccatgaagcataaaaggagcagtgataatctgttttgcttctgatttgtgtgaatttggattggactggactggctaaatcccctgaagagctggcttagaagataaattctatgtataatagcaatattggtgagagaaatattatgagggttttttttttttttttttttttttttgagacggagtctcgctgtcgcccaggctggagtgcagaggcgcgatctcggctcactgcagcctccgccccctggggttcacgccattctcctgcctcagcctcccgagtagctgggactacaggctcccgccacctcgcccggctaattttttgtatttttagtagagacggggtttcaccgtgttagccaggatggtctcgatctcctgacctcgtgatccgcccgcctcggcctcccaaagtgctgggactacaggcgtgagccaccgcgcccggccgagggtttttttttaagcaaaggaaaagaaaatcttaaagttagagaggttgtgaaaaaacatgtcataaagtaacgtatgacggcaaggttagctttgggaaaataaggtaatgtaattcctctgaagatggagcaaaggaacagataatgaggactgattataatacatttatagtggaatttaggtgagtgcccaaaacatctcagctgaagaagaggagatttgaaggaatttaagctggagaactttaatctgcccagtagaacagggtaggtcttatacttagggagaagagaaggagaaagacttggtggctcaagaactgaaagtttggaacagaggcagtgagtcataccacatgaaaaaaatataaggagagaacagaaagcatgctgggcagcactgaggacccagatgaagtcagaaatcatagtagagtcaatacattttccgttaggactattcaagaggaaaaacatgtggtacaggtagcacagggctggcagacagccaactacaagaacctaatgtgtacagcattgaaatggcccataatatggctcagaccagataagaaataaatgacaccagaaaaattctcagggctcatgaggccagtgaagggtattacaagaaatgggaaccctcaaggcagaggccagttcaggttaaggatatagacaaagaataagtatatagaaatcaaaaacaaaaagaagaaaaaaccagaaaataacccaggcataaggaaccatgaatggacacagttagaaacagaagaaaattgaaaaatgccatgtatcaaaactcatccagtgctgctgaaaccattcctggaagaaaatgtatgtccttaagcacatttgttagtaaaagttagaaattaatgatgccaaaaagatagaaacatattattaaataaagaatatataattttgtatatacaaagatgaaatatcaataaatgaatttagcaaggttcttagatacaaggtaaatatataaaaataaattatatttttcacaaatattagaaaatgaaatagcaaataacttacagcaaatatttttaaatgcacaaaataaatacattaaaaatgtataggacccctacaaataaaatatacatcattttgaagagaaacagaatacttaaataaatggagggttaccccatatttatcagtggaaagattcaatattgtaatgatgtaaactctctgcaagttattttttaaatttaatgcaattccaataaaatgtaaatttttgtttgtttgtatgtattgttggcacttgataagttgactttaaaatttatttgcaaatgctaagaatagctaaactattcttgacatagaataagggagctaggggaaagactcactttttcagatatcaaggattaatttaaagctacattaactaaaactgacattggtttacgcataggaaaaatgaccagtgtaacacagcagaggccagtaggagacccatgcaaacatagagagttgatttatgacaagagtgtgcatcagagcagtaggaaatgaaaactcttaataagtgaatttgactcttatctcacatcataaaacaatcacttctagaagaattttacaacataatgttataggtaaaacaaatttagaaaataacatgagaataattttagaatcttgggacagaagaaaaatttctgcaatagacacaaaatacattaaacataaaaaattagattaatttaaaatgatactaattatgttgtagtaatatgaacttctgttcaatgaaagaaactaggaaagacaaagaggaaagatacagactaagagaagatatttttcacatatataataaacagatagtatatagtgatatcctaggaataacttagaaaaaagccaatccaatagaaaaaaaagagcaggatatttgactaggtatttaatcagagagactgtttctctgattattaatgagaaaaggcattcaccgagtgtcgtaacctactcactataatggttaaaatcaaagttatcaacagtgtcatgtgtcacatgtgttagtatgtggcataattaaaatgtctaacaatattataatagacaaaacaaatttttcagaatagtcctatgatagaatcctattcagcaataaattttttttaaaaaagcaaatgactgacagctacttgcagcactgtggaatctcacaatcagaatgcttaataaagccaaatacaaaagcatacatacttaaataacttcatttctatacatttcaaaagcaagcataactgaagtttggtgttagcctttaggacagcggttacttctagggagtaagggcagggttactaataggaagaggacaaaagggagactgtcagggtaccggctattttcatcatggttacctgggctattcattttggaaaaattcctttggttgtaaatttgttttgtgtgtttttctatgcgttatactgcaacacaaaagaaaacagacaaagcatgtgaatggaattgttgacagtgtatttcttgcattcataatacaatacatttgtaacgcaatttcccatttctgtttcaatgactaacctttcatggatatgtagccttagattttagaatcttgcttaaaactaatgacaacaaacaaggtaatgaagactcggtaaaaactacactattgaatatattatgattctttagcttcagagcagttactgtagctgccttcctccttttctctttgcccatatatagcctgagccttctaatatttctaatacaccccaaggttgtcaactcatggcttagattattggccagtttgactacccctaaaaatgtaagtggaaagggtcacagcaggacatgtagccagactccattaaaaatattaataaaagaagagcacaaatttattaaatgaaaatcctctgatctgttcactgtagcaaacagctgttattctgtatcctaccgagggccttgggacccagtggcactagcaggtttgcctctgtgtacatttctctcagctggtcaaataaacagctcttctatcctcctgtagagaggcagggttgctcccagttgtcaaactcaaataatccccttcaaacagaatccctggcaagttcaaagaaaacatgccaaaccccactgctctgggggataatggccaccaagaaccgactgtgggagtagaaattaaaagatgcctctgaacatgaaaccttaataaaccaagcatctttacaaatattactccctcatccaatgccctttctcataaaattaaccccaatcccttatgctctcatcccctcattttatattccaatagttgaagttcaagtttacttagcagcataaaattttacttacactgttttccaatcacataaatggtcttgaatatagtgttaccaaaacataagacaaaacaagtagaattacatgtcaaagcacagtttgaccttcattttaataaccaggagagatataaaaatattaaacagctgataagacacaagttgacactgcatggacacgactaattagtaagcaactgattaaccataaataactggtgcaactaataattcatatacataccttgtggctgatggaagaaattaataatttcttcaagatttgtgagtatgtttctcaattccttttcagtcatcacaagttttccttgtatccccatggatctcacccacacagaaaaacaggcattatcttttctctatctatcttttctatctctgcatctctccatatattatctatctatctatctatctatctacctacctaccatctatctaactatttatgcttgagaaaataaggtccaaaatttagctgattaagcaggaagagttgaatgtatgtttcagtgggtaaataattataccaatagtgaaaatagcctgaacactttaaaacatcatgttactgtgtaaatatcatatggctgcttatatctatcatttggtttctacctttatctacagtgaatttcctgacttgattttaataggcaccatgtggcctattttgccatcccaggcagctcgtaaacttcagaaataaataacttccgcttatgtcacaggggtgttttaagtagtaatataaatgtgatcacttgccagaaagtatttgaattcatcagagaaaaggtaccatgtatgagaaatgtaatatcacagtgggtaggggctaaacatggtcattcttagcctaacacttatctgggcagtatgtctaaggttttcctattgatggaatgctagcctggatacctagattgtgtgtgagaggaatgaacattgagctgggagtcaagagatcccaacatttgtcatggctctacttcagactagcattggcaaattttcataaaactctactttctaggcattaggtatctcatctttaatatgagatagaaaaaaacagtagataaacttgaagatggcttccagtactaacattctgtaattctgtagttcatgctaatccttcatgcctaagaaggtaaaaaattgtttttgaaagtaaatagcagaatgatgatttagaagttaaagttctaccttcactgaaatgcctaccctcatcaactaattaggatttagccctcacaggtgacttaggataagagaaaaggcttcccttatcctatcaaagcttgtttccaagtactgtagtatgtaatcttactcatttcttccaactcactataatctgtaattttattttcattttaaaaaacattttctcctctaatataatttaggctatcttgtttactgctgaattcttagcatccagaacaaacacctagcatgtagcagggctcaaaaacatacagtgagtgaaaaaccaaatgcatatcaaaaccatttagcttagtgtagcatatgactagatatgtttaaaagaaagatgtttaatgaacactagtatgcggaagactgttttcctcagatacactgaaagaaaaggtgtgctggaatcagatcaatagaaagtatccggcagttttcccagtctaaatcacttttgccaggtcattagataagtacatagcttacgtatgataatggttttgcaataattcaaagagagtagtcttctattttatatgacatggcattaattcagtgaaagctttgctgaatcctagagtattacttttatttactgtggcatggttttaatatatactcaagttagatgcaaattttagcaaaagatatcagctgagtgctttaatcagtttcatattgtgctaataatataccataatatacaaattgttatatatcatgttgtagaaaaataatttatataactgagctttacaaaacttaaagcataagaaatgtattttacatgttttctcagcatctgtagtttcaacatgtatattgtttgttattgctatttattgtgtgtgtctatttttaaagatactatgtttagcaggattaaaaatatggatgtcatctgcattgctccagaacactctatcatagaatagtctgttgggtaatttgtatataggtcatcaggatttctttataaggttaatctatagttatattttatgtagtcagagaaatcattgtcccatgatgtcttttcttgggtcatcttgataactgattgtcacacaatgatccaatcagccatttgattgatctgattcagtatatccatggcacctggaccaaacatttcaaggtcagactctttctgtgtgacactgatgaacatggcatacaacatcaagggataaaaaagtccattatattcaagaactgtcccacaccaaatacatttccatcgctttctttaaagatgactgagactccgaactgaatactgttaggccaatgatttcagttgacagcaatctgtggtatgaagttgcacagttagtatggacattcggtcagattgataaaaatcatcacggtaataatgcttcattaagaaactagagatttgtgttcagaaaagcgacttcaatataggatttggaagaaattaatactgaaataagcaaatagcttatgggtctagacagcagtcatgaagatacaatacaatgttatccaatttcaaattttaaaacaaatggacagaactatggaggagtcattgaatttcctgtcctctgaacaatcagtctcaaatacagattcatttttcatatgcctgaacttttggctgaagaattcatcacaaatatccactgagtatttacatgaaataggcattcccataggagctggggatataacaatatatacatttgacaaaaatctcttcccttttggactttcaggtctaatggcagagataggtaataaacatattaagcaaattaattaaaaagtgtattaggaagtgatagtgctatggaaacaaataaggatagggtgaaaaggggtgccttggacttgggggattatgtttgaaatagagagatcagggtacgctttgctgaaaagtgacaatggtagaaattgataaggttccattgggagggagatctacaacatcagtgggaagcatgttctgtgcagattaaatagccagtgcataggcaaggaggctggactgtactagcatgtgtgaggaacaccaaggaggtcagtgtggctgcagtgtgatgacatagggaagtgggagtaagatacacggtcaagtgtgtaggaccttgtaaaccatcataaaggcattcaagtgcaatgtgaagctgacaggggttttcagcagaaaagtgacaatatctgagttataatgtacagacttactcttctcaccatgggagaaaatacattatgggattacaagctatgatggaagaaggatagttggttaggagtgagatgatgatggcttagatcagagttttagactacaaactttccctctcaagtcaaattctcttccttgaaatgatacattaatgtctctggaaggcttccagagtttttccagtagttctctttagtggaatctatttatgccattaattaatgtaatgtataaatgtaatccatttaacctcaccaatctcagttgtcttatttgctaaatgggtttaaatacagtgcctaattcataacttaatggtaaaaattatacaagaatatgcatgtaaagcataacaccattgttatataatataaagtaaattttcagtacattttagctgttgttatacatgtgattgtcatctccaatgacaatatatatcattggagggattcagtttgtaaatatttcatttatggttgttgcaactgcattcatgaaaatgactgaagttaatatttatttcttttgtatgtgtactaaaattttgatattaatgttatcctactctcataaaatcaattaggatgggtcctttttttattccctggaagattttgtgtaggatcggtgttacttcttatgtttggaagaaatcactggggtaaagtcaccttggccaggcatttttttttcatgagaatgttttaaaaaacatatttaacctctaaaagaaatgacaagtcatatttcctatcttttcttgtgttcattttggtagtctgtgtttttctaaaaatttggccatcttttaattaaattttcaaattaattggaataaaatttcttagttatttagtaggctaaaaaaatggtctcccaaaagatagtcatgtcttaatcctggaaattatgaatgtgacctcatatgaccaacaacaacaacaacaaaaagttttgcagatgtgactaaattaaggaacttgagaggggggagattattctgggttcttgagtggaccctaaatgtgatctcagatatgcttgtaagagagaggcagacgaagatttcagagacagaaagaaaagacaggaccacaaaggcagagattgaaatgatacagccataagcccgaccatggggtagctatccaaagctggaagataaacgggacgggctttctcgcagaactttgcgaagcagtgtgatctagctgacaccttaattttgacccagtgactctgattttgttcttctggccagaaattcaagaactgtgagagaataaatttctgttgttttaattcatcaaaaggattatgtggtaatccctattaaaacttgtcctggctgggcgccatggctcatgcctgtaatcccagcactttgggaggctgaggtgggcggatcacctgaggtcaggagttggagaccagcctgaccaacatggcaaaaccctatctctactacaaataaaaaaatttagccctcgtggtggcacatgactgtaattctggttactcaggagaatcgcttgaacctgggaggtggaggttacagtgagcctagatagcaccattgcactccagcctgggcaataagagtgagactccgtctcaaaaacaaacagacaaacaaacaaacaaaaaaacttgtcttaatactgtaagaattttcaactgtatttttgtgtttattacagaagttaatagctaagtttttgaaacattaatgcttatgtttgaattctttgtgtatttacgtttatgcctttctaagtcattgactttttttgttaatatttgcttatttttcacattgtgtgtgtcataatagtgtaccatgtttctaaggtatgagtatattgtgagctctattcaagtgtacctcttcctctcaagcttttctcctcctcttcttggcaggtacttatcttctatatattcttatacttcaaggtttgcaaggacattttaaattagtcttttggttatttactgtaaaacttttgaattttcaaaattaacctctttattttgttataatatagatttgcatatggttgtaagaaataacacagagagacatcaaataggctttatccagtttctctcagtggtaacatcttacaaacctgtaacacaatctcagaaccagaatattgacatcaatacaatctattgatcttgtctagatttttttagttgtatttgtacttgtgtctgtgtttatatgtgagtttatttagttctatgcaattttatcacatgtagatttgtgtatttaaactagaatgaagacacagaactgttccattacctcaagtgtccctcatgttgtccttttaaccacattcacttttctcttccccacctctcccggctaccagttcctaatctctggcaacactgctctgttctccacatctataattttgtcattaaaaaattatatacataaatacatttaatatttaaccttttttagatttttttctctctcttttagcttttacttagcataattttctcgagattcatccaaattgttgagtgtattgatttctttttgtcctttttattactgagtgctagcccatgaaatggtgtatcacagttttttatccatttacccattgaagtggacatctgggctgcttacagtgtttagctactagaaataaaatttctttgaacatttatgtacaggtctgtgttaacataggtttccccctcccaggataaatgcccatgaatgcaattactggttgcatagtaattgcttgtttacttttataagaaactgatgcttctttgagaagctatgccattttactttccaccaacaatgcatatgcaatctttggatttcttttagtttctgacattcactatcatctagtattttaataactgcttttgtgtcacttttaacacttaattgctaggacaccacattaaagtctttctcatctttatcttgcaactgatgttttacaaaaaattttcttttttcttttgagatggagtctcacttgtccccaggctggagtgcagtggcgcactctcagctcactgcagtctccgtctccctggttccagcaattctcctgcctcagcctccctagtagctgggattacaggcgcgtgtcaccatacctagctaatttttgtatttttagcagagatggggtttcactatgttggccaggatggtctcgatctcctgaccttgtgatcttccctccttgaccccccaaagtatttggattacaggtgtgaggcacggctctcggcctacaaaaatttctttatgggaaaatatttggacatctgaaaaataatttccgggtaataggcaaatatcttcattgtcttcaattctgtagtaagatttcatatatacaaaggaaaataaaaagcacccacttaagaaaaaacaaattaagaatatgcttttattcaataagactacagtgtatgagaaaacctgacggaagttctaaagatattgctatacttaaaggtttctcaaggtggaactttaaattcccaagacaagaactaatttagtgacatattaagacatttaaataccattgctaaatgaaaatagccccaaattaatttttccaaaatcgaaaaagtatctttatttataagtcaatgcttattaaaagagcagtaaatacaaaaaaagtataaagaagaaaataaaattagccacagtagtattcacacacaaaaaactggctttcatacattcatgacttaaacgtctttgtgactagaatgagctggtttgggaagagagaaaagtggttaattttaagaaatgggattaaagtgaaaggactgtaaacttaaagcattactgacagaatgtagtgagcacagactcaaagcaagaagagttatcatgatgctaccttaactgttcagtaacaaccttagattgctggctccagccttgtattgaggccttcaagccagcaaagttataaactcttttattaaatgccaattatttagtttcttgtagtgaccagtgtcgtgcctgactcagcaccttctaaacttaaccattgtgaattgagtttatgaaggcagtgttagaatgtaaagatgaaggaaacatgtatacctcttaatttaatatggaaacctcaggtattatacaaaaccaatcctagcagcactggaagaggagcagtataaaaatgagttcactaaagcagtgccagattgaatcatctagctattgtgtaatgttagcttgaggatcatctattgcttattatttcaccagtggagaaaaagaacctataaaattaaaagaaaaaaaggctttctcctaggtgtctgtgagagaacagagtttaaagtaaatcaacacttcactggaaaatatttccctagttgtttcctctatggacaaagtccttgaggaatcagtcatgtatttcaagtgtcagcagagcttaggagaacagctgagcttcataactcttagcattttatttattcacaaggaaatattgacttaaattagctagattctgtcttggtgtcacttgattctctagacttacacagaggttggagaaggaatttatgcaattcaaagacgccaacttgtcaaggagtaaatcaatgtgattttcacaaagccagttttacataaggcgtcttgtaattctacaagaaatatgctattttcctttcattccattatagaaatatagaaaaacagttataataaattaatatatgttcccattctcatttttctttgagcataggtagcaacatcgatccaaatgattcaaagactttaagttgacccattcaactttatccaaattttgaagagaataatatgcctgaagttgaaaatcaagggcacattccttcacattttgcccatttgaaaaaaggggacaaaacccataaggctctatacagtttttcttgattagttacagtcttttaaattattttaaaataaaagcaataagcacttttaacttaatctttgtattcagccataagaacacactacctgttcttatgtactgaagcctcatttgaagatcctataatcactgcactttggcattgtatggaaatcttaataattttttagttcaggatttacatttatcacactttataagtaaaacactcaatgtgctaagcagtgtgtctagtttaagtaactaataagtggcagtcaaggctagaatccagagtaccttagttgctactgctagtgtccccactagcactacctttattatgattattattgagacaggatctcactctgcctccagggctggagtgcaggctgtagtgcagtgcctcccccagctcactgcagcctcgaatttctgggcccaagtgatcctcccacctctgcctgctgagtgattgggaccacaggcatgcaccaccatacccagctaatcttttaatttttttgtagagacagggtctccctatgttgccagtgctacctttaaatacccagtaaaacacatttaattctttctgtggcacgtaaaacttggagtggcttgcatgaccctttcgcctctaccctgaacttttatattcattccctgtgtaatcaatgctctccccttgagtttggacaaggcacacaacttctcattagtaaatatggcaaaggtgaagggctattgcagatatgcaatttagatgccaaataggttgattttgagttagtcaagagggaaattatcctgggtgggcctgactgaatcaggtaaaagcccttacaaaaagaactaggccttctctgaagttagagattttacataggagagagtcttcttgctggcttggtgatgcaagcagtcaggttgaggaagcctaagttgcagggaactgtgagtagcccctgggaactatggatggcctctggtccctgaggtcagcctctagcctccaatcagcaaagggtgggggctttcatccacacagaccaaagcaatattaattctgacaacaacttgaatgaaactagaagaaaaattttccccaatcaaacctacagatgaaaatgcaacccggctgataatacatgaccatgtaagatctcaaagagagggcccagataagctataactgggctcttgattcataaaaactgggagaaaacaagtgtgtgttattttaagctgctaattttgtggtaatttgttactctaatatagaaaagtaaagcgctttgtaagtggagtatttccccgtcatacttgagagtaaaatatgcttttaacctgtttgtgtataacacatagaaatggtctgctgttttgcagtcttgcttcacacatcacaccccttcctcatcactgcacagtcatatcagagctcctgccagaccgaagaagtgattgtttcctcaggcagtgatttgcagatgtttgattttgcaaagcaggataattttaaaaaatgttttggccacagacatagtgttaccaaactttaaattaactgcataacaacattttaaaaacaccagctactatataattattttatcattaaaaaccaaaatataataccaaaaagcttagtagggttagaatctcagaaagaaaagagtctttctcacgaacaaagagctggcaacttacacacacacacacacacacacacacacacacacacacacactccttaatattcccattttgccattgaccagaataaacagagcattgtcacagattgctaccagactatacacaatgtcatttggaagccaatgttgtaagaagttgttttaaaaaccactgggtagagcagatggcatcctctgctacttcgttcaggctgcttactatctttcaagattaagatgcttttatgaaggagtgaactagaaatgtacaagctgtctttttataccccactaattatacttttataaaaatatttcttcatctacagagcacctcttatttgccacatactattctacatagtcagtatctatcatgtcactgagtcttcattagagtcctgtgatttgtattactatgataatcgtcattttgcacatgggaaatcttacgtagcagggacttgacgaaagtgaagtgatcttaagttatttagcccacacttttaaacactatgttagaatgttacatggagtcacattttgccttgtgtatattcctttttgtccatattgatttcacacatagattaatctagaaaactgaatgagcatttcatggaaaacaggatataagacaagtatgaaggcatataaaaaattacgtgccatcttgaacagatctctactgacagcatatttgagagagattttcgatttgaggatctcaaacatggaagttcagaataaaacttaaaggacagcttttcaataatataatggtgaaaccaatggaagaaatcagtggagaaataaaaaggggtaaagaaagacgagagaatgttgagggaaacactaattagtaataacatggttgaggttcctcttggaaaccacccagaatctaacttgaactcagattcaacgaagatttatttactgttcattttgtacaagcactgtgcaaggcattgttacatgttttctagtgattatcagagtcataagcttgtggactctcgaatcagatgatctggctttcaataatatatctgagatggtatgcaaataggacaatatgggacttctttttttaaaaaatcaaatatttggttatgaataattttatgtgtcaatatggctagatcatggtactcagttgtttggtcaaacacttgtgtagatgttactctaagactatttttcagttgcgattaacatttaccaccagttaagtaaagcagacaatcctccataatatgaatgggtctcattaaatttgctgaaggccaagactgaggtttccccaaaaagaagaaattttacctgcagactgcaacatagaaattctaccttagtttcgagccttcagatgcaagactcttaactgcacctccagcctgtcggcttgccctattaattttggacttgtcagctcccacaattatgtaaatcaatttcttaaaataaatctctgtatatatgtatatcctattgtgcctgtttttctgaaaaaccctgactaatacatatgccagctgaactaaatgccagttctaattctccaaaatccattaaaaatcctcatttttatattatatgtgataatccatatataatatactaaatgtaattaagcatctagtctgtgtaatattggtctcaacagtttccccacctgtaaaataaggactaattatagtataaccttccagaaaagtgggaattatgtgagatgtcaagtgggtagcatagtgcctgacacacctaagatttcattaaatagaagctgttttgttatccttaaaataatcccacaaaaaaatattatttagagatgaaaaaactaaagctgagagaagtttaaatagctcttaggatattaagccacttattttgacagtgaaatgatggttacttttctgaatatagcttcctttttcctgagttttattgatcttcaatgggataaatgtgctgatggctgaaatactgaagtttacatgaagaataattgaaaagagataaggagtagcacagggtataaaacaagtaaaacacaatttgtaaaaatgatcattgataatgaaaatgctttaggattgattcacatatacgcaaattttggtggaacactcactaaaacagattttcaacatttagcagtcagggttgacactgggattattgtagaattctgagaagtgatcaaaattgagacttgtaatttctttccaccttatgttttatggatttggtagaatttgggagtgaaatatagaccaagactatgtaaatattttaaatctggctcatattttattatatatataaaagatgatcagtgatgttaagcacctttcatgtgcctgtttgccatttgtatgtcttcttttgagaaatgtctattcagagcttttgcccatttttaaatcagatgattactttttttttctgtagagttgtttgagctccttgtatattctgattattaatccctcatgagatgtacggtttgcaaatattttctaccatatatatgtaaaatataacatgtaaaataatcagttttagaacaaatttaggtttcattctgaggaaaagaaattacaatttagtttgggaggtattttgggcaaaaaaaaaaaagtcctatattatcctatcatgtaccttatcacagatcactgacaatatagaacaaagatggtcttgtttattttatttgtttaatgtttattgcaactttaattataattgtacaaaaagagaagaaaacaaaaattccctacaaaaagataatggtcaaatgcttattgtactttcctatgaaattattataattattttgcttttgataatctgtgtttaaaaatttttaatttttaatttttgtgcatacatagtaggtgtatatatttttagggtacatgagatattttgatccaggcatatgatgcataataattacaacagggtaaatgggtatatcccatcacctcaaacatttatcctttccttttgttacaaacaataccattatactcagttatttttaaaagtataataaatttttgttgactgtaatcaccccgttgtactttcaaatactagatattattcattcgatatcggtattatttatttttatttttattatactttaagttctagggtacatgtgcacaacgtgcaggtttgttacatatgtatacatgtgtcatgttgatgtgctgcaaccattaactcgtcatttacattagatatatctcctaatgctatccctcccccatcccccaccccacaacaggccctgatgtgtgatgttccccactctgtgtccaagtgttctcattgttcaattcccacctgtgagtgagaacatgcggtgtttgcttttctgtccttgtgatggtttgcttagaatgatggtttgcagcttcatccatgtccctaccaaggacctgaactcatccttttttatggctgcatagtattccatgatgtatatgtgccacattttcttaattcagtctttcattgatggaaatttggcttctttccaagtctttgctattgtgaatagtgccgcaataaacatacgtgtgcatgtgtctttatagcagcatgatttataatcctttgggtatatacccagtaatgggatggctgggtcaaatggtatgtctagttctagatcctagagaaatcgccatactgtcttccacaatggttgaactagtttatagtcccaccaacagtgtaaaagtgttcctatttctctacatcctctccagcacctgttgtttccagactttttagtgatcaccattctaactggtatgagatggtatctcactgtggtcttgatttgaatttctctgatgtccagtgatgatgagcattttttcatgtgtctgttggctgcataaatgtcttcgagacttcatccactttttgatggggttgtttgattttttcttgtaaatttgtttaagttctttgtagattctggatattagccctttgtcagacggggagattgcaaaaattttcccccgttctgtaggttgcctgtccactctgatggcagtttcttttgctgtgcagaagctctttagtttaattagtgtaagtgttatttttgtacccattaaccgtcccctttgctcccctgtctagtactcctcccagcctctggtaagtatcattctactcgctatctccatgagttcaattattttcatttttagcttccacaagtaagtgagaacatataatgttcgtctttctgtgcctgcattatttcacataatataatgtccttcagttccatctctgttgttgcaaatgacaggatctcattctttttcatagctgaatagtactccactgtgtgaatgtacattttctttatccattcatctgaggatggacattaggttgcctcaaaatcttggctattgtgaatagtgttgcaataaacatggaagtgcagatatctcttcaatatgataatttccttttttttttttttggttatatacctagctgtgggattgctggaacatatggtagctctatttttagttttttgaggaaattccaaactgttctccatagtgattgtactaatttacattcctaccaacagtgtacaagggttcccttttctgcacatccttggtagaatttgctgttgcctgtcttttgaataaaagccattttaactgggataaggtgatcttattgcagttttgatttgcatttctctgatggtcaatgatgttgagcaccttttcatatacctgtttgccatttgtatgtcttcttttgaaaaatgtctattcacatcgttttgcccattttaaaatcagattattagttttttttttttttctgtagagttggttgagctccttatatattctggtttttaacccttcatgagatgtgatgtacagtttacaaatattttcttccattctgtgggttgtctcttcactatgttgaatgtttcaaagatggttttattaatgaaaaaataccatgggtgtatatttctccatagttcatagaagcagaatggggatgaattcaggtgactgaaaatgttattatcttgaataagcttaatggatctatttcctaatgtagtaagtcttttccattgctaactttggtgatttttattattaaacaaagtcaatataagatgtggttggttcatctggattaaaatacatacacatgccagaatctattactccttttttatgtttatagagatccacaaaaattgatgtgaagagccagttttctaaaactaatagcggagagtgtcatgcaaagatttgtgactaaatgtgtatacttatagcttaatgcaccctgattgggagagccttgtgaaatatcactttactgggggagggaggagtagtcacatatgatggtccacagttaaacacacagctatgcctacctatacaagataaagatgaagcacatggaacatttccttggaaatgtgaaagggaatgaccccagcttaacctgagtcagttttgtattcaaatagtccctctgtgtacattttctcctttctctcaaacttgaatgagctctaaaataaatatctatttacattgaagccattgagcatttatctacctgaccatagcctagaaataagagtgaataagaaaaaggaaaaagtttacgctttgtattttgtaaatgtatgctagatttctatacagatattttcaagggccttgacattttcaatggcttatgagatattctaagaccttcatataacatttgagtccttgaaatcaaatttattggctttggaatacaaaaaagaacccataaaatcaaaatgaataaatgtttaattaaatgtctgcaagacataacattatgtaaacgtcattaattattaaatttagtattcataaaagttttattgaatttgaaaacagtttgctggatatattttttccacttcgcaagaatttctgagttctgctgaaaaatcatggcccatccttaattatatcatagttaaataatttcaaaaacaaaattacaacattcctttccagaattttgcagtaaataattaatgttgaatgtgggtgtgctttcatatgtttgttatgaggcatgctgtggcttcgaaagggctgaccaagttcttaaaacagctccactttgaattcttccattgcttgctgtgccatgatagataagaaagaaatacttggctcatgttccacttttttattataaaacctttcaaactaggggaagccttagattgtgttctccagaagcagtctctgggaaaggagttgtgtttagaaggttttttttactggggagtgttctcaggagatacagctgcaggaaagtatggatggcaaaggcaaaaactatcagcaatatggttgcaacagaggacccagtcgatcctgcagtgagctctggagctgggatggcccttcagaattgtgccaaaatattggggcagtgggatgggactttatttatttgtaattgaaaaataataactgtacatatttataaagtacaatagtttcaatactcaatatatagtgatcagatcagggtaattagcatatttcaatactcataatgttgagtgatcagatcagggtaattagcatagccatgtttcaatactcatgatgtatagtgatcagatcagggtaatcagcatatccatcatctcaaatatttatcatttatttgtgttggtaatgttcagtattctccttctagttatttgaaactatatattactgttaactatggtcatcctacagtgccacagaacactataacttattcttgctatctagatgtaattttgtatcctttaacaaatctctccttattcctcctttcccccacccttcccagcctctaatatcctctgttctactgtttacttacattagatcaaattttttttagcttccacatatgggtgagagcacacagcatttaactttttgtttctggcttatttcacttaatatccttcagttccatctatgttgccatacatgacaggattttattcatttttatggctgaataatattccattttgtatatgttaattccatatcttggctattgtgaatagagctgcagtagatgtgagatgcagatgtctcttcgatcttctttgctttggatagattctcagtagggggattgctggacaatatgtagttgcatttgtagttgtttgaggaaccttcatactgttctccatagtggttgcactagtttacaattggactggggcctctgagtccctgaattagttagctgtcggtctcatatctcctctgggaggtgacataacctttggcaggcagctcttgacagctgacagaaacactttagggaggggatcaggacacagaggatcacaatatgtatgcacttatgtactttaaggagtattagatttctcacaccaaaattcagcccatatgctgtggttatgacaaaggtagattaaggagagctaggatttcatccagttcatgagtttaccagattaatacattggtgatgatgtgttgctggaataagggtgcccttagtttctactgatgtttaatatttaagtgtgcacagtatgcttgatgaagctaccaatacaatattaaatgttcaatgacatcccgaacattctaaattcagttattggtattttatgtgatcatgtagaattctgggtttaatctaatttagtcaaatcataacccatagttattgtctattgagcatctatcactgtactagatccctgaatgcattatattactcatttctcaatttacatctcccatgttaaaaatagaaagctgatgtctagagagtttatacaacttatccaagtttacacatggtgtaagagatgaccaaatatctttgattccaaagactttttctctgccaatttaccatgttgccactctagaatgacatttttaaatccttcaaaatacatggaaaagtaatttaaaacggttgtgctcaaaaaggtgacaaaaagctgtatgtgaatactgattttataataaaagtcgcttgctactactatgtgccacatattgtttgaagcactttacttgaatagaccctttacaactttagaaatgatatcctatcatcttattatcctcttttttgaggttggtaaaataatatacaaatagggttaggtaattcccaagattacatagctacaggcagtagagatagcatgtgactcctgcagtctgactccagagcttcccacttaatcacaaagctctatctctcttctgggtctatcccacttaaccagaagtgggattctaaactgtgtactacattgttttaaaaagcaaatgttcccttgggagggtgtatgtgttcaggaatttatccattttttctagaatttctagtttatttgcatagaggtgtttacaatattctctgatggtagtttgtatttctgtgggatcagtggtgatatcccctttatcattttttattgcatctatttggttcttctctcttttcttctttactcatctggctagcggtctattttgttaatcttttcaaaaaaacagctcctggattcactgatttttttaaagggtttttcatgtctctatctccttcagttctgctttgatcttagttatttcttttcttctgctagcttttgaatttgtttgctcttgcttctctacttcttttaattgtgatgttagggtgttgattttagatctttcctgctttctcctgtgggcatttagtgctataaatttccctctaaacactgctttagctgtgtcccagagattctggtacattgtatgtttgttctcattggttttaaataacttatttatttctgccttaatttcattatttacccagtagtcattcaggaacaggttgttcagtttccatgtagttgttcgattttgagtgaatttcttaatcttgagttctaatttgattgcactgtggtctgagagactgtttgttatgatttccattcttttgcatttgctgaggagtgttttacttccaattatgtggtcaattttagaataagtgtgatgcactcctgagaagaatgtatattctgttgattttgggtggagaattctgtagatgtctactaggtcttcttcttccagagccgagtacaagtcctgaatatccttgttaattttctgtctcgttgatctatctaatactgacagtggggtgttaaagtctcccagtattattgtgtgggagtctaagtctctttgtaggtctctaagaacttgctttatgaatctgggtgctcctgtattgggtgcatatatatttaggagagttagctcttcttgttgcaatgattcctttaccattatgtagtgcccttctttgtcttttttgatctttgttggtttaaagtccgttttatcagagactaggattgcaactcctgcttttttttttttttgctttccatttgcttggtaaatattcctccatgcctttattttgagcgtatgtgtgtctttgcacgtgaggtgggtcttagtcaaatccctgaatagaccataacaagttctgcaactgaggcagtaattaatagactaccaaccaaaaaaagcccaagaccagacagattcacagccaaattctaccagaggtacaaagaggagctggtaccaatccttctgaaactattacaaacaatagaaaaagacggactcctccctaactcattttatgaggccagcatcatcctgataccaaaacctggcagagacacaacaaaaaaagaaaatttcaggccaccccaatgaacatcgatgcaaaaatcctcaataaaatactggcaaaccgaatccagcagcacatcaaaaagcttatccaccacgaccaagttagcttcatccctgggacacaagggtggttcaacatatgccaatcaatagacataatccatcacaaacagaaccaatgacaaaaatcacgtttgtctcaacagatacagaaaaggccttcaataaaattcaacaccgcttcatgctaaaaactctcaataaactaggtattgatggaatgtattttaaaacaataagaggtatttatgacaaacctaagacacaagacaagggtgccctctctcaccactcctattcaacctggtattggaagttccggccagggaaatcaggcaagagaaagaaataaagggtattcaattagaaaagaggaagtcaaattgtctttctttgcggatgacatgattgtatatttagaaaaccccatcgtatcagccccaaatttccttaagctgagaagcaacttcagcaaagtctcaggatacaaaatcaacatgcaaaaatcacaagcattcctacacaccaataatagacaaacagagagccaaatcatgagtgaactcccattcataattgctacaaaaagaataaaatacctaggaatataacttgcaaaggatgtgaaggacctcttcaaggagaactacaaaccactgctcaaggaaaacagagaggatacaaacgaatggaaaaacattccatgctcatggataggaagaatcaatatcatgaaaatggccatactgcccaaagtaatttatagattcaatgctattcccattaagctaccattgactttcttcacagaattagaaaaaactaccttaaatttcatatggaaccagaaaagaacctgtatagtcaagacaatcctaagcaaaaagaacaaagccggaggcatcacattgcctgacttcaaactacactacaaggctacagtaaccaaaacagcatgatactggtaccaaaacagatatatagaacaatggaacagaacccaggccgcagaaataacaccacacatctacaaccatctgagctttgacaaacttgagaaaaacaagaatggggaaaggattccctatttaataatcctggtgttgggaaaactgtctagctatatgcagaaaactgaaactggacctcttctttatacctaatacaaaaattaactaaagatggattaaagacttcaatgtaagaccccatactataaatctcctagaagaaaacctaggcaataccattcaggacataggcatgggctaaggcttcatgactaaaacatcaaagcaatagcaacaaaagccaaaattgacagatgggatctaattaagctaaagagcttttgcacagcaaaagaaactatcatcagagtgaacaggcaacctacagaatgggagaaaatctttgcaatctatccatctgacaaagggctaatatccagaacctataaggaacttaaacaaatttacaagaaaaaaaataaacaacctcattaaaagtgggctaaagatttgaatagacacttctcaaaagaagacatttatgcagccaaaaaacatatgaaaaaaagctcatcatcactggttattacagtaatgcaaatcaaaaccacaacaagacaccatctcacaccagttagaatggtgatcattaaaaagtcaggaaacaacagatgctagagaggatgtggagaaataggaacacttttacactgttggtgggagtgtaaattagttcaaccattgtggaagacagtgtggtgattcctcgaggacctagaaccagaaataccgtttgacccagcaatcccatttctgggtatatacccaaaggattataaatcattctactataaagacacatgcacatgtatgtttattgcagcactatcacaatagcaaagacttggaaccaacccaaatgcccatcaatgatagactggataaagaaaatgtggcacatttacaccatggaatactatgcagccatgaaaaaggatgagttcatgccctttgcagggacatggatgaagctagaaaccatcattctcagcaaactaatacaggaacagaaaaccaaacaccgcatgttctcactcataagtgggagttgaacaatgagaacatatggacacagggaggggaacatcacacacaccagggcctgtcaggggttgggggtctagggagggatagtattagcggaaataactattgcagatgacaggttgatgggttcagcaaaccaccagggcatgtgtatacctatgtaacaaacctgcatgttttgcacatgtatcccagaattaaagtataataatagtaaaaaagttcccactgacacacatttctgggagccaaagtcaatgtatttaaaggactgtaaatgaatgggatctgagagtgttatttttaagcagaggtaatgtactggcctctgtccctaacaatggtagtaaaaatatactccaaatgacacacactatagcaaaatgtgggcaaggtgcttagagaaggacacttgaaagaggaagagtagattgcttcatagttcacggactgttgttttgatctctcatcaaaagagccatccaaacagatctctacatttatcaaaatatcaacattttattttctctaatgtttaaatatttcttagccactttctcatatgtatttttaagactataaaatgaagaaaacttttcatcaaccatttttagcacagacagggaaagattatttttccctgaaaatattcctttaaaacttctatctttgctactgtatagttaagcacaaaaggagatattgattataatgtatgattctgtaattttatcattatttcattacaaaacaatttttgtggctgctcacaagcctgataaatatatatttagtgatttttttggtcaacacttaaagtgactttctctttctgtcattttaatggcattgtgataaaaagatcaagactgaaaagaaagatagacacaagaacatatcaccttttaattattttataactacctatttaggattcctagaataaatattctacttttaccattaagtgtgaacattttataataattacttccttctctctcagagaaaatgttggtttttgccaaggaaaatctacagcatgcaaattcttctttcaagatgcgaatagtgcatatgtaagctttgacgggtactaatggacatttcttcctatttttgacccttagggtgaaaataacagcgccttattatttttcaggaagaataagatccatttccaaacagtttagaaactcagggctttttttccctcttataaatagacaaataaatggtcacattagcacttatacttcattgtgagccaaggacatttttaaaatgtcactactcagggttaatgctctttttttttttgacatttggccttcagatttttctgcttaattgtcggtttgccacctcattgccatatacagggtcaaatgcatctctttcctttcacattgccataagatataaagtccaaatgttttaaatgttttatatattgtgtactaccagacctttccaagctctatattaatttaagcctctcgaatctagagaagtcttccgctcaggctgaaattgtccccaggaaggattatcagttacttgtgtccaaccctaagctgctcactttttagcagatgcttgtggttttgctttctccaccagtgaaaacattttgggctagccttacaaaagtgaatacatatgcaacttacacatataatttactgatatataggaaagtaaataaattttcaaggtgattctgttaatgattaactaactcacataacttggacttcaattttctttttaagtaaggatcacttccagaacggcaccaaatcgaattgaagtgtgacctctatacatttttcactaaagatgacttttgaaaatattctaaatctatgggtatagaatactgaacctccttctgactggtactattcattgagactaattcactgagagtgagaagcatagtagttttagttttgatatggagatgtttggtttaatctagaacgcatgctgttcattatgggcagcctattgtgtcatgccacactttgggacagttactgggggaaatgaagagaaaagctgtccctcttaagaaggctaggagcctaaagactgatttctgtctcacatcaccctttatatactgatttgcttgtttcccacattggattattatcacctttataaaccattataagccctagattggattctcaattcttggctgccttttcaatcatttagccacaaccatcttgtcctcacccctccctgcagctgtggaaagtgggcttaaattgttcctaggaaatataggtggctgaattctgtacatcaggatgccattcccttggtcccagctgaagtgactaacaatggacatctattttaagaggataatatttgggctggataaaagcatctggtgtggcttgggcaaatgcttttttaaaatgtgaacaaagatgactggttaggtgagtcacagacttctggggaattgggccagtgaaacaaaaaagttgaccatagcaagctgaaactaagagatacaaaggaatgatagtgtgtaggtaccatacaatagcaaaagccaaagaaacagatgccatggggaagagaagaaaagagaaataatgaaaaacagtcatcatggctgaagtgatatacagagtgacacacacaagctgaattttcctaattatgtcagagctctaattcttgctcctagaaaagcaaatacacacacagaaaacactgatttccattgtctctgagttggcttttttttctctcttggatttttctctctgttgtttttccaacattacttaaggtaaacttagtgagtcctctaaaatattttattactataaacgtgtgaaacatctacagatttccccagttaccaaagcagagatttggtccttggccctgaagagttggtgttttcatagtcagaaatagaatgtgcatagatgaatgtaatagagaagataaatcacaaataataaaattataattatacctattacccatgtgtgaccatttttcagtggtttaccgataagttcaagaatgagaaaaactgtgagaaggtccggaaggcagccactgtactcctgcatactgaagaggcattgtccttccataaagaaatgtaggtggcatttcaaggaggaaaaagaactaagaaccaggattgaaatatgagaaacatacagagaagtgatttcaaggaaaatacagagaattctgagtgccagataagttacttacattgtgctagagttcatcacatacataatctcacttaaccttatggaaaacatggggaagtgaatatcccaaactaccaaaataagaaagtcaaggctcagggagcttgtagtaatttttccaaagttaaattttaaattcaaagtcattattttctggctttaaaatccacattcctttcattttcacaatatgcctgctcttcactcaacacaatcgcttgatgtcaaatagaacataataatcttattttccaccagagccctaaactcttttttttttttttttttttttttttgagacagagtctcactctgttgcctaggctagagtgcagtggcattagctcactgaaacctccaccttccaggttcaagagattctcttgccccagcctcctgagtagctggaattacaagcgtgcaccaccatgcctggctgatttttgtatttttagtagacacggggtttcaccaagttgtccaggctggtcttgaactcctgacctgaagtgatctgctcgcctcagccttccaaagtgctaggattacaggcgtgagccactgcacccggccagagccctaaacttttgattcttgtgtcctcattcttcccttgaacctgccagaaaagaaagttcttctaaattttaaaagctgttaaggaagggacaatcttgaactaataaaatgaaatctgggccgggtgcggtggctcacgcctgtggtcccagcactttgggaggccgaggcagctggatcacctgaggttgagactagcctgaccaacatggtgaaaccctgtctctacaaaaaatataaaaattagctgggcatggtggcaggcacctataatcccagctactcgggaggatgaggcatgagatttgtttgaacccaggaggtcggggttgcagtgagctgagattgtgccactgcactccagcctgggcgacagagtgagacttagtctcagaaaaaaaaaaaaaaaaaaaaaaaaaaaagaagtctggcttgcagtagatggtctcaaaggaccttcatactttacaaatattaacacagagtactccatattagccctggatattcaaatagagccttgcctagcttgctgagattgcagaagacaaaggttttcttagtatttgtggaggctctgaaagaacttatgcctgtgagctctggagtcagtgtctggatttgaaacttgaccctgtcacttcatagctatagtttagcaagttacttaatgtctgtagtctctgtttcctcaatgtgttataataggtaattatagattttctgtattaaatgagtaaatattgtaaaacacctaggactgtgccagaacaatgataagcactcaataaatatgagctattttgaagggaacacaagggtttttcactcaacattactcctatttttaccccctagtaaaaagaaggtctttctcaaataatttgtgacttgctaaaaaagtcaacaaaaccctttaatgtggctgtgtttaagtgtgtgtgtgtgttgagtggggtggcatatgtaagatattcttgtgttgaaggacttgacacagttgacagctatcttacttttaaaagggctttctgtaaatgtttagagaataaatattttaggccttatgagccatagtcacaaataataggtaaagaaataagtgtgtcctaataatactttattggcaaaaacaggcagtgggccagatttgatccaaggtctacagtttgctgactgctactatgggcacagtgctcaaataatgagtatgtagctgggacaattgctccccagattcagtacgaatattaatatttgatctgcggcaggccatttaacctttctgaccaaagtttttcattcatgagttagaataaatgctccatgaagcttctttatgactctactaactcatagtatgcaagggcctacaaattgattccatgtagcaaaactatcactattctattaaggttcctaaactttcctctatttcttctaaataaaatcctgcttgcctatttaggttctcctctccaatttttcctgactgttgattttgagattttataatgcagagtaagaacgaagggttggtgtagaagggtaatgtcaacatacttgtcagggctggggaaaatagttttgtgaaggtttccaaagtaagaaataaggaaacacctataatatgtggggaaagcagaaggtaaaaaaagtagtaatgctctgccatatttactcctttcactgtgtttgaaaaatgaaaagagacaagtttattttgaaatcttttccagtttttattttttattgatacataatgtttgtccatatttatggggtatatgtgatattttgatacatgcatacatgtgtaatgatcaaattcaggtatttatgatattcatcacattgaacatttattcctttgcattgggaacattttaaatattcccttctagctattttgaaatatacaatatattgttgttaactacagtcaccttactgtgctattgaacactggaattcctatgttgtatgtttgtacccattaacctacctctcttcatctccctggccctccatacccttctcagcctctggtagcaatcattctattctctacctctataaggtacacttttttagcccccacatataagtgagaacacgcaatatttgtctgtctatgcctggcttatttcaattaacataatgacctccagttccatctatattggtgcaaatgacaggatttattattttttgatggttgaagattattgaattgctttttattgtgagctgtgtgtctttaatcagaacatcattctgagattgtaccacatgggtaatggcttgttagatattatatatttataatcattctagtatttccacagattgagtagtgaatatgtcagcgttattaggtcttcagtggccattattgcaatttttataagcctatttttggatgaagggcagaagcttcagataacaataatagttggcagcctggcactttcatacaaacttaaaaaacattttcatcttcctaagtgaggtaaaactaatgatgactcttgaacaaagacaatgtccttactcaaaacatcagtgatttcaagttgcatcctctttagctgagttgctgcattcttcaaataactcttaatgacatctcaatgatatcttattccattgacaatgatgacaggttaaaaatttctttaaatagctgtctccggtccgtgcctccaagatgacaaagaaaagaaggaacaatggtcgtgccaaaaagggctgcggccacgtgcagcctattcgctgcactaactgtgcccgatgcatgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagtccgcaaggaccgaacacccccaccccgatttagacctgcgggtgctgccccacgtcccccaccaaagcccatgtaaggagctgagttcttaaagactgaagacaggctattctctggagaaaaataaaatggaaattgtactttaaaaaaaaaatttctttaaatagctgcgtatttttctggaactgtacatttctgtaaatctccaatcaccttatgactctggttcttactaaagttttattcctttaaaaaataccttgttagtcttgcagattgtttcccaagacttcagtaggcttataggaattctaggtagcttcaatatggacatttgtcctacagcaattagtaatagtccccatttccagtatcaactcttaaaactccttttcatagtaataagcctattcagcactttggacagtgcctaacacactcagtaagtatttgtggaatgagaagtaagtgaacagtcacagagaatgacttggacatatatctgcctgtaacaagtactatatttgctaaaattcccaatcacaaggaaactaaacaaaacctaacagaaccagccaatatagtaaagtctgtactccattgaagaattgaactttcaggttggggcaaatgggatactgtttactctcaggtttcatctaggtactattaccatcatgcttaaaactcaattgggttttgtgttgagtgtgggaataagacctttgaaaacctaattaacaaaaaattcttatctcactaatgtcaccttctatctgccaggattagacaatggtttttaagtgtctctgccattttcttttctctcagtttatctttggggttcttctccagagagaaagtcatgccactttagaagattcactcttaaactttcatttgacatggtgaaggtttataatgtactggatggtaataaaacactaggctcactattgttaccaacatgctactgttaactcattttcatgttctcttcttagaaataatgcaccattttcaaatgttaaacatattgtctattatagggcaaagttctctacagataatactactggaaactaaagtagacacagatattgaataggtgattcttcattcatgactgtatcctggtactgatttctataccaaggtatttataaaggtatgctgttttcatttcttcttcaactgattcatattattattgttataaatatcacatgcagtaaacatattaatggtaaataattgaatattcacagattgaggaacagctactatattactcttatgcttcatggacaagggaagtgtattcataaagtgaataaataagatgtgatttacaaattaagtgtaatagttattctattcacttataacatatgaaaaagttatgacttgaaaagttattctattcacttataacacatgaaaaagttatgacttgaaaatatgacttgaaaatttgtctatttaggacaaatccacagttgactgaaatagacaatggatctgaaaccactatcatttaagatatacaaacttaataaacatctattgtgttcatgttatgtgcaatgtgctttaaatataaagatgattaatagtgtagaaatttagaaagacaaataaaaaattatgatcatcaaccataccaataatttcatcatgtgtaaatgttctaaacacacaaattaaaatacagaaattttcagattttacttaaaaaaacccaatactctattatatgctattgacaagaaacctgctgtaaatacatggacatagctaggttcaaatgaaaagtacaaaagaaactaatgcagtacgaaagaaaatgcaaacaccaatcaaaaaaagcagaaacggctatactaaaataaagtaggcttcagaacagggatatggagggacattgcatagtgataaatgggctaatcaacctagaacacataacaatcttaaatatatatacatctaacaacggaacttccaaatactagaaacacaaactaatagaactaaaaggagaattaagcaaatccataattatagttagaggcttcaaaattctttgctcagcaattgataaaacaattaaactgaaaatcagtaatgacacaggaaatacgaataacactagtagtcaacttgatgtaattagtattgatagaaccctctatccaataacggcagactacatagtttattcaaatgcccaagaaatattcaccatgataaaccatattccaggccataaaacaagtcttacaaaatttaagagaattaaaattatgtaaataatgttttctggttataacatattcaagcagaaattagtaataaacaatctagaaaattccccaatatctggaaattaaataacacagaactttctaagtaattcatgggtaaaaaggcaagtcacatgggaaattataagcatttttaattttataaaattaaaaacacaacctgttaaaatttgggcgggggggcggatgtagctaaacaggcatatagaggaaaatttatagcattaactgcttctattagaaaaggaaaaagttctcaagttaatgatctagccttctatttaagaaactagaaagggaagagcaagcagaaggaagaaaataaagagcggacataaataatatgaaaaacagaaatacaatacagaaggcaatgaaacaaaaaacagttctataaaaagatcagtaaaattgataaacttctagccagagtgaccaagtagaaagaaaaaaaaaggcacaacatcaagaatgaaaagggatataggacctcaatacagatattaaaaatgtaataagagaatattaagctcaactttattaacatacataagttcaacaacttaaatgaaatggaataattctttttaagaaacaaagtaccaatgctcactcaagtggaaatggtcacctgaatagtcctacattaattaaatgaattgaatttgaagttgaagtcttcaagcaaagaaaacgttagaaagtcattacgtgagaaagacacatgcacacgcatatttatagcagccacaactctcaattgcaaaggtttggaaccaacctaagtgtccatcaaccaatgagtggataaataatatatataagacatcgattgccactcagccataaaaaggaaccaaatagtgtattttgcagcagcttggatggagctggagatgattattctaagtgaaataattcaggaaaggaaaaccaaaaatcgtatgttcccacttataagtgggagctaagctaggaggacacaaaggcataagaatgatataacagactttggggacttacggttgggggaaagttgggagggactgaaggatcaaacactacatagtgggtacagtgtacactgctcaggtgacaagtgcaccaaaatctcagaaatcacaatggaagaacttatccatgtaacaaaaaaccacctgtacaccaaaaactattggaataaaaaactaaaataaagaaagaaaactttaggcccagatggcttccctaataaatttcataaaatatttaacaacaacaaacaacgacaacaacaacatacaatttccatacaaactattacaaaaagcagaagaggagggaaaactttacgaggctagcattatcccgacacccaaatcaggcaaagacatcacaggaaaataaatctttaaaccagtgtccttcatgatcatagatgcacaaattctcaaaaacctaatagcaaatcaaatctagcaaatagacaaaagtgataatacttcatgaccaaatggagattatctcaagaatgtctagcccaacatttgaaaaatcaaccaacaactgatatcaacatccattcatggtaaaaacttgcagcaagataggcattaaaaaacatgcttgctaataggtggtaattatatatattaaaaaaaccctatagctaatttcacacttaatgtttaaaaacggaagattttcttcctaaaatcaggaacaaggcaagaggtctattttcaccactcccacccaacatactgcaagtcttagcttgtataacaacagcacaacaactataataaaaggcatataaatagaaagaaaaaaataaaatgacctttattcacagccaatatgactgtctacatagaaaatctgaagaaatctataaaaaggctatttgaactagggttgcagaatacaaagtcaacatacaaaaatcaaatgtatttcagttgtttcaatgtcaattttctccagattgagctgtggaatcaacacatttgtagtatattaaaaatatatatctgttgacaggcagggccttaggaagtctcctgggacttgtctccaactcttggcctcaagtaatcctcctgcctcagtcacccaaagtgttggaattatagacgagccaccacacctggtttggacagtctttaatacactcatgtaggaatgtagattgggagaaccattatggaaaacagtatggaggtttcaaaataaattaaaaatagaactaccatatgactcagtaatccctcttctgagcatatacccaaaggaaataaatcatcactttgttaagatattttcattcccatgttccttgcagtattgttctcaatagccaagatatggaaacaacctgtccattgatgaacaaatggattaaaaacccctgtggtacatatatacaatggaatattattcagtcccacaaaagaacgagatcttgccatttgccataacaaagataaccttggaggatattaggctaagtgaaataagccagactcagaaagaaaatattgcgttattctacctatacatggaacaaaaataatgcatttcaaatacacagagctagagaacaacaggaaatggggagatgtaggtcaaaggatacaaagtagcagatatgtaggatgaccaagtctagagatttcatgtgcaacatgaggactataggtaataaaattgtatttgacatgagattcatgccaaatgagtagattttagccaccgttgccacaaaatggataactgtgagttgctggatatgttaatttgcttcaatatagtaatctttttactatctataagtatcccataacatcatgttgtagaccttaaatatacgcaatacaatttatcaaagcaaacaaacaaaagtccccaagaaacaattgtcaatctcacgaatggaatgcgacattttggttaaactccagcactgaaaattatttccaagcattaatttgtatactgattagacatttttgtgttccatgactctttttacaattagatgttaacctgtagaaaactatataagatatagattatattttccaggtgaagatatagatgatttcttttttttaaaaatattttgtcataatttcaaggttacatagagattatcagaatagaacaaataatactcatatatcctttacccagatgatatagatacagattaatcacaatagtttcagtctaattgcctttagaacagtaaacacatttcaattaaattagcaaaaaagtattatgattatgtgttgtgctaaagtaaatgaggtttatataatgctatggaggcttcatgaatgaggccataattggcatgtaggactgcatgtcagggatgccttcactgtaagatgatatctgaggtacactttgatgagtgaggtcaccaaggacctcccaaatgctgaagtcactgcttttatctcccctaccccctaagttttgtgttgcatttcatatttctgaaaatattattaatcagcttgaactaaacagcaacacttgaaattcaggtgttttatcatcaaaatacacatttcactcttctcttgaaacatcagaatataaggcaacatttggtttgcatacaagcagggcaacagttagctggatctcagcaggggctgattcctaggcataagaggcatactcttctgatttgcaagcatagcaggcattatgttttcttgatccctgcatgtgggcgaaggacttgagaaaatctgtcctgaaaacaaatgcagtatcagcactataatgaggagattctggttggggcctaaagcaaaggtttttggggtactaaacctcatactcatgaattaagctaaggactggaggaagggtttaaagaggccacaggttagtagcacaccatggctctttttttttttttctttttcttttgagatggagtctcgctctgtcacccaggctggaatgcagtggcgcaatctcagctcactgcaagctctgccgcccggattcaagccattctccttcctcagcctcccaagcagctgggactacaggcacctgccaccatgccaggctaattttttttgtatttttagtagagacagggtttcaccgtgtcagccaggatggtctcaatctcttgacctcgtgatctgcccgcctcggcctcccaaagtgctaggataccatggctcttgatgcaatcaagtgcaaatcctctctgaaggaaattgttgggagacaattctctatgggtctcatgtttctacagatcttgtgagcagaagacctgtctttgttacgaactatttttcacggatgcttgtatagtgaagagccttgaaagatagagatggtgttttcctaaggagtaaacattgggtttgtgtactatccaatacaataaagatgtttccctttggctcgtctggcaggcatgcttgctgaccatcataaaagatccagagagggacctggaattgggatgtgataactcagtggtcaagggattttgtttattagaagtgttttaattttttaacaatattaatatatttatatataatcaaagtaaatatatttatatggattttgtgtaattataaaaaattagcaaatgttcattaaccatgtatcacctcaaatcacacacattaatgatgattcttgctccaaaaattgcctttctttctttttccccaaattccagtgtgctctcttgcctcctatttttgactcctattcttttgtccataaatagatttattattttcagtatcatttttgttgttgttgtttcccgggctgaagtgcagtggtgtgctgttggctcactgcagcctccgtctactgggttcaagtgattctcctgcctcagccttccaagtagctgggactacaggcatgcaccaccacacctggctaatttttagtagagacagggtttcaccatgttggccagtctggtgtcgaactcctgacctcaaatgatccaccagcctcagcctcccaaagtgctgggattataggcatgagccaccatgcctggcctgttatttctttttagttattatttacatttattattattacaatttgagtgtctgtaatataatctgcaaagttactaacgatgaaaagaataatcattacaagtatgtttatcatgtacccatcgacttacataaactcttggcaactatgtggatcttacacgctattggagaaaatacaaatggatacaacattttggggaaaaattaggtatattttgtaaaattcatcatttgtatgtaatacaaggcagaaattctattcctagagagactcttacacatgttcaccaggagaattacatgaacatattcacagtggtattgtctatatttgtaaaattctgaaaacaactgtgatatctctagataaagaaatgaatacagacattgtggtatagtcacattactgagtatttaggtgacagtgaaaaagaaaaaatgtggtctgataaaattgaatgggtaattcttggaaacacaatattgattggaaaaagcaagtgagtacaatgacattttgataagaattttataaaaatgaaaataaaattgtgcatatgtttacaaatgtgataaaacctttaaaaagacaatacagtggtaaacacagagcaggccatgtacacatttattagcaacaggtgatgggagaggtaaaaagcaatccacgtagattaaaactatgttggtgatattctagttcttcagttgggtgctggttcataattattcattttcttatttgtctcattatctataaatatatacagagagaatgtgtctctcacatgtgtcaaaatattacacactaaaaatggaatatacgaaactgccttgtgtattgctaatcatgtttgtcttgaataagtgtctgtggactgtatcagtcttaggatttagagattattttacaaggcgatactttttatgcctgcctgggtgtgttgcaggttttggaggtaagtaacatcatcttcttcagtgtcaaagcccatataactatgtgcaaagtaggagaacaatatctacttgagttactaccgggcaggtagcagatatttgcttataggatgcatttctacaattgtaattatgtttttaagaataaaaatattccatactaggaaactacataggtgttactgaaagcgtcacgctgtgtaatggaagtgaggattacttttttatggcccatggtttctatgaatagaattaaccagacaccaattatcacctcattgaaaggataagtcactgtgacatctacagctgagatcaaactcattgcttttgcaatgtgaattaattagagttggagagagctacactgaagggtgaggaagcactgcagatttgaaaagtctatattttaagcaactcaggggaaaatctgttccaattagtgtgtgacgttaatatgcaatggtcttatttatataaaagtgctttaaagaaatacttctaaaagaaaacattaaaagagtcatacaaaatatcctctttttgtgatgattataattaaaagaatataaaaattcagaaagtagattatttatttatttttaactggcaagcaggctctacagaatggggtatctttacttgaaagcatgtgttcctgggtagtgaataaagagagatagttggcttcttaccataattcaaaaacatatcagataaatatgcctaccagcctatttggacacagcagtaggtattaccatctgctcccaaatatgcctgcaaccctgtagctcttccattttggcatcagaatttatagaaaagagcatgatgtcctaagatatactgatttctgagaagtgctttgaaaatgtatctgtagtgacacagagtagggtaaatagctgggtttgattcaaatgctactgtttattttggggaacaccacccccacatttcttcttctatgatggaacaggatgacatgacccagaagacaattctgttggtatgatcaggtagacagaacattgttcaagcagatcatagccacatttatcatttgtttgtttttaccagaaaatgaaacaaaacaaaacaaaaatttaatgacacaaacagatgtaagcatctttataggtaaaagtcctgagaaaacagtagccacattccgaagggaatgttcctgtctcaggaatatttctaggcaggtccatttccaccttcaaaattatgtattggaaatcttagtattagaatctagatataaaaatctcacagtgatgtaatatatagtacctaattttaaggagttcctgatctcatattatattattaacattgatttccaaattctcattcatactgtgtgtataatcataaacagaaatttgattgcttaagaatttataatgcgtaaattggatttcatataactatagatattttgttgtgaaagcagatttattttgttaatttttatcatacctgatcatttggaaagaataaagaagataaaaatgtttaaaaatcagcacatacaagatgtaaatatgaaatctgaaccaattggccaatgtaaaacagagagagagagagagtagagagcaggagaccagaagctttagcaaatgaacaataatgatcagcaaaacaaaacaaaacaaacccgaaacaaacaaacaaaaaaaaatgctcattatagatataaaaaaagatctttcagaaagatctgagctttaatagatgcttagggattcattgctggaagaaatttgggatattaggtagatagtagtttcttatttttaagaagacagaacattaattatagacagatgatgttcttgaatgaacagtacgatttttctggcagctctataaaaatacacctgtacagatacgattagcatcctcacctcccatgaaatcaagaatggggatggaaggtgattctgaatatattcttgatgcattaatgaggtagcagagcagagtgtgatgataaaaccaaagtgcttgctcaagattgtcatgactgacatttacaaaataggaaaactaataagagaattattatcttttgtagcacctgattaaaaaaagaattctcaagcgttaaaaaccatgtcattatccacagacaacttgaggagctaaagacttgagacatgatgtgtgcctgtcacttatgcatgttaccccactgagttattcccaaatacccatatgattaacccacatgtatagtaattgagaatatttttactttaagaaaagatgtgggagaaaattattccttaatcatacatatagaaaatcttatttcaattattccagaattctaggattacttaaaattttaatccgtattttttaaaaattgactatcctgagttattgatgtgaagtaaataatgatacctcttggctatatttgcatggaatttaaaaaacacacacaacttttttggggctaatttgacttagtgcttaacataaatgatcaaaaatggaccatctgtcaagataagaatataaccagtgcttcattggtaagcatacagactcttcttttaaatgtaaatattggcttcgtcttttatgtaattattgaagacaacagccagagattttatttcatatgttttataaatatgtaggttgtagctgctccattatttttaatagcttttcatttttgagaaagaaaatattcttacaataagagtattttctgtcatccatatatgagggcaagaaagaggcaattatgatgtgtctattctcttttgaatttaccattctatggccaccaacaggtagtgcctgagtaggggtgatgatctaaacagaagaaaatggccagtttgagccattgaaccagaatcacgctgcgggaactgtggcttcttccaagtcatccaaagataactgccagccaagggggtagagagaggtggccttcagccatttggcgttcagaagcatgtaagccagatttgctccaagagcctaatcaccatcaatcagaaagataacaactcgccctcgcattgaattggagctgaaagattcgctttcccaccagggtggctgattacgtagataatttagcccatgtggaaaaacatttaccaatgacaacattttcttaaatatacagactacaattgttttacgatgtgatcattcacggaggttactgttataagtgaccctgatttcactgtacaaattaatattttcaggaaattaaactggtagagattttttctcaattttgaaacatgacacttgggaaaaaataagaaaacaaaaacaaaataacaacaaaagcaaaatttgtgaattgctagtttccaatagaatgaattaacgctataatttgagcagagtgattttgttttcttgcaaatagaaaactaaagcaggtattgatttatttgtgtctttggtcagtttttatggtctctgtgtctttgatactgcattgtcctggctcttatttgtggaagcatgtagtaatcaaacagttttaaattaaattttctttttcagtagtgattttcctatttagaacttcctagctcttttgtacttgtcttaacagtgctggtattccaagttataactttttatttgggtgggttagccaatgtattttttaaaagtctaattaatattattttctaatgtcttacttccagacacaatttgagaaaaagggattaagggaactcctttagtcacctaatgtcattaggaaatagtttttgtttgtttttttttccattgcaccaactttacagacagcataatgatactttataaatgtctcaagccaaatgtcttttttaaaaaagatcagatctctgcttgagttagcatgaaaaaattttcgtaagtaattatggagtaaaacaaaatgtggaataaacaagtaaatatatgatgaacttatatatgttaaatgagaatgtattattttaaagaaagcaattgctcacactagttcttggtttcaatgttgcaaaaatctaaagaaaaaaatttagcatatcctttccttctttagcgtatcctttgcttccataagaaaaaaaaaaatcaaagaggtgacaatgaactttctccaatttttgcaagtacctcacctttccattaaaagtggagcaatttggctgggaatggtggctcatgcctgtaataccagcccttttggaggccaagatgggtggataccttaagcccaggagtttgagaccagcttgggcaacacgatgaaaccctgtctctacaaaaaatacaaaaaattagctgggcgtggtgatgtgcacctgtattcccagataccctggaggctgaggtgagaagatcgctggagccttgggaggcagaggttgcagcgagccaagatgttgccactgcaccccagcctgggccatagagcaagaccctgtctcaaaaaattaataaataaataaaaaagatgaagcagttcttccaaacacacagtaatttctgtttataaattgattttgataataccattatcaaaaaggaccatcagatatagcctggcttggcaaatttttctgtataggactaaatagtagatactttaggctttgtgggctatccagtcttttgtgactactcaactctgctgttgtggcatcaaagcattcagacaatagtaatcacataagtgtggctgtgttccaataaaacttcgttggtgggcaaaaaaattcaaaattcatgtaattatcatgtatcattcttttgaatttttttccccaaacatataaaaatgtaaaaatcatttttagaatatgggctctataaaaacagataaggtaagtagacaggaagatggctttagccaacagatagtgtgccaattcctgagatgaataattaagtcttggctaacatatatactccattcctactcaggtaggtgttttataaaggctgtttaatggtaatcaaatttgcaaaaccgttatttccaaagatactcaagcccactgtaattttcactgaatgccagtgctgtcagctaaaacaagtgctgtaagaaccatgttggacagtatctaacctcatgaaacaggagcttaaagataagttctcatgatgaattgtattgaattacttggtgctcagtgtctctttgtttacttcctgcctcgctgatattaagctatgcattcatccacctagtcattttgtcatttctttgttcattctatcgctccacattcaatgctaagcactttcctatgcactcgggaaacaggggagttcgacgtgattcctgaactgcaagaattgataatagccacgagtgagacaaacaaactggtggctggattccagtgtgataagtgtgagataggaaaagataattgccacaaaagagaacggatgctgtgcacaacacagaaagtaaaatgaagacttcagagaaacaaatccgtttaggacattaaaagaagagaattcttcctgccaacagcctcagataatacatatcctatttatttatgcaacattgtagcaattttctgcatctttcacagacagaattttagggatgaaagacatcctaataataacttctttgaattctcaaattttaactgatgaggaaaaagtggccctgagagaagtgagaagttcaaggtcatccagctcttgagaggtggccttattcaactccaaagctcttcagtgccaactcagcattgttttcactaagcctttcatacctcttccatagcttttcaatgattatgcattgttgattttgttgattctctcttttctatgcagattctctaagtcaactttcagagctcttaccttttcttcagtgattccttagtgactatagttgataaaaattgagaaaatgcagttggaactaatgcacaaaggatgttccctttaaaaaattttctgctgatctgaagtaaaaacacaactacctcagctctcagactcagcatattgtcttcttcattccaggttactccataaattgaaattatcgtcatttgtggctctcacaagattagaggtgactgagtacttcatcaactaagatcagaatttcccatggcacaaaacaaaacacttgtataatgatctaggagagtggattaaacatactgaatgagagagctacacactgaaaatgttcaggggattatcagtgtagcttttcaaatccattcaatgaaagtgaaattgatgtggctttgcttaagtgtcagtaccattttggggtctgaacttttatatttctgacttcctgctattttaactgtaaagaaaagaatccacactctttacttagctacgactccacccagtgctctttttggtacattcagggttgggaagtggagggaagcattcaacttcctaaggcagaatctctgtagacctgcagggtcttagagttattgtgcttttctctaggacatcataattagaaaagggggggtcgatggctgagatacctggaagaatttccaaaggttgaacatggcaactacaactacaacatagcaagagcttcgtaggaaaccttactcatcatttttgttatccacttagtgggtcactgtgttatagggcttcaggtacatagtttcatttaatctatgttgaatcctatgaaacagcccctattctccccatgcatctcagtcacatctgcagtggagggaagtacacaggatttggaaatgaaggttataataataatatcaataatattaatacaataataacaataggcatgtaccatttgtgttttagggattcttataaatattaatacttaatatgttaatttatttaatctttccagcatccataagagttatgatcctcactttaaaattataagctatagttaaatatgcctaaagttaataagtaaaagagcaagagtttggaaccaggcgatccgactttagaggtcacatagaaataccaccatactacagagaagctcccacaaaaggcagccgatggaggggtgtttatatttgctgttaacctatattccataggcaaaaaaaaaaaaaaaaaaaaaaaggtttcatctgcaggctcctacctaagtttaataggtgtataatttgccaatagaatttaagaaatattgagcaaactctgtagttggtgatttaaatgctcatttaaaaaatttcaatacatgatagttgttctttctccatgtattttttaatgaaatctatcccttatccacctccatggattggaattgttttgttctatctcttattatccttgaatatacctcagcatagacagtgtgacataatgtctgtatgtgtttgtgataacttaatctaccttctatgggagatcagttggcctaattgggagaacagtctccaaggacagctagcattttaaaacttctaatctgaagcccactttctaaaagtatgctcttcagctatctttatctttaagatttttatgtctgattaacatcagaggttttatggattagcataacagatatattagaaattatttttttgttactcacatgaggatatgagtaatggaagtattgtaggaatagagtgtaagaatctagagactaggtggcctgtatcttttagaaggaggccaaaagccagactttgaaataatctagtatacacccattgattctgaagatacttgctgccacactaaattctgctgctagaatattggttgcatttccttcaagcaaatttgtcacactgctggcgttaaaacactaagaatgtaccgaacaagctgcatgcttgattgccaataagtgtttgtatgtgtgaccaaatttcatctaccagccttgtttttactataatgtggttgtaggaagagacttataacctttacctgactctactattgaaacttttatttaccacttggaacctactagttgtgaatgatccattgccttagatcagattgtggcaggagtctgtgtgtgcacacacatgcacatacacacacacaggagaaaagtgaaataaaagggaggaagtaggtgagagaatcaggctgccaactgtttatatatggacttacttgtccttgtcccctttggttggaaagtttttcatccacaaattctcctgaatttcttacagtgatcaggccatttgtcttttgctacagagatgatagcacattctttatgatatacacttaactacagttgttcatacccctgtcaccttcaggattgatgactcaaaagcactctccttcagactaccatgccaacttacatgcctttatttgttctttgaaagcctgtgttgtgtatatttcatggaaaaatctggtttaaatgttcttccttttactttttacacatgacaaatgttcaagccacttttctccctcaaaattttcattaatattgctttcttcctttcttctaatgttgccatgcttcttcctcatgtctttgaaatcagaaaaccatttagtaaacagtgtcataaatacttcttaaaacccttagggctcatatcacggaatactatttccaagcctgcagcatcatagttttcttaagttacagtttttcctgtaaaacttatattatttacgtttgtctgtatgaattaagtattctctccccagaatggcatttcttgaatttttctccctaccttttgttttcattttcttctttaaatgtagctataatctgtttcaacaaggggtgaagatacattgtagaaccaacagaaaccttcatttgacccagcagaggaaataaatttagtattaacatgagcggttgcattagtttaggtaggctgtgctatgctgcaatgaaaaacaatccatggtaacaaatttactaaacaaatttatacaacaaattctttctcactcttacaaagtccacccaaggttgagggactctccaggttgactctcctctatgtagtgactcacggatccaggctgcttttatcttgggcttatgccacttataacacttggcttttatggtaaccgaagcaatggaaaaaaacagttggaaagttatctaccagatcttaaatgctttacccaagagtaatacaaattacttctttttacagcacattgaccagaccaagtcaccaatgactgcctaactgcaaggggactataaataccaggtgagcagtaatcatctctgcctagtgctttcctagagcaagcactgtgtaactgctgaggccctctggcaccaactccactcagtctggtcgggggagcaatggaatgcaactaaatagttacaattagcatgcctctgtcattcagagttatccttttaattaactggcatttccacttagagatacgactggcatctcattcaactgaacccaatttccctctcccccactctttgcaaagtgctattcgtttataaagtagtcagcctgttcctctcctttaggcaagaataaataaaatgatatggggatggggtggtgaagttttgatgagttccttccttagcaataaaccatgagggaagaattccaacagtacctccatatttataagattgtatcctgctatggattaggatcttgagagctttaaaatagtttctcaacttttaaaccttgctaagcttgttatactctatctatatctatgtagagattagcagcaaagcctttaaaaatgtagcatctgtgcatttttctttcaggactacagtaaggagaagggaaatctggggtgctgaagaatggtcatgaagagaggctatggtgtcagtaagctctgagatgaaatttctctcactgttgcctatgaactgtttgatcttgaataagttcattggcatctgtattgctctaaaatgaagatgcaaagacctacctcagcagtagttgtgaggatgaaataagaaaatgtacccaaagcatttagtggcaagcatcaacgaatagtggccatcaatataattgttaatactaataatcataacagttatactgcagagagtaggagaagagagccacaaagagctcagtctgggtggaggtctaggagatggccctgattttagtagtggaaatatttgcaagaaggtttgaggcctcctcttatattcttcttggatgatatctttctaatatttttccatctttctgcgaatgaaatagagttgtttaatatcaacatttattttctttttgattctgcctagatatggtggccttcttggtctgagttggagagtctggggatgtgccaggaatactgggtcaatagaaggaaagcttagattttgaaaatcgatatgtagactgaagatgagggagacatttctataagggtcacagggacagaggaaaagcaatatgaggtagatctgggggtactcaacgaaatgagcttggcaccaaaccaggagctccaaagagacactacagaagtcaaggcttagatggggacaggaatgacttcatggctcctttcacagaaaatgttatggcatggggagaagaaaaggaatcgtattgtagtctcaaaggacttcattatttgtttaaaggatagtagtatgtatactgctactatggcattctcaagattttgcttggttctctctccatttcacttacttttaatactggtgacacccaaataaaaaccccagcacacgtctttaggtcagtttttctcaaagaatagtccccagaccagcaacttcaacatcatctgggagcattatagatatgcaaattcttgagccccacctcagaatcagaaactttgggtgtgaggcccaggaatctgtgttttcaacaagtcctcttggtgactctgttgcacacaaagtctgagagccaaattgttacagagtatatcacatatttctcatattcagtatgctccaaatgtgactcacctcttcttctccactcttgctaaccatacccagtcccactgtttttacaaaaatatttcctccttaagaccagaggctcaagtcagaaacttgaatttctactctacttcttacccacccatcaaataaaatctccaaattatcaaatcaccaaatagctctcaaatatatcctcttatctccctgcccacagaccaccatcaactcagcctgtactttggaaagtcttctctgaaccactattttgtgccaggcattttgttaagccagagtcagcaactatagatggcaagacaaatccagcttatgcctgtttttgtaaataagattttactagaatgtagccacaatcattcattttcatatcacctgtggcttttgtgtgtgtttgtttcactgcaacagagtagttgtgacagagactgtatggcccacaatatctaaattaatctttactatctggtcctgtacagaaaagctttaccgatctctgtgattggcactgggtactggagagaaagatgccatctacatcctcatggagctgacagtccaacagggaagatcagaagttaaagtgagctatctagttatctaggtcaggaacatctgacctacactatggggaaccagaaaggatttccagggaaagtgaggtgaagctgagtttcaaaggataaatagaaattcattagataaagaaaaaaaaaaaaaagaaaagtgttcaaaccagtggaaataccttttttttttttttttgatagcttctctcagctcttagtctaatcctcagtacattctgattttttaacctagctgactgttcaatgatcaccttataaaatccagtgagtctaagtctttagaaccggaatcttctgatcgccgccttcctagatggtttttctgtgcctgctgggtgagtcctcactttggatgtggtcagtcgtgattcaggtagcactggaacaccactttcgagcaccccaaacaacccacattaagactctaaacaaattgcttcctgcaaggccaatacacactttgggaattgccaaaagtagtaactatcagattgcattttacatctggtaaaagtgacctggatagaagagtactggtgtaacagttttgcccaagggtctgtggccttttgctcaaatgttttcagaggcaaattatacacaagatctgaaattattttggccacatatttatttttttcctagtgaaaattcttttcctttttgtggagacgcttgaggaaaacattttttaaaaaaactcaagaaaatatatctgaaataattatagaagaatttacttcctttacttttttctctatttccactgcatgatacaaaacaaaacaagaaaacctttcctctgctcattaaggacgactgcttcataggcactttctttctttctcctaggagaaaagaaggtgcaaaaatgggggtccaggccattgccatggggagtccaggctccaacaatttgtggctagagccatttttcttctcattttgctgtaacctcctctgcttttactgctgccccaacatctcaggtaaaacacatattcattctctttcctgtctacaaagccatgctagaataattccacctgttttgtagctggcactgatcctttttggcatgaaaaatggaaacactgggaccgtgaaagcactgtctacatttccagcatctcactgggtgccctcctctagctaataacttgctcccatccaaatggtacattttcacttcaggcagggatgtctctggatgactgttttagaggtagaagtagttaggggatctgagacacttcttaattttcccctcctctccagcctctaacattcctcatgaatcagatcactgactgctcgctgctttttttcctgcacagcctgctttggttatcaccagcattactttcaatcatgttgcagatctagctgattaaaaacactggccttgagaaaattctctttcttagaagtcaatgcttgaaggagattaggactatttatattgtaaggcactccctgaaagcctctggtggctttactctcttgactgatgcaaacctcgactaattctctttatccagataatccactcacttccaatattcatcaaatggcaaaatgaaaagcttttaagaaagagaataaatgtgcaggcttaaaatcacatagaattttagtcttaacaaaattgtgagagaaattatgggaaatcagggttctgaatcctatttccaatgagataacataaaagcagataaaattcatgggaccatagcaaatatgtttcgtatctcttgaattactttagcaggtgtttcgattacaaacctttgatgaggaaaaaaatgtgtttttctttctctgataagatcacaataggacaaacttttagaaatctgagctcctatttttttcttttttttttgtttgagacagagtctctttctgtcacctaggcttcagtgcaggggctcaattatagctcactgcagcctcaaacacctggacccaagtgatcctcctccctcagcctcccaagtggctagaactatggatgtgtaccaccatgcccggctaattaaaaaatatatatatattattttttagagatggggtctcactatgttgcccagactggtctcaaatcctgggctgaagttatccttctgcttcagccccccgaggtgctacaattacaagtgtgagccaccatgcccagccatacttcatttttatacatgaaattatctattgcatccatctttccatctgatgcttatattaagtatattcgatatttactatgcagtgaccacacacaaggtactaacaaataaagggggagagtgttgtcctaaaggagtttccagtattatagtaaagactgatggagtcattctgagttaggccagaaaactaggggaagctaaaataatcaaagtcagtcttttctctgattcaatcatttctatggcattaagagaaacaaaacatggtgagaaaagggatgttttttgaagtggtgacatctagaactccagtcccagatttgtgtaattagtagttagttaaacaggcttctgtgaactaaaagcggtgtcaatcatacctctgcatctgttactctgggttaggggtaacatgtaggatgatgctacaagattcttactagtgctgccagggtctcagcaaggcatatcaaaggattttccaagaatattcacaaagtagtgtagccattttattacactttgaagaattctgaccaaaaatgtaaaatgaaagaaaataaaaactcagttctctttatagatagcaatatgctatagtaaggtatcaactggcttagtattcaccaaaaaatgctctgatatttggagcaaaagagtatgagaagaatggtctgttgatggaaggagctagcaggtttcttttccaggtttactctatatttgacaagtgggctgtttctggcaagttgaataaagtggtgagaatcactataagagaacaaacagaagagctataaaccatatccttttgacctgaattttcaaacagaaaaactatcatttaaagtttagtcaatgcaaacaaaacaagaagactgcaggccaatcatgttgcctttaaggtctgattccaattactcaggtttctacagggtagttcgggtgcaaacagggatgggtattgatggccatacagttgaaacgagggcacttatgtctgtgtatgtatcctgttatatctccataatgaaacaatgaatgtgctgaattgtaaaatgataagaatcgtttttagaggccttagcctaggaaaggccccttacactcggaaaatcctattcagggcttgtacaacatgtaaaacctcagtgggatcatttggtcctgtaggtgggcacaatctgaaggtatctgaataagggagggaggtaagctgatttcatcttggctaacactttttaaccacatcaacatgaatattgacattctcctgagacccagtgtatatgtcatagcaatctcttattcattcctggggactttatggtcctgaggataaaagatgcttggactgcctcccttcccccgacaaagatttcaagatactccctgaacaaaaattttacaagctccaaaaaataaggaaaaaaatcaatgtaacccttttgcctcctctttctatagttaagcagatggccggcattagggggagatggctttgaaacgggtcccagttcgtatgcatctatgggccttgggcattatctagaagatacgttattctaggtggaagctcccatgcagattataggacatttagggaaacgttctcttgaatttgaatttaaactgtgctgagctcaagaatcagtgttgttcttaggagactctgcatatacaatggttatctacatttcatggttgtgcgcagattttagagaggaccgtgtataaggtatccaaacaaagcttgggtggctgtcctgaactggagctcagaaagatcactttacttacactctagtctacggtgttgttggaggtagaataattttttactttggtaaaggtatttctggtggttattctatttcgcagattctctgaagggaagaggtttgaagaaggaagcctacagggcagggaagcaagttcagagattggggtatgttcctaattgtagagggtttcatttgggatgctttttacttacgttttgaaaataatcttacatagaggataattatttccatgacatgaacagacatttctcaaaagaagataaacaaatggccgacaaacataggaaaaaatgttcaccatcactaatcatcaggaaaatacaaaataaaaccgcaaggagagaccaccttaccccagccagaatggcttttactaaaaagtaaaaaacaatagacgcttgcatgaatgaagtgaaaaggcaatgcttatacactgttggtgggaatgtaaattactacagcctctatggaaaacaatatgtagatttctcaaagaactgaaagaagatctatcattcaatctagcaatcccactggtatgtatctacccaaaagaaaataactcattttataaaaaagacacctgcatgcctatgtttatcacaacacaattcagttttaaagacacagaatccaatctaatgctcatcaactgatgagtggataaagaaaatgtggttgcatgtgtatgttcatcaaagcactactcagaatagcaaagtcatggaatcaacttaggtgtccatcaatagtggatttgatatagaaaatgtatatacccatcatggaatactacacagccataaaaagaatgaaattatatcctttgcagcaacatgtgtatagctggaggcccttatcctaagataattagcacaggaacagaaaatcaaatactgcatgttgtcacttataagtgagctaaacattggatacacatggacatgaagatgggaacaacagacactgagagggtgactggaaggaggggaagggttgaaaaatgacctattgggtactatgctcactacctgggtaacgggatcattcatatctgaaacctcaacatcacacaatatactcacgtaacaaactgctcatgtactccctgaatctaaaataaaagttgaaattatttaaaaaataagaaaatgtggtgtgtatataaatatatacttactatggaatactattcagccataaatacagacaaaataatgtcttttgcagcaacttggatggtgctggaggccattatcctaagcaaagtaattcaggaatggaaaaccaaataccacatgttctcactcataagtgagagctcagctgagtatgcacatgcatacagggtggtataatggacatgagagagtcagaagtggggagggtaggaggggctgagggatgaaaagttacctactgattatgatgtacactatttgggtgatgggtacactaaaagcccagacttcaccactatacaattcatccatgtaacccaaaaccatttgtatccctaaagctgttgaatttttcttaaatgcattttagcaaagtctcatgcacccaaaaaccttttatttacttattgtttttcttgggggggaagggaaagagatggttattttcaagcaatctttcagatcttaccttaaatcttccttgcacagaaaatgctcctctacatgcagaggatcaagttcttcaattattatctcctccagataccttgtgcttttcattcctagtgcttgccacagtttgtaattaaatgtatgtaattattcaattaatccagagcattgttttctcactattggctttccaatgcttgttaccatgcctgacccatagtatggatacatatttgtccaataaatgataaatgctcagggtgtgtgtgtgtcacagttggggagaagagcgtgagatgggagaaacaggacagatacaggctttactccttcccaaatatattaaaggaaggtgactcctgaaagcagaaggatgctatctggacactgaatagaaactctgaagtaatttttgagcttgttgaatttttagcatgttttaactggaatctgatctaaaattagtatctttttccagcagagagctcaggaaattaagtttttttttttttttgtactttcagggtatgattaacttatacccaagtaattaattcgtgagtacaaaagcactgttagatttgtaaaacatagctccattgtgccttaatactttcattgacatcttgttttacttactaacctaccattttaataacttaaaacacttgttgtacttaagcataggaaagtgattcaaatgagataatgcacatgaaatggtgataccccacaagacactatatatgcagctattttaaaatcattttataattgaaaatttcactaaatactttggacactccaaatgtaaagttggtaggccaactgaggaacaagatcttttatttttctctttatcactttatctttgtacatgccaagagccatgcagcaacctcattactgaatgaaagtttactaaataaagaaaagaataaataaaagaatgaatccctagtctttcctagaataaactgaacttaggaagctttattttaatgttaatatgccaagaaaaaaaatatttcagaagataaaaccaactgtaaaatcatgggtggtatttttggaaacaatgaacctgtcatttgtcccattgcttgaaaaaccaaactgatgcattaccttgaatgtatggtagaggcaaagaaaatttaaaaaaaaaaatgaagggatggatccaggttttgtggcatctgaagtttacacgatgttgatgctgtttttttggaaaaataaattttaaaattacaactataaatttaactacacgttcttagacagggacatgcaagtgagggacctgaagcacaactgaagcataaactccctggcttcaggccaaatcagcttctggcaggttggacagagaaacacccacacttgggtttttgatcattgcattacctaaacaattgctacaacttttgactgtggctctgcaggatttgaaagatgcataacactataaaagtatttaaatatgcttttaggtatggcaagctatcaaaataatatgcaagtaaaaatactgtctcaattattagcaggatctacctgagaatacatggtaagcttgatcccaaacctgtatagattcacaagcggagtgaacagatatgatccatttagccccacttaactgaccattttctgcagaagttatagtgggaatagaaaaatcctgcccaatttcacactacatgcacagtgatttagtacccagcaactttttagtcacacactggcttcctatctactttttaggaaggtctgtttttattctttatgtcaagaatctaaatagctattctagtagcctgcataatggaaacagactggaatcttccagcattactcatacatctcctcccttaaaaaatgaaaataaagttcttatatgtataaagatgcagctttcctctattgagacgacagggttttgctggtggcctgaaagttacttgcaagcatagacagctgataattgaacaaataaggtgactaaaaagcagtgagctcaatataccctgccctttttatttttataatttcaattccaaatgatcagtgaaggatgaagtacttattctaccttaaagtaaataataagagcattttattttttaacagaatagaaacccaacactcccattatttctaacaaaagtgatgcacatgaaatcacaccacattttactccacaattacaaagggaagttagagggcctaaagttgtagtagcggacatggacattattcacctaaaaatatactaaggataatatatttccatgtcatatggaaagaccaagacagccaaattaatggggacaaatgtaatcttttcttcagcaacatgaaaaatatgctaacaaacttgtatgttctttagtatgtcctgctgggttctctgcagaagtgaagtgaattggtttaaccttgttgagtttatcttattatgactccttatcattttataggtttaccatgttagtcaccagtctaagttattgcagaaaccagttagttgttttcctaaaaccagctggcctagtttctatctattgctttttaacaataacaaaaaaatgagccttccttccaatgtctcagaaatctgatttagcaaaaatggtgagggtgaggagataactctttgggttgtgatatatttacatgaaactctattttctggacaaaattaaagagattcatattgaaatccaggcacagaatcagaatctcagaaacattcctgcaaaaatatttactttgcaagattagatgactaccaattcagattctgtgattttttttttttttaagaagtctcagtctgtagcccaagctggagtgcagtggcacaatctcggctcactgcaacctcccaggttcaagcgattctcctgcctcagcctcctgagtagctgggactacaggcgcgtgccaccacacctggctgattttttgtattttagtagagacggggtttcaccatgttgcccagggtggtctcgaacttctgagctcagatgatccactggcctcagcctcccaaagtgctaggattacaggagtaagccaccatgccttgccagattctgtgattttttttttttttaatctcacagagaaagatgactacacatgaaagtgtattgtacttgggagatggacaccctaactactctgactagatcgctatgcattatatacattaaaaaaattctcatgcactccatacatttgcacaaataaaaagaaatttgtgtttgggacataatggttgaatgcataccattttctaaactgtgttctgtaaaacatttttccttgaaagatgccaacaggtagacatcaagtaaagagcccatggtctaaatagcaaatgatgtgcctgattatatttcatctactggaaattcacagtgcacattggcatcttgaaggcttttggaagtcatagagaagtactagactgaagaaatctgttcaccaaatttatttgaagaaagatgtcatttaagtgcttattaataacatcttgcagaacagtgtatgggggagcatcagcttgggaaatgctgaatcagtaattacatggagaccgtgatgatatatgccatcaggcacttgtggtgctttagaaagctctaaaaagaacctccaaggaactctgcagcactcaggcaatctgcctcattaccatcaattatcattgactcctgtatacatacgtgacatatggagctatggaaaagtctgtcaaatatgaaagctgtgcatgcctccattgcatataaaagctacctctttagatttagtcaaacatttgcagagttcctgagttaggtggtattctataagctacctgcgtaagtggttctcaatcatgaagcagatcatctggagaggagggtaaaaattcatcttctcaggtcccagcaccggtgagtctgactgagtagatttgaagtagcacctgtatattcataactttaaatttccttcaggtattcttttatatagccaaatttgggaactactggtctaggccagattttccaaggatcatgtgtacaacatttccatagattgtgacagctaagtctaaacgtttccaagggttggtatcactgttagaaactcttccttgcttgaatctaaaatgcaactaagaactatcactttctcattgcttactaagtgctaagcaatacactaatcactctcaggaattattttgtttaactgtcacaacaatgctgtaatgaagatattattattatctgcttttagcggtgaggaaaagaaaacgtacagaggttatataacacctccaggagtccaattttcagttcaaatacttattgaaagtcaggataatttctcttgtagtaaacagaacataagaaacatggcatagatgctgtcatagtcaccaactatttatggaaatgtgacaaaaagtatttttatttgaaaatctccattcttgtaatgtaaactaatacagctgctgtggaaaacagtgtggagattccttgaagaactaaaagtagaactgccaattgattgagcaatgacactactgggtatctacccagaggaaaagaagttattattcgaaaaagatacttgcacacgcatgtttatagcagcacaagtcacaataggaaaattgtggaaccaatccaaatgcccatcaatcaacaaagaaactttggtatatatatatatacacgatagaatactactcagccatacaaaggaatgaattaacagcatttgcaatgacctggatgagtttagagactattattctaagtgaagtaactcaagaatggaaaaccaaacattgtatgttctcactgatttgtgggagctaagctatgaggacgcagaagcctaagaaggatacaatggactttggggacttggtgggaagtgtgggaggggggcgagggataaaagacaacagatatggtgcagtgtatactgctcaggtgatgggtgcatcaggttctcacaaatctccactaaataacttactcatgtaaccaaataccacctgtatcccaataacttatggaaaaataaaataaaataaagaaaatctccattcttgtaaaaaaacttgatcagatatattttggctcatgttctgaacaatattattcaatgtaggaatctctctaaagagttttgtagtctacaagcccaagaaaagtttaatgagcatcaagatatttgctatcactatttatttaatgttcccagaatttgttacatgaggggagactccctctctactccacccataaaaggtactagccatttatgatagaaaacaaaaaaagtagatccttgaaaagtgattcatgattaacagtagcagacttcatatgttcctcagtgatatctggtttcctgagatcttacagtgaaatgatgtgttacaaaagagttattgttactcatcagatattatttctagctttgctgattaagagaagcaacacttattcagtatcttgtctttggaaagacacacctatatgggaggatcctttgccttttaaaacaagaatttctattttattttgtttatttctatctacataactacaaaaaatcaaagatatataatatttcaaagaagaatcttaatatatgatagaaatggatgagtcagcaaatgtcctaaatttatgaatgcagaattagcctaaatctgaaaaccatcagaaggcattgctctatttttttcctttttagtcagatctccatcttgggttttattttggactcctcttcattcctaacataattttagctaaatgtttaagaggattttaagcttcactatttctaagtgtcctcccatcttgaaatgctatgacacttgccgcagtacatgacatgaacatatggtgatttggctcagaagtccagataaccttggattgaaatcctgtgtttctcatttagctacgttctgttttacagatatggactatacccatactctcatctaatgtttatgccagtgcatggagtaacgtgcaagggtatgaacaattctgggaaaactcatctcctccctggataaacagtacaaacccaatcccatttccagtgatgattaaaaataatctttgtacaaaaagggtaacctaccactattaatacagttacaccatttatttaaaaagaaatagagtttgtgacatggggaaaatggcattgctatatccacaaggcacttaaattcactgtttttgttgttgttgttgttgtttgtttgttttagcaagcctgatatctttggacagaaggagaaatgagaaccgaagcaggactgctctgtttgtgcagcagaatcctccatttttggtggaaaagtgtctgccatttgatgaacactgaaacactaatattttcatttgcggttagatttagggtcagtcatgcagtcatggcctcatgccatctgtgccatgtcactccaactcaggtacaaaaatgcaattctggtattggaaacccaggtgttggagctaggacatttctctgaaatgctagcaccatttccccttcagcaagctgtgtgtgtcctttccagttctccttaggcatgatataaaaagagtatttttaatttaactcctcagtacaataagtcgcatattaactatcagtagactgacagctacatgctatggaaaatcaccaggcttattgtagtccagattagaaagagaatacagaactctgctgcctcagctacatacaatcagatatgtacagagaaacattttttttttccaatggcatcaagaaagccacatgttgttagcaaagtaaccagcccatagactgataaaaactgaacatattatatcttagaggttaaaaagcaattatactttctcgagtgaaaccttgggtatttcagaacaaaagggtgtagcttgctttactttacatcaaattatacgagaaaatatttccagaatgaaaggaagacaacatttgttgaaaggtagattccaaagtcatcacatgcaaatttagaatatcaaaaattattttgatgaggggtcaacaggaatagccacaatgaatcacagtcaaccacattgtgtgagtgggaaatcatgatgtcatatcagatgaataggagacaaagagaatatctaagctaaagcacacctcagaaaaagtaaattgaccagtgggcagctattggtttatgtaggcatattgtctaaaaggtggggtgggggagggaggttaagtagttttggtaaactgcctaggaagttaataccactagtaagcaaggcatcaagcaatcatggatataattaccttttatctacatatctgtgtaaggaaacaagaacatcagtcatatcaactttaagtatatgtcacacattataaagtattatgccatagatgcctttgatgcaacagtagacattttcctgggagaggtattggatagtaacaaatactggaaaaagtagcttttaagataattctcattaagtgttacttacatatattagtaagattctttctaactatctatctatctaatcatttccttgtgccaaaatgagaattcctagatttatctaaataactatcttaaaatagatgcaaaaataccaccatataatcaatatatttactgatgcatttctaatatggttggtcaaagacagactgaaattagaccagagaagaaatgacaaaatggccataattgctttcaagacaattataagactaaaaacaatcaagcaattatagactctcagctctaaaattgcctttaaaaaaatacaaagaactaacaaaaccgaactgttcagctcataccaaatctgcttcatttgattcccggtgagttcagacctggtggctgctatttcaagcctcatttctttttgacctcaaataataaagttgaagtcagccagtttccattcagccttgttgcattgtttgccagtttataaggctttatgtttgtaccaaaaatgttacaggaggaaaaccacaaagaagtcacaaatctgggcaattttccctatattacacagatgttaaaattgttgcaaaagttgccaaccactggacatacttgacagcaggaaataatccaaacaatgaaaattccagtcactattttgttaactcgttataacaagagactgctgtattgagcaactggttcctctccctaccttccttttctgtcttcctgccatccctcccttcatccactgtctatccattttctagtatcatctgtatgctcccttaagcttctcagtctaacagaaaaagacaaatgtaaaaagaaaaaaacccatgacaatataaatttatctgagcctggatttctcaacagtagagcagctatccttagcagaactggctccttacttagcagagtgggccactcctaagcagtatggtcagagagtctaacaaatccctgcttgactttatattacctagccaaacttcctgtcatgggagcacctcgctgccagagaagggctgatatttctaccattaaagccatttcaacttggtgtcaagacatactgtgagaattaccttgtgtgaaggctttctctaatttgctctctcactccattaccattcagttgcagtttgactttctttcttcccacagtacctgtgcttacctctcggttagcatttccctcacagtgctgcaattgtctgagaaaagcagtatctcccacttcagactatgagccttcagggcaaggactttaccttttatattagtttcacaacaggtagcaagatatctggcacaaaataggtgctcaagaaatacttcttgaataatttcattagaaaacatagcctcccaggtgagaatcactgatctaaacaattcagctaatatttactgagtatgtactatgtttcaagcactaggtacaattatgtgtggcagaaataaaaaatccatgccctcatagaactatatatactccaagagaggggacatacaacacacaaacaacaaataaagagtatcatcaaataaagactcaatggggtaaagttgttttaggctgtgatgactttactgaggaggtgacctttgagctgaaacatgaaagaaatggagccagccaagtgaacagcaaggggtgaatggtccaggcagaagggacagttgtgttaagatgagtaagagcttagggtgctccaggtacagaatggagggtatcatgcctacagcattgccaaccagggaagaatagtaagagatgagatttaccctgttggtggtgccagattatacagagcttttaaaggaaagctaggagttaggcttttattttaggagcaatggaaactctttgtaggattttaagcaggagggggatataagccacaatttattttagatcgataatgtcttggtcagtgatgcagaaaatacactgaagctaacgacagaggaattaggggcaggattcaaaacatttagcaattcctatagcctttggcatttatcaatcagaaaagttgccaaccggtcagaaggaacactgtccaataggccataatatttgaatataagctgaatacagtaagtcctcacctatatcaaggatagctttttagaaattgtgactttaagtgaaacgacatacaatgaaactgattttaccataggttaactgatataaacaagattaaaatttctatggcatacttattgtcacaaaaagttagaaaaacttctaaataaagattcaaaacatttcaaatattaaacagtgaaattaatgtgagttatatatacatttaagaaagattaatgaaaacaagatagtcactcaatttttggtgaatcactgagtgatggtagttgtagtggtagtaaggtaaatcaggaaataattgatggtaaagtgaaaattttaagaagttcttgctattgtctcacagctcaaagacaatcactgaatgcttttgtactgcttcatttgttgttgtgcatttgtaagattattgtaatcctacacatttttatttgacaataatttgtattcgttcattcatgcattcactctttaacccatttattccagtttaggaatgcaggtggctggagcccatcctagcatctaagagcacaaggaacaaacccagaacaggatgccatcccatcgcagagcacattcacacacacacatacacacacaggtacacacacacacactcaggctgggaccatgtacacatgcacaaggaacaaacccagaacaggttgccatcccattgcaaagcacactcacacacacatacacacacaggtacccacacacacactcaggctgggaccatgtacacatgctgactcacctcatgtgcacttctttgggatgtatgggaaaacgagaatacctggaaaaaatccacaccaacatggggaaaatgtgcaaactccacatagacagtgacccagctgggaattgattgcttttctcatcaatgttataatgaaacaacgttgaacaaaatgacatgatttgagaactgctgtagttagttaacctcataacaaacagtgagagataatggtagtatgaactaggtggacagtgtaagtatgaagagaaatgaattgatataaaatatactgggaagctataactgacaagacttgcagataatttagacagaaggggtccttaggcaagggagaaatgtttggtaaacaaaactgaaaggtttgacttgagcaatcaatgataatggatgtctattccactttagtaaagactagtccaaagttctgtttttaacatgataaagttagatgtctataccacattcagatatatgctaaataagggaatgagctttcatatttgagccaaaggtagtggtcaagacgggaggtgtaaatttatatatacatgtatcagtctttcatcgaatgtctggaagagattacctcgggaaagagtaaagaaaataagttcagaaaaaataaaatatgaaggaaaaaaagaggtgatgcctacagacaggaatttagcaaaaggaagaaaaggaagcaccctgtttgaatttcgtatatcttctaactttgccagaatttgccactactagaatatctggtctacaaggtaccccaagctctctgtcctcctacttcttttgcctctattaaccttgataccttccaaattggctgccaattttatttaggctctaaaataaattcataaacttaccaatactgtacttttttaaaaaagatgtgggcatgacaagtatttttatatgcatttagttgaggccagatggttttactacatgaacaacatagatgctggatcatcagcttaaagcatgtgtgtgaccatgatgctttggctatttaatttaaaaaataaaactcataatatttaccattgttaataggtctttctaaatatgaggtatgtatatctatatttcaaaatatttaggtcattagctctcctttaaccttccgaactcatacatttgcgcacagaaacataaacacacatatacaaacacatatacatgcacatactgtccaagtattagtaaacagatgactgatgataattcaggagtatatgtcaaaacctacattctattgcatactatacaaaacatatattcaattatacacgtatgcataataacatcatggcccattatctcacttattttgtggctaaatgatacaaggctaacatgaccaggaagttagctagcacaaacagatttgggggctgtaagtataatagtctatacatgtagttgctttaaaaatatatcagctttctgaatatcatacgactttttgagtgttcatgtatacaatacttgtgatgacattcatgcctatcaaatattttggagaactcagtatgattagataaaagtggagtttaggtttcgtgtaaaagactaaataaattgtagttgcagctgtgttcctgtggctaacgctgcccacagcagagcagagaagttagcgtagtatacaaagaatagcagtatttttcactgtggtctgagcataattttaaaattatgaatcttaagtctaaacaaatgttaaatgtaacatcatttttctcattccaaatggacttatgaaagtcataataaatgaatacttagcaagcaaactatagaagattctatttgggaaatataaagctgtatttcattcttccacagatgtccacatcaaccacatttagtgagagtactgctcttacaagcagtcctaacacaaggctttatctaataacgaattaggccgggcgcagtggctcacgcctgtaatcccagcactttgggaggccgaggcgggttgatcacctgaggtcaggagtttgagacccacctggccaacagggcaaaaacccatctctactaaaaataccaaaattagccaggcatggtagcgggcggctgtaatcccagctacttgggaggctgaggcatgagaatcactggaacccaggaggcagaggttgcagtgagccaagattgtgccactgcactccagcctgggcaacagagactccgtctcaataaataaataaataaataagagaattaaatattcgattcgtgtaactcagctgatttcccttcctcctttcttatttacgtatttatttagttattatcttccacccttactttcctaatagaaccataggaagtcttggtccttttagcttctgacagctgatacatcgttcaattaatgaccagatttacaaattttatatcactataggtaatatgctaccccttaagtggtagctgtgccactccaacaaaactataagataccttacatctaacaaataccttgtctctgaatcaattgtttgagttagtcactagccagatttttttccctttattatttaactggaatatactgtttgactacatcccacatacatattgacattgtagttatttgtccaaccagaaaatatttaccatggatttatttatactcaaggcatgacagcatagtattgaggagtacagactccccagaagttcagtttttccacttaccagtttttttattctgggcaagttatgtaatttctctctgcttgagattatttgtaaaataggtgtaacaacaatatctgagggtatgagttaagatatattaagcacttaagagtgcctgacatataataggctcttaatgttatacattgctatcattttaattattaagatatgcttgtctatcttatgttaagtactagggatagatttctgaaaaagctattcctgcactgaaggtattttcaggggggcttgggcaatgtacaaacaagacaggtaatttcagaataatgagtggtttgacaggagtaagtccagatcttgaaatatttacccaaaatatagggaaactaatttaatgatggatgatgaaaataaatgattactatgaaaatttgggcatttacttttcatctatttataataaaacatcaaaattttaagtaaaattaaagagtttctccagttaagtttcattggaattccaagtcacgtaaacagaatccttcttaacaattttagacacccatctttctgtttcactgtgttactaatttaatagtctacaacttgtgtaaaacagaggtcatatatattttgtggggacaaagtgttacagtaaattccagaaaacaatcaatatctaggaatgaaagtaggaatcctgcataaaaagtgtttatatattctctttcatctatttattgttctcttattgagacttacctcaaagtgaggggaatcattttaaagactgaatctctacatatgtatgtaatattatttggttcctactgaccttcctgaattgtgattacctgggtgttgcgtatggataacgattgaatggaaatctttgattgagtgtatttattaggttgctgagctattttggggtagtcatttcacctagctggcctcaggggtaccagttttttaggatggttagcatcgtatatcaggaacagattccaaaattacttacgaatcaaatgtccatttaaaagccgttgtttttaatggatcctatgacgaaccctttagtaaaataactaattctatcttcatttcctggtacaaattttaattttgtcatttttcttttctaatacaagatttttttaaaagaataaaaaaacaaatccggtgcttttgtaggatggaaaagtctgaaaaaatagttgggaaggaaaagggaaatagaaaagttgaagttaggagtaaaaagttgagagaataaaaaatgatacttagggcaaactccaaaaatactggtgcttttgatgccttctttcctttgcattgtctctgctctacttacacgttgatgcaaattaagtctgatttcaatttaactgttttctttcagattttagtatgaaaacttttagtatttgtggaggaacaaaaatatcattttgaagaatgcatgtccagtagcaataagacaacctatgactagaaacaatggacttttcacagcctatacaaatttgtatgaataaatcagctaacagatatgtcagaaatattgtttataaatagcggagttcaaataataatatcccatggaacagattgtagcagttcgctattaccattgtaaaaactccacaccatgctatatatattctatttgccataatatattctatttgtcaaagaatttccctccataaataaaattgtcattttacagagaagtacacatagtaatagttacttggactttgcttaagtatggaaaagcatgtaatgctattcttaattaattgaaatatcagtatatgcccaaagagtttctctgtataaaaaatctcaattgtaaatatcatatatgaatagccaattcaaatatttaccataagagattggtgacttaattatgagagttcgataatatggagatgaatgtacgtagtggttcatgtagtaaaatatgtttcttaaaacaacattaaaatttttaaaatttggcagaggtatcagtgaaataaggcttttcatgctttgttgtaatgaattttaaagacagatgtactatttctttcatttgagggggaattgtttagtctactgagcctaagtaagggccactagttttttgtttgtttgtttgtttgtttgttttgagacggagtctgtctctgttgcccaggctggagtgcagtggcacgatctaggctcactgtaagctccgcctcccgggttcacgccgttctcctgcctcagcctcccgagtagctggggctacaggcgcccgccaccatacctggctaattttttgtatttttttggtagagagggggtttcaccgtgttagccaggatagtctcgatctcctgaccttgtgatccgcccgcttcggcctcccaaattgctgggattacaggcgtgagccaccatgccaggcctggccactagttttgaaggttgtgaattttcctaaatcttgcatgatttgggtaaagtccatctgtacctaatctgcaaatgtgcaaattactacataaagtacatcagtaccaataataatttatacaacattttatgcattgaaagtcttcttgcagaggaaattattaaatattaaactagatgaaacatgggtcaaattcaagcttttagacaatggagctggaaaaaagtatctttatttcaaaggaattatgacaccttctttggagacatagtattctcattctattaataaaaataaacaataagaagaagtcagtctctttctaatttaattaaaaggatgtttgattttaatgcttcattcaatttactttgtccctaaccaaatatgcaatcataattaaatgaactgtaggcaatgttgcagattccaaatcttcttcccatgctatagggaatgaatggactacacaacactaatacttgtgtgcaaaatacatagggctagatactcactttgtttttaaaatcaaagagtaatatatgattaagtgctatataaaagaaggagaatgtgttgatgctgagaatagggatggcatatataatattaagttatattcatttgcatatcagataaagtccaatgcaggaaacaaaagacattagtttttcttttttcattttttaagttactctaagggtagtgatttcaatagaagatattttaataatattatttctcatctatttcatatcatgcaatcagggttatttttacagatgtaaaggaattccttttctagtggtttctgtatttggctaatcagaacaaatgaatgcatgttaagtacagattccagggcctatcctaaaaccattggaagagaattacacagaggtagggcaggtgttggctggcagatagatggtgatgttgtctgaatatttaaagactccttcctaggttattcttacgatgttccaggcttggcaagtttcctaaaatttattttaataacctgctccccggggacatttattttgcataacttggagctctctaaatattaatcaacattatcttcaaataaataatatggattcagtatccatttaatataagatggtcaattcattttaagaaattaagaattagagtgtatacactgaaagaaaagcaaaagggaatttctagaaatatttcataaacaaagtaatgtgtgcatggcaagggaagctttttaaatgagttgttataaaaaaactcacttttgaagacatggatacatagggattttagatgtgagtactgtgtcaaaatcactattggatcacactggaatatgaaagaagcattgttcggttactgaacaatcgcagtcatgtatggccactgagtctgtaaggatgctgcacacagacttttcaattgttttttatcaggagaaacagcacagggctttagggaacaggggctgagctgcctgtgcacatgtagaatgagaaaggctcccacttcctcgtaagggcatcaacacagtcccaatttacccagaccacaacagcactgaaagggaactgggtaagactctatacagcttgagcaagaagacttccatactctaatagatctctcagacttaacatttgtgaaattccacaccttacctccatccccaaatctgctactcctgcagtctttggcacctgcagtttccaatagttcatatagaatcattctttttttttttttttttttttttttgagacggagtctcgctctgtcgcccaggctggactgcggactgcagtggcgcaatctcggctcactgcaagctccgcttcccgggttcacgccattctcctgcctcagcctcccgagtagctgggactacaggtgcccgccaccacgcccggctaattttttgtattttttagtagagacgaggtttcaccttgttagccaggatggtctcgatctcctgacctcatgatccacccgcctcggcctcccaaagtgctgggattacaggcgtgagccaccgcgcccgtagaatcattcttgactctcttttcctctattcccatctgttaatctatcagcaattctcttggctttaccttctcacacctccacttggtctatgcttgctaaactggaatacagcagtagcctccaaacaggtctctctgattctcacctagccaaattgatagttttaaattggtaccacatctctttccacacaaaattcagtgattttccaaattatcgagagtaaaaatttaggtatttgaaatgcccacaaggcccagtggagactctccctttctcctcccaggacactcatggctgcttcctctggctattttgtcttcatagcacttttcatcatctgacttgctgtgtgttttactttcttatttctttattgcatgattcctaccaagagactgtatcatccttgaaatctggtatttggagtgcgtgtgtgtgtgtgtgtgttttcactctatattcccagcccttaaaacactgccgggtacattgaaggtgttcaataattttagaaatggtacataaaaatcagtagttatgtcacaggatgtaatcttagcagacagaggtaaggaacgtttccacaatataatcaatgattataggccctttctgtgcaatgacacagtcatggactcatatgcgctttatgatgctttaccttgaatttcattaatttgagatcacatgtctatgttaatgagatcataaattccttgaggtaaagggtagtgagttgtgtctggaattataactttacctaagtttaaagacgtatcatattttgcctcaatttgcagaactgagagaggactcatgtctttccactctgattgtatgctttcaactcagaagattttagacttcaaacaattcctctggcacctagtatgatactttgtacatagtagaaaaatacattcaatatctcttgatttatcacttcctatgtaatcttttggttcagagaaacatttaacctccctagttctggattgaattttttgaataaaacagcccaaatcgatgtgtgtatacacagagtttaaaggattgaagatgatgagatcattttccctgtgatggctgccaccaggacttcttcacattgctgttgactaattctcattgcaagagttagtgctggagagaaagaaaatggctttcaatgctttctgttacattcccagaaggtggctaagtgcgataggagacactaaagagggaaaatattggatttgaagctaattactaaggaaatgcttagtaattcattaatccaatactgaactcactttatgcaggattatttgggtcaaaatattgtgagcatatatcctatgttagaactttggctatgaatgttatattgtaacaatttattttgttacatactttttaatagtttaaagatagaatagcagctacatttggtcacaactagaaatattcagcttgaaaaaaaccccacagttttctgtcatccctcttgttcttcaaaagttgagcaggcattttggaataagctcattagtttatgacaaccatttaaatattaatgatgacaataaaacgttattttttcatgtgaaatcatcttataaattatatacatgcacatgtgttcatgcacatacacacatgcacacacacatacatagtaatttgagagaacaacatatttcttttgctaatgaaatatctcaacctcataacataccgtcatagtatagaaaggtgaattctcagcttttacaacttcatcaaatgttgaatactgagtaattcactgtggtaaggagtttatgttcacattaaggagaaaaaaatggcaagcactagaagctcaagtattttcattccaacttgatttttaagtctctaattaacatcttttggtcatggttgtttttagattaacatggcttaattactttattataaggtgttggtagcattctataaaacatttttctctttattatttacttatatatgttaatttttaaaagctgtagattctcattaaacaaaatacaaacactttcaaatcatcatctgaactcattttcataaatgtagataaaagtggtaaaaaacgcaattaatggaacacctcaaatataatcactacttagattctagaaaaaaggttaaaaagagaaagactagcaagtgaaatgataatatgtgaaatcaagagtaacttaattttacaaaaattaattctcttttagtaaaacaaatagtccaatggttaaaaatttttcaactgcagtgtttccatgtagtagtttaagattttcaaagagggcagcagtttatctgtatgtatttgcccctgtagataaatttcttgaaaaaaggatcaaaacatcaatcattatgttctttgtctatatgacaagtttaacataaatgtaaaaagaaaatggaactatggaagaattttggaagtaaaataaaccctatcagtattggagttgtgtatttccaatgggtgaaatgcctatttgggattgccttcaactggtaggggatttactctgtgcctggcttgctcagggataaactagatctccactggcagtgcagtgagagaaaggtgatgttttcttcttgtttattatttggtctttaactataaagcattagctttttcaacaatcacaaaagccccactttacatgatttcacttgctcaagatgtaatttattgctaatggaatcacagaaaaatgttttcactgtttctggaatgcagaatcaagtaaggcaaattgctattgaagaggaattattgattcttgttataatagctgcatttcagctttaatacatgaaattttatttttattgtttcaataatttatatttaagcctcaaggtttctgtataaccttccttgggctattttgttttaaaccaggtgtgacaattttgccttaatgtatcattctcttggtctgtcttgaaaaccttaattgagtagatgctatcaaactgggtttgagaagttgtaaagttaccaataacttgcttggcaaactttgtcaagaagctttattttgtcctcagtttttctgtctgaatatataggagactgaatgaagagatatataacccccctcttaatatctccaaagttataaaattattatttaactctccatagaataatcaagggtgcatattgaaaccatggatgaacttctttatgaaatgtgttgaacaaggactggtgctgttttctaaacaaattagtttatttactataacaaatttattaagcaaaaatgttaatcaaatcaaaattaatcattactgtactctcacaggacattgtactttgcttaaaagtgtttctctgacagttgtatattacagctggattcctggtgcatccatttgtctcatgaggttgcacaagccacaaagagcagggaataaagttgttctttacttattttatttccagacccaattcaggtctaaataatatcatcttccatttcccgaccattgttttcattatataatattttgactttccccaaaagaattcatgcatcaggtattattacctcattttgtagcagagaaaacaggtcagagatatttagttacttgttgaaaatgataaagatgttaagggatagagctgagatactacatagatctgtctgatgctaaagctcaagacatttctcctatgatagaccagagcagatgaataatacctgttaaatcaaaggcaaagaaatcttttttttttcttctggaaacactgtacctaaaaacttcccaaaatgtgactcttttatctgactataaaaagaaatagcaaaatcaattatattacacagtatctgcatcagctttatcatctcctaaatagggatataatattgagatgtggtgagagttaagtataattatttatatgacatgaaatagcttatgtacctgacacaaagaagttctcaatgactgttatgtacaattattattatcattattgagtactatttgcacttaaaagtcaaacatatcttgaatcagaggaagttcttacttttagaatagctctaccagaaattaagaaatatcacaaaatatgcttctgtaattattttaaaggtgacttgtgaccatttacccatttctttcacttttaataaatgccttaactttttaaaagtatagtgtgttcattgtgccaaggaaagatgacatctgtgtttgtgtggggagggaataaccacagttttaaggtacattctttaacttgattttacaaattgaacgttatgagcagtaatttaatttatgctacacattttaattcagaactaaacagttctgtattttaacacagagttgtttatctagaataatgtttggcattaataagcatttttttgatatctatttatttaaaaaatgaacaaattaggcccttttatgtttaatataatgctaccattctaggctaaaattacagtttttacacaattaatgttatatttggttattataactaccctagacactaagtaatagcataataacaataatagttacagtaatcttcattaaggtattatatttacttatttatgtgcttaaaaacatatagacactaaatagcagagccaggatagactctcaaatccaaatttgggtatcatctattcttactagctatgcaggagcccccctcccccccgcccccaccttatccgtgggggatacattctgagactcctagtgaatacctggaactgcagacaattctgaaccctatatttactatgtttttttctgtaatagtaagtcctcaatgacatccacaggttcttggaaatgtgacttaaagtggaacaacatacagcaggtcctcaaataacatcgtttagttcaaaattgtttctttataatgttgatgaggaaaaaaattgattttcttataaattgtttcagttatagtcccagttttcaataacctatgtatgacattaactgaagacttaactgtacttacatccctatgatagagtttaatttataagttaggcacagtatgagattagcaacaataactcataacaaaatagaacaattaagtaaaagaagcattacttgaacacatgctctgtgataccgcgacagtcgagggtggctactaagtgactcaggaatgggtagcttagaaattataaataggccggacaaagggtggattcatgtcctgggtgggaaggagtgggactgcacaagattttcatcatgcttctcagaatggtgcaaattaaaacttatgcattgtctatttctatcgtaattttccatttagtattttcagaccatggttgaccacaggtaattgaaactgcagaaagtgcaaccacggctgagagaaccactgtaccggcaacagtggctttctatgaggttgtgattgaactattctacccttagggagatgcatatttaatatttcagactaattagtgtaaaaatataaaaaggataaatttgaagagtcctagtaccctggttgtccatgatttgcattcattacggaaatggtgggaatatctagtataattgtatatatacctcccgctgttcttgatgaagagaatggattattttgtttgaaaaaagatttattatagtcaggaaaccaaagtcaatgagcagtttgtaagactgaagaagagtctaacatttctggaatgaagttactattaggaactaaagaaaaagtcccttcataggagttgggtcactatgtaaatccatgcatggaaaaaaaaaaagaaaaagaaaaagaaaaaaaagaaaaagccctgtttggctgttttccagcaagactaaatgcagtgttttatcttgatagattacatacaccccaccttattttctcctgtattggctaacccttggtatatgtgtacatacccacatatttaaatccccactattttttttatacttgtcttcttgtgtaacaccaaatcaaatagagagaaatactaaagaaggacagatataacctttgaaaaatatctgagggtctccaagattcaaaagctcagcagtccaagcaatagcaacattcagatgacaaccgggactctggactctttcaagacgctggggattggaaagccactgtgacagaaacagtgctacatctttttttatttttttgagacggagtctcgctctgtcgcccaggctggagtgcagaggcgcgatctcggctcactgcaggcttcgcctcccgggttcacgccattctcctgcctcagcctcctaagtagctgggactacaggtgcccgccaccacgcccggctaattttttgtgtttttagtagagacggggtttcaccgtattagccaggatggtctcgatctcctgacctcgtgatctgcccgcctcagcctcccaaagtgctgggattacaggcgtgagccaccgtacccggccaaacagtgctacatctttaacaactcccatttctttttcttcctgggaatgaagctggactacctttctcaatttcccctgtggttagaaattagattcggtcatatgattgagtgccaaagacatataaacaaaattatatggaattcaagcttggtgtttaaatcctgtaaatattccacttatatttttttctctgtctctgtctctctgctcccccttctcttcttccttctcctcttcttcttctttttctctcctctcttctctcccatcctcccctcccctcctcttctctctctctctctgtctctctccatctgcttgcttccctccctcccccttctctctcctccccccgtcttcctctcccctcaggggaagactattcccctgaggcactacagaccctaggttcctgagtcatttcatggaacacggcacctggatacttgcactggaccataacacaggtaattaagaaaggtttcttgttttaatgcagtgaaattgttgggtagtttgttatagtggttatcctaccttgaccactttagaatggtagcttctgttttatagacaaccttattagcactggaagtaataagccacaaagtagtttattatttttccactacactaaaatgtagttccagaaaaggataaattcaatacattatactgttctccttagccacccatgtttcctctttacataattgagaccaaatctccgggaacagtgcacatcatgaagaatgaagaatccctttcacaccaacacccattaaaaaatctgatataaatatagatttatatattataaatatattatctggtatatacctaatgtaaacatatatttatatattatctcatgcatattaatataaacatattcatatattatatatctctatataatagttattaacaaagtttctgggaaagtcaactatttattctggaatatatgcttggggcatgaaggtgggccatgggaatcgtggaggtttatcattaatagattaatagttttggctttctcatgtcccctttctaccagagagcaataataatgcctgcaaggcatgtggtttgactgctacatagacatattcatccttatagcgattatcttagtagagctccattaggaaattaaaactgggtgctgataaaactgagtaattcaatgtgccagtctgttccttgtgcttgtagggaccatctgcagttctgcaaaacaagtgtgggttgtggacaggtgctctttgaatgcaggctcattatcatttaagctccgcagaggcaaatcccatagaagccctagaagagcagcaagcaggtgtgctggcgccatctccagagaactctgatgcctccctcctgagaggcccagtaacaggaccaccaggatgactggcataagggacaggagaggtgggtcaatgagcagtgagttatagtctccctagctgaggttttagaatgagcttgggagttttattcttacaaatatattttcttcatcactctttgaacttagtcctaatgcaatgacgggtaagtggttgccatcagcaacttcaaaattaatttactcctttggcgatgaaatcaattcttagaaattttgccaaagttagcagtgacttatgttcacctggtagtctttaaattgcctgttgtattttaatattttctaatagtgttcattgcatgtttaagcttaactagagatgtttgtaacttctgtacatcacttgatataaaaaggaactgctacatttatctgaagctatacagtagcagaggacaggaaagaattcagaatttctgactcctgtaattgaattctatttttctggtggtttttatttttaaagtattttcacataccccatctgtcctgtatatttccatttgctcctctcagttcattcttttcattcatctggctctgtgtcctggaagattaatctacagggccatattgttgggcttcctggtcttctggcttcctgttgagttcaacccctagggaacacagtaggagcagagagagggagtgcttgccaaagaccctacctgtacccctcagaggaaggccagagctcctgggaatggcccgttctctccacaaagctttctgtctctgtgttacagtacccattctctcctctcacccgtctggatggtaacatttcactaccacttggtctttctactcctctcccctttgcaaatagactgcttactaaattctccccaaattcctcattggagcatgctatttgttcatctctgagaccctgacagagcaaccatctcatttgatgtttatgccgaatctataaaatatttgtcccattttgtaatggaaggatttgatacatagaaaatgaaattacttgcttaaagtcacacagctggtcagtcagtggttagaattcagcaattttgactcttattacaatgttccttccacaccctgacactgcctccactttctacaattatttaatcatgttaactacgttatattgaataaatgtttaactcattatcaccttctattatcttttccaagtaaagatcaggcattgaaagggagcccctttaaattaaaattattgatgaaaatcattgatggtaatgtggatgttaatcatagtaatttttaaagaccgaatgttttctaatggcataattaacagtcacaggagatcatcccaatatgggtctcttcaaatatctctatgttcagagtttagtacatcaggcattcacaaactttgtatgttattaaaaaataattggcctaataatttggtcacacattttgaataaacagttgactcatccatcctcagagagaggaaggcttgagactgccagttcttgggtagaaaatcattatggtttggacagtaacataaccgattataaaaactactaacttggccagttgtacttagtgatccgaattaagcaaaaatgatttcctcttacacgtaatacctcagtacatgttttgtgaggttttctcatgtgatcattcatccagagatgtttaggtattttcccccttctaggagcagatgttctgtgaatggaggcacacttcttctaagatcaattcttttattattaaagtgataacttggcaacacagccaaatgtctgataaacgaatggatggagtatttcccttctttcattacagatccatataatacgtcaacatttaaaaaagttaaataaagtgaagtattgggaaagggaacatctcactctgatagatttgaatttgctatttctgctctgtgacaaaaccctgagttgatatgtgatcagacatttacaaggccctgcattctacctggtaatggctatagtggtgttgagctgctgtgagatgatttactgcaatttgtcactttttgaaactgttccaaaatagtctgctgacatgtactaaagagctttcaataaaatccgaaatagttcatttttttatgtcaactggaaacattaagtggtacctaaaatcatttaaagatttattgaagtgattgaaaacattctttaggccgggtgcggtgacccatgcctgtaatcctagtgctttgggaggctgaggcgggtggatcacgaggtcagaaggtcgagaccatcctggctaacatgatgaaaccccgtctctactaaaaatagaaaaaattagctgggtgtggtggcacgcgcctgtaatcccagctactccggaggttgaagcacgagaatcacttgaacctgggagggggaggttgcagtgacgtgagattgtactattgcactccaacctaggcgacagagcgagactctgtcaaaaaacaaacaaacaaacaaaaaacaaaaacaaacacaaaaacccaaaaaacaaacaaacaaacaaaatctttaatggcaatttggcataccgcaaaagcaatattgttattaaaattaggagaaaatattttaattgcatctttaaagtatttatatcatgttttagtctaactgcatcacctcaccacttgggaaatgtatcagtttaaaggtattctgaaagttattaagcaacttttaaacaaatatcagcaaagtaaaggggatagttgtgatttgcataatttaatatcattgaaaatcataggcctgataacttaaattctagaacatacactagtgtaattaggttaaagttgtggcttatatactgtttttccttaagaatctaagtatgtgttgctaggcagcaaaatctatcttggccactgtgaatcactttctaatttatttaacatgcaacttagctaaaccagataatttatgtgtactattaaatattactagaagtttcctaaatttatctttgggaccactgctactagaaagatcagtatttcatagcaggtttaagctgccatcaaaaaatttcctttgattattgcttataattattctccttaggggaaaaaaagaaaagtatattgtatatctttaagtttagatattgagtgtccttttaatttagaatatatactatgagattctttttttattagtcaagaatacctggtcatcacaatgctttaatttctaagttaaatataagaataaaaagatataaactaaactctaacataccccctcctcacccccaacccgaattttaaaaagctgctaggccaataataacaggaatctgttttcttggagtggatctaagaaggaaataaggtaaagataaaattgccctcatgtctaagctgggctacatggagtgagctggctttgccctgtgtagaagcaaggagggaacacagtagaatagaactggatcttggtcagagattgggactatggccatatactttttccttgttcaaattcataggatgttctagtacctgactacgattccctcaggcaaaagatacctgacaatggaaacctgcaacaatcaaatcacatcgaaggaaaggtaattaacataggcacgtatcatcaaccaatgcagcccaaggaaaaacactctaactgaagatgtccttcatgaagaacgggaaacaagtgcctgatggcgctttgacctaactacttctttgtccactccacccactcaacagactctccttgtaaaaattacacttatgagtgttcagtgacatcagaccacaaatgtgacttcaaatggggttttgatacacattttccactgtgataatttctcatgctgaacagaagtgatccagaatatcatgcctgtagaattctatgatttagattgtttattcgttagtacctgtattaaacactgctgtgcatggctaaaagtaaatttgttattttttttttaaatttaattctactgtcaagctcaattacatatttggttgtagtaagtcagtgtttctcaaagtgtgatttatgggccagatatgtcaaaatttacatagggtatcattttaaatgcaaaatttggggccctagacttcttcaattagggtctctgatgtgaggctcaggagtctgccttttaataaaaaccccaggttattcttatgtacactaaaatttgagcaccagtgtaataggattttgtggtggttgtcgtttttctttttttgattagggcttatagtcaccatgaacagagcctcacaactaatttatttcacagctcgaagggaccttggagattattgcattcaatagctacctgattaaatgaagatgtgtttgaagttccaaaaatatttgattatttcaatgagaggccagccttagagactatttctgacataagtaaaaacaataataactgtcatttataagggatcagaaatatgcttggcaagtaacatgacatttttaccaataaaaatgaccctcagacatagaaaggtaatttaggaaacatagtttataaataggtggaccatttctactagtgcttactaactccaggtggcctttagaacaacaataactaaacacacgtggagcagctgcagtgataataaggtcacccaaaacatttgacttgactttttaaaaacattttctgattgattcttaaaaatggacagattttgaaattcttgaacccagtgtgtgtatatagatagactttaactaccaccaaattggaataataagttagtacattacaagtatgagattagacctgttaaaaggaatgattcttattttatatgatttgatcatataaatttcaaaactggtttaccaatctgagaagtagtctcagattctgttatttgcagagtcctaaaaacctgaataatgataaataatccaatccattaattggcaaaactattctttggagtaatcacagtgactctggaactcccaatttgttctttttgcagtaaaaatgagtttcctggggtgggggaggggattaatactgttattctttttttaaaatttttattctatttatttatttattttagtgtgaggcccttatttggcacttaccataaattttactactgaagcttctacttattctctccttctaagtccagtgttggcaaactacactaggacctgccagttaagaatgttttttacatttaaaaagtgattaaaaaataatatgttgtatcatgtaaaaattatatgaaattcaaattttaatgtccatgaataaagctttcttggaacacagccataattatttgtttacctattgtctatggatgctttcaagttacaattgcagagttgagcaattgcttgccacagagaccatatgtcccacaaagtctaaattatttactatttggccctttatagaaaatgtttgagaccctcccccctctccctgcttcccttctacagtagtggttttcaaagtctttttcccaaatctggaatatcaatcagcatcactaggaaatttcttgctagaaactttggcctcaccctctatattcagaatcagaaattatggaggaaggcagttgtggaaggtggactcagcaattggtgctttactaagcttttcagctgagtctgatgcatgctccagcttgagaaccactatcacctggagggcttgttttaggaatgcaataagcaaaaatgatttgaaaatataggttaatacgcatatggaagcattatgatttatttagcttttgtattgcatttgcaagaaaaacatacaaaaataaagaagaaaattacgagcactggtgactaccctttgtttccagagagaaagtttttgctagagaaaaaaaaattgcatgttttactttagaggttactttaattttaataggctttatgaaattacttcaaagtagctttgataaatcagaaaaatgacatggcaacctttttttggaagctgaatctcagtggtacttaagaaggcttatcacttggtttatacagaagaaaatatagtatgtttcaattatttatatacaaagttaaaaacccaacctgtaattatatgtggaaataaaattgacttcagcagacggaaagaaaaaaaatacagcttctttttgtagatgagtctaatcctgatatcctgtcatttgatacatacgtgtcatgaacaccaagtactcacccccatatggctgacatttttgcatctactattgaagatgagactgcttggtccccatcagaaccgaaactgtgaggacagatgaggatgaaaggaggcataaaaactaatcatttaaaaataaaatataatagaataatccactctaagtgaagctattgctttagaaagcccactaaagaaaaccctttaatggcttttaacattccactctaagacaacgaatagctcaatgtaccattgcattctcattcagtgatatttatttcaggatattaatgaatatttaattttagtactatttaccagtacaataaaacctaaggtaataaaaacaagaaaatgatatggttacaaaagctagaacaaaatggtgcagttacaaataaagattgtaactgagaggtatggtcttagtaggctaatactgcctttggagacagtaagcaaatctgacaatggatttggttttccaaagagcattgtaaacttataatgaagaactttattttcagttaggagacatggaaagattgtcttggagtagttaagagttcagcttccgcagtctgactgtttaggttagagtcctagcatcacctggataaccttgagcaaggtataaaattatcgctcacctcaggttcatgtctatctatcagataaagaataataacattatctacctcgtagccttactgcaaggatgacatgagataatccacataaggcttgtagccctaaaacttggcacatagtacacactgaaaagtgttagctattgttattgccattattaattatttatcatatatttgcaatgtagtggtggtggtaaggcaacaaagatatgcagagaaagatgattcagtttgccaacaaactcagagctctctcataaatcagatcagattattcactagacttgccttctggatcagcttcgaaagaatttattggtggtgttctgtagaagccattttagcaacgcatgcatggtgactccacaaagttcacgggttccctggcaatcagcttcagcaacatgttcatgaaagactgaaatcacccagataaaaaaatcccggcttcatcccaatccaagtaggtgataacaactttcacttttctatgaaaagtaaagttatctcacttagattctttgctagaatttccaaatgaaaacatagtcaataaaggcattcttgtctttatgccttggcctgtaaatttcaagtctgtttccaccttggggtgacaggcatttggatgctggcagctgcctggctgtactgttccttcatgagggcgtatcactgaggcaactccaatgcctgaccttagtctgcatgtatgagatagtctttccatttaagtacctgaggacttagagcttagtataaaaaagtaaactctggtgaaactaagtacaggtagtccagtatacatgaagacccattttacaaacacaagtgacaatatcttgctttggaagaagtgctgctgcccatcacctaagcaattgtcaccggagtccctaacatgtgacgctattgaaattacagatccagaaagctgccttgttttttgaaaacttaaaaggttgctttctgtaatgcctagccataagaaattattctaaccatggacatgtcttgttatgtgctttttaccatcagagggtgatattagtgttccagggagtatgtatgagaaaccacaatataatcattctgcatcttccaaaagtctcaatataaatgcagcaaatatttactaaggatacgtgctttgtgctagcgtagggttgggggatatagtgataaatagtataagcacagtcttttacatcatggagctttcatcatctaattgaaactatatataaaaatacataatatattatatataatatatatgtatgtaacatattatatatataatatatactatatatatatgtatatatatatttttttgagatggagtcttgctatgtcacccagactggagtgcaatggtgtgatttcagctcagcaaactccaccttctgggttcaagtgattctcctgcctcagcctctgggattacaggtgcctgcccccatgcccagctaatttttgtattttcagtacagacggagtttcactggccgggctggtctcaaactcctgacctcaggccatccacctgcctcagcctcccaaagggctgggattacaggcatgagccaacaaccggcctgaaactatatttttatatgaaaacaaacactggcaaatatgctatgacataaggtaaaacttttggatgcgtgtgtttgataaaacaagtaagttcagttaaattttccttggggcggcctgttgatgcccctctgccacagagatactttagtggaagaaaagcaaagatttttgagatagaagtacctgctgaatacactttgcacacaagatcgtgggagtccacattttaaatgttaccactagactaatactttacctctatgcagccattataattaaatatttcctcccaattcaaagataattaccatatatttaggggtaggaatggctctagcctccattcccatcatccccttcaaactttcttactctctcttgcacttttacctcggatctcaatgaattctagtccttcagaatgacaattgttttggggagtctgaggtttttgtttgggcatctcctgctcctactgtttctgctttccctccctcatgccagacttagcaaatcaaaagcaatgatattgcacatcctttagcttcccaggtttcccagatcccaggaactcaacctgggtcacagatcacataatcagacacagaggtgttgagatccctatttctaagtgggagtggactcctgatgtcccccaggctgcaggcaggcgtctggggatgggtgcaagacatctcacaaatgaaattggacttgaagttctgaagaattggggatgaaagagttaaacatgtttaaatgagatagaatttaaaaatttgaaatggttgaataccaactaggaaactttacgaaaaatattctctatttttattttctttgagaaacccatcttggaagattaattttagaggctattgtagactacgtttttaatgcaaaatgctccggttgttgatgagacaggttttgtttttcagttcatcagcaagatggcactttgataaatcacagattgctcagtgcctaaagaggcacattgtgacagttttcatcacaatgtgatataaagaggcaaatgaagcagtgctccagatcacgcctgggccagttaggtgatagcacccactgtgtcgttaagaaccaggagggtctgtcatttctaacaatgtgttcattgttttctgacctacctgtgagagtaactttttcaatcacttagggactgaatttgatttggagtttgttgcttataaatagttagatgagtgagagtaacacagatagcagagacctctgtaaaaagaaataaactggattttgttcttttctgtcttgataactgagttggaatcttctgtgtcattgcattgggtacgaatgaagagctggtcactggttcacccttgcacatttgcatgcactggctaatactaactagctccatgtctaatcctttaaccaagctttctggcaaatcagagccatggcatttttcataggcatctgatttgaatgcacatgtagagacattacccgtgacttcaaatttctcatcctgatgctctgcttattttcagaatatatgtaatacaacattctgccctgtatacccaggtaaaattttcccttattccatcactgaaagtaaattctaaaggaaatattgaacactttcactccttgatttgtttttaagtctcaagggggaaattatgatgttcacacacaggttaaagcagactgtaggatcctaatagtaataactatacaagattaatggtaaagacaaatatgtaagaaagaattcaggaaaaaaagaaaacgaagttgtcaaccaactttatcattgggtggtggaggtagggctataaatggtgccaaatgaattgcttgactgtaattttcacctttcgaatattgctgtggcgctgtagaggctagtccaaaagaggctgatctcatttgtcacccagtggtttcttttgggccttgggcaaatgggccaacacttattttcaaggctgacctcatcttttctggctgttgagtagactttgcacttcagttgatgagggcatatgagaaatgaaccagataaattgcttgattagaatcttcgtgaaccagaaccgatgagaggggcacacatttacttgtgaattaagaatcaaatgtatctttctttggcccagtactgacacacatttacatcctccccactgtgtgttgttcactagtagcaaaccctggctattccttattttagaattttctcaccactatgtgctgcttgactattggccatgcttctcttgcaattctcatgttagtctataaatgacattctggttaggaggggcactgaccctcctcctgtgcgttcacgaaatgtgaaggagggaattaaacctgtaactcagccagttttaaagtaagcttgattattatttcttcaatagcatcagcttctataaccataataaacaaacaaacaagtaaatataaattctctttaactgctaaatggatggaaaatagactgactctttagtttttaaaaggtagttatagttagccaagatggaatcagcttacattcttggcgctgtatacgatataacaggtctgtgtgtgcctgagtatatgtgtgtgaggatgtatgttctgagagtgttaaggtgataaataacatattttttcttctcaaatgtgacatggcttggaattaaacatttacataaaaattatgaaatttataaaatgtgagaggtcaatttctccatatgccataaggtacagaaattaatgtcaattttgtcagttatgtgtgatttatttaacttattaatggtaaacagtgatattaactatacatttaaagatgtgtattttgttaactttagctaaagtgtctaggtctctacaaaacacgtctttctaatatgaaatatatttggtaaataggtggcaaatttcaaatacacttttctagccaattaccttgtagaaaaatcaacattcatctactgcagtgttccacagccaaaatccaataaaatttggggtagaggagacataaatttgtctcctcagaccagaccttctgatattttaagggaccaggaactattaaaaagtatctgatttaggttgttaactagtgaggcagatggtgttattgttctgcaaatattcactactcccacttgcattcttcctggaggaatatacttccctgccctgttgacattgaagatagcatcacgtattttggccagtggaatgtgagtagacgtgatctagtaacatccaaggagaattttgtggtgcttgatttgtctgcttgcactcttactgtcatccatgagaaatgtatgatcctgggagctgcaactccgtcagaccaaaagaaagacctaaacctgatgttgagcctggaacattaatgccacaatgaattacagacttgtgaatgagaaaaaaatatgtttatagtaataagctgagattctgtggttgtttgttaccgtcttagtctgtttaggttgccataacaaaataccacggagttggtggcttaaaccacaagcatttgttttctcacactttttgaggtagaaaagtccaagagaaagttgctgaaagggtttggttcctggtgtaggctctctttctggcttgcagagggctgtcttctctctgtgtcttcccaaaacagggagagagagagagcaagtgctagccttctggtctcttttctcataaagatatgaacctattgaatcaaggctccaccattacgacctcatttaatccaaattatttatataaaggacttatccccaaattattacatgaattttaatgggaccaaaacttcagtcgatagtagttataaaacattattgtagcataacctcactgatatatcgttgttactaaagcctgtgtcccagctctttgcatctgctctctcctaaaacagcaacaggtaagccagaaaagtaaaagaagagtgtaatctggtgtaggcaatgaaaatgacaaaaaccactttttgtttatgtggccttttaaaaaaatcatttcctatattttataccaatgtaaagatttttaaccagtaaaaaatattattaggtagaattttttaatttgctatagttgaatgcatgtaattacttctgaaagagttaactcttattttctgtcttgtgtgcttgtgtctggttgcattatgagattcataggttttcttaaagtctgctttgttagatacaatatgatgaatgcagaaatgcaatagggtggtattaaaatcaaataacgagatcaagagacacagaagcaatatcagtttcttatgtagtacgaaatgacgattgccttagtatataggcctgctctaagatgcattgaagggtaacattctcttttgattctagaagtgggtaatgtatcggccttttcattttttaaatgtagaaatctagtaactagattttttaaattaaaattatgtgttcctgtcacagattgtcttctttgtacatgaattggatctcaatattatgaataagcatatcatacaaacaaggctatcttaataggaacagcaatcctagaatacaagagtaagaaatgcttacacttgagggaggggtaggcgaaggcaaaacaagagatcctgggattaatgttctcagaaataagtctctagcctacaaaggtggcacatattggtaaccagaattataagattgattgatgtgcctgagaaatcaacctggagtcataatcaacattgcttattagtgcaagacctctcagtatgatggtaaatttctagcccagatgctctaagtgaagacattactcattgggctacattcatccttggaagaaatctttttttgtttgcttgtttcacataaaggtgctgcctgggccaatgtttgcttggattcatggataatcatcgacctacatcaaatgcctgatgtgagggtaagaggtaacactgcagtcctggtgatatcacttggacatagtttgaaaaccactaatttatcttagtaattataatttgaactgatgggttcagaacactctaaaatttgaacatttgctttaagtacaataatgcaggcactcatttccctggagcctgctttatttctttcctgctttagcttccttgaacagagacttcagaattactactcccttagaccttgtaacttggtcattcttactaataggctataacagctcccctacaaatcaatgagggttatgctttcagccttagacctctgtttcagagcagggcaatatttattcacagttcttgtttatttaggtgtaaaacagatatacaggcactatgagaatcaaatattttgttttaaaagggttctgagaaaagcaatctttgtgccagatatgtacatatcttgacatactttttgtaaactaccatgaatatattttcaagctttaaaacttatttcctaataaaatacctttagtcaatgttataatacataatagctgacttcctaatttttcatgtaaaattcccattttctaccttccaagatatttatatgtatgttaatgtttttatggtacattatccccaaaatttaaaaagtaagcagattcatacttgctcacctttttataaatatataaaaagtatttataaaaatacttttatataagtatatattaattaaaaagcacctcaaacttaaaaataaatttatttttgaaaactattaacagccaacacataattgattagaccaagttgtctataggaataccaagagattatgtataaatatatggctgaggagatttggggacatccatttcaatgattcacagcggcgtcatgtatttttgctcacatcaaaatcaaaatcaggtattccagattagatcatcctctatgtggacccagactctttccatcttagggttctaccttgtcaaaaatcttagagtcttctccatttagctgatggatcagggaagaaaccacaggaaaacaacacctgatttttgatcaatttggctggtaagtgttactcatcgtttctattcctattccactggtgtaaataagtaatgaggcctctctagattcaaaggagataagaaatatgtaattcctgcctaggcagttgcttcttaggaacaattccacactctcattctctgctaccaagtggttatccaaagcctctccacatattttcagttttttggacaagaataaatagcaatgatatttatctattaatctccactctgtgacagcataaagaattagtggccggaaacacaacatatgaaaacttaaggaatgtagcaaaagtagcccaaagacagaaatttatagcaataaatgcctatgtcagaaaagacgaaatatctcaaataaacaatataatgttacaccttaaataactagaaaaagaagaacaaaccaaaccaaagttagcagaagaaaggaaataacaaagttcagagcagagataaatgaaacagagaccagaaaaaaattacaaaaaattaacaaaactaagagatagctttttgaaaagacaaacaaaatcaataaactcttagattaatgaggaaaaaagaatactcaaataaataaaataaaaaataaatgtcattacaactgataagacagaaattcaaaggatcataagaaactactatgaacaactgtatgtcaaaaaattggacagtctagaagaaatggataaattcctagacacatataacctaccaagattgaattatgaatcaacagaaattctaaagagaccaaaaatgaggaaggagattgaatcaatattcaaacttctcccatcaaagagaagcccaggaccagatggcttcaccactgaattataaccaacatttattttcttcccttttctttttttttctttcaacttttatttaaagttctggtgtacacgtccaggatgtgcaggtttgttacgtaggtaaacgtgtgccacggtggtttactacacagatcatcccattacccaggtattaagcccaatatccactagctattcttcctgatgctctcccttgcctgaccccccaacagttgcccacagtgtgttatttcccactgtgtgttcatgtgttctcatcagtcagctcctacttataagtaagaacatgtagtgttcggttttctgttcctgcgtgtttgctaagaataatggcttccaagtccatccatgtccctgcaaaggacgtgatctcgttccttttcatggctgcatagtattccatggtatatatgtaccatattttctttatccagtctatcattgatgggcatataggttgattccacgactttgctgttgtaaatagtgctgcagtgaacatacatgtatctttataacagaattatttatattcctggctatgtggctatatacctgtagtgggattgctgggtcaactggtatttctgcttctaagtctttgaggaattgccacactgtcgtcaacaatctactaaacatttaaagaagaactagactcacgcctgtaatcccagcactttgggatgctgaggcaggcagatcacgaggtcaggagttcgagatcagcctggccaacatgctaaaactccgtctctactaaaaatacaaaaattagctgggcatggtggcacgtgcctgtaatcccagcttctcaggaggctgaggcgggagaattgcttgaacccggtaggcagaggttgtagtgagccgagatcgtggcactgcactccagcctgggtgacagagtgagactccatctcgaaaataaataaataaataaataaaaataataaagaagaactaattacatttcttctcaaaccctttcagaaaaattgaagtggagggaatacttgtaatttcattttataaggccagcattaccacagtatcaaagtcagaaaaagatactacaaaagaaaaaattacaggctaatattgcagatgaatatacatgcaaaaatactcagtaaaatattagcaaactgaattcaacaacacattaaaataatcattcaccatgatcaagtgggatttatccttgggacgcaagtatggttcaacataatgcaaatcaataaatctgatacaccacagtaacaaaacaaagaacaaaaaccaaattatcgtcccaaaacatgtggaaaaagcatttgacaaaattcaacactctttcataataaaatctaatagacaaagtatagaaggaatgtatctcaacacaataaaggctatgcatgataaatctatatctaacttcacactcaatagtgaaaacttgaaagcttttcctttaaggtcagggacaagacaagaatgccaaatttgacaacttcctttcaacacagtacaaattcctagccatagtaattaggtaagggaaagaaacaaaagaactacctaatagaaaatgaagaagtgaaataggaaatgaagaatagaaaaaatagagaaatagcaaatagagactatctgctgaagactccaccataaagctgttagaactcaaacaaacttatcattgttgcaggatataaaatcaatatccacaaattagtagtgtttctatatatgtataatgaactatccaaaaaaattatagaaaacaatctcatttataatagcaacaacaacaaaatatgtaggtgtaaatttaatcatggaggtgaaagatctgtatactgaaaactagaaaacactgaagaaagaaagaaaagaaaatacaaatcagtagaataatatcctgtgttcatggattggaagaactaatattgttaaaatgccattactacttcaagtgatcgacaggttgaatacaatccctaaccaaaattcaatgtcatttttcacagagataaaaaacctccgaaatccttaaattcgtatggaactacaaaaggccctaacagtgaaaactatttgagcaaaaagaataaaataggaggctcacgcttcatgatttcaaaatacaaagtgattgtaataaaaatctcatggcactggcatagaaacagacacatcgaccaacaaaaccagagagaaagcccagaaataaatctagtcatttgtgggcaattgatttttgacaaaggtgccaagaacacacaatagagaagggatagccttttccatcagtggtgttggaaaactggttatccacatgcagaagaatgacactgtatctttatctcacatcattataaaaattaactcaaaatggattaaagatttaaatggaagatctacaactataaatcttagagaggaaaagctctgcaacattgttctgggcaattattttgtggatattattcctaaagcacaagataaaaaagcaaaacatagacaaatgggattgtatcaaactaaaatgcttctgcatagcaaaggaaattattaacaaagtgaagagacagctcacagaacaggagaaaatatttgcaaaccattaatgtgataagccaaaaatatataaggaactcaaacaactcaatagcaagaaaacaaataacctgattaaaaatgggcaaaggatttgaaaacacatttttcagaagaagacaaacaaatagccaacaggtacatttaaaaaatgctcagtatcactaatcattagggtaatgaaaattaaaaccaaatgagataccacctcacacctgttagaatggcttctatgaaaaagatgaaagataagtgttggtgaggatgtggtgaaaagtgaacacttgtcttttgctggtggaaatataaattagtactgccattatagaaaatggcatggagattcctcaaaaaaactaaaaatagaactaccatatgattcagcaaacccacttctggatatacattcaaaggaattaaaacaatatgttaaagggatatctgcatgctcatgtgcattgcagcattattcacaatagccaagatatggaatcaatctgtgtccatcaacagataatagattaaaccaatgttgtatacacacacaatgaaatactatttggctcgaaaagaaggaaattctgtcattttcaacaacatgaatgaacctggaggatattatgctaagtgaaataaaccaggcacagaaagacaaataccacatgatctcacttacgttacttatatgcagaatctaacaaatttgatctcatagaagtagagagtaaaacaatgattaccagagcctgggatatggggcagggggtggcaggtgggatggaatgaagtgctgttggtcaagggatacaaagttttggttagacaggaggaatatattaagctctattgcacggcagggtgactatagtcaatcatgatgtattgtatatttcagaataagtaaatttcaaatgtctcaccacaaagaatgataagtggaggtgataggtatgttaattagcttgatttgattatctcacattgtatatgtatatcaaaacatcatatagtgacctgtagtgtagacaattatgatttgtcaattgaaagtaatattaataagaaaagaattagtggtcaggagataaaattggagatctaactcttctttttcatatatggggcactttttcttttactcatattttatttgctaaagtgatcacaagatgctgagaagagaaagtgtggtctcatttgggctccaagccaggcagtttagcaatagagatttaatttttaaatttaattctaattaaaatgagaagctagagatgtaacaaaattcaagaagtgaaaactacaaaataaaatacaatcctgggggagcaaatatttaaagattcatggagcctcctgaatgagaatactggtattccttgtttctccttatgtctcctagtgataaagatacagctgtacattgacatctgtggcaaaattatagatacatttaaaatatgttttagataaatacatacatacttgtgtatcatactatatttttatctctaaatggtaaactatgtaacacatcatataacagtaatggtaacattactgcataagctacacatatatatatatatttaaattgactaaatgtttaaattttcctgtacctttatgaaatgggactcagcacattaatatatagtacagccttcaaatgcatttcattttaagatttttttttgtcttgaatcctaaaagagtagcaggataacatgataagggattcagcattttcaaagaagaaaacaacaaggcccagcatttagaagatcttcaactattttcttgccaatatctgactattctatgccatattggcctttgtccatttgtgcctagaaaattcctcacagtgagattttttcttatgcatgcaccacggttgctaaactttgctaaacactgctacaaaatgtcgcaaaaagtggcagattggtgccaatatacattcatgattgctaatcttacccaggctctcaacagtgcctgagaatcctattagctttccattacccaacttaattcccattcctgacagatactatttcacatcttcctaactcttctcaaatcttcagttcatccatcttccccctcagatccagaagattacttaaaaccactgggggaaaacttttggacttctcactgcccaagtaacaaccagcatacaccttttcctttgtccttttgggacaaggaagagttgactttccatctacataattgatctaccatgtatctgcagtctgaaatccttccccgctggattccttagaaatactgtaaattctccaccctccacctgcttgcatctccattttctccacttctggaggaatctcattagaatttcatcatgcatggtttttcagcattaaaaaatagaaaataaaaagtaaacaaccttcaacacaaactacctctgcaagtactattttttttctctccttacccctttacggtcaaaattcttgaaggcattatctatattttctgtcccagttcttcaactcattcaacattattatttttcctgcaatatgccaacaaccctgctttcacacaggttatccaagcttacatgttgcgaaatgtagacactctttagctagcttgcttaacttcttgggaacatttgatactgttggcaacttttctttaggactctctattttcttacctcctggggtacaactctcttctggtgtgcctccttccgcaccagcttctctttttttcctctgaacactccttttatctactctcacttaaaatattgatgaccttcaaggctcagttctagtctttttctccacctcactctaggacttattaaatgaatccaagaaacctttggtaagtttgtccactcccaaagcttcaaaatctgtaaactgatgactcccaaatctcttccttcagtacagacatctttcctgggatacttgcctagatatttagctggttactaaaactgcacatggatgtttcataggcccctgaagtctaacccactcaaagatgcactcatgatctccttatctttcttccacacttccacacttaattgtcctcttgtgttctctatctcagaaattccactaccatctacccaggacacctctcacatctagtaaatcatcaagtaatttagtttctattgtcaaattgctttctggatatttctctttattgctacagccaccaccgagatccaagccaatactatgtattttttctcctcattggttgccatctcttcctaattggccttttttcccgtcaaaatctctctcctgtaatctattgtctacagtgcacctatgagaatacagttatgatattctcccacttaaaatcttttaaagctgtcctactgcccttatgatcaagatcaaacctctaaccatttaataactgactcgaccattcatgatctgacctcagtacgttaagcagcctcataacttgacagcatcctcaaattctgttgtccagatatactgaactcccaccagttcttcaaagcagaacttgctcttgtccacatctaaggcttcacatatttttgttttctctcagattcactttagcacccctcttttctatttgatcctacccatccttcaagtcttatgttacatatcacttcctcagaaagccctcctgaaatttttggattagtttcagtaaatcctactgaaatatgacttcaacatttatgtacttcccttatcataacacctatcatgctttattattatgcctattatattagtttcctatttcttctgtaacaaattacaccaatttttttttgcttaaaacagcacaaatttattatacttctggagctcaaaagtctaaaataggctagcagtgccattttccttctggaggatatacaagataatcaatttctttatcttttacagcttttagaggctacctgtattctttggcttgtggtcccttcctctatcttcaaagtcagcaggccatctttaactttctgtcttctgacctctgcttctattttcacattgccttcccacattgattttctgcctctctcgttctcttataaggatcttggtgattacattgggcccacctaggtaatccaaggtactcttctgatcacgatatctttaacttaatcacgtctgcaaaaaactttttgacacagaagctaacatattgacaggtttcagtaattaggatgtagatatcttgtaggagggtattatactgcctttcatacttgtttaaatgtttgtttttcctattacagagcataaaatcttttctcttcccttctttattcttagtgcctagcacagtgccttacctctgagaggtgttcaatacatatttattatgaagaaatacaaagtcctagactgatttcttttttaaaaaatttctccaaggctagacacggtacctcatgccagtaatcccagcactttgggaggctgaggcgggtggatctcctgaggtcaggagttcgtgaccagcctggccaacatgatgaaatcctgtctctactaaaacaaaacaaaacaaaacaaaacaaaacaaaacaaacaaaccaaccagaaattagccgggtgtggtggtgcacacctgtaatcccagctacttgggaggctgacgtaggagaatcgcttaacccaagaggcagaggttgcagtgagctgagatcatgccactgcactccagcctgggtgacagagcaagactccatctcaaaaaaaaaaaaaaaaaattccaataaacatttactggtttctttttaaaaaaattcattcaataaacatttattgaacttcatctacctgaaagacatatttttgatgcttagattatagatgtgaataagaattgttctttgaatccatagtctaataatgaagacacatatatagaaagataaatacattaaggtctttttgttgtttgaaataagtatgcacattgagagtgaggaaccaaaagatgaatgtcaggacttcttaattttgaggagagaaggaagagtttttatgtaaggcattgccttcaaagagaattaggtcttctccggagaaacaaagtcagatgagaaatagcattctatgcagatgaaggtaggtgaagacataattagagcggcaaagccatttggttgatttacagaactgcaagaagtcagaaatggctgctgtttgggatagatagaaactatattatagtaagattggaaagataaaaaagagccagctctaaagggtctgtacatcatactattaaggtttgaatttagttcataaataatgtgagaccactaataatttcaaggatgtcaactatgactctgtacatattaaaataacttactgagatagcaatgtgtacatttcacggggggccacatattaacaaggagataagttagaagtcaataaccaatagtcaatgtgtgatattaaaggatgtcttcttgatctttgaaggctaaacttgatttcaatgtatatcaaaagatactgatgtagatataaagacatagatatagcaacatatgtaatactgaatgagtacaaattataaaatgtaataataaaacaaccaactataatcacaaaccagccttttccccttaagtgtatcacccttttaatttttttctcagtgactagctcttatcctgtcccaaatataaatttagtcaggtacaattgtctgtccctatgtaggtattaaaaaaacctgtggtgactttaactcacaaaacatagtttcaatccactaattaaaatgtctcagctcatgaatatatcaagactctgggtttgatttttttttttttttttaagttgaatcacttctccatctaccttactgtggtttctgatcctttcaatgttgtaatagtaggaatagaggagagttgagagaaacaaaaatatattgcttagctgaatctgtggagatgacatattcctatactctctggacttggtggatgtccaaaactgactctcttgtgtttattcctggaattttgggagaaactccttccactccatccacagagagctctcttctgcagcctctaggctcctagcatttggcctctactttctgttaaggtcatctcattcccccagctgacctgtgtgcaaagtttaagaccacctaattgcatattcctctcctgtgtggctcaaaagtggtcccaaggaaatgcttatgaatccatcatccctacaaaacctagagatgccattaacattctctaatcagccctctcctctgctgcaacagaccatgttagccagtttcttgcttgtagactacttaggcttagctcagatattagttcactacaacctgtaatttgaaaggacacagattatgatccctcactggtcttcttaaaaacaccttggagtttgtgtgtaagtttggagaaggagggcattcacaaaatacctctccccaaaagaaatcttcaaaacccctccttccaaaaaactccaaaaaaagacaacctacctatagttgtaagaggtttaagactacctatagttataagagtcatatagctggaccaaagccaccacctatttttgaaaactttcataacaacttagaacctcactttgcaatatacgctcttagctgagttaagtaagtattaagtactgtgtgcacagtactaagtcttatcttaatcatttcaactcagtgagaaaaaaaactaaagcccagagaggttaaagaatatgttaaaggtcacattgttgacaaatagtggacctgatattcaaaaccagggagcccaaatcagaactatgtctcctcatatcataacctttattgtattatatttgtttaaatgcccgtcatccctatcagattgcattttttttctcttcacaattaccatagtaatgctcttccatttcttaacactgatgtgcttcttatttttttaaatgcaatgcaagatggtgtattgcttctcatgctatatggggtttgtgtgtgtgtgtgtgtgtgtgtgtgtgtgtgatttttcgatttgctaatgatgacaaaataagcagcacagccaactttggaataaaaatgattccaaaacataaatattattgctataatatcgtgttaaaaaaataaggagggctgggcatggtggctcacaactgtaatcttagtactttgggagaccgaggtgggtggatcacctgagatcgggagttcgagaccagcctgatcaacatggagaaactctgtccctactaaaaatacaaaaattagccgggtatggtggtgcgtgcctgtaatcccagctactcgagaggctgaggcacaagaatcgcttgatccaaggaggcagaggttgtggtgagccgagatcgcgccattgcactccagcctaggcaatgagagcaaaactctgtcttaaataaataaataaataaggagaaaagttcattgttttcatctacaaaaaagcaaaattaatttttatcctgaattttaaactcattttacagccactgcatgaaacatgctattttatttactggagagacattgcactgacaatgcccacagtctgatcatccttagaaagctccctctcacatgccaacgaaaacctatctttctgtggggtccttctgtggagtagatttttatcttaaaatcagataactgatttttttttccacctttgctttattctgaaggtttggcaaactaccgcccatgggctaaatctggtccactgcctcttttctaaataaagttttattggaacacagccatgcctattcacttatgttttgtgtacggttcttttcttgctaaaatggcagaattcactagttgccaaagagtttgtataggccacaaggtctatggccctttacagtaaaaggttacttacccttcttctagacagtttagattgacataaaatcctctacagaataccactgcaaccatgttgccctccttcaatttacttttttaacatttattcatttttttatcttgcctttttaaccttgtttcatttttattgccttttccatatatttttagcaattttaaatttattttattttagtatattgcatgcatcttcaaagctaccctaatttctttttgaaatacaatggcataaaactgaaattaaaatatcccatggtgttatatacattttgcaggttgtctcaaaatgtcttttgtttaaaatacagttgaatataaagaaatcaaacaagtaagcagcgaaacttatagtttaaaaaacgatttttttgcactgacttgactatttatcttgttttgagacaccaccacatatttgttctctaactttgtaagctttagaagcactagctaatgtttttaatgaaaaaaagccaacagacaaaaataataataattctattttcaacttcatgctttattttctgagaggaagaaagcagtttatttgttacgggtacatttgaataagaccttaaatcatttatctgttaaaagcattaagtactgtcttttagatttttttaaaaaatatttatttatatattttttttgtagtgaagtagaatgaaaattaatgctctcctgtctctgtataataaaaaataatttggatatatactttttatttcatgaaatttcatttacctagaaaatatgcttctgtcatagaaataaccactgggtgctacaaaacgtatatataaatttttatcagtggaaatcaatttgcataaatttatattagccttctaattgaaccttctcatcttatctaatacactgtttgcttaataaatcttatagagcctctttttggctttaacttttctcataaaaaacttttatgatatttctaaagttttatttcactttatataattcaaaaaccaccacaggtaatatatataaaggtcatactacaaaaatgtcttgactcctaaccaattctatgccacactaaagttcctatactcagtgtttctgattcaatgctaagaggacttttacattttcaaagaccttttgataatgaatagacggtaagtatttggaaagaaaatataaatcccaggattatatttgaagcacttttcttcagtttgcaatgctaaagttaggagattaaatgagaaaaccccatactaaattttccaattaaaaaatgaggtaggccctggctataaagaaagtctctttacatagacttcattatgttgctggtcaaatcataccccttacatatatggtgatacacataggcagctttgttactccttctttctgtttttgccaaagttaaaagagattcttctgtattttgctttcttgttggaaaacaaagatttactaccatgtttaatacccctgggctgattttggaaatttcaggttaaacacattctaaaaaggcatctgtagtctaaggactcagagcataggtgtgcccaatccaaagaaaactaaaacaacatcaatagcagcaacaacaaaggcactaacttcctggttagcctaatgatgtttcattacaaatactcagccaacagttttaggaaaagtcctgtcctgtcctggaactgcaagatttgatggctctgccataagggattagaaggggttgatatttgtcattttgcaagcaccacagatctttggtgttttttcatttgtatttattttattgtaggattaaactagactaagcccataaagttttcctgaaaattaaacttttttcaacttaaaaggtggtgatttagccaaacaataaatatcgcaatctgtgattacaaaattggatcaaaggatgtgaaaataacaccagaggagcaattttagatcattgtgtttagatttctcagaagaatctgacactaagctgaattatttttctgaaacccataccaaaaatgttcattagagttcttgttcaaaatcactgtgatgggtaaggttctttgtccttcaaatttttacttatgttagatttcactgtggcatcactgaatagaaaaaaataaaataacaaaatagattgggtggtttgattttagggaaaaagtccttaaatgaatcttttgttttcctgcttttgctacctcattaatcctaaatggtgtcagtcagttgagtctaatagctgcgagtgttactaccttggtcagttccaaattatagtattgattaattgattgtcttcttccagttgtgaattatattaacgctggcccaggcagtttggcttgaggccaaaggctaattttcaatggaaggcaagaagcagtttcactgtttctctgctgtggttaagtggatgctcagaaaacagaaagctttgaaaagatgatttgacaaaaaggaatgcactaaatataattaatatgtgcttattgatccatccaacctagagaaacaagtaggaagacagtaagttgagaattcatcatttgtcagccccagacttccaaaacagtcttaaaacaattgactggagaatgagagtaggagggaagcaagatggtccagaatgataatgagccagcctcaggatctgtggaattaagtccagatgcaagtgtggtgactgtggtgctttcaaacgaagtgaaacttgatgtgggttacaggctcctctacatcataggcccagctgtccaggaaagcttaagaaacacctgccacattgtggtaccaccagggcagcagtaccatgttctcagaaaaatataaacattacaaattgaaagtcaaaacaagaggggctgctttctcgttaactctctgctttaaggaagaacataaaagggttgagtgtgcttatcattgattcttgtggaacgggaaaagctaaatggggcattgagaggttaataactttcacagatctataactctgagtttctttgttgccagatcaattcattttccctgtaaaatgtgaagggaaaactggtatgggatggagtattgctaattataagattatattatatataaatataattagattatatttataatcattattggtctttcttttcaatgtggacaaaattatgcttggtttcacagggaaataggaaaaggagcttttcttcttcaagtaaagagaaagagcatgaaaaaatgcgggaagtgattgaaggggtcttaaatttgaaagcattgacatcaaatatatagacgattgtcataaatggaaagtttggaggaaacaatcatgaatacgtggaaagcagtcacaaggtcaaatatgttgataggaattagaattctatgggcgtattttctataagagaagagagactgcaggtagacatattgatgaggaaaaaactactcttctataagtggcactaggtttaatattattgattattttatatatatatgaaaaatccttagcagaagcaattatgtaacagcctcttggcatggattctataatgaaagttcatagaataaatctccacaaaatataaaggtatattaattcttcattactgtctcaatgatctgcagcaaaaataaggttaaaatttggaaagacataatcattatttaacaaatattatgataagctaggctgtttatgatagatgataaggatattatagagggagggccaaaacaagaagcatgtctttagggtaatctgttgagtagttagtaattcaggtaactcacagtataaatggtattacaaatccagtgtaccagtgatttgaataaattactgcatatcttagtacactaagtattctctaagtgagctagttataatcttagcttcttttggaaaagatacaaatataattcatcctagtaaattcttctgcactcagcacagagaccctaacacaaaatgagtgctgcatgaatatttgtcaaaaaagggaatgtataagaatatagcctttgaatcaatttcctttcagtggcaaaatgtactttccctaaagaaacatagtaataaagtcaacaatgacacagtagcaaagtaaaatgtttgggatccaagcatgtataaatataactatttttatctcttctcttcctcctctctttacctgaataaatctgattaaccctttactcactttcattttctggagaagtgatcccttgcccgtttggacctagattaagcagcattatctcgggctctgtgtttcccatgttttggaaatatttgcactctcctataattgtttatttaattggcttattcatgatagatgtgctatgtcttcttattcttctgtatgttccctaggcactggcaaagggtttggcatatagatggcacttggtttttctagtctgtgtcattcttggcccctctcctctatacctcccatctggttgatttgcacatccaggtagctctaagcaatgcctatctagaatttaaccatttctctgactcccaaagccatcatcttatccagtacttgcctgcattattccaatagcctttatcctgcacctggcactgtttttgccccatttattcagttctaactcaagcctaaatgattctcttaaaatacagattcgatcgtgtccaaaatattcagtgaaagatcatcttctgttcagaatgttcaatgagagatcacctcactcagaatgaaagccaaagttcttaccagcagctaacatggccttcgtttatttcccagtcatcttttcctcctgactctcctcagactttcactccagacacgtgagcccttctgttccttgctttaggtaagctccctccttagggtctttgcacctgctctttccttatctagaatattttccccctaatatctacatgactcactccttactttcttcagagtttgactcaaaagtcacctactcagttcaaaatttgaatattctccttactcaatactttaattttatttccctactttatcttgtcctaatagtgctgatttcaagtctggtattcagcaagtaaaatgaacttccattctgtgtagctgggtgtctattcggatgggttggtatccatttgtactggttgggtcatgggtcacttaacactggggatacattctgataaatgtgttgttagctgattacatcattgtgcaaacatcatagagtgtccttacaaaaacttactaattatagcctaccagtgtagctatatggtatagcctactacccacctaggctatatggtatagcttattactcctaggcaacaaacctgtacagcatgctgctgtgttgaatactgtacaccattgtaatacaatggcatgtgtgtatctagacatatctaaacatagaaaaggtaaagtaaaaatatgctagtatgctcttacaggaccactgctgtatatgcagtccatggttgaccatggaccattgttacacaaagcatgactctattttaaatctcacctctgctcgtcactatctaatatacccgatactttgccggtttctctttaccattggcctcccctactctaatgtgttcttgttcaacactgtatcccaatatctgcagtgtctggcccactttggctcctaccggcatgctcttatgttagcctatgcacaatttcaccttaaaaagaattgcaaatgcctcagagaatgagagattccatagacatatattttctaggcaattaaacctccatgataatgagggagttaagtatctttaaaaaatactatgagaagtatattgcatgaaaaaatagtttgaactataaaacagaaatatatttgtttataccatacagcccccccaaataaaacattaccaacaggaaaaaaaatcgttatatagaatacttatttgctttcctattgtctccatgtaacagatcatgaactccttgagggcaggtaccattttttgtatctttgtctctccatcatctacaatagtgactgattaataaatattcaataaatagatgaatgaaaaaagggactttgaacatatccacaattacccatttaagagacagaaatcatcacaactatgcttttatttactatgcttacatacttttattttaatcaaggtaaatcatttatacatactcctattggctcaaatataaccttataagttatgttattccaaatgtgtgcatttatctgccttaagggttttcaggagcataatccttgtgattgaggtgaagatagtagatatacataaatgctatctcagcattactgtggttttaaattgtgtaatatgttctcctaagtaaattgtaaacaactgttgccaacaaaggatattacataagagatttcataatcttatttaataactatagtgatttctaatatttcaaaaagtgattgaaaaatgtaattctgcctagaaaaatttaggatcagatttagaagtaattttaaaaattgttattatttttataaatttggaaccatttaatgtgctaatgattttcttttttttaagaccgtgagatttgctttggactgaatgttgctagctcacccaaaattcataatctgaagcctgatcaccagtgtgatggaattatgaagtggggccattgaaaggtgattaggtcatgggatgaagccctcaggaatgggattaatatcattataaaagagtacccagaaaactgatttcccctttccactatatgacatagccagaagaccccatctatgaaccaggaaatgatccctcaccagacaccaaatttgccagcactttggtcttagactttcagcctccagaactataaaaaataaattgctgtttatatgccacccagtctaaggtaatttcttatagcagccaaagtgaactaagacaagatttttctaaaacgttgtctttcatgttaccctgttcatcacaagaacaattaaccactaaaatctttgttaataaattatataagatcatacagggcatgtttgtcaatcgtacaaaagatagttttaataattcttggctgggcacggtggctcacgcttgtaatcccagcactttgggaggccaaggcaggtggatcacgaggtcaggagttcgagaccagtctggcaaacacagtaaaaccccgtctctactaaaaatacaaaaaaattagctgagcatgatggtgggtgcctgtaatcccagctactcaggaggctgaggcaggagaatcgcttgaacctgggagatggaggttacagtgagccgagattgcgctgctgcactccagcttgggcaacagagtgagactctgtctcaaaaaaaaaaaaaaaaaaaaaaaaaaaagagttttaacaattcttataagcttaggactcaaaaatatactatttgttttgaggaagactcttctttgtgtgatccgattgtattactccatatttctaccggcccaagtacctctccccatggtcagcacagctcatgctaggtacctccaggatcacatcattgagtatttggaaaatgggtcatcgactagcaaaaactcatattataaatgcggagccatatgcaatgggtataacttaatgccccaaatctgtaggcctgaaaaaagaaagaaagaagcacaaagtcttttatatatcactcttgaactcaacttctaggtaatcttctatagctgagtctgcaactccttccctcagaataacaaatgtgcagctaccaagcaccaaaatttaataattcagcaatctcacattgctactcttatatttcatccttcatctttccacagcctataagtagaaaaatagttgaagagcatgaggcagataaacttaagggcttgatatgtaagaaggttgtcagcttgctggtctaattgttctggttctacactctgccacctataattgaatgtgattgaattaattcagcttatttatttggtcatttatttctagaaagaggtatctaacttttcatgaacataatcattgatgatttgaccattaaggtcactctcaggaggagttagaagtcagtctctatctatatagttctatgcaggctgaaaaaccattcactttctcctaatcttcttttcttaggtgcttttcttcctttttgtccatttattaggtaatttccaacttgattactaaactaagatgagagatatttaaaaatagacccatgttaattgctatgatttcaatgtctccattaaaactcatgttgaaacctaattgctaatgtaatggtgttgggagttggggccttaaagaggtgagtaagccatgaggcctctgccctcatgaatgaattcatgctgttatagtagaagtggtttaattatcatgggcatgggttcctgatgaaagaataagttctgtccccatttactctttcagtctcatgaaatcacttccaccttcttcccttctgccatgggatgaggcccttgccaggtgctggtgccatgatcttagatttcccagtctccagaaccatgagtcaaataaacttccattctttataaattactcatgcgggggtattgtgttatagcagcacaaaacagataaagacattaatggaattcagttctagatggttagatggtcaaaatatgtcctatgagtatctatctatctatcttagtagttttttctgtctgtatatcctaatgcccacttgtattaattcattttcatactgctataaagaactgcccaagactgggtaatttataaagaaaagaggtttaattgactcacagtttagcatggttggggaggtctcaggaaacttacaatcatggtggaaggtgaaggggaagcaaggtgctttcttcccaaggcagcaggaaggagaagtgcctagtgaagggaaaacagccccttataaaaccatcagatctcatgagaactcactctgaaaagaaaacagcatgggggaaactgcccccatgattcaattacctccacctggcctctcccttgacatgtggggattatggggattatggggattgcaattccagatgagatttgggtggggatataaaacctaaccatatcacgaccctaattgttttttagcttctatttttagaagtgaactgataagtactgactaaaactagtgtgaaaaatttatactttatactcattaatatattgcataattagaaaatatattagagcataactatcttaaaatttgttttttgtcattatgaactcaaattaaacttaattttaaaatgattatgtctaatgcttgattaattcaaacaatccaaactgatgatcttttaaaaataattatggtgagcaaaaaaaattccggtaagcaaattgttaatgcttaatcctatcaatcttgacttgaaaatgatggatgtaaacaaatcaatttaaaaatcagcttaagaggccgctatttatagtagtccctataaaaatggctttgtactttagttgttttataaaggcatcttaaaacatataaaagactgagttaattttaaaagctaaaagtatagtggccaaatgaagagatgcacatgcctatgatggtatccagacactatttgatacatggtatttaattgtaggcatcaatttgaaacatgaaatattttatcgatgtgctgggaaagagagatcagatgatgaaatatctggaacccatctcataataggaatggtgaaggaactacagatattttgcataggaaatagaagactaaggataaaaaaggcaggtagcttttgtatcaatataaggaagacttttcttgtaaatacagctactcaataatgaaagtgaggtttatgcttagtttaatcagagtgtggctgactgtgtgtgtgtgtgtctcaggaaagtagcctacaaagagattgaactgtgacctcccttagtctttctgccttaattgccttggttttcctgcctgcctgcctttttctttcctcctctcctccccttctctttcttcctttctttcttttcttttctctctctttttcctcacttcctccttccttctttccttttttctttccttctttctatcaaagggtgatgtggttttaaacacagaataaaaatgatttgaatcacagatatactaccaaatatcttttattatcttgggcaggacatttgccttctctgggtttaaatttgtcatgtacaaatcatggcctggggtctttacagcctattttagttctaatattctctgaccatgtaagtgtagacatattgacaaactctaagtctagttatgaagagtcattacaactataggcttttagagctgaaaagcatttagtcaacctccatacaagtcattacattttacatattgttgtttctacattgaattgctagtaaatcatttcaataagtccttctttaaatgctgtatatatagtataaaggttttttactacccttgaatgaacaaatgtgactctctcaagcagaaatgctctgggaacatcctgctgagctttcttcttctggccatacagtctacatacacaattaaccttcccttaattagattaacttgttctttacctgggactgtcaaattaatactgtaatcaaagatctcttttagagacctgaatatgttcctgctacgtgtaatgctaattacttctttactaaaagtaactaaaaacaggctcacttaatggtatgccttagttagaagatctggtttatgtctccaaactagtgctactcagaacttcacaaacaattcttaaaatcaactaaagaaaccttagtatttctgattttcttaattgttgaaactcaaagatttaataaaattccagactagacctacttacatgaaaatatttataagcattggcactggttcttatattaaaacatgatactgcatagcatttaatcaaatgttatttataacaaattaaattgccctttccaaaataagcaaagcatttggctatagaacccacagtattgttatgttcaccccacatatttccaaatgcagacattttaacagtttctggctatcattagcttgatccaattatgaaaagtgacactgatgattacatgacaaagaaagctcacttaaccaaattgactaaacttggtcaatgtccccaaggcaaaatgctacgaaccactagctgaagactaggatattaagcatcaacagtattttaaataccctctaacattctcaatcagccattgattaagcatctatggtttcaatgtttagacattgtgggaaatgtgaagatgagcaaaaagacatacaccctccttttaaaaagtttacagtcatagacacttaaggaggaactggcaggataatggaaacctgattcttttgccatctagttagatggttttgattctgtcaatcaggaaccaccttgaaataaaataatgaatgaggtctctgaagtttcacctgggtttgaattcttgtgtgatgtagcaagatatttcatttctctagttctcaggtccctcatcctaacatggagataaagtacagacctcaggttttctgtgaggagtaaatgtcatatatgtacaatatgttttgcacataatatacatatcaaaaataaatgttaaaatatttaagggatgaaggatacattaaacaagaaagctcttttttattggcaagagtgaaaagttaagtattttgtgttacataagtaccgattgcgccactggatgacccagccatcccattactggatatatacccaaaggattaaaaatcatgctgctatgaagacacatgcacacgtatgtttattgcggcactattcacaatagcaaagacttggaaccaacccaaatgtccaacaatgatagactggattaagaaaatgtggcacgtatacaccatggaatactatgcagccacaaaaaatgatgagttcatgtcttttgcagggacatggatgaaactggaaaccatcattctcagcaaactatcgcaaggacaaaaaaccaaataccgcatattctcactcgtaggtgggaactgaacaatgagaacacatggacacaggaaggggaacatcacacagtggggcctgttgtggggtggggggagggcggagggatagcattaggagatatacctaatgctaaatgatgagttaatgggtgcagcacaccaacatggcacatgtatacatatgtaacaaacctgcacgttgtgcacatgtactctaaaacttaaagtataatagtaataaaattaaaaaatatatattttgtgttagatggctacattcaggactgatgtataacactcacatactacaaaaggaaagaatttcttctttctttcaggcaatgccctgaaacaactagctcactagctggtgatcttaaataattggaggaaaagacaatttaggaaatactgatgaaatctaataccctaaataaagtgtattgagcttcacccaagtgtctgacaacatgtcttacaatatttttgtacacatcatgtcttaaaaatttttgtagacaatatggagaagttggaactgaaaagagccaggtagatttcttaagtggcaaaaatcataaaaaagacattggaatatgtaaatattaatttgtaaagcacttttggacttggctcagagttccgtcttcggtagagtaaaaataccaaagaatttgaaagtcagaaaggtttaggttggagttcttgctctaactctttagctgtgagagacctttgcctccttggccatcagtttcttttgtaatgggatcatatgaagataacatagaaagccattccttttctgcttggcacatactaagggctcaacaaatgatttcaataataatcattgttatttttaccttaatttcatttttgtaatgaggtgcagctgattatggtatcttgttttcgtttttattcactttgaaaatacagttagaaaaaaagccttttctctaggtaggtagttatgtttttttctgactgtgtgctatgattcaagcaactatcctgttttgagaaggtgaactgctaaaatatgctgcctgtttccattttcaaacctgcctgtgtgtgagcagacaggttcctgatgctctaaattttaataaaaataacaataataacatctacaaacaaatttatgtacctcctactgtgtcaaatagtattcaccaaagcagctttcatatatgaactcatttaatcttcactacagccaccagaaatataattattatctttatttaacaaatgagaaatctcaggcacaaatttgcacagtttacttaatatcaaatggctaataagtagaagacaatccaggcaaatgtaagtctagaatctatgaaatttgctccttataatagaattggtctgtcttgaagaaacaatgtcattaatggaggcatatttgaaatatttctattagcactagatcagacagaaatagaactaaaaagaaaataggaacatcacttgtatgattagttctacagaaataagtactttggactcccaaacaagtggcttttaaatgaacactggaagataatgtgcttggaaaatggaaactgattctatacaaattgctgaaacataaagcagaatgagtagtattttaagagagtcaagaatgaagacacagaggaattcaaaagaataacacatcaatttgactgggggtatccaagaaagctttttggggaaggtaagctgaatcttaacatataaaattgaacaatgatgaacccccatggaaacaggctgaaagcctgaaataaatttactacaatcttcgttatctcttatttgtttgttgagttatcatcttatttgacttcagtggtactgtgatttctgaaggacctttgtgtaccttctccatatgcagatatttccattttcttagagtcataagatacatcaaccccaaaataagatcaacaggggatagggacggtgatattcttttctttaaactgaggatgcaaaattttagcagataagagatttgagcatgctaacgaacttttaaacctcacagactttatttagaaagtttgtatttagaaacattgattttaaaacatttaagtttatcttattcatcacaagtttattacgagataatagtctctgaataacaagccaacagatcaaatatctcagagaaagaatatgggaattgtttatttcaaagaattatctttgtaggattagaaacacactattaaactgcaatgggtgaggaaaaaatgtccttggcagaggattttaaacaaaaagtattattatggtagatgaaatgtttatattagaaaagggatatgtaatgaaacaaagctgtgttaatagcaaaaattttgtcacaaagtagtgagaactgaatgcattaaatcataacctgttattgtttaacaaagattagactttaaaaaattcgctaatctactcactaatctgttttctcactttattccctcattaacaataaatagctttgtagcttccaaaagagccaaaataaagtatgtaggcgagaccaccaccgagggctaataatttcatagcagcagcagctaaattcaatcaacatttaaatctataagcatctgctgcttcaattcagaaatttaaccgattgttagatttccccccacgttcaggcctaacatcatatataattcagaactgaaaaataaatctctcattgacagatttcttagttattctattgtcattaatacattataaaggaaaatctatagtaaagaataactcaatattaggtaaacagagtaaaatgtttgagtattttatccatccatccatcctaaccaatattcgttgagttgaactatacatcagttactgtattaagtattaggacccagagaagggaaagggttaaaatgtggttgtggactcaccttgagttagccaccgtcggtgttttcagacacagtccctggcctcaagaagttcaaaacctaattataaagatagaaagtaacaattatttaaaaaatattttaatccctacattgtctttaagataaatgctgtcaccccattttttagtggggattgaggcagagatgagaaaaagtaagctagttaatgagaaactagtatcaattttatgaaatacaatctttaattgaagtagtgaaatgccaaaaaccaacatggaaatcactattgttcacaggctataaagcagaatattgactattctttaaaatgttgaattgaaactaacatgtccaccataaaatggctaaattgccttcttacaacatcagtttcattaagtccagtaaacatcttggtttgttgcatcctacaattacataatacatttcagaatatccatcctttggcctttaaataaataatgcccctaagttgttaaggggagcacttaaaccttggcagccaagctaaagcaaatccttgtctatcctactcgttctgggacgaattagcatggaaaattccatcttataagcattacatttatgtttaagaatttcataattaatttaaaaagatccacacctctgaaacatataaaaaggcacaatgtcttaatttctcaacagaataatttgtacaagatttgaagtctaccttaatgattcatttttgtattgttttcacaattgctttattttgtttagcacatttttttctcaactctttttaacatattaaactcttattcctccttcaattcccagcaaagttgtcatctcatggggagagactttttgacaccctgctccctctaagttttagttagatgaatctcctagatgctccaacaagctctgcatctttccctatcacacgttatcacatcaccctgtgtcggagaaaatggctaactgttcaccaaaacatttcccttttccttctgttacatagccagactacattttgtagttagatgtgactacattcctcaccatggaacacagtcttaagaacatcttgcatatgatcctcattctatgtttcttacctataggttaaatccctaaggacctaaaggaggaaaggtcccaaagacaaaaagaacatgattctccagccacagctttcaggatcacccctcacttccactaataaggtctattcacagtacagtgttacatagatgagcattcgtcacctcaccctgactaggacatctattggcactgcgttttatgtaaatgagaattaaatttctcttctttaagccattaaaagggtgggtgtttattatagcacttagcctgtttggtttattagatttcccacattagattgtaaactatggtaccccgtggatacagcaactagttttgtcttgtttgaggttttagctgagcgcttgacacagaaaatagcatatacttaccatccctctctctgttttttaaaataacttaaatcttatgtgataagatgtatcatgaaaatttcataggaactattattctaaatagttattccttcaggaatagggaacataaggcttcatttagcacgggttccaaaatatcctttggtaaatacctaaaggtaaaatttgattttgtttaagagctcacagcaagtggaacacatcaaaatatgcttgcaaaactgttcttataggcctctatttgtgggttttaggtaagacgctgagagcattgcacaaccttagtcagaagtaatgggcttggaagctccttgctgtagtcgtggtgatttggaatgtcctttgaccctctactggatttaatgccaatggagagaaaatgaaaggtaattttctttccttttcaaaacaataaccaatcacagaatccaagaccttctgctcttcacatattacaatgaaacagcttttgaagtctagacaaaaatagagacatctgacaagcaatatcaaatctcagtcagcatgcctccatgtattcattactgacacttctctccctttcccctagagtcaaacacactctattcaatgattccttttaggcaaccaaccacctgtttggggccacttcctaagggtctctccaaaagtctcacccatctgtctctctttactattgtccacttgctggttaagtttagtcttgcttggcagaagtcaactttccgagatttacctcctttactttcagccctacttaagcaacggactttagaggagatgatcagatctcctggcttcctttctgaggaatgaagaggaaacttttgctgctagacatgcaactgccttttgatctgaagtagaaaatcctcaggctctattccattactcatttagatgattgctgaatggcaccttcaggctagattttatggttgctttaataaatttgtagttcactcacattaatgtctatatattaataaagcatttctctagtgtcaggcaaacatgcgttggatttactagttaaagacacctcttacaggttttcatagacattttagataattttttttctttttttttttgcctctcagaccaccacacaagtgcctttcttttcagagtacaaatatcagtctagttatctgtcgatctggtagaggagacaacaaaaactatttaacatcagtgagaaatagaaaaaaatgtaatcctttctaagccatgcataatgtctaggtcaactaagttttctccactgtgattaaaaatggcaaattattaagaagtcccattttattttctggagattgagaaaaaatagatgataaattctcatgaacagaagaaaatggattttcagcaagtaatttggctcaagaaggcagaccctagtgcatggaacatgctcaatctgggggagagaaagaaatgaacaaggaggaaataacaataagggttctttcatttcccagctgtctgccaaaatttggactggttgttatggctgaggaaactgtaagagctgaagttcataactttaaagcgaagatctgtccatggtggggcacaatctgaccagatacagtttctagtatttgtatatgttcatgaagcctgggcaacatcataagatcccatttctacaaaaaatacagaaagctagctgggcattgtggcatgcacttgtagtcccagctagtcaggaggctaaggtgggaagatcgattgagctccagaggtcgagggtgtagtgagctgtaatggtaccaccgcactccaacctggacaacaaaacaagactctgtctctctctctctctctgtctctccctctctctctctctctctctctctctctctctctcacacacacacacacaaacacacgtatcctaatacatatgtgtgtatgcatgggaagttttgaaggctccaattcactttggtcataacccagttttccaccttcacagaaataacaaacatttcagaaatagcctttcatttagtgtgttttgcattaaaagagcataatcttctattttctaactggaattatctagatgatgtttatattcttacacataaaaatatttagatttgcttagaataatttttttatatttactatatggtatcccttctgttataaactgaaatttccaaattttaatatgactcttgagtattatataaaatataataattaaaacatttcacacctgaaaaaggtatttcaacagaaacactgaaatttattttacataatatattgcaatgattttcactctaaattagaaaaaagtttacttcctatcaattttatttctgctgttaaccctattctaaatcatccctcaaaattctgattatcaaaataacatgtaattttaaaacagattctcattagtgcaagcaactgtgactttttaaagtagcttaaaattacatattaaagagatttcattaggaagctttcattctctttcatttagaattgtttgcacatacttctcattagtcattgtactcagattttcagattcaagtataaggatagtcctttgcattaccttaaacaccaggtaagtaaaattccaggaaaaaataagttttgaaatacctaaaggtacctgtcttatgaaattgtcaagtcccttttttatgtgcagtttgtacaatacaaagccaagacagatgaataagagagtgtgattttaagctttgcttggcaaacatgttagatttcttaaatggcatagcttgtctttcctccctccctccctgcttccctctctttccctctctctctctctcaaccttgttctaatgtcatcccttataggtttcttgtgaaatagactgatttggagctgtgttaataacaacaacaacaaatactactgcaacccacattgcagtgaacaatatataaaatggcaaataaattgtacctctcatgactaaagaataagaggattttttttttgtggtgttgtgttatgttgtgtgtgtgtttgtgtatgtatgtgtgtttccatgtgacaccattataagaacaagcaggacttcttggaatcctgagtccttttgtctcaactaaattaagagataatttaaattaaaaaaatcaatatataatgcacttatagaaaagtacataaataatgaatcatacaaaataaacatcagggtaaacaccacccacgtcaagatatagcacatttccagtaatacatacttcatgcttactctcaaactcactttttcctcctcaccaaaggtaaacaaacaccatcttgacttctaacctatggtttagggttgccttgaacgttatgtaaatgtaatcaagtattgcatgttatttttgtgtctgccttctttccttaacattaaggttgttggctacattcatgttgtaatttgtcaaatatctgaatatacagtgccatatttttgtaactattctattgctgatggacattgggtaatttccagtttaaagcaattacaattaatgccgcaataaacatccttgtagatatttcttggtatgcatgttgtagataatgaggagtggaattgctggatcatctggttacgtatatgttaaatttcaatagataatgccaaactgttttccaaagtggttgtagcaattatacttttcctgcaatatatgagtgtttctgttgtataacatctttgccaatagttggtagaagttatttgctttgaaagtctaagcttggttagtgaaagaggagagagggagtgaaggcttggactagaaaagggaagacccctgacctaggattcagttgactggtagaagaatgatggttgtgccatgagtggtaaagactctaacaacccttttaaggattttccctggaagtagggagatccttgaaggattgcaggatctaatgagagacatggtattctgtggaattatgagagtggacgtcaacctggtcacagaattttagtgcaaaataaattgtgtgtgtgtgtgtgtgtgtgtgtgtgtgtgtgttgtgtgcatgcatgtcttggaatctttttacaagcaaataaacaaaaccaacacataaagtggaaagagtctctttacacaggaaaatcatcagaaattcctagggtggtgaattaaagatgacaaggaccacaagagtagaagctagccatgaagaactacttaatatcagtctattctaaattacatcttattcttctttttgtaatccattttgaacatggtatgtatcagaagagatgggaatacaattccattattttcaggtatgaggaattttccataagtgttcactgagctgttttagtaagtgattgctttataaggtaattattttatgattatcacatagaaggtgcttttgaaaaaatatcctctagagtcaggaaaaatcatggaattttatagttgaaagagatcttgaacaacatctaattaaacctcatttcacagatgaggaagttgaggtgcacagttgctcagtgatttgatggggctaacgtagtagttaactgcagatatagaagaatctaggccttttaatccggaagactctcatcataaattcattttattaaataaacattgaaattttattaattcacttttcttacctggtctattcctacacatccttcagaacccatcagggtttatctactacaaaacgtcctctctgatcccttctctccttaaatccatatgagatgcttctattatgtcttaacactttataatgatttctattttataactgtctatatggttatctctttgcccactatactgaaaaagcagaagacaggaactgcttttatttttttctgtttttgtcctcagcattttgcataagcctagcatacagtgataaatggtaaatatttttgaaatgaataaacaaatcaaaatctggctctttattattttgctatgcactcaggtggatgtgaaatatattactttacccattaggttgttttctgggctgttcattgatatttccatttctcatctttccaggaatatggtcaaagtgaacttccttgtgcctttgaaattagtgtggctgtgtaatttgagcagaagtatcacatgtcacttccatgcagaagactttaatagccagtgataatttgccccttcctcgctcctggcacagtgatgttggagactttctgagtgaggacagcatgagaagaatatgtagccaatggctatggtttgaatgtgtcctccaaagttcatgtgttggaaacttaatccctattgtaacagtgttaggaaagtcagacctttaagaggtgattaggtcatgagggctctgttctcattggtagattaatgctttaattgtgggagttggttagttattgcaggagtgagctcttgataaaaggatgagtgatatggtttgactgtgtccccacccaaatctcaatttgaattgtatctcccagaattcccacatgtcgtgggagggacccagggggaggtaagtgaatcatggggccagtatttcccatgctattcttgtgatagtgaataagtctcacgagatccagtgggtttatcaggggtttctgttttgcttcttccgcattttctcttgcagctgccatgtaagaagtgcctttcacctcccaccatgattctgaggcccccccagccattctcaggtatgtctttatcagcagtgtgaaaatggactaatacaacgagttagcccctttcctctctctcctgatcttctgaatttcaccatgtgatgacatagcacaaaagccctaggaggacactaataccttgacattaaacatcctagccctgagaactgtgagccagtagatttctgctctttacaaattatccagtctcaggtattttgttacagcagcataaaatgtactatgatatcaacccatgatagataagtggtgtgattgagaaatagaactatgttattctaagtcacaaagattttagagttactactgtctcataacccagtgcatcctgactaattaatgggatgagactttgggggactgttggagagagtgagcctattctgcagtgagagaaggctgaaccatagagttcagatgttgaactgtcacatatagcttcaaaaatggatcttgaagattctcatctcctggcattcatacacttgtgtaacctcctccccttgaatgtaggctggacccagtggcttgtctctaacaaaaataatgctgcaaaagtaatggcaagttgccgattagattataaaaagactggggcttctttcttgcttgctatgtcacattctgtctcttggagcctttggtctggaaaaagccagttaccacatgatgactagccctatagaagggcccatgtggcaaaaggttaatttctttcgcttacgacagagactactgaaggcttgtcaacaatcctgtgaatgagataggaaggggtcttctgagccttaccaaaagccatgttgctgaacttgagtgtggatcttctttcatttggtccttgaaatgaccccagtcctggctgataccctgattgcagtctcgtgagaggtctggagcaagaggcaccccgctaatgcagctacctccatttgtgacctacagaaactgtgagctaagaaaagtctgatttaagttgctatattggggataatttgtaatgcagcaatagttaactaatacattttatgagtatttccctatctaagtatactgtcccaatatgacaaacacatttaacattatgtcagagatgcctgatgatgaccatatctgaagttgaaagcaatgctgtaactctttatttattgcaccattgaaatatggtgcactatgtgaaccaaaagccatttaagaatcaagtttatactttagcttcttgcatcaattaattaataaaatttatataggtattagcaagcatctctaaatgcaaataaaatattaagatataattaaacatatactattaatagtaatcagtatttaggatactggaatgttgggggtattttgtgtctctttgatttttgcaaacaacagaaaatttgatttgcccattaaggagaaacatggatttttattagaccattttcatgttgccccaatataaactgacttctacttaaatagctaacccaattcctgtactgcttctgaaaaatttatcaaaatatgatcaaaggagtgcagggacagtgtgagactgggactttcaggctattttgagtcatctgaatctaaaaatgagagcatgacacctacacttttcccatagttgttcaatatcaggaatctaggacagtgtctgttcagtaaatcagagagttaatgttaaattttatatagcaaagataaaaaaaaagctgtaagaaaaaaattataaagtgttgggagaaagcaggagtgcagttctcacacaaaaaaaataaacttgagagctgaaaatcttccactagctatcttgtgacaatacagtgaagcatgagccccaagcgagggacctgctttggtagtaggctaatgagagactcagaaaacaggtatcctagtgattaaaaggtttctcataggtgattataattgtttttacatgtttgaagtcagcctggttttaatcccaacagaaatttctaatgaatactgcattttctgtggaagcaacaattcataatttccctttattcttgtttgttactacaaaagactctgtctcagagggctttgattaagatgatgagacaataaaacaaatagagagtccattaaatgcctgcctgaaaccagagctgcaccacttaatatgaaagactcttcagaaccaataatgaaataatcatcctttttccatgactgataagaaaatgaaggctagatacagatttgggaaaactaatttacactggaggagggaagaagggaaagaagagcaactacagaaaatcaactgttaataaatatcagagactgcagagaagtcacgagataagctgcagcgtatgttcctccagctagaaaatcgcaatcatttctctgagaagagaagctgataaggtcccctcccctccaccctgcaatcattttgcattttaggttatttgaaaagagcttgattattttcctttgaatgaaaccagattgattcacatttacctgtcaacagaatgttccattcctctgttttgcttgtctatttaaaggcatatgacctgactatgaaattccatatacaaacgttcagttaaatgtaagtaaataaaaatgagtgaccagcttgcattttaaatattttatatttttatttctggtagcaaattatgctaaattagaatccactgattgataaatatcactgatatggagtaatgaattgaggtcatgaatattgctttactcaaggtcagatacaatctttaaaaatcatacgcagaggaaaaagctgcatgtgaacatgataattatgctatttgaagcctattttaagggggcaaatacaacatataatcttctcctgttttgtaaacttggataaatgtgtaagtacactcatgtatcacttgatgataggaatacattctgagaaatgtgttgtcaagcgatttttcattgtatgcacaccacagagtgtacttacacaaacttaggtggtatagcctactacaaacctaggctacatggtatagcctatttctcctaggctacacgcctacacatcatgttaccatgctgaatactgtaggcaactgtaacacaatggcaagtatttttgtatctaaacatatctaagcatagaaaatgtacagtaaaatatcatctaaaagataaaaaatggtacacctgtgtagggcacttaccatgaatggagcttacaggacagaagctgccctgggtgagtctgtgagcgagtgatgagtgaatgtgaaggcctaggacattactgtgcacaactgtagactttatacgcactgtaaactttggctacactaaatttattttaaaatgttttttctcaataataaattaaccttagattactgtaacttttctactttataaactttttaaaaattttttggctcttctgtaataacagcttaaaacacagacctattgtacagctgtacaaaaatattttatttctttatacccttatcttacgagcttttctgtattaaaaataatctttatactttaaaaatattttttgttaaaaactaaaacacaaacacacatattagcctaggtctacacagggtcaggatcatcagtatcactgtcttccacctccacatcttgtccccactggaaattcttcagggggaataaaaggcatagagctgccatcatctatgataacaatgccttcatctggaatacctcctgaacgacctgccagaggctatattacagttaactttttgtttataggtggaaagagtacactctaaagtaataattaaaagtatagcatagttaatacataaactagtaacatagtcgtttattatcactatcaattatgtactgtacataattttatgtgctctacttttataaaactggcagtgcataggtttgtttacaccagcatcgccacaaacatatgaataatgtgttgtgctacaatggctgtgatgtcactgggtgacaggaaacttcagctccattataatctcatgggaccactgtcatgtacttggtctgttgttgacaaaagcattgctaagcagaacatgactgtattgctctatcaagtagagacagacaagaggaatgtgcaaaggcaaataagaagtgaggagctggtcagtatacttatatgggtttaacttcacttgttgaaatagggcgctgggatcctgagcgatagtgggaaaatagttctaatagcacattgcatattatctcttaatattgtaaacattttgcttattactaaaaggggatgtggaacaaaatgcttctctgagcatcaatgcagttgggttctagtatggattctatagcttataaagtttgtatctttagtaagtcagtgacacttttttgttttagttattccattctactaagtgaaggagtcaaatagtattatcaaggaccagttgaaccctacgtgtgtgtgtgtgtgtatacagatacctatggtatatatgtgtgtgtgtgtatatatatacatatttatacgaatacatatatacatatgtgtgtgtttgtgtatatatatatatatatatatacacacacacacatatacatacatacccatatatacaacttttaaaacaaacaaattgttaagctgacatggtgttagccctcaaagctatgaaaacttgagcatacatcttggataaaaaaaggtaacttatgtggaatctcaatttcagcatgctgtttacataattcacaaacaacatttagttgaaaacatatgtttggaaaataaatcaaaatattctgtttgtgaaatacagaattgatgctttaaaggatgaaacatgctttgggtgatagaaactgtgttcactatcaacagaatatctcgtttagtctaaatacaggccaattggtcatatccgtagtaagccaatgggaagacatttgttggggattaagtagggactgtgctggtctgtttcagtatgtttttcagtgtgttgatattaatacaaagttttgaaattttggtactttttgttaaagtattggttttattttcctcaattcatcacacaacttgaaacctttcatttgaatggagcattcgcttcccacagagtctgtggtattgttgctttcagctagaccctagcagtgttcctcagccatcaacatttttaaatgcaaaaaaaaaaaaaagtgtatacaaagacaattttaggaagtatacataggctgtaaattatttatagtgcttaaggattgaaacagctacaggctgtcaagaataagaaaagacaattacctaaaaagtaggggtgaaaacagagttataggctggtcattgtttcattattattaaatacaaaggctacataaatgctgatatttagaaaatattttaaaaatctgagaattctaaactcttcttctcttacctaaattattttgaagaattaaaagataaaaggctgtacagtttggaggatagtcctctggacataaagatggggaggccaagattctagcccatgtctgaccacttgttacttatgtgaggacttagcatacctgaccttcaatgttctcatatgaaagataagagaattatctgcccataagaataaatatgtgggggtacattgtgaaactcacacgatccaaaacatgagtaattactattaccaatatcttaaggtttcttcctacttcctggaacacagagtgaaattatatgaaatagtcatgtctgatcaagcatgcatatttggttccatccatctaattgatcattttatatgtattaaacaccattctaagtaaatcacaaatctccttgctctgaaataattcagaaatgaacaacacagtatctctgccatgatataccttttaatttaatggagacactcatctcttaaggtaccaatgttgtgttcatacactcttttataaggaatgattcaataattttgctctaaagttagacaggtctaggattctaatcccatccctactctactttatacggttatgccattttaaacaaataactttatttttctaagtcttattatccttacaggtaatatgcactcaaatagtacttaattcagagggttgttgtgaatattacgtgaaatcatgcatgcaaaacatctagcatatttcctgtcttgtaatatgtatgcaatacataaatatccacaatttttctttggtcttttccttaccataatctttatgtgtctccccctaaaaaagagcaaagcaacaactgataaggacctggcctgctactatctttcaggctttggtgttgctaccaactggcctggctctcacagctgattcttgctattctcctgttgaacataaaccatttcatggaatatcaatatcagacaaggtcaatctttgaccatgatagatctagatacaaacaagatcactccctaatcatgtctgagaatagacaaaaacataataacattgtcaaaacccacaaatgaccaagcatcccccaacttagttaatgtgtaattgttacttctataccaattacagttttacctcactctgcctttcttccttctgaataagattacagtaccaaatggcagagttatcttcactttctggaagcatctaatccagagcaaagccacacttccttacactttcccccaaagcacttcacacaagcccaaatcctataatattaataaatcctatcactcccttactaaagtccccatagttccccgatggcttgtgttctcctacgctgcagtgaacactaaactcaacttctttgactggtggtcgtcttcagctggagtgcactgacactctaacacacctgtcatctgtgttgtctccacatgtcattattttgagatggagtctcactctgtcgcccagactggaatgcaatagcgcaatctttgctcactgcaatatctgcctcccaggttcaagagattctcctgccccaccctctcgagtagctgggattacaggcgcgtgccaccacacccagatgatttctgtatttttagtagagatggagtttcaccatgttggccaggctggtctcgaactcctgacctcaggtgatctgcccgccacggcctcccaaagtgctgggattacaggcatgagccaccatgtccggcctatttttcttttctgctgagttaatcttccagtctactctggcttccttttcctgtcaacactcctttcatgtttcagatactcaataaatgatttttgaaggaatgaatgttccctttctgtatttctactttttatctttttctttatgatagctccagtccacacaagcttcaggaaaataattggctcaccactctatcagacattgagcagggaattgcatagcatcaagctttttgacactggagtctctcaaaactttggcaggactaatctagaaaaataataatttcaaataagtgttatgcagtgaaagaacacaaaaaggctactgagaatttttaaccatgtataaggaagtaaaagtgtgcatttaggtttacttatatttttgataataaaatttgaggtttatattttttagtcttttaaaaatatctggttgagctcacttattattttaatttcacttagcactgtggctttgcatttctttaatcttttgcagttttcactgggagatttttaggctataaacacacacgtgcaattaactgggttgaaaacatacaccataaaatcaaaccaaacttagaaaataagtttggttaatttttgtaccctaagtgtccatttaaagtttcactggaaattaacccttatgtgagcaattttgtagccctctgtcaaataggttttttttttcttttattcatttacttaacatggactcacttagaattcaagcaacttttagaactgacacatgcgatgtggaagcgtaccatgtattttactgtttctctgctgctctcaagtcattctcaagaattttagttaatttcttctccatgaatattttttagtgacttggtttggaattcctgagatttggcatttcaatgtgctggattaccgaggaacatcagctcaaatgcaaacttaggagttagttttaaactggtctgaaattctcacatgttctaaaataaaaatgaagtggatagatgccttatgattcccttgggttaagagtgtccataatcagtgtcttaccttaatggaaaatatctgatttatccctgagatagatgactgcatatagtatatcttcaaataagaagaggtagatgaacagaacttcttaattggctcctacatgcatcccattatggaaggtctgcttttgattctaaggtcaggcctcttacttccagattcatcaagcaacttgggtgacttttcaggaaattctcagccatggcaggaagatataacttatgatttttatgattaaatatttatatagtaccaaagacatgtgggcagcaggtcaagtgttatctacaaggcttagattgaaagacggctgagagccttagggcttctctgatgatgagtgcacaaggagacacaatatcatcccctaggtaaaaaaaagaaagaggagagaatgactagttgcacctagggtattttgtaatatatatataactaagttgattccttaaggaagggctctatactattcgtgtattattgctgggataaagatttattttagaaaacatggaagaactttaagcacattctcttattcagggtcctagtataaacttctgttatgtaaaatacctgttagatgccttaagtaaaatctctaatgcaattgctgtcccgtatgccctatggtacacaccagagtccttaaccagaaaactcaaagtctgtaaaatgcatctctactggtagaattcacatgcagtgatttgctgctatgaagcgctaatgagaggaatgaaaataagaccagactaaatataaatggtgagaactgataaaagtgttataaaggaaaccaagatcaatttaaacctagagaaagttttagccacagatcaccatatttggaaagatgaatataaataggttaaatagaattttaaatatatttcagaaatatgcctagagtcacagagcatttaaaatatacaagtcaatttcctaaataaaggtaaagtaaattcaaatttaagtttcaaaaatgattttattagaaacacgctaaagtaatttatatataaattataaacatcatatatatatatagctgaaatcttatttacaaaaaagtatggccctgctgtgattactggacttggcattagagaatttgctttctgattctagctctcctacttcctagcagtgtggtttagcaagtctttgaaacttagtttctgattgtaaattggcaatgcctatttacctacataaagttgttattggtccagtggtggccacaagatctgaaatgttaatcaaatcaaaggggcagactagtcagggcatggttgaaggctaatgttgactcccactgtctgttagcgaggaaataagttgcctctgctcctactgggagccatttggtgaccatgagcaagccagcttggcaaacaaacaaaaacaaaacaaaaccatgaagaggagtttagaaagcagaaatcagaaaatttgagcaaaaatcctgatatcctacaatgagagtctttctggcctttggactttttgttatgtgagatgaaacacattcctttcatttaacccaatttgaatgtgatctgttttatttctaacatcttcttacatttctacaaagagcacttcaggaaaattcttctctcttctttatctgaatcatgtaggtattaaatttctatgagtgaaaacagtttacacttgttggcttcacctatgagcaatatattttgttgatattttacacatgtaatcttatttaatcctacaaccctctcactttatagattaaggacccaacactcagagaataaagcaatttgcctaaggtaacacaggattccaaccaagactgtctgttgcagatttcattgattttttcattacgccactcagcaaaacaattgtaaatccttgtggaagattccctggttggcagagatctgctaaaagtggattccttaagaggtatcaagaaataccctggataatcaacaatgcttttgcagtgaataaatgtgatgggggagttcctttatctttctaaccaaaaactgcaaaaacctttagaacaaagaaattattaaagcttacacaaaaccatcattgattacatttccccatgtggttttcctctctattgtagaaatcctttcctaattcaaaagaagctattattaaaaagctaatctcttcttatatgaagcacagtgtatgctgcaaatatcttaaattctgttctaaacaccgttttactgaagggttagaatagcaggactattatcaagtcataagagaaaagaatagacacctctgaataaatatatggaaaatcttatcatgaaaagtggtttatttgactacaaacactgacatcttcagaaaagcttttttctttttttgtaagcaacatacaaaattgctggaaactgccatatacatgtcaggagcaagaagaaaactaaaataaatgttggaaacaggcagcattaaaaaacaatgctgacttaagtagaaggaaacaggaagttaagaaatataaataaactcttgtgtttgcattttggtggcaaggtctttcctatttttctcgattgaagaaaactgtggaatgcttatttggacaactaatatttggcaaaggtgagtgcagcaaaatttaaatcaataattctgttgataccaagtttattttgatcagtcttcctaagaacaatgtaaatgttaactagtatgtctttaataaggcaataggataggataggacatacatggggaatagagtactatattatagacttggtgattaaaaaaaaacattgatttcctattacagggttaggatcaggctcaaacattgaacttttctaagccacttaagttttaaatatcttactgataaaaataattaacaaatgtcttacaatattctcaatgcatttaaaaggtaaaaataatgttttgttgattgcaaaatctatacaaaataattctcattaatttaaataaactgattatttgggatgagggactaattttgatgtgataattatagcacagtcattaactcattttaatgatagttgccaaatgtttaccatgcagaaagcctacaactggaagctgtggagcacagcaaaaagcccatagtgaagtgtgatcattaccctcaagaaacatttaggaaatgaaacactaataactattttagaaagaggagagagtgttgaatacactaataaagatggacacgaacttttggtggagttcagtgcaagaagtgcttgtttcaaccggaagataagaaaagccttgatggaaaagatgccatttggatggactttggatagtgtgttgggtagcacacacagaggtggagaacatgactgagtcgagtccagtgtttggaaagcctagacagtttgtcagcagtagtaacaacgattaatgaatctcttcattctactaaatttgcactctattataacacaaatcttattgtcagatctattgcagtcttacctttctacagattaacccgaagtccctatgcaagatggttaaaaatttactgaatacttctctttaatatcctgatatgtttatgacattttaattttcttttggacatttttcttatcaagtaggagacattaaagctgtccctgacagctgttttccagtattctactattgttggattgaaaatttttcattttcaaaatgtcccaaagaaaactgtcacaagttattagatccagatgttgaagaggccacattacatcagatgcaagcttgatcaacagtctcctaacccttttatcaggatcttctctagttgggggatggggggtgtagtggtacattattagttgttgccttgaaacttctgtcttgcagttgtgaattagcagtatgaatgacatttgtattgagaaaatatgttcctaccaaatgatcttctgaactgctgcacatgtaacctgaggacatgctcagttagcactgaacacaactgttcagttatggggactttatagccactttgctcttgatctttgaagcttggctttcttatttcatttacttaagagtgcttttctaactgttctttagtccgcctcttaaatgttgttgtttcttcaggtcactgtctttagacatgttctcttccaatgtctgaatagtctcatgcactcctaatacatcacctttgttatccccattgattctcacatcaaccgtctttatccctttcttgagctctaaacatctattcccagctgcctatttgccatgtcaatctagaaacaatattttagatacaagtttaaacttcaaaacaaattctgaaaagtcagtcagctacttgggaggctgaggcaggagaatcacttgaacctgggaggcggaggttgcagcgagccgagatcgcaccattataccccagcctgagtgacaagagcgagactccatcagacacacacacacacacaaacacacacacacacaatcagatatacttttcccccttttatctgaaatttagaaagcctaggtgatggagtcagggccacaaaactggcatatagtagagcttggactttattccattttaaaaccttacccattgaattgcatgtttttgttatgctttaccacatatcccataggaatctcagtctgtttttcacatcatcatctatcaattctctcaaattagaaaatttaaaatcacttcttcctctccctctataagtcattaactctgtccctgaggtatcattttaatcttctatcagtcccactgttacagttcgggttcttattgcatcttttcaggaagccatcctaccatttttcctattcccaagattttcctccccttgatccattctctccatctctgccacagtcatatttcccaaaaagttcaaattggattagaggcaattttgattttcttctttatgtgtttttgcagtttctgatgtagcaagcgggtattttatggactcagacaaacaatacatgctttatagcaaagaaaaaggtcttaggaaatatgaaattcttatgtagaaaatggctattttagagatgtgttatagaaaagctaatttgagtgtagagtatgagaagaattggagaaagaaaatcaagccatagactggctttttctgctcactgtactcttaaaatttacagtttaggtaaagataggcacaatatatctctgatttggggatcagattaaattgggaacactgagaattttgccctgagtgatccactgcctttctgggtcaacttagactaatactggctgcattactgctaaaattaatgctgtgcgccagggaacagatgtgaattcatcatgtgaattcaagaatagggacttctgatttctaatccagcctgatactctctttagctttggggaattgagttggtaaatctgctttgcagaaatgtagttagtaaatatgcacaggccttgtttcattagcgaatatgtctgatgcttccagtgactacatttctcactgcaaacaggtctctttatataaagttactaatttttttccttggagttttcttacttatcatcacaaaatcaagttcataaattaatggatgatgttaatctactattaaggagaccaagtcagctagtttaatccactcatgtttggataaagcctagctcagacactttacagagtttcctagcctctaagcattaccgggttctcaacttttaaaggaacactcacgagtcctttgcttccaactatagagtactctatataactctggcttaattttggaaggctcacagatgaaatgtttacattgcatttatgtaagatatttaaaacaaatattaaaccagtcaattcaatgatggttttaaattgatggtcctgttaaatgcaactgaaaagaacataaatagtgaatagattttgctctgtacagccttgtaaaaatagcttttgacacagatttacttgaaattgtgctaatattatattgtatattaaaaatgaccaaaagaaacctatcagaaccatttataaatgtctcaaattattatcattattatcacaaaacaatatgcagaactaagaatttcagagttcataagacaacttattgttcctggagttaggatacacttcctcaagtatctgcggcattaaagaaaaggtgaagtgtgtgactattgaagaatgcaaattaattcatagtagctttgcagatctctaggggtggcaatttaatctaatgggaatttaatagctcatattaaacacattactaatctgatgctttgcttacagtaatttagaaacagtgaaataataaatcacttatttaaaaaaaatcttctggaatttgaatcttttcttaactaagaaacagcaggtaggaagaatccttgttgttttcaagtgaattcccatcaagttttgtattcatgttgaaacattaagtaaacacatttaattcagacaacttaaaccagtgtcttttgtctaatcatataatactgtaaatatgaactaagtacttcaccagttcacatttaactacacattggcttccacttcatattcttgatgagcagggagcatgatcatgtatatctaattataaacacatggtaatgcgttgcttaggtttcatgctcaattacttctagataataataataatatagatccaaaagaaaccataaaagtatgccaaaattcaaaacgttttcccatagaaacttgaaaaacaaagcatcattaagacagtcttctttctttgcattatctaaaatgacattgagcaaagttttcttagcactaagcatacattttatatcttttttgtggcttttagtttttatcattttgcttatactcagatatttctgtatgctgtaattgccaagtcaatacagtataactatctatttatccattcttttactcattcacccatttataaaaaatatgtagaatgcctactttattccaggtactgccctagaagattgtacatgcagcagttaacttaataatgtcatcccctcatggttagtctcaggtggaagaaggacgcaatgacacaattaacaaatcattatttcagtttgtcattaagtgacttgaaggggagagcatgatactgggatgtagtgagtatagcagagggtggggttattttatcttgggttttaagagaaggcttaagtgacataattgttgtcattacaagcacagagaagaaaatgaggaagtaagttatggagataattgggggaagagtattctagatagcttttagagcattctagaggttggcaaattagaaggcttgtgcctagaacaagaggagtttgctcaaagaacaaggtgaccagtgttgctggggctgagtgagtgatagggaagggagtggaagctgaggtcagagaagtaatgatggagggtggtgggagatgacatacagctttatagaccattcaaaagacattcagttttacaagaggaggaccattggagggttgtgcgtaaaggcatgacatgatgtaacatgttttttaaagaacacactggcaattatgtgaaaactatactggagtgagagttgggggaggcaagagaaatcagttaggagggttgtgatggttaatattgagtgtcaacttgattggactgaaggatgcaaagtattgttcttgagtgtgtctgtgaggttgttgccaaaagagattaacatgtgagtcagtggactaggagaggcagactcaccctcaatgtgggtgggcaccatctaatcagctgccagccagtgtggctagaataaagcagacaaaagaagttggaaagagcagacttgctgagtcttcctgccttcatctgtcttttgtgttggatgcttcctggccttgaacatcagactccaagttctttagcttttggactcttggacttacaccagtgattttccactggcttttgggccttgggccacagactgaaggctgcactacttttgaggttttgggattcagactggcatcctttctcttcagcttgcagatggcctactgtgggacttcaccttgtgattgtgtgagtcaatactccttaataaactccctttcatatatacatctatcctattagttctgtccctctagagaaccctgactaatacaaagctattgtaataaaccaggtggaaaataatagggactcaaatcagagttgaagtgatggatttgaggagaagattctggatttattttgaaagtagagccagtaaaaattgctgatggagtccatgtggtgactgaaaaaaacaagaagtcaagtttgactcttaagctttttggtctcaaaaacctagaatgatggacttgctgtaactgagtagggggaatctaggagagaagagttggtgtgtggtgagaaagcagtagtttcattttgaacttttaattattagatatttaatagacaaccgcatggagacagggagtagatagttggacataagagcattaagttacacatagaattcggggtgcagatgttactttgagagatgtcagtaaatgaactgcctttatctaaaatacaaagagcttctaaaaatagaaaaaaaatcaatcatacaatagacaaatgagttagggaaacagttcaaagaaaaaaaagccaaataaaaatataaactaaagctattagactgacaaaactcccaaaatctgacaacatacaatgctggtcgagctttgtaaaaatcaactttgtggaaaaacgtgctctgtcttacattgctggtaggtatgaaaaatggtgcaattactacagaggataatttggcaacatctagccaaattaaatgtgcatttaccctttgacctagaaatgctaattccagtaatgtattgcaacaatatgctcgcaaaaatacttaacaatatttggtcaaagctgttaaatgtaagactatttgtcatagtaaaagagttgaaacaactcaaatttccatcaatggcaggttggttgaataaatcacggtgcatccatataatagagaaccatgactgcaaaaaggaatgagaaataactctatatacttccaagagcaatcttcgtagtatatcttttagtgaaaaaggaaaggaagagacaaatacatagtatgccattatttttctaagaaaaaaggtggtatggctattcatatatatctgctttttttttttttttttgagacagagcttcgctctctctcccagtctggagtgcagtggtgcgatctcactgcaagctccgcctcccgtgttcatgccattctcctgtctcagcctccggagtagctgggactacgggcacccgccaccacgcccggctaattttttgtagttttagtcgagacggggtttcaccgtgtaagccaggatggtctcgatctcctgaccttctgatctgcccgcctcggcctcccaaagtgctgggattacaggcgtgagccaccaagccccgccatctgcttgtatttttttaaaaaacaccttggaggacaaaccataaatctggtttttaaaagttgtttctaaagagaggtgagggtataggatacaaaataaataaatgaaagttaagatctatcttcacattttaattcatatggaggggataagataaatatttgatatgttccctttatttggtattttgctttgtagagtttactttgtgactatgttaatatttacatatttatcaaactaaatttaataatctttaaaattatcctcaagaatagaaaataaggggaacataccaagtgtttttcctatctgtcttaagtgaaccaattagtatttagggaaagtttctctatgtagaaagaaataaagaagatacgataaaattggaatatcattagtttgtagacactaatgaattaatgaatctaaaagttaagcatcaatggtctcaaactacaaagaagaaagaaacccagagacaatataactcttttttttttttctttgagatggagtctcgctctgtcgccaaagctggagtacagtggcgcgatcccggctcactgcaagctccacttcccgggttcacgccattctcttgcctcagcctcccgagtagctggaaccacaggcgcccgccaatatgcctggctaatttttttgtgcttttagtagagacagggtttcaccatgtttgccaggatggtctcgatctcctgacctcgtgatcggcccgccttggcctcccaaagtgctggaattacaggcttgagccaccgcgaccggctgacaatataactcctgaaagaatatactcccaccaatgatgtagtttcaagggggtaaagagatctgaatcttactaagcctctattcctaattagcaatttgtagaaaacggagaagatagaaatatatattaaaagacactattgttaagcaatgaacaaaattcagactgtgggtcaaacacctgtgtttcctcagtaaataaattgcaaagaataagaaagaaaaattagaggcagaacctagagatcagaagagggaaatatcaatcagcctcactgtgttgagttcatctggattcagatacaagtaatgtgttaaagacattataaggtaattgaaaattagagatggaccagtattttggtgcattaaagagttattgttaattaatgttgggtgtattaacggtattgtggcatattttttaaatcttagagatatctactgaaatatttgtgtatcaaatgatatgatgtctggaatttgcttcaaaatactactattttgtagaggatggttgaaatgagacaggactataaataaaccagactgttcatgagttgattattgttgaagtgggtgatggcctcagaaagaattcattatactattctgttgatttttataagtgtttaaaattttcaatagaaaatatttaaaaatatatatcctgtctcagattttaccttacttgcaattagtaagttagcctaccatggtttcatggatgctgacagaagatatgaaactcctgggtcagatacaaaggactttattactctcagcagagcaagcagtatgagctttagcatattttcattggttcctcctaaactcagatcccatggggtgatgcagaagggcccagatagatgattatcacgcagtagatttgtgtcctaagctaaggtagcacaaatcttttataatgagcctttccaacctttgccccagcggaaaatgttttcattattttactgaacagtaaaatacttgccctttgctccagagaaacaaacaatttctatcctccaaagctcctcacaaccttgaaaagtctggaaaagagagccagcatctctgctcactagatgtgcagaaatgcaaaagatccatagagaattatctccacaaataatgtattggctgtaactcttcaaaacgaatctgaaactcaagaattgggtattaaaatatatataacaggtgagtttcatccatatgtataataatattaagaatcactgcgttttccacatttggtttcaaaatttaacttgttcattccaaagatactttgggatttgaaaatttcttaatttgccatgaaacatttaaataatttattttaatgcctactcctttgttttcttgttttcatcaaaaaacataacttttgaactttattataaagttagttccacttttctccttccttgcttcttttgaatcatatttaaaacatctcttaccatttttttgcttgagaacacttgcaaatgtttctggaatttattttaatggacttggattattactttcatacaaatgacttgccacatgccacatgccacatacatgtgccacatgtatgccacatacaaatgacttgccacatcctaaacatctcctttctctttggccaggaaacaaaggcaactattttttttgttgtgaacttactaattttgctccctggcacaaatgtatctttagtttcaatatgcacaagtggttaattttgtttccttttttttttctcttcaatagaaaccaggcttttaaaaatcatttcttataggttctattttcctatttcttaattattatttttatttttctgaaatttcttatttttcttcctctctttggaagttgagaataaagataaacatagttccttaataatgtttgcttaaagagcatttgtttttgtccttgcaaatatcaaggcaatacatgtgtgtgagtgtgtgtgtgtgtgtatgtttgtgttggagtacattctggcatttttttccacagtcatatgtaagccacacatacagacccatctatgtctcttttcatatttacttataaaggtctgtattgcctggtatttaatcatacagactctgaagctcaattgtgttaactcaaacatagcctaattatttactggctctgagacctcagccatattaccttttgtaaaacctcagtatactcatctttaaaatgagagtgataataggtcttgtgtcctaagtttctcattaggaatataggaattaatgtttgtaaagcaattagaagagtgttgggcatattttttaagtactgtataaatattagctttcatcactggttttccttccttccttctttctttccttccttcctctcccccagtgtgcgcacgcacacacacacacacacacacacacacacacacacacacacacaagagctaaggtttcttctcaatgatattaagaagttaaattacaagacctttaagctacaaaatatttgacatataccaaagagccttaataattagattcttaataaacaattacatgtaacatgtttaagagaataacaataaccatcaaatttttggtattgactttgtcaaaggctctttgttgtgctttgcacatattatgtcatttaatcctcataaatagcctaagaaactggtactattttttttttttcattttgaaattaaagaactttattttcagccaggctgagtaacttagcccaggttacacaactgtttcagtgttgcagccagccaagatttgaaaccagttctagaaaattttaatatctgcactctttttagtgatctatgctgtctccccaagtttaatgaacataaaattttagaagcaaacatttttgtttcttgaatatactcgtcaattctgattctttataagaacaatagcatcaaaactggattttgcctggaaacagaataattatttcagtgttttgtatgggcaatacccaccactgagagggataaagatgtttgtattttatgatatccatcactattcattggtgaattccatgttcttaggtaatgtttttcattgtttaaaatattctattagcacatttgaaaacagatttaaatttgacaacagccttaaattattgccataagactaaggaaaataacaataatatcactaatacacatcaaatgtctcctgccacccctaggcctctgtgatttttccctatgctgaaacagttcttttaagctagcttttagtgtcttccagctactctctacacattcctattgttgcctcctcactatttagtcagtctgtttataacttgtgattttaacgctattaattgtatattactgcaaaaacactttggtcaaatccattgagcagccaagaaaattaacttgttttaactgctagcttattgcattttaaaaataccctacacagccagtcaatagaaagctgggagaaaaacagaagaaggagcaagaaacccggcatgttgagatagaagtattttgcacatacagccaaggccattcacagatttaatgagtatgttttgattatcatttaaggaactaatacagatatgggttattggactcaagacgattcctactgagagaacagttggtgtgtcactcttgtgtgacacatttcaaccattacatagtttctattttgcaatgtgtgaggtgaaaaaaacaagggattaggagttagatctgggtttccttctatagtatgtgacttgaggtcatttgaactcccgtgcctttggtttatcactgtaacttatggaattagcctagagttctctaagattctatagattctaactcctataactgtgacctgtttttttaggtcaggttaagagtaagatggtgattaaaattttaattataacatgattacttattaaatgaagttgaaacgatgcacatcaaatcccaaaataggctcttatgtgaaagttctaactcgtagcttctcaaggtgctcttatataccactatattcagtggtttcagattctgtttcaagatcttgttgcagagaattgactttacatctctttagctgaactcattaactgagaggcgtaaatgctttaaagtatcattaagttagaagagttgggagtgttgggggactttgagaagacttgtggtttggggacaacaggaaaggtttttccatttgatgcatagacatcaacgaaagtttacacaaaacacagtgttactctgttattcgtgcacagttattggtatgtgaaagtattctttgctaaatgcaatacattgtaattaaataaaatcacttcatttaaaaccgcacttgaaaaatcaaatgccctgttttcctggttttttgtttgtttgtttgtttgttttgataataggcaaccattggttaggtctgcctcatttgggaatcggttatatttattacaattttataaaggtataaattttagtcactttgtattcaaatatacagacacattatgcaaaaggcacagttagcatcaaacagtgtccctgaataataagttcacattcacatgagacactttcatgtgagatgaaagtaaggtgctaaaggacactaaagaagagctgattattcatcccttcacagcattccttttgatcaaaatatttatctatcatctctctctctctgacaataaacaagcaggaaaaatgcaaccgattctgagggtctccttatcccttgttcagctttgttttttgtgtagtttttcttgtttgtacttttatttgctcacttttctagaatatcttcatcttcttttttttcttactgggcatgataataagaatgatagcaaatatttggtggaacaacagataaatgtaaacatgttccagtgcttaacatccatcctccaacacccaaacaagatggtaaccatggaagaattctcattcccaaaccaacagagtgttgtctgccccctactaactaaggagaagtgcaaagtatccgggacatttgttgatggacatcaggcctgctccagctgtcaaaaacacagctgttgcgtttccctctgagtgatcagtgctccagatgccctccagctagtgtgttccccgatatggtccagtggaaagctgaaaaagagctgaacacttggcttctaatagcaaatgcaaaaacaaatttcacaacaaattgcattttcagcattgcctgatgccatacgattaaacaggctgaatttgttttagtccactaactcggaagacatcatgatggaacagtttctcttggtgactgttaaacgttaaagcagttaagggaggaggatttttttttttttttaacttctactacaaagcagggggtgggagagggaaagctgatcaaacttattagagcttctcaatgaggagaaagcaaataaggccatttaatgtctttaccagggtaaaactgacaatgagacctctctgtgacttttttgtacacatttgttttttaaacttttagagaagataaaaacgccaatatttttatctagcccttctaatgttcttcaaagctttttgcaaagatacattataaaaataatattcatacgtacatttacatagtgcctactgtgtggttggcactatataaatatattaactcatgtagttgtctcagcaagcctgtgtgatatgtactaacagtattacttttaacagatgaaggaattaaagcccagagatgttaagtaacgtaatcgagataacacagttgtacaatggaagaactagtatttgaacgagcccttctgggttcagagtctatgctcttaatcatgacattctgctgcctcttgaacacacactacttatatatttgttcaaatgcagtgctactgtttggcctactttcttggaacaatagttccagtgcaggatcagtttgatgattcatttgtgtgttaacaagttcaaactacaacctagcaaaattggtccatgtgcatttgtgaagaaacttcctttagaagtcatctgctggtgggaaatgtttaaagcctgctttcatgtgtctcttaattgactcagttgcagaagtcacgcctgagagtagtttaacccaggttatgcaatggagcagttacatacttgtacttgttcaccgggaaagttatggagctacaagagaactggatttgccactcagccacttactgaaaatttcttccctgagttctggagagaaaataaaaataccctgcctaccacacagaattgctataaaaatcaaatgtgataatttatatgaaaatatattacaaaatataaggattacaatgggtggaaatttccactgctccatgggctaagcagaatggggggagaaaagggaaagactgaggcctctgttttggcaggaatttcccctactgctgcaggaactgggcaccagattgtggagctgaggcacagtgaggtggagttgggacgaagggagcagctcctcagggggctgtacaacccaggaggttaatctaatacaactggattaaaccctgctttacaagtaacacatgtagctgttcatgactttcttcattccatcgtacattgattcattgattcactgtagaatgattcataaaatcctctatgtatcaagaattgtgctagggagtcagaacaccacaacagtaaaatagtacagtatttaccctgatggagtcaacagtctggtggaggagacagattagtaaatggacaagtactgtacactctgctagatgaggggcaagaaataccataaaccattttgtgacaccttctcctctgtgttgagtgtcacctgtataaacattggcagtacttgctgtgtggttcagaacacacaatctagtgtcagcctgcctgattggaattttgattccattccttactagctatgtgacactggtatagttaccaaccttctaagtctcagtttagtcaccttttaaatggggattataatagggactacctcacagagctgtaaaaattgcatatgcttttgtatgtaccttgacatacattttactcagtactgtacaatgcctggaatatagacacaacaaatattacctattaaaataaggatgccaatgctagatagtcaccagctcccaaatcctagccacttacctctctctacctcagttttctcctctatgatatggagctaattatactacttgcttcgcagggttacagaaaagaaatgggataaaatatgtaatcctgagcctaggaattttaaacttcaaatcctatgttgagccacccttctatatgccctttcttctttctcctccctctccagcctcaaagactaagcctgattaactacacagccgtcatcttccaggttcagagtgaagttagagtgaaagctcaaggcagctgagaataataaaaacaggactgggagaagttaaagctggaaattgtaggtgttcttataagtcttcagcttgggtctagaaagaccaagcttggtatcattcctctgttttgtgccttatctttctttttcttctgatttttattttagaatgaaacaaccctctcctctttattgaaataatattagggttattatagacattgatataacaaaatacttctttgtaaaatctataactgtgttaatataaaaataaataaccttaaaataatttaaaatggaacagttaaatgacttttggttaccaacatttattgttttttcttctgaattatttctattttttttctattatttcccacattgggcttcagagggcattagttctgcgggattttaaagagtagagggcaaaaaaattcaaagaaccaatatgtttaagaaatgccagtgttaacattttttttaatccttaagactagtcagacaacttatatgcaaatgagaactaagggcccctttagccaaagagattccactgggaggctgtagggctggcagtttaaaggccacttgttccctttgcaactctgtctcttcctaatgttggggatcctggataggcaagatgtttctcatctgtaaaatgtggatgataatagaacctactttataagggtcttgtataagaattaaatgagtatttgtagggtacttaagaagcctgcgtggcacctcataagtgttttatatgggctacaaatacataaaataagattcaatatttcccagagttgttactttaccaaatctctttttaaggcatatcactttgaactagtgttccttggaataaacctgagcaacactcaaattcattatgtcctcttctttgacacagcaattaccttagcacaaccagcatcctctcatctgggagtatattggctatgtcggatcctttatccattcaggactccatctacacagctatcttcctaagacacaaacttgagcatattattcccttccttaaaaagtttctctggtttctaagggcctgccagaataaagtccagacttcctttttatattgaaggcttttcaaaacttagccccaggcagtcttgacataaccttccttggatccatttctactctttaaaacctcatctccaccaaaatcccgcccagcattccaaattcctctttgcatttgtccagtattatcttgtccatatgttttctgataaagtatttcagaagcggcttcctttttgaagccttcttggtcccctgctctcttacataattaatacataaatttatttttatctatggcgtgcaatagttctgtcttcatgttgctaacaaagcatgttttccattgtatgacagttatgccgttcatgttcactctgtttgtttctgagccctctggggtccgaaaatagaacatataactatctgtttaaggaacacctgatcttcaggcttggaacacagcagcaaattaattaatgttgcattggactgaataaagaaaataaagcatctttgggaattgcttctttcgttttctaaccatactggctatcctcaatattctcctcacaatgtcaaacttctgtcttgttttggtttcaattttttctctttatatttttctaatcaagcctatgcaactcatagatccggattagataggccttgaatgttgcttgatgctcactttaccttctttctccctgtcacacttcatttttaaaagccatttcaatgttaaaacaagactagtggccattagatgaaaattttacggagtttaatcctgcacctctttttctcagtaacataaaagatttcagtctcattctgacaagaaaaataaaatgaaatgcctttccaatataaataggtctgacaattttaggtacagaaaggacactggtgtttttactcctctgtggaagccttctaagtgagacaaatgaaagctaagtcctttggtaacatatataataggacaggtaagactggtgagcactgtaactaaatctgggactgtaacatatataatgggacaggtaagactggtgagcactgcaactaaatctgggacttttgtgtgtggtagtgttatcagcattattcttctagtatgagaatacaagcaaagagcagcattctccactgtcatgaatgcccggccctcacagctgacgaggtaaaaaacactaccagacaatcacaccccacattctccagaggcaacactgcaacctccctggggcattgtcttggtattccttaaatataagaagccaaatagaccttttaactatgtctcatttgtgtagtccagctgttaagtagcaaaataaaaagcataagcatcaatgaatatactacaaggaaaggaaggggtactttggtacacaatttttccactaaacaaagtctcttttcacatcgtgtgtgccaattaaaatatattacattattacatatgcataagcttatgtgaaaatcctttttagatttcaatgtacagatatttaaatattggaaaaatagaattgttaaaattttctgggctgatatgaggcatttacaaacttttacagatttaaaaacactgtctgcaaagatttttagaaatacaaggtctctagatgtacagcttgacatagtacaattgattttgttttcagagactactctggttaaaaaataggattatatttcagggattgttttgttcaaaatatcaaatttcacagatgatttattccataatgataatgcatcttctgtgcttattaaattaaaaaaaaaaacattatagcaaggaatctaataccaaagacatgtccttaaacatttggctaaaagccaaattccttaaagtttaaagcagctgctcagtttgtatttaaagtcatagagatacattttaaattctttcccaataatacatattttttcactatagaataaccctgtttacattgaaacacacaatcaagcaaaggaaaactcttcgaatgtatcaagagcaatccctgtatcaacaccaaacttgattctctggtggaaggattagacattgagcacaagtaaacctttggaaacattttctgtggagtgaaggcagaaggtggatcagaattctaacctccaccctgagagttctacacatggcggacagtgaaaatctggcagctgcatgttcccagttttgcaattctctgcaggaaatgggcatctgccccaatttcagcaaaacattgggactatggtaaagggaagctttttgttcttcattagctcaatacaatttgcattctgtagtttttttcatccatttgatacggacttttcacagtgatatacaaactcatattgaaataaacggtatcataaaatactcttgaaaagcttagaacttgaaggacttaactgtttacttagagaagtttacttagagaaaaatgggagaaaatgctgtgaaccttttcctttaggtaactcaaattaaatatttggatgaaaataaatcattgaaggactacctaaactcatgcctgtgacatttttagagtattataataaatggacacattcaaataattattgtacatgttactaaaagcactatcttttagtgctctgcctatggggtaaccattctttactttcttaataaacttgcttttgctttttttttaaaagcactatctagaaggcttcatattgcaaaatgacaagtttttttgagtttagaggcagaaagcattactgataaatcttaccaaatgaaggccaatacactaactaagttagcccaaacatatttggtcttgataaccttgttttaatttgcctcctttgtgcattggggatatattctttgtaaaactgtttctgaaactttctaaaaataggtggattttaaaaagcaaggggatgctccatgatataatagcacatctttccataatgcaaatgaagtgctttgaatagacattagtatccattcatttgcatttcggggggttgaattcaaatattgatgtagttagtattcctacagcacagtcaactacatttgacatatactgtaaaatgtaatttgactatatgtaggaatgtgggtaacttaggcaaacctctatttcacaaaatcagtttgtccccacggccattttgtatttttataattcaaaagataatccttatagtcatgcaatataatagatccctccagcttttactgaagaggtactacaatttattttgctgacacttgcaggttgataacctggtgtatgagtaggaaagtagggggaggctaactgattggcagcagccaggatgcccacctccatattctgagaggtaaaagagccatgacaactgccttcagttctgtccctctccctggttgaaatatcgggtgtgaagacatggcagaggctgaggccatgaaatcaaccaggtacaacttttttcaagtatcggcctggaatttctactctaaggctttaagagattgcctcaacaatttgccttgttaacaggaataatgtagtaactaaggaaaattaaatgcattcattggcaaagtgagaaaagcatcatctttcttgctcagccaatcaatgatgatgcatgacatgatcaggatagaattcggagcaacaggagaaaacttgcttctggttacactggcttcctaatttggttaactttacttcctcaggtaaaatatgagaggaaagaaagcaaaagacaaaacaataacatctgtattagttggcttgggctgccacaacataatatcatagactgaatggcttaaaggacagaaatatattacctcacatgtctggaggctgggaagcctgagatcaaggtgctggctgattagatctctggagagggctctctttctggctcgcagacagtatcctctccttgtgtgctccatggcagagacagagagtgacctctctagtgtatattttcataaggaccccaatctgtaactatactcttatgaccttatttaaactgaactatctcctcaaaggccctatctccaaatacagttacattgggtgttggggttctagcatatacactttggaggaccagaattctgtccatagcaacaaccaaaacctgttagcaatctgtcacgtgtagcagaagaagacaaaggaatgatacaagattacggcatgatgttgcacaaacgctgtacctaaacaagaaatacagtcatcacttcagagcttattagaaatatagactctgaaaccccaccctagacctactgagtcacaatctgcattttaacaaaatcctgaagtgatctttatagacattaaagtttaaatcaatcaatgttataaaattcataataaaagcaagggttaattttgtccattgtgttggaaccttcttccacaactagaactgccaaatgtatccactgtaacaatattaatattcttaggaaaaacttacaaagtttattagtattatttttcttattgtaggcaaaagtaatctattaatttaatttaatagcttgaccttttgttactatagcctgtgatagaccactagattccttgcccagaaagtttagcaaacaacttccaggccttaacataaactgaaactttggttaattgtaccattagcttaaaacatgctattcatcttttacaagagttctgtgtttaaaaatggcattatttttgaaataaatagcactttaagctaggcatatttttctagaacacagggagtgcgacattacttataatggaattttcaattatgtagcatttcaaagcaactttaaaaaatttattccataatgtcaaaaatgtagagttatgcccacaaagcttaatattttggcatagttctagaaaagtgcttaataaatcaaaaaccctacttataactggcatttataggtccctaccatatattttcttaatattctgtctaaacacgaaaacagatgaaatatgcaaaagaatacaattatctttgccaatgagaaacaacagatacaccctattatcagtcttcaaactattagcattaggagatcactgaaaatatcaatagatgttgtttacagtttgaagtgaactgcgaataaaagtgacatattccccatgtaataatttttgaaaatttgaaggaatatattttaatgttaacatatattcttggttaattttacagtacaatattcaaatttatgccagaactcttaatggatgcctcatttaaaaaacaatgcagattaataatggatgacttgcataattattagctaaactgcaacaagtatacagtccatattactaaactatgactttttcttactgtaactatatttttggtttgtgtgttttaaatctgaactacaatggaaaggtataagaatttctacttatgagaaacataaagaaaactgtgatgtgataaagcactaatacagtattatagatccccagcttgtttataatatagctctaagtgggcagatatttttggaagggcccactgagtaactgaggaatagagctgtgtgggggaggtggcatcaacatgtcatcataatacttgaggggattgtacagcataaggcacaatgtctaatctctcagaagtgtgattatttcatgaaaaccacaccccactgagctgccttattgctgttataaaaaatctttattataggaagctcttttgtgctgtaagaagatgaattccacactttagaatgttaaacagcagtttcagcagagttctctagttcacacagattaatctacccctttggaatattcatgattcaatcagaatgctctctaagtcttggcaattttaccattgtaaaataaactaggtatattctgatgaaacagcctatgcctaacaaatgccttcattattttttttaaaagtattttatggattctgttactatcaaagaacatctctctatgaaagtagacatcattccactagagcaaattggtattattaaaaaacttggtacttgagaaaaacaggataaaaccaacacattatcaggcaaagtgcattgacaatgcaaatcaaatgcacgtggtttaattataattgagtattaactgaagaactgaggattataaatgatatgtctctggtgaagagttcggctgagtacattacatattcattagctttccatttttattccctaaatgtccagtcctttttcctatacacctggaattatgcttgcatggctgaaatgaatattttgaattcagaagaccatgtttatgtataaaaaggatatagaactaagtattgaatataacaaatgtatttctactaatctgcttactttcatctgattagaagatcatgttggttttgtacaaggccagaacattctataaagactactcaaagattaactttagaaggagtattggagatttcctcaagattcttacaaatgaggaagttgagagagagacaggcagctacagtcagtgactccctcagatcccacacagaactggtgatagactcaagagtaagaagcctaggcacatgactcctgctttagtgaagtttattttagataagtttcagataaaaatgtattgtgtttgctggatattatgtgtatggggagggagaaagggaaaggccatttcaggaaaattttcaattttaaataggtggttctcattgcgtaaacttcattttcaacacagttattcttatttggcatgttctttctaagactgcctctgatttggctccattattgaaatttaagtatggctttcatttataactttgaaagaagtgctgaaaatgggggataataaaatatctctgctctagtttagataatccaatagtctacagtgaaaattggaaaatttaaactaaagtcattattaatgattaaggtaaacgtattaattatggttatatttttatatctttatgacttacaacaacttaaactggcttacctagtttatttcatccattaatgacttttaaatgatatcacacttaaattttctaagtatgtgctaactgctttactatcttttctgaagaaagtacatcattgttttataacataatagttttctggactctgtaagatatgtcttaagctaagagttaatcatctttcacaataaaaagatacatgggattcaaattgatacatttgctaattgctgatgtctacatgttgtctatgaactgaaattgctcaaagaccttttccccaaaaaatcagtttgataatttgattgacttcctgttactttggtgaatactaacttgatccagtgaattggttaaactcatttatacacgtatactggcatctatggcaactcaaatccatagggaataattgttcctgttttgtcttttttctacaaagagttatgattaatataatgaaacttcttgataaaaagtacatagttttattaaaatattatcagacagcagaaggggaaggctgaactaagatggaactttccagaatcattgcaaatggtttctagagaaaaaaatttttttaaattatgtctatgattagctcatctgatccattaacatatgagcattaggtaaatatgtcataggtgacaaccagacagaaattacctgaacagtttcaataagacacactgaacaagccttaacatctttatcgaagaccaaccatcgtaagaaatatagagcacctcttacaaggaacactatataagaagatgaacatgattgatgaaaaattcctcacacctcggagaaaaacaactcatgctggttgctttatgccaaattccttgtgctacaaatctatctatgcagaacccacttcctcacacatcacccaatgctatcagtgtcttgaactaaacgtgggtgcttcctacaaagccctattgagacatcactagctgagaaacttaccttgagacataatctttttcatgtaaaggatagcgcatttaagaattctagactctggcctttgaacagtttcacaacaggaagatggaaaaagaagtcagcctggaggaaaagcaacagagaattttgcccaatagaacataaaatacagaacacaagaagaggagaaggggaaagaactagacagtttgaatagtgtctttagggtatttaggaaggtcataatatagtatcatattgatgcatctcattcagacttgccatgttaaagagtatgaatacctcctcttcttcacaagcccagacagcagcaggaactcctaatatattttttgttttcaggagcctgttactgaggaaaatttatggttccctcttctggaattctaggatcctattgcacataagaaaataataaatcaattgggtcaaatttatcagtatctaaaaatgaattgacgttacctctaccagatattatttgcacttaaaaggctgctttatatgagataggtaaagtgggggaagaatagtggtcattttagatggctaggtagctttactttgggaatcaaagatgccttcagggaaatctagtaggcagtggtctgtttctctgtgcaaagggcaagactggtgggacatgcttgctggcctcagatcaaagctattatttggatgaaaaatctaatatcaggggattaaagcaaattttacttttacttacaacctatttaataaagctatcttaatccctatctatctcagaagactcactttttccttactgttattattattgatgataccaaatcagtcaggatgataaaactcagcccagggaatttagtgggtagtgaagggtatgggcagaaggtgacaagtggagggagaggggtaattgaataaaaatggaggttaaaaatataaaaatgtgggaaagaggaaggaacattgtattgtttcaaggttttgtcttttatctacagtggagtaatgagatcttggatcttgggtaaacagttggaatgagccacagtttccttatcttaggagataagtactttgactatctcacagggttgctatgcagaacatttaaactataagctgcatgaaggtaacctctctaactattctggttatcattgtatctttcacttaacatggatatcatataataggtacttaacaaatgttgagtgaattaaagacatatttcacaatcatatgaagatatggtcattgactaatttgcattaagggctacaccagataataaatatatctaaattttgtttccaacatactaaaggaggactttaattcacaaccaaaaagatgatagatattgttagatacttctatttcatatttatatggctttttttctaaagtgcattatcataatttctgtttactcttataatactttggtgaaataggttaagaaagtaatatcaaaattttacaggaaaagaggcttacaaatgaggtgaagtaacttgatcaaagacatccccctttctaccatccccgaagtacaatcacggtcatatgttaagtttccttacatactggtgaagcccttgagtaatttttttccatttcttttttcatacacatcacaacccttctaagatcctagtttcatgtagtggagttagtagtattatttgcacggtatgggagaagaccgagattctttatttttctcctctaatgtgaaattacaacctcagcccctagcctggagaaaatatctccaggtctgaaatcccatcagctatctggccctggcttcctcctactgttttggcattttactttttgtgataactgtggcttaaaaacattatgtccacaatctctttgacactctctgacactcctccctataagagacaaaggcttgagtatgggctgaacttaggtacttgcttctaatgattagaataaagctcaagtaatcatgtatgacttggagaacaggccataaaaagatatcacaacttctttgtagttctttccttcttgaattacttatctgggggaagctagatcaccaataagcagcccacatggtaggaaactcaggcctccagcccacaggcagtgaagaacggacacatcctgcccatagccatgtgaatgagccatcttggaaatggatcctccagccctttccaaccctttagatgactgtagcccaagctgaaacttgattgcagcctaatgagggacccagagccagaaccatccagctaagctgttcttaaattcctggcccacagaaatgatgagataatattttggtggtaatttgttattcagtgatagatagataagtaatgccctatttttccaagcatttctgtttctgtagtgggagaatgcaggctgtctatatcatgtcagttggtcatgttagctgaaattgctgggcacagtagcccatacaataaaatgtacaaatatagatgaattacattttacatatatatgcctgtatttctaaggtatcacttgcttatattaaataattgctactcttataacccctgtgcttcaatgaagacattcattcttcatgcaggaatattcataagaattgaattcaattaaataggatgtggtcagctttctctcaaaatgtgttactgtagaaactcccagatggaataagaaatgttgaaaaaatttaaactcattctttttataaatacatcttattgaattattagattgcaaatacacatatgtgcacacatatgtgcatgtgtatttgcaaatcaatagttcaataatatgcacacatatatgcatgttgatatatgttgatatatacagtatatatacatatctgaatgtgtgtgatcatatatataattaatctactactgtatcttttttttctcatatggcaataaatacatggactttagggtaaacaggtttaaatctcattttgatgccttgctagttctatgaacttgaaaaaacttacttgatcactgtttctgttcctgcatttgtaaaatgaatgaaatcttacaatgtcatagagttactatggagattaaacgtcattatgtatttcaaatgcctagcgtaaagcctagtttaagaagcacacataaactattaatttcttttccttttcccttgtcttgccttcgttttttgtttcttatagttacttactcctacattacaaattgaaaaggcagaattctaataagcaggctccacaaacagtacttaaaaagtatgtgaagtgtagatagtttatgtatgtacattaccacaaatgtttttacagggagagcacaaaggcttatctataaaggtaagacttacatttaaccatatatactttctttcttttagaaataattttaatgtgggtcattaaggctagaagtgaaaagtttgtatgtgttgacctttttgtttccctgtaacattcatatctcacctaatttttccagtagaatgatatcacattttattgctatattcttggtctaaatatagacattttaaaaaattgataacattcaacttacaggtattatccttctattcttaaaagttatatttacttacattggaaaaagcagagtaatagtcctgtaactgataagatttggattgcaaacaagagtctttagttaagtaaaaaaaaattattggaaggctacaaggggcccagagaattaagacagataggaagaccatgtgagctgtggccaggaagaacagcaatgcctcatagaagaaagtctggccggcctgttcctgtgtgatgaataatctgtaatccttcattgcgcccttacccaagactcaaaaccacaaaaaagcatccaattggccaagcttagatcatgtgtcctctctagactgtacaaaaatgttgagagaaaacttatggctcctttgactattcaaatggctgacaaatactcgggtttactctcagaccaaaattatacatgatggaatgaaacaactccccaaaatcaaataagactatcttaggagagacaaagctgggctgacaaaaaaatacatttgtggaactagtattgtcttaactgactcttttcaagggaagagaaactacacgtgccaacaaggctatagaattgaagagcaggcatgatgagatatgagaaaacaaatttatcattgtgaacactgatacttcatatttggttaggaagactgatagttacattaaatacagaaattatacactttttaaattaaaatagagaaagaatagggagtgactagataatactagattcattgttgagatttattttcatttattaagatttatcttgtaatgaaaatctaattattacttaagtaatagcaatagattcatctagttttcatgttaaattaactcaatatggtataataaacagtgtatttggtctttgtcctctgttcccgactgataggagtgtattttgttattcataagcaaatcttttgatcacacttgagtttatgctaatgagacaatgggggtgggtgggtgcaggcctagataacttcagaatggggcggttcgacagaaagactgaatgattagaatgattctaaagaggaggtaggtaggagaaaagattaggctaactaaaatctcttcaacaaaatttgacgagcttccaggctggtgaacatatcaaaatgctgggagggtggcgtacccaggtaggatatgccccattcatctcttccatctggctgttcctgagtaaatataagtacagtgtttccctgagatctgtgagccattttagcacattatcacacctgagaatagggttgtagaaatccccaatttatagctagtccatcagaagtatgggaggcccaggcttgcaactgacatctggattgggttcagtgttgtgatactaagccttctaattggtacactctcaaactaactacatttagatgatgtcagaattggattgaatgctaggacacccagctgtttggtggagagttggagaattgcttggtacggaaaaactccacacagttgttgtcaggagtgttgcgcatatagagaaacagtgtttctccagactaagagatgctataatcaattggctgaaaataagaggataaatctgtatcttttcttttaaaaaagactaacctgagagattttgcctgagattactatcttttgttggataacctaattaaaaacaacccactgccaaacaattaattctggaagctaagaaaaacagatttttatcgctttatagtgtgcagtccagaacgtgaatacttcaaatagccaatctcacacttgcttaatctaccaagtgagctgaaacttgaaagttcttatctccttgattcttatctgtgtatgtctgtcggggggaggggggaatgggtgttctaacaagttaggaacagagttaaaatgcccgattttcatgttgttttggtaacaggcttatatctgcactgtctgctactattggtgagaaaattagtttttaaaagatagtctcagtacagttgttcattagttagacttaaaaaacagacacagaattccatcctttgtacccaagaaaacattttaatgactgggaattaaatttatctaaattggcattcttaactctttggctggaaaagccaaattagaaatacaatactctcttgcaaataagtaattagagtatattattgactgtgttgtagatttcagatataatcaggaattttacaagtggaaatcctggaactgatataataaatggaagaattaaagggtttaacaaagtttcattttgtgttgatacccaaattggacaattgagtaccattaaagtagtaagactatctaaatgctacccagcatttttgaaactacctaattttccaacaaataatactctctgcactatatataattaggtatatgccaaagtcagctttgttttgctattcctgaatgccatttttgttacttgtaatctctattaagtatatagaacagtaacacacttgagatttaaatgaatatctaagaaatgcttcctttttctttttttttaattatactttaagttatagggtacatgtgcacaacgtacaggtttgttacataggtatacatgtgccatgttggtttgctgcacccgtcaactcatcatttacattacgtattttccctaatgttaaatacttcctttttctgataatcaggcatttcttctcttttgtttgatctctgtttctgtcactctccatccaggaaactggtggcatagaatacaatgggactgtccaaaggtgcatctccactttttgtaatttcacactctttatgattctatttcacacttcttaaaacatggtactatccctacagtgtcactattcacttgtatgttattgtgcaggggaacaaaagttgctgtgtagaataaataagttgagatcctttagtatgctgagttgacaaaactaaattctttagcacttgtagtgcattatgcccatcattacctttaaactactgaaaggaggtttagaagagttgcataagatcaactactaaggatcagcttgtggaaaatcaacaattgtccctgcactacattattacatgctgtgagaactattgagaactggaatactaaagtactaaagaactatcaatctgttgttgctatgcaccatcattataaaacatttccatttcagctagtcatattcaattagctaatatgtaaattgaattcaattttattaaggtataagcaattcacaataatgaagcttacaagtacacgattccatcaattgttaaaagatcattgcatggtaaaatataaacatttcactgttatgaaatttattctggaagtaataaaaataccagttctttttgaatcaatataaataatagaaatgcaagccaaggaattgcattttttataagtttgactgttttcacactgtcttttgtttagttttatatatttatttattattaatctaattagatcaatctgctagggctcatgaaacaatactccaaagtatggcactatgacatgtttagtactttgaactaaaggacattggaaagcctcagaagtagcctcagacccacgatccctctgaccttctgacattcttcttgaagcaagtcacagaaaccaaaatttctcttcctcaaggccagtcataaaaactagaaccccttttccacaaatccagctataaacctagaaaaatactactctaaccctccttgttcttctatataggagatgggtgtaaggaaattctctaacccaaccttgtccaataatagctcttaagacccttataccagaaggggccctactcagtccctgggaataaggaatgatgcacagaggctgtattagtttgttcccatgctgctatgaagaaataccagagactgggtaatttataaagaaaagaggtttaattgactcccagttccacaaagctggcgaggcctcaggaaactcacagtcatggcagaaggcacctcttctgagggtggcaggggagagaatgagtgccaagcaaacggggaaaatcttcttaccaaaccatcagatttcgtgagatctcactatcatgagaacaatatgggggtaactgcccccaagattcaattacctcccaacaggtcccttccacaacatgtggaaattatgggaactacaattcaagatgagatttgggtggtgacaccgagccaaaccatatcattctgccccgggccactccctaatctcatgttcttacatttcaaaacacaatcatgccttcccaacagtcctccaaagtgttagctcattccagcattaacccaaaagtccaagttcaaagtctcatctgagataaggcaagtctcttctgcctattagcctgtaaaatcaaaagcaagttagttacttcctatatacaattagggtacatgcattgggtaaatacacccattccaaatgggagaaatagaccaaaaaaaggggctataggccccatgcaagtctgaaatccaatagggaagtcattaaaccttaaagttccaaaatgatctccttaacgccatgtctcacatccagttcatgctgatgcatgacgtgggctcccacggccttgtgtagttctgcccctgtggctttgtagggtatagtcactctcctggctgcttttatgggctggcattgaatgtctacagcttttccaggtacataatgcaagctgtcagtggatctagcatcctggggtctggaggatgatggccctttttttcaaagctccactaggtagtgccccggtggggactctgtgtgggggctccaaccccacatttcccttctgcactgccctagcagaggttctccatgagggctcagcccctgcagcaaacttctgcctggacatccaggcatttccatacatgatctgaaatctaggtggaggttccccaaactctattcttaacttctgtgcacctgcaggcccaacactacaggtaagctgcaaggcttgggacttgcatcatctgaagccatgtcccatgctataccttggccccttttagctacagctggagctgaagcaactggggcacagggcaccatgtcctgaggatgcatagagtgggcgggccctgggcccagcccatgaaaccattttttcctcctaggcttccaggtctgtggacagggactgctgtgaaggtctttaacatgccctggagacattttccccattgtcttggtgattaacatttggttcctcatacttatgcaaatttctgctgcatgcttgaatttctccccagaaaattgttttcttcttttctatgacatcacccggctgcaaattttccaaacttttatgctttgctttctcttgaacactttgtcacttagaaatttcttctgccagataccctaaatcaactctctcaagttcaaagttccacagatgtaaaggacaggggcaaaatgccttcagtctctttgctaaaggatagcaagaatcacctttattcagttcccaaaaagttcctcatctccatctgagaccacctcagcctggacttcattgtccataccactatcagcatttcgctaaaagccattcaacaagtctctaggaagttccagactttcctacatcttcctttcttcttctgagcccttcaaattgttccaacctctgactgttacccatttccaaagttgctctcacatttttgcgtatctttacagcaatgccccactacctcagtaccaatttattgtattagttcattttcaaatgctatgaagaaatacctgagactgggtaatttataaagaaaagaggtttaattgactcacagttccacatggctggggaggcctcaggaaacttataatcatggcagaagtcaccacttctcagggtggcgggagacagaatgagtgccaagcaatgggggaaaagccccttataaaaccatcatatcttatgcaaacccagtcactactgtcatgagaacaacatgggggtaatcagctccatgattcaattacttcccacttggtccctcccatgacaaatgtggattatgggaactacgattcaagatgagatttgggtggggacacagctacaccatatcagaggccaagaagagtttccactgatgggggctttctggattattaccctttgtccaattgcactcctacatggctgtccactcttcatggaatgtaagcataaagtggacagtttttctttgtgtctttcagccttcattctgaaggctctcatgttatgttcttctcctcttgtcttttgttataggggagtcagccttatgaggggtgagaaaaggtatcaccccatttttgcccctactgtttctggtgtccaataagggacacctgagacacctgactcactttggaacatactggtgttattctcagacaaccaacaaaaagccagataaaaaaggtcagaatttttatcaatgtcagctgtcccagatttctgcctccagaatcttgtcaagaatgtaaagtaaaaatttgtttgttccttcctttccaaattcagattaacatgaaaaaatcatttgtataaatttgctcttagattcagtaactctggtgactttttttttgttgttgttgtttggccatgatattctaaacatggaaagttaccttgcatgtctccatgaacttattagtctgagtcaattctaaacaataaggggttatatttaaaaagagcaaaattggccaggtgcggtgtctcatgcctgtaatcccagcactttgggaggctgaggcaggtggatcacctgaggtcaggagttcaagaccagcctggccaacatggtgaaaccctgcctctaccaaaaatacaaaaaagtagctgggcacctgtaaccccagctacccaggaggctgaggcaggagaattgcttgaatccaggaggtggaggctgcagtgagccgagactgtgccattgcactccagcctgggcaacaagaacaaaaccccatcccaaaataaataaataaatacacaaataaggaacaaaattatttgagagagctctcatcccaaacaactatatttctgatacctatgggaaaatcaaatttaaaaatggacacaaaggagtataaaagctagccttagatactcctttaataagattaaaaagcagaaattagattagaaacaaagttaaaattcaaatccacccataaattctcctctctgccctcttatactctctcaacttcctgggagtccctgacactccagatcttttgcatttctggtccccagatttaaaattccctttttctaaatctagctccatttccttagtacattcctttagctaaagaatgaattatttgtttgaattcatttgaattatgacttttggttttgggtgtcaattcatttgtggtccttccccttccatgaacagcctttgttttcccatttgtcacatttttaacactccgtctattggggcattttgattatttgggctttgtgtgcaggcagccaaccataaggttgggaccccaaagaaaatggccagagagaaatgtgtgttaagccccactgtggctaagcaaattgactaccgccagctctcaatgtgttgtctaagcttttctaactctggctgtcatttggagtgctctggatcttgaaaaggctgcacctttttgcttcctctttggaaaccttagttaagcctcaaaaggcttattagtttttgtctggaattacttgtcagatataactttggttcttatttgtttgactttctctactaagctaaaatggaactgtatactcagaaggaaaaagaaacaatttattaaaacatcacaaacactaacaattctaaatatagagcacagaaatcttttgatttccttcttagttggaaacctgattcctgataggaaggagcaaacaaatgataatacaattggatagatgggtgagcccctcaatagcattcaggctgcaaattaattattgaggaattaaaaacaactaaccttacctgggcatgatggcacacacttgtaatcccagtactttgggaggccaaggcaggaggatcactggagcccaggaatttaaggctgcagttagctatgatcatgccactgtactctagcctgggtgacagagtgagaccctatctttacaacaacaccaccaccacccaacaactatccttatctcaaaaactgagtatttaaaaaaccgacatgtgccctgaacttaaaaaagaaagaaaagtttgggtagtaattaccctagaccaccaatatgcaaatatcttcccttcccccaaagccaggaatatttgctgttttgttggttgaaatctgacaagagatttgcaataatttttttttaagagctccatggtccaaagctgacttaatggaaagctgatcttcagactataaatttttgtaggcctctctcttctgtctatttgatcctgcatctcctgtgagaacttcttagtcaactaaaacccattttttcaaatccctgctatctatatgttcagtccctctgtcagcttcttttcttgttgccatgatttttgatgaggttaacagggcacttcattgacctttttgagaaacttaaaatctcctcaaattagctcctctaagaactgttccttccatttacttctgttcctccttctgccttttgtcacctttgattttctgtccagtttccttaaatccttgatatgttccccttcaagtccctttctcctccatttggtgaagagtagatacaagattactaataggaagcatcagcgttctggcagccacatgaagggacctgaaggagacatcctgtgacactaaaacctcttgaggaatccaggaaaggcactattgaccccctttgggaggcctctgtcttctgcatgtagccctgagagtcatgaataagtttctctcaggtctgaagctctgctgtgttttgcattgcctaatctctttggctttgaggataccaagggttagttactgcagtgtgaaggcacttgacctttgggtttgcagtggctgacaagtcactgacaagagatgcagttttaaaagtaactgacagcagttcattaagtaattattgctgcaggggatacagactccactttttggagttataggtgtctgggttttaaccctttgtctctttttcttgtgtacttaagtgaggaaggcctcgggcatctgattcggtcagagagaaactggaaaatcattggttaagttagctaaagggatcttagagtcaaagtcttgactggaggacacagttcaggcacttaagagctagtagcatgctcaccactgaaaaatatgacttccattttagaataagctgggcatagaatgggctagttgacattaggtcacccaccagcttcaataaaatgtccatgcaatgaggtatattctaaaacaattacacaacctaagcttgtggcattttactcttatgcttttatcttcattttgagagacccaagattaaacaaaagcaaaactgaaaatccacgtatctgattaaattggtctccaaaatataactttctgatattcagccccttattttgaataagcttcttaattttatcctaggaccctctgcgtacttccctataccattccaagtggtctttggaaacattcagacagccacggtgtgtctttttcatcaccagtctaaaatctagcccacagcctccacaagattgagctctgataataggcaaatatgcctcaaactccttcttagaagaacttgcaatctccctgtgcccatgagatgtaaatctattaccctgtcttctctagaactatgcttatcttttatcttcactagaactatagataccttttggaaatacaaacttcagggagatgactgtctgaaaaaaaaaaaaaccacaagtattctgtcaaaaaggaaaagtagaaactaactcaaaggcttttggttcatgtgatatgagataatccttggtaaataaagataattttaaattttttggtcatataaaagtaggaatgtcttctgaattgtcagcatcaaatataatacaaacatttttgcctgggattgctggttagacaggtttaggttgtgtctcctaaatgttttaaggtcataaaatgataaatcgaacctaagagcagaaccaattacttggtatatattagtcatgagagcaagaaaaaaattacccttaacaatttattctgtgatatttttgatacttgcctgatttattggtggactgaagctatgggagtcagttgctgtgctctcctgaaatcttacacacatcttgctgtgagcttattttagtatgaagccctggattttgggatctgggcagatggccatggtacagcctgaagacatttgtgtatctatagcacctgggctgctagccaaagtgcagggtcaagcccaggatagtcctgtcctccctggcccagttgtgactcctggtgatccaggcattatcttcacagctgtctgacctctatcctttggcttgtgctctatccctggtatgtgggtcaaagatccagatgtgctctgccatttgcaggcacactgggcaccatctgattgctcaaaacccaggatgactagaggtgggaattgaggaccataactatgttcagagtctcagaggccttggttaagacaaggctagctaacacagatttggattggtttcaatttttcaaaagaaaaacatagattatgcttagcctgttttcatgacccattcaagcacaaatattaagaataagtaaattcaataagatataagtggaataaaagtttgtaagtaaacttttcaataatatttatgttttataaaagatatctacttaaaaatagtttcaaaaatatttttggtattctgaaactttaaagtgaaattaagtaatagttattaaatgtctgccttatttataagttaaaatactgacacattaattactagtcattggtttaaactatatatattttgacatcttgtttttataaggtatacagaaggtaaatatatttaagtctgtaaacaaacataaaaattctttctaggctggatgcaatggctcatgcctataatcccagcactttgggaggccgaggtgggcagatcatgaggtcaggagttcaagaccagcctggccagcatggtgaagccctgtctctactagaaatacaaaaattagctgggcatggtggcacgtgcctgtcatcccagctactggggagactgagttaggagaattgcttgatattttatacaaagagagacactaaagcaattaggcttatttgatatattaaaatatatggaagcattgttgaacagtaagtgatgctaaactttctttaagttatatttacaggtatggtagtaatacgaatgtttcaaaattgtataaaattcctagaagtctatacttctaatataattttggttattacattaaaatattttatgccacagaaacaaccaaattttatcaatttcgctcatcaggtttctaatcacggccattttaagtttttgacatccaaatagttattgttttactttggtttttatttaaaagcactgtcaatcagctgaggtccaaacttgtttctttaattagattcatagaaaggatagaaagaactctgaaatgtacaggtttctgataactttaagattataccattggactgggtgagaattttcagagctctaataaatgaactgagtgattttgtgaacgtgctcatcgagatcaaacagagtaagaattaattcgtgggtctaaatgaactgataagaactttttatgattacttatttgaaattttgctgattacttaaatgttaacttttctggatttaaagaaactgttttgttttgtttttattttaagctatctatttgttacagcaatttggtcaaatatacattggtaaatagaatgaaaatatttattcttctccccatctgatatctccaaaatttggaaattatttgtgagtattctcatttttatggcaatgtagttattcacataagttcaataagaaaatattctctttgtaataggatacaaggggaaacacttcttaacttacaaatgcttgactggaatgacatattttaaaatatgaccagacaactttgagaaactaaggtaaacttcagaaaggcaagaaagcgcaccttggagaaactggtctcataccttgagcacatggttcacgtgactgctttacaggtgggtaaaaaatgtccctttgtcttctttgtctcttttgatctttgttggtttaaagcctgttttatcagagactaggattgcaacccctgcctttttttgttttccgtttgcttggtagatcttcctccaaccctttattctgagcctatgtgtgtctctccatacgagatgggtttcctgaatacagcacactgatgggtcttgactctttatccaatttgccagtctgtgtcttttaattggagcatttagcccatttacactgaagggtaatattgttatgtgtgaatttgatactgtcattaagatgttaggtggttattttgctcgttagttgatgcaacttcttcccagcatcgatggtctttacaatttggcatgtttttgcagtggctggtaccggttgttcatttccatgtttagtgcttccttcaggagctcttgtagggcaggcctggtggtgacaaaatctctcagcatttgcttgtctgtaaaggattttatttctccttcacttatgaagcttagtttggctggatatgaaattctgggttgaaaattctttcctttaagaatgttgaatattggtacccactctcttctggcttgtagagtttctgccgagaaatcagctgttagtctgatgggcttccctttgtgagtaacccgacctttctctctggctgcccttaacattttttccttcatgtcaactttggtgaatctgacaattatgtgtcttggagctgctcttctcaaggagtatctttgtggcattctctgtatttcctgaatctgaatgttgacctgccttgctagattggggaagttctcctggataatatcctgcagagtgttttccaacttggttccattctccctgtcactttcaggtacaccaatcagacgtagatttggtcttttcacatagtcccatatttcttggaggctttgtttctttttattcttttttctctaaacttctcttctcgcttcatttcattcatttgatcttccatcactgataccctttcttccagttgatcgaatcagctactgaagcttgtgcattcgtcacgtagttcttgtgccatggttttcagctccatcaggtcatttaaggacttctctacactggttattctagttagccattcatctaatcttttttcaatgtttttaacttctttccgatggtttcaaactcctcccttagctctgagaattttgatcatctgcagccttcttctctcaacttgtcaaagtcattctctgtccagctatgttccattgctggtgaggagctgcgttcctttggaggagaagagttgctcttatttttagaactttcagtttttctcttctgtttttttccccatctttgtggttttatctgcttttggtctttgatgatggtgacgtacagatggggttttggtgtggatatcccttctgtttgttagttttccttttaacagtcaggaccctcagctgcaggtctgttggagtttcctggaggtcaacaccagaccctgtttgcctgggtatcagcagcggaggctgcagaacagcaaatattgctgaacagtccaggcccagatggattcacagctgaattctaccagaggtacaaggaggagctgctaccattccttctgaaactattacaatcaatagaaaaagaggaatcctccctaactcattttatgaggtcagcatcatcccgataccaaagcctggcagagacacaacaaaaaaagagaattttagactaatatccctgatgaacattgatgcaaaaatcctcaacaaaatactggcaaaccgaatccagcagcacatcaaaaagcttatccaccataatcaagtgggcttcatccctcggatgcaaggctggttcaacatatgcaaatcaataaacgtaatccagcatataaacagaaccaaagacaaaaaccacatgattatctcaatagattcagaaaaggccttcgataaaattcaacaatcttcatgctaaaaactctcaataaactaggtattgatggaacgtatctgaaaataataagagctatttatgacaaacccacagccaatatcatactgaatgggcaaaaactggaagcattccccttgaaaactggcacaagacagggatgccctctctcaccactcctattcaacatagtgttggaagttctggccagggctatcaggcaggagaatgaagtaaagggtattcaattaggaaaagaggaagtcaaattgtccctgtttgcaggtgacatgattgtatatctagaaaaccccatcatctcagcccataatctccttaagctgacaagcaacttcagcaaagtctcaggatataaaatcaatgtgcaaaaatcacaagcattcttatacaccaataacagacagagagccaaatcatgagtgaactcccattcacaattgcttcaaagagaataaaatacctaggaatccaatttgcaagggatgtgaaggacctctccaaggagaactacaaaccactgctctacaaaataaaagaggatacaaacaaatggaagaacattccatgctcatggataggaagaatcaatatcgtgaaaatggccatactgcccaaggtaatttatagattcaatgccatccccatctagctaccaatgactttcttcacagaattggaaaaaactactttaaggttcatatggaaccaaaaaagagcccgcattgccaagtcaatcctaagccaaaagaacaaagctggaggcatcacactacctgacttcaaactatgctacaagtctacagtaaccaaaacaccatggtactggtaccaatacagagatatagaccaatggaacagaacagagccctcagaaataatgccacacatctacaactatctgatctttgacaaacctgacaaaaacaagcaatggggaaaggattccctatttaacaaatggttatgggaaaactggctagccatacgtaaaaagctgaaactggaacccttccttacaccttatacaaaaattaattcaagatggattaagacttaaatgttagaccaaaaaccataaaaaccctagaagaaaacctaggcaataccattcaggacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaatttctgcaatctactcatctgacaaagggctaatatccagaatctacaaagaactcaaacaaatgtacaagaaaaaagcaaacaaccccatcaaaaagtgagtgaaggataagaacagacacttctcaaaagaagacatttatgcagccaacagatacaagaaaaaatgctcatcatcactggccatcagagaaatgcaaatcaaaaccacaatgagatatcgtctcataccagttagaatggcaatcattaaaatgtcaggtaacaacaggtgctggagaggatgtggagaaataggaacacttttacactgttggtgggactgtaaactagtttaactattgtggaaaacagtatggcgattcctcggggatctagaactagaaataccatttgacccagccatgccaaaggaatataaatcatgctgctatgaagacacatgcacacgtatgtttattgcggcactattcacaatagtaaagacttggaaccaacccaaatttccaacaatgatagactggattaagaaaatgtggcacatatacaccacggagtactatgcagccataaaaaatgatgagttcgtgtcctttgtagggacatggatgaagctggaaaccatcattctcagcaaactattgcaaggacaaaaaaccaaacactgcatgttctcactcataggtgggaattgaacaatgagaacacttggacacaggaaggggaacatcacacaccagggcctgttgtggggtggggggatgggggagggatagcattaggagatatacttaatgctaaatgatgagttgatgggtgcagcacaccaacatggcacatgtatacatatgtaacaaacctgcacgttgtgcacatgtaccctaaaactaaatatatacaatgtaaaaataaatatatacaatgtccctttgtcacatgcccaggaacgtttgaatgtttttgggaaccttgagcagaaataaattttctcacatatatagatattataggtgaaatgtgacattgaatctttggcttggttctgtagctttcagatatttttaaaagtccagtctgagattccttataaaacgttcaagcaaagcaaacttaaaaagatcctatgtggctgatcactagttttactgcacttacataaataatcatgccaattttaatgagactaaactgattttgcaaacaaatatattttactttgattatctttggtaggaatgggggtgactttcaacataaatatgatattttagaagaaaggtagagtgaattcattattagactctagctcattgtttttgcaggtttgttgtccacctgaattctgggctggatcctgaatgtttttagtgtcctccgatatgtctcgaaactaatactttcaggtttttctcacaatctcttgtgtggaattgttgaaattaaaactgaacttttcctgcagccctgcaagctgaagcttgaccacttgatatggacttcagaaaaatcaccagattagcttatacatacacaaactttgtgcctattcctgtatgggctgcttagaaaagttcacctgatgcaaactgcaaactagaaaaatctgtcagtttgctccttcctgcctccactcccacagaaaatgcatcaagctcaaatctagaaatcttctcaactggctatcccccagactcagaaaataatttatagtctctcctaaacattgacttttgcttttctttcattttcatagaaatgcctcttattaagtatgtaactgctcacaccatatagcagcctcactttggagtaagcccaccggcaacatcagtttgggagctgagacttcacagtttaactggactggcctattcttggagctgagagattggttccattgctcatgagacaatccagcaacccaatttctggactgtgaaacttcaggaagtttcctgttaaggaaggaagaagaatgttgtggttcagaaaataataccccaaaatatggcactttggcatgctgagtaatttgagccacagtacattggaaggtctcagaagcaacttcagaaccaaggtctctctgaccttctcctgcccttctgtctcttgccactcattttccccgagtgactcatagaaatcagaattcctctttcccaagataagtcatagaaactaaaattccttttccccaaagcaaaccgtaaagtctaaaaatgtcactctagccttcttccacctttcttctaggagctgaccataaagaaattctttgagctactcttgtctgatagcaggtcataagactctcattccagaaggggtccttccctatacctgggaagaaggaaggccatacagagaggtcaagaagaacctgcacagacaagcctttctgggtttcccaactcagtctattactattagatcattccatttgtgtccaatcacatttctacctggctgtccactcttcatggaatataagcacaaaattagacagtttcttcttgtgtcttttaagtcttcattctgaaggctcccacatcccataaaacgttgattatatacatttgttatgcttttttcctgttaaccatctttcattataggagtgttggccttgacccttatgagggatgagaaaaggtatcacacactttctgcctctacaaatcaaaacgaatttaaaatttcttttcttctatatagccactcatctttcttctcagaattttcaactctacatagccaaagcctctccaatacaaggcccgactcacatgctttcttctaggatgttttctgatctccagcagggagtcacctcttctgacccttgaatcccacacaatagtagttctccatctttggttaaaaatatagatgtaagagatatattccaattccattgaatcagattcaatgagggcagctaaatttttacaagttctcaaagtgattctgatgcacattgaagtttgagcatgatcaccatacatttcatttgcatttctgctatctcacttattactctcagctttgctttacagttattcaaattatctatctttaatttcctatgaaaggtagctcttgagggtggaatctgtgttcatgattctctttatatctcttgcagtacactgtaggtattgagtaacgtgttaagtcattgagtaaacggaggaagcaatgagctcctaagttatctattattatttttttttaatttgagacagggtctcactctgtcacccaggttggcatgcagtggtgtgatctcagttcactgcaacctttaactcccaggttcaagtgattctcctgcctaagcctcccgagcagctgggattacaggcgcccaccacaatacttggctaatttttgtattttttagtagagatggggtttcaccatgtgggccaggctaatcttgaactcctgacctcaagtgatccacctgcctcagactcccaaagtgatgggattacaggcatgagccaccgtgcctggcctccctaagtgatttttaacatcaaagttgcattttataacatttgtaattatcttggtaacaatgatttttgtaacttcttagaatttttctaatgttagggcaacatttagtaagcaatggtggagacagatatgaattagcacccatctgatgtcttagagttttagagtaatgattgtttatatgtcatctctgattatacctgtgtatacctggtgttctgtgttgaaaaggaatctgaggctgtataaaatagttctatgcactatattatacatacagtctagctaagggaatgagaagtcttagcatgtacactgagactgtaccatcctttatcatctttaaaaggcaagtatgcatttgggtgttgcaaaaaggcacaattctatcaaagatcacaaactcaaatgcttgcagggaccatggagacaaacataagcaagtaaagtagctcagaaagagagtgggttaactggagagatttctactctaaagaatcatggagcactcagtactagctggtaaagtgtatggcaaagctgcaggttcagtgttatcagatcttgcttttgaacgggagtcataaagcaagtgatatagtttggatatttgtcccctccaaatctcatgttgaaatgtgatccccagtgttggaagtggggcccagtgggaggtgtttgggtagtgggggcagatccttcatgaatggcttggtgccctcctatggttaagagtgagttctagctttattagttactataagatctgattgttaaaaaagagtccagcatcttctcctttctctcttgctccctctctcttgtttcctttctcctcgtgacatgcctgctcctccttcgacttccatcataagtaaaggctacctgagggctcaccagaatcagacgctggtgccctgctggtacagtctgaagaaccatgagacaaataaacctattttctttataaattacccagcctcaggtattcctttagtgcaatgcaaacagatgaacacagcaagattgttcttcgtaaacctcttgatttctaaatgttgacaaccaactacattttcaaaaaaatttgtcttgaccaaatcagaatgtctgcttattatacctcataaacttatttggattctctctccatttttgtctatgtctctgtgtcactgattgcctggctttgtctctgtttctccctccctcttcctccttctttctcttgggttgtccaactttatttgaacagttagaaccaactgctaaagtttcaactatgcattatttgtagaagtgagcttccacggtggactcttgtcactgtctttgtcaaggaaaagtcagctgcaaacagcactttgttggctattttgtttgaagctgatgccttacatgtaacttcttatactgaaagactgaactgggagatgaaaagaaaggattaaatattctttcagacttcagtggtttcaggtaatgaattatagttctttagaattcaaaacatactttgtcttaatgaatggataaacaaacaggaggaaattgggagaaaagtgttattttaaaaaatccctgtaaatgctttagatacacattaaattaaatactgtttgaataactacagttaagtaaggggaaatcatttttaatatgactgacattttgccttgcaacttgccttctcccagaagaactcccgagcacaccatgaacagtcgcatacatacattctttaatatatggccacaatgttgagttgacatccttacacttatagaagctccagagcactggccctgagcatgagcatgtgtagcttcatattttcctgttccctgaatggatgttttcacctatgatgtaccagtactgatagaactttctgaccccagggcaaaaacatctcatctgtgaagaagtataggcattgcttgaatgttttgtgtataaatactaatatctgccctatcttatttagctgagtaaatctctcagagggtataagtcaggcagcttgacacaagctgttatagttaggtgagacaaggaatgcaaaccctctgccattaatcatgtttcttagctctttagattttaacaaataaccccaatgacaaaaggttaacatattatcaggtgtctcttcaaacagcaggtaaaggtgattttcatgtttttgagtttacttaaagccattctcatatgcactaaactgataaaatgttttgcatttcagtgtcagaaaatttggtctgccttttagattggctcaggggcctttggcctttttgggactctgcaattggggaaatggcaacctatgaaacagcaaaaaccaaaccaaaaccaaaaccaaaaaagaaatatcaacaacaacaaatatattattggtgaaaaaaatgagtcccaacaaatttgttttcctgtgcattcctatgatagcagcttgtgaaaagtctttttatttatttatttgaattctttatctttatccttggatcacacatagatgcaaattcagcaagggagaagagaaaaatgttcagctttcctgatcagaaagcatgaaccagcttaagaaatgtattacatttgaaattgaccctcttttccattccttcaccatgttcgcacacctctgatatcctatttcattctttataccacttttaataggaaaataaatgaaagtccagaatcagagaaccaaggacagatttaaggttgggggctatcagagatacataaaaatctagtgcgggcattgccagcaatagatcccagggttgaggttccattttggatccaagccaggttgccttgctgagcatcattgtgagattgactggcatctgaatgtggcagcatgtaaaagaatgtccaacatttctccattatgaacaggataaagttcaaattctttacacaatacttcatccctgcctacttttctagcaatatatcttctatatccctatacatattcatacatacttgctagtaagttttaaagctctatgcctttgtacatgctttttcctttatttggtaattccttctcttccttctttattttgaaaactactattcattaatttttaaaagccggctcaagggtgtttctctgtcaattgacctacagttgaatgtactttccttcgggcaaatattgcatttggtatattttttcattacagactttgtcatactatattgctattattattttttgtattttacaccacacaaggctgagagttctttaggataagaagtgtcttctcttcatttgtgtcctggataaatagcataatggggtactttgtacatttgaaagaagccaaaagtaattgttgaataaagtgtttaaataaaagaatgatttgagatataactgctctagaattattgtttataatatttttgaaatatcagatttagtcgctgcagcagtcttaactacgcattgggccaccttgatgctatcccttgttttcctttcccaagtgaaatacaaaatactacccagagtgccttcaccaaaaactagcagtctgacttccctattgtctttacaacctatatacaatgcttgctatcctctcttttagctgaattttatatctcggcagctacatttgccacgggatttctttttttttgcccaggatatttaacatggtgccacaatactccctggggtactctgttgtaggggaccaaaatgtgccaccccaaaatatgcctctttggcataaagcttattttgagctgattattttgggaaacagctgacaaagaagaagctccaaaaacagcatacttcccttttgtacaggaaatgtacatttataaggaaatctctgttggtcatggcatgtccctttttgtatcaggaagagaagaacgagttaattaagagattttattatcaatgggtaaggcatgaacttaaatttgcataacacaccttaccctcgtttattgtacttttcctggccaccttcctataacttgtctcccccatactttcttcctttattttagctgaagatggtatttaaacccaaatttttaaattttgttttgttttgagacagcttcttgctctcagatcccaggctggacctcagtgacatgaagataactcattgcagccttgactcctgggctcaggcaatcttcttgcctcagcctcccaagtagctaggactgcaggtgcataccacatgtctggcaatttatttttatttttgtagagttgtggtctttctatgttacccaggctggtcttgaactcctggcttcaagcgatgcagtcacctccaccttccaaaataaatccaagttttaaacacctcttctgggttattcattgctgggtactcatgctaatacgcttctgtttcttttctgtcttgttaatctgtcttttgttacagataaccagccaatcacacgcaagagtagaaggaatgaaagattttacctctcctacactttctttttaaaagaaattaacataaacaaatttaaactcacttaagagaaaagtataaggacattaaacaaaaataagactattggcagaatttgctcatcaaggaaaactagatttttgtttaatggaaaagtagaataattgtgaaattttaaaaaggaactattttgagatttccaaactaagatataaattcaagagtgtccagcagcaacatcccagaattcagtcttcttatctctatttttgaagtacctactgacataataatattcaggtatgcaacatcccagtgtaaatgtttttagaaagccaggatcatgatatctatttttttggctaaaaatctaaagtatctatgacttccatgaacattcaatataaattattaattgatgaggcctgactttttttattaatttacaatttttaaactactaagttgctggcgtcgagtctagaaattattggaaaataatgttattctgttaatcaacaaataatatttacttttattcaagtaagctactaacaaaagttggcatattcattatgttgttgaatcatatttttgagcttgactgcacttgtttttgaaaaaaaaaatatgtatacacatatctccctgtttaatactttccttatctaaacacctcaaattgcttcagtttgagtgattttgatgttttaaatttcacttgggtttagagtctgctggagtctcaacagatgccaaagcataaaaaatggtttgagtgattttgaatgaggaactgtaattttcgtagtcctctttcctttgggtgaaatattcctacatttgttgagcttcactgattgcttgaagtcatactgtatttgtttctgagaactgctgtaacaaattatcacaaacttggtaagttaaaacagcagaagtttattctcttctgttccagaggccagaagtctgaaatcaaggtgttggcagggctgcacttcctgcagagggcttggggagagtttgctctgtgcctagttcagcctctggcagttgccagcttggtttctggccacatcactccagtgtctgcttcggtcttcacattgccttctcctttgtgtctctcttcacctctgtgtgtctcctataaggatacctatcattggatttaggccccacctggaaaatccaggatgatatccttctctcaacatatttgaattaattacatcttctaagcaaagactttttcccaaataagtgatattaataggctccagggattaggatgtgagcacatcttatgggggcggggcggggcaccattcagccactacccattcctttcattaggaattctattagaacaaaaatttcctttttggacaaagtaagtctatatattttctatttccttctattttctgtctggttggatgttgtatttataaattatatggatgtgctcatgggttacatttgagactgcttttagaagtaaatttatttcagtgagcaaatttttattgtttttcgttagcttttttggttagctacctaaagaagaggtatagttttatttacaattaatggtaatatttgtagttatatatgatttttaacatgaaggatggttataacaaaagattctctttcattcttgacataaattatgtgtcagttaataatatatctttcaatagtgaaaagaaagaatcccaaagatgaagatgatttggagttggttcctctaactttcatgattaacatctggaagccttagaagtgatttaggagaaatatcagcagatgtttcttgttgaagaaatctcagcatacaaacatttgaaaattcactgtttttaaacggtattttaaaaccctgcgccctcattccttttactttttgttcctgtattcagttcctggatttgaattcctccagttgtaggataccaagccaccaaagattctggagaatacaatttccacacttttgataggcattgttaggatatttgtgatttactacagttttatatctcctctaaaatatccattattcaaaaacaggttgtaaaattctgacaaagatttctttcatcattatgcttctatgatatagatgagattttgtggctacataaagaacaaaatacagttcagctaacgaatgcaactgcactaagtaaataaacaaagctcaagttaaatataggctaggctttgctgtgtgcaaacagacccagaagaaaaacaatgaacatctgtagttcattgccactggaacattaacttgcttttaggtgttcaagaagaataaaatatgtttgctttgattgcaatgatgattttatttaaatttagattccgttatcattgatttattttgacctatctcaaggactgacttagtctgtatcaataatttcctttaaaagccatttgcttcttaaggtgaccagaagatattcaattgtttcctcctacttatagctcaactcaggagaggtatggataataaaaacctctttatatatttaaaggattaagatctattttcaataaactaataatgctctatctctaaaaccattccactaatactgaaaatctcacgatgcaattctaacaaagagaatgtatgtaacattgggcaactctctctgccttttaagtgattacataagtgtaatagtttgttcacactccctctcagcacttatagatgtacaaagagatgctaagaattaggccaatgagttttattggcacagatactacaaaatactgcaaaaaagttttacaaccttttgttgtaaaagggaatcatgatgattgatcgcaaaacgtaatccaattgtccactattggcataaataattccacaagatccgggacttttttcattttgtttatgactgtatacttcatacccagaataattcgtacctagaacaattcctggccccttgtttgacttcaggattcagagagaatgttcaaacctctgattcaaagacctttgtaccttagcacatttcaaggaggatatgcttggttctttcagtttttggattacagggcttgaagaggattttgccagggcaaacaccttttccccagataaaagcataactttattgaactttagaatagcaagacatctcaaacttcacccacttgccatcttcagtgttaacaataagaaaaaaactaggtctggagaagaaaggcaacttgtatagagtggccttagaaatgaatgacagagccaagactaaatccaattccttttctccttggaccacaaagaagagtgacaatgacattgctggcctttgaaattataaaggaaagatctcaaggcttttagcctctgtggttgaaaaaatgctactgcagaactctgaaaatatatacaaatcacattatctttccttcacatttcttttatctccacctcttcctttttcttctctctgataatatctgcattttggtccttacattttttttctctcttttttttccatttttgtactatttttcccttcctcatgatttgaatgttcttgcctaaaagatttaaactcttctaatccagccctaaacgctgacctaataaaaattccttgcctttctcaggaggaccctttaaagtgaaaatgacttgctaaactgcttcaaccaatgtttggcagatctgggactagaatccaggattcctgtgtcctagcctcggttctttctattataagacagtacttataatatagtttctttctattataagagataaatagcagtgccctgactaattacaagatttccaaaatggatagaaatgacactttaaaatgtcattcctctatataaaaatcgacaatcttcttgtcctgcctctctgtctacctgagaccccagctgcctctctgcttataagaaaaatctctaagtcttatttgcctaaactctgttgacatctcctctcagagggtcttctgtatttcccttccaggaatcaagttgtttttatgcaccatccccagaaaaagaaaagcctttattcttgctcatgccccacttctctaagacagctcaattaattctttaagggttgttccctctttctctctctgtgtcttgtatcatattagatgtgtaaaacctccaataagaaatgtattaatatcttaactgtggcccatatgttgtcagactgaaagggcacctagagatgatctagtaaaatctcctcttttgtggggggtagaaaacaaaactctggaggagttaagtgactttgccaagatttctaggtgctgtgggaaactctgagcagaaggaaggaggagagggagtggaagttttctttatatggctaatgattttatagatagtatgtatttgtatttacattttccatattatgatgttgagtctgtggtagtttcataaactatatgagacacaatttgaggatggaagagttggcttccatgtcccaaccccaagctcttagtcatcaaactcaactgctccttaatttgaagagaaatttaaaaacagaaagctaaaacaaaagtccgaatttttatatatgatatttaaaaattggccaaggatgggggctcatgtctatgattccagcactttggaaagccaaagcaggaggtttgcttgagtccaggggctcaagaccagactgggcagcatagtgagaccctgtctctaccaaaaataaaaaataaaaaacgtaatcaggcatgataatgtgtgcctacagtcccagctgtgggaggattggttaagcccaggagtacaaggttacagtgacctttgattgcactactgcactccagtctggatgacaaaatgagaccctgtctcaattaaaaaaaatctctgtgccagggcaaagaaaatgccaactctatgcaaactagcagggacattagggacaagtggtcttaaaaaattttccgaactaaccttttaaaaaatatagtgactcctgtattggcaaaaatcacatacaatgctattaaagaacatttactcttcctcttaaaataatactcaaaaattagaaaatcagctgttaaatttaatataatttggcttttggctttagtggtaatgaaagaatttaaagagtaaggcagaatatgaaaaaagctaataaatgaatggatagagatagatagatagatagatagatagacagataaactgcatcaggcttctagataaacagaactgccataaacattacgatggctgacagctgcaaaaataagtgaaagtgacagtagccaatactatacaaagctgaaccatgtaatttacatcttagtgaaattaaacatactataacagcttggcttccaggcaacaatactattaaatttgcagtagtagattatgacatcatctgaaaccccaggatacacatttagagctggctattatggtttgtaatctgtattgctgttctggttagtttttcatttaattcattgcacgcttctattaaataaaaaaaaaaatacaacagccattgaggatgcgagttttttgaaaaatctgttaagcttcaggttgtactgatgtcacattttagaatcaataatgataacttatgtctgagaagcattcagaggtcagaattacattgaacagtataatcattcaaatatttttatggtcattaagtataatttggggagtttttctaactcacctttcttttccaaaatgtttcttagctaactaagactatacaatggtggaataacaacaaaacctactgcttttagtagagggtttacattatacagcagcattctcaagcaaatacactgtactgagatcattacaagttcaaacttttgcaggggactgggggatggagaggtaagcatatttgaacttcaaaaaactatttccagaattttgtgtgtaaatcaatttctttggaaaagggatttaaacggatatctaatttttttaaaggcctatttttccaaaaattgtgcagacattgattcattttaacagtgtttctcgagttggggagctttattacaatttcttgtggtgggtaggaaaaaggatcatatagtttgaatactcccctctctctccaccatatgattctaatgttcttgtctaaggaatctgtgctcctcttacccattcccaagactgaactactcaaaattccccatttattgcaagaggacacttgaagatcagggacatgaaaatagcttggcaaaacttcttcaaccagtgactgccagacatgggactagaacctaggcttcttgtcacatagcccagggttctttataaaaagctatgtgagaaagagaaagacccacagaggtaattcaattagacatagcagaaaaagatatctgctacacaaaaatacagggcagacagactataaaactatggctggaaggtaatttagtaatgtgcttacaggacatgtttctggagattctgctgtctttgtaccagccctccctctccaccaatgaatgtatacctacatgtgtaagtgtaaagccttacaaaattggaaattcaggtgaaagcacttggaacacacattcagtcactccggcctgaaatagatgatgctttatataaccaaattaaaggaagtacatctgatttgaagtatgtcattgaacactaccagaactctaaagcccatgggaaagtatcaccttcattcacctttcaggaaacttagtgatgctgccattagtgcttccctctttaagtcaagtataaactacagacaattatcaccaataaactttcagtaatagtaaacgcagatcaggtggagaagaaaggtttggagaactgtataccaactcgcacacatggtcttctgaaggaaggatagaactctgacctaaggtcccaacaaagggcaatcagagattcctgagcatctagggaagatgaacttaggaaaagtgatgcgaggagggtttaaggaaagccggcatcaaccttgtggccttagctggacaatgcttagtgacttctgaaaggcgagtaggcctcaagtaacctgatatttgccctaaatctgcagaatttaacagtcagataatggagagaatgccagaaaagtctgtgggacaaaaaactgttttatgagctttgagatgacattgtgaaatatattttctataaatgctatacacgtaaattaggtatgtacataacattatcttatccttgactttcaaaagtaaaaatgggcaaagaaaactggcaagttaacccagaacactgggctgaataaaagcaaactccatcagctaaagccctgaacttgaaatatggaaacattaagaccatcagagtgaggcacatgatcttgactccaaagactactgtaaagggactgactatattaaatcatgattcaagtagaaaaccgaaatcacgtttattaaaattacctatttctacctctgggaaacaacttcttttacctttgcttgagggaaaaatagtttaagacagttttcgccaatatatgtacaatagcgcctcttgtcattttaacgctgctttttctaggctagtttttctctcctccttcctatcaccttttttcattccctctcaattttctcattttctaatttgcatttgaaagagtagggtgaggtaggatagggttgttgaaactgggagggacttggcttgacggcattgtaaagtggtgatcctagacattatggttacaaaagatgatagacaaagaaatatttattggaaacttcaattaatagaatagaatagtgcgggtgaaataaaatggtagacgacacttttcatgtactcactgacaatcactttttcccaccctgttctctttaggacaaaccgtgcagaaatacaaggcatgacaatcataagtctttcttcaagaaatccaaagtaatgactttactgctccatcctgcaatcaacagatactcagaaacagcccaaagatgaattacttagctaattctttggtattttctcgcaatcctctttttcattgtacatttcattttttaacagccattggtactgaaacttatgtttgcaaaagcaagagagttgattaataggtattttatacatctggtattttctcataaaagactagaaaacttatttcaattatcataccaccaacaaggatgcaatctgttcacaaggcctgtttacgagtggctgctttgggtaatggctgttttcttagcatgggaaatgaaatataatattattaagcagagatatgcaaaatgaagtgtcaacttatccatcttcctgatgtttataggcttcattttttagaatgtttattttattttatgggaccacacgttaaaatacctcctatttcaaaggatctaatttcttttattccgattttaatgtccttgaatattaacattctcaaacttgtaagcaatcagctaaggaaatctgtggtaggtactttattaattccatttagataaatgtatcataatgggagagacaataaaaatgaacactttatctttgcctgagaaaaagaactggtctttgccagaaggatggcataaatgattttcacttttagaggccacctgtgataaaatgggggaaggggtggcggttggtagaaagcaaacctctaataataatgagtgtgtgcgtgtgtgcatgtgcatgcacgtgtgtgtgtgtgtgtgtgtgtgtgtgttcaggagggagaggggttgtgaatcaaggcactgtaatggaaataataaatcaattttgaagagcttgagtaagatcattggaaaagtctagctatatctgtttttggctaagtgtggctccttcgttatttcactaaatttcattatctctgcaaggagtggaagtgagaaagaataaactttgtaaaaaggtaaatatcaccacttatttaattatcatttctattattttcccaggaaggcatcctactaataaatggacctacctgcagataaaggaaaggaaatcatatactaaaggaggaggataactttaaacagtatagattatagaactctacaaagccctcttgcaaaatatattaaattcctttatatgaggaaaaggaatattaacactggcaagatatatactggggtgtcccacagtgtaattcccttatgatttaatggacacttaaacaatgactgggtcatgaaagcaatattagaataaaaaatacttcttttaaaaatatttcttagatccatgctgtctagtaaaaatatgagtcacaaatacaatttaaactttactcatagacacatcagaaagagtaaaatgacaggggcaatgaatttctttaaaatatattttatttaatctggtatgctaaaaatagtacaatttcaatatataatcaatataaaaatattaatgtaatgtttacatgcttttttccccataccaaatcttcctggtgtttattttattttacttacatttaaagtatatctcaatttggaccagtcacatttcgaatgctcaatagtcacatgtagctaaaggctactatattgggcagtgtagctcttgattgtccaagatatgcctttttatacagaaatgggctacaaaattgacctcaatataaatgagtaaaaaaaaatgcccttgtatagaaatggatgaatccttactatcatcattcacttagtcaatgattcctagagctaggatatatacagaaaaatcagaggttcttttataacagaatccagaaatttgtttgcttatttttaatgccatgtttcttattgtaatcagttttccatatatgaatacataaaacaattaatttgcatcattgacttagatagataccctttggtttcctgaaatgaaatctaaccattgattaatttccgttttctatgttgtgttgactctgctttcaaaaattattcatcttacttagagttcctaacaattttggtgtcataaacgtaaaaacatttctactcccaccctggccaaatgcaaacacatctgatacatataataatttgtatgtaatttcactttcatataataccaagggattaatagaaatgctaatcctcagggtaaaaaaattaatttatcatgaaatatatgtgaaacattaaagtacagtcacaagttctgggggctctgttacattttgacagactaatgaaatcttgttttcttaaatgatcccaataaatcattcaaatttattattattaggatttgactctttttattatgtactttaattctgtttcacaagtacatatcattttttgtctttttttataaatgttttttgaatacatctcctataggagaattgagggaatagacattgtcttttccaccttcttctcatctaaaacattcatcaaagcaccttctcagtttagttcaactgaatgactataaatgaacgatgatagtacatttctctaccttcagtcaatagtgtaacataaccatattgaacagaaaattacatattccattcctgaattacatttagaaagcctttgtgtagtttttgatctgatgtaacttcatgaaagcattatattcttggtacttagtatggtgcctgaatcacagtaaatatccaattttccctgaattaattaatatgcccttcctttcaaatgatgttcatttctgtttaaagtcatcatattgaaattttcatctgctagccacagaagatattaaataatatgaaaaacaaatactgcatattctcacttataggtgggaactaaacaatgagcacacataggcataaacatgggaacaatacacaccacagacacttgagtagggagggtgggaggtggatgtgggttgaaaaactacctattagttactatgctcagtgtctgggtgcaatatacccatgtaacaaacctgcatatcaatcccctgtaattaaaagttgaagaaaataaagaatagtttcccaagaagagcaagagatatggaagagactcatccatagaaaaatttggaaagagcctcagaaaccctaaccagtttgtttggtgaaggtatttctttcctgaagccagtcagtaatgattagcaaaagtgaccacttattcaaatgcaataaccacaatggaagacttcaaggatttaatgcaaaaacttcaagacttcgatgaaaatattaagtaatatgacacccccaaaggtacacaataatatttcagtatccaacctaaaagaattggacatctatgaactgctcaacaattcaaaataattgttttaaggaagcttgctgagttataacagaacacagataaacaactcaacaagaccgaagtttaataaagaaagagatagaaatcataacaaagaaccaaacaaattctggtgctgaagaataccaggattgaagtaaaaaatgcaatagagagtgtcaaaggcatacttaatgaagtagaagaaagactctgtgaaatcactggtcatttgaaaatattcagtaagaggagaaaatatttttaaaagataacagaaaataaagaaagcctatgggatttatgggacactatcaagacagctaaatttcacatcttaggagtccaaaaaggagaagagagagagaaaaaaggcagaaagcttatttaaagaaacaatggctgaaccctttccaaatctaagaaaaggtataaacatccagatacgtgaagcttaaaggtctccaatcacgttcactgcaaataagatttcaccaagacacattaaaataaaactgtcaaaaatcaaagacagagataatttttaaagcagcaagagaattgtgtatgtcataaacaagagatcctccatgagattatcagccgatttttcagcagaagccttgcaggccaggagaaagtggaatgacgtattcaaagtgatgaaagaaaaaaaaaaaaaaccctaccaaccaagaatattttaaagctgtctgtccgtcagaaataaagaaaagatagagtttcacagacaaataaaagctaagggtgttcatcgcaactagacctggcttacaagaaatgctaaagcatattctttaagctgaaacaaatggatgctattagtaatatgaaaacatatgcaagttaactcactaaagtaagtatatagtaaaatacaaaatattcttttactgtaatagtggcatgtaaatcatttttaactttagtataaaaggtaaaagacaaaaatattgaaaataaatatagctacaataacttggtaatgaatatgcaatttattgacttgtgtttatttatttatttttagagatagcatctcattctgtcacctaggccagactgcagtggcataatcatagttcactgcagccttgaactcctgggctgaagtgatgctgccctactgaatagctaggattacaggcacataccaccacacctagcgtttttttgtttttgttttttttgtagatatgggtcttgctgtgttgcccaggctagtctaaaactccaggcctcaagtgatccctctatgttggcctcccaaagcactagtattaaacacatatgcaatttaaaagatgtaaattgtgacataaaaaataggacatgtatctagggagatgaaaatgtagaatttttgaatgcaagtaaagttgttatcaacttgaaatagatcggtctaatcctattttttatgtaagcctcagattaacaaaaaaaagcaagaatctatagtatatacacaaaagatgaaaagactcaaagcacaccactacaaaaaattatctaatcaaaaggaaagacaacaacaacaataaaaaaaaataaagaaaggaacaaagaaataaaggactgataaaacaaccaggaaatcataagtaaaatggaaacagtaagttcttacccatcaataatgactttaaatgtaaataaattacattctccaatcaaaagacagagtggctaaatggttcagtaaacaagatcaaattatatgccgtctgtaagaaactcacatctgctttaaggacatacataaggtgaaggtgaatagattgataaagatattgtatgcaaataaaatccaaaaagaaaggggtaggggtaactataagtaaatgagacaaaatagactttaagtcaaaaattgtaaaacaagacaaagaaagtcattttataatgataaaagggtcaaatcatcaaaaggatgtagcaattttaaacgtgtgtatgtgtgtgtagccatatacacacccagtattaaagtacctacatatataaagcaaatattaacacatcttaagggagacatgacagcaatagaataatagtaggggactttgacaccccattttgagcaataaatagatcacccagacaaaaagtgaatactggattttaattacattttagaccaagtagacctaacaaacatatacagaacacttcacccaacagtagcagaatacacattcttccaaagaacacatggaacattctccaagatagaacatttattaggtcacaaaataactcttagaaaatttaagcaaactgaaattatatcaagcatcttcactgaccaccgtgatatgaaactaggtatcaataagtgaataaataagtagaataagtggtataaataagtggaaattaaggtgtaaataagtaaaaattaagtataaataggtttaaataaatggaaattaaacagcacacccctgaacaaccaatagggaaaagaaggtatcaaaaaggaatttaaaaaatattttgagacaaatgaaaatgaaaatacaacatataaaaactcgtaaaatgtagccaaagcagttctaggagaaaagcttatggaagtaaatgcctaaatggagaaaaaaaaaatctttaataagcaaccagttttgcacttcaaggagctagaaaaagaaaactaatgccaaagttagaaggaaggaaataacaaatttcagagcataaataaatgaaatagagactacaaaaaattagaaaaatatcaacaaaactaagagttcattttctgtaaagaaaagaacatcaacaaacttttagctagagtgatgaagaaatataaatgaataaatgttttaaatgctaattaccctgatggatcaccacgcattatatgtattgaaacatcactatgtactgaagaatatgtacaattattatttatcagttaatacataaagagcaaaaactcaaataaaatcagaaatgaaagaagagacattacaattggtatacagaaatacaaagattcacaaggaactatttgaataatatcaacaaattggtaacctagcataaatggatatgttcctggaaacatacaatccacaaacaataaataatgaagaaatagataacctgaacagtctaataatgagtaaggagattgaatcagtaattaaaaatctctcataaaagaaaggccaagacctcatggcctcactggtgaattctaccaaacatttaacagaattaacactagctcttctcaaattgttacaagaaattgaaggaaacactcatgaggccagtattcccttttaccaaaccagaaaaggacactacaaagaaagaaaattacaagccaatatccctggtgagcatagataaaaaattctcaaaaattaccagcaaaatgaattcaatagcttattaaaaggatcatataccatgatcaagtgatatttatccctggaatgcaaggatggcttaacatacataaatcaatatatgtgatataccacatcaacaggatgaattataaaaatcatatcatttcaatagacaaaaaaaaagcatttgacaaaattgaacatatttttatgataaaagctatacccaaaaatgagatatagaaggaatatacttcaacattataaaggctgtatttgaccagcccatagctaacgtcattttcagtggtgaaaagttaaaagcttttcctctaaaatcaggaacaagacaaggatgtccactctcgccacttctattcaacataaaactggaagttcttgcctgagaaatcaggcaagaaaagaaataaaaggcatccaaatcaaaagaaaaaattgtctctgtttttgatgatataatcttatatatagaaaaccctaaagactccatgaaaaaaagctgttactaataaattcagtgaagtcgcaggataaaaaatcagcacgaaaaagtcagctttgtttctgtatactaagaatgaactcttaagaaaagaaattaagaaaacaatcctatttacaacagcattaaaagaataaaaatacttacgaattaatttaactagggaggtaaaagatctgtataatgaaaatataagacatcgatgaaagaaatggaaaaaacgcaagtatataaaaaaatagcctgtggtgatggattgaaaaaaaaatcattattgtcaaaacatacttctcaaagagatatacagatttaatgcatttttttaaatcaaggttccaatggcattttccacagaaatagagaaaggaatcttaaaattcatctggaataacaaaggattcccaatagctgaagtaaacttggttgagaagaacaaagctggaggcatcacattcctgatttcaaattataataaaaacctatagcaatcaaagcactataatatgggcataacaacaaacatacaaagagaagagaacagagagcccaggaataaacccatgtttaccatcaactcatcttcaatgaagatgccaagaatacacaatggagaaaggatagtgtcttcaattatggtgccaggaaaacttgatatccacaagcaaaaaaaaaaaaaaggaaattctttttttatattacaccacaagcaaaactcaactcaaaatggattaaagacataatacctaaagccatagaattccagaagaaaacatagaagaaaagctccatgacacaggtctgggcaacgattttctggaaatgacccgaaaagcacaggcaaaaaaaaaaccaaaaataaacaactggaaacacatcaagctgaaaagtttctatacaacaaagaaatcaatcaacaacatgaaaaggaaatctacggaatgggaaaaaatatctgcaaaccacatatttaataatggtttaatatccaaaatatacatggaacccatacaactcaacaacaataaagctaaataaccttatttaaaaaattatcaaagaacctgaacagacattttcaggttatgaaatggttaataggcatatgagacagtgctcaacatcatcaatcatcggaaacacgcaaatcaaaaccacaataagatatcacctcacacccgttaggatggccattagcaaaaagttaaaagataagtgctggtgagagtgtggaaaaaaaagaatccttatgcattgttggtaggaatgtaaagttgtacagccactatgaaaacaatatggaggttcctcaaaaaaaataaaaataagactaccatatgatccagcaatcccacttctgggcacatctcctaaataaataaaattgagatctcagagaaatatctgtacttccatgttgatcacagcattttttccaatagtcaagataaaatataagtgttcatttacagatgaatgtataaagaaaatgtggtcggtgtgtatgtgtgtgtatgtaaacattattcagcattaagaaataagaaaatcctgctatttgtgataatatggatgaacctggaacacattttactgagtgaaattagctggacatagaaagaaaaatactgcatgattccacttatacatgcaatctaaaaaagataactaataggaacagagagtagaaggatggtaacctgaggttgggggtggttggggaaacagggagatgttggtcaaagggtacaaactttcagttagaaggcgaataggctcgggagacctaacgtacagcatggtgactatagttaatatcgatttaatataatattaattaataaaattaataatttattttgttactatataatattactataacatgttaataatgtgttatatactggaaatttgctaagaaattagatctgatgtattctcaccatatacaaaaaggtaactaggtgagttgatagatatgttaggtagcttaattgtggtcatcatttcacaaattatacgtaaaacaaaacatcacgttgcacacattaaatatgaacaattattattttcaattatgcctttataaagctaggggaaaatattaaataaataagtaacatttgtgataattgctgtgacagaaataatcactgatgacataaagagaaataagggaaaagaacatgaaaatatttagacaagaatgtagagaaagcctctctgtaaatgtggcatttatgctaaaaatatgaagaataagagcaagccaatgttgggaaaaagggcagaaagagcgttccaggcagcaagaagtgcatgtaacaaagtgctgaggtggtgaagggcttagaacagtcaaggaaacaatggaaggctgacgtggctgagtgtgaactacagagtataatgtgctcatgctggtgagttaggaaagatcaggtcagggcaaggattccaggaaaaatttgattctaagtgcaaaagaagagccatagaagttatttaggggatcccatgatcttatttatgttatagaaagatttcattggctactgtgtgtagaatggtatgcagaaagatcaatggatttagagagagcactttgacatgatggtatctttagatgatggtgtttggtctagctaggcagcagaaaaggtggagaaaagttaacaggattcacacacattttaagggtagaaccaatagaactcattaatggaatagatatcggggggtgtagggataggaggaatcaaagaacactcttcgaattattgcctggagtacttgcataaacactggattaacttattaatataaagaagacggtgagataaaagctttgagggttggggataaagggttctattttgatcatgttaagtttaaagtgcttatgcggcttccaggtggagataaggaggaccgattgggctactaagatatgctgctgatatgaagcctgaaactctaaattacatattagaattagaaaaaagaaagccactcttcaaagattagtcatacatctcaatttatagttattccctaactagaaacttcatgaagccaactttcaaaactattacaaagcattgagagtatttttttccttcaaacttatttttctcatcttaaaaaaaaaaaacatctgtgaactttctcatctttctgaacatggtataatttggaaaagtacgttcaccttctccaaacttctaattaactatttatctttcagatcagaccagttataaccaaaaatcccccatttcattcctgttatgttgcatctgaatagaagataaatacagttcatattcttacttgcacagcaagtggtaaaaaatccatttaaaacatgctatgaattgaattcatttaatctattaaatatagcaatttaatgaagcaaaatacactaattaaattattaaaatctggatagcaagtagtagttaaaaagcctgttgctatgcaactcagagaatttctataaacagtctgcaaaaatgtattggttaaatatgttggtattttgccttgaccttttataatcaaacaccttctcaatctgtgaaaatgttttttctgagactaacatcaaatagaattcatggattttaaaaaaagaagaaatttagggtttgattgtgttacttcttctattatattcaaaggtataagaagttcaaaattccaaaaataaaaattatcaaatatacatacggaaaaatagcagcagttccttaaaggtttctgcataattgagaaacttcattgtttatagagatacaaatctgctatattgcattattatttctttcatgaggttgtagcactttatgacagaagcaggttagcatagatgaggtgaagaatggagttttttaaagtcaaaacttttttttttgacagcaattccccccaccccatactgcctgctgagactgtcagagaattaaaagttggtcacaagttctaaaagtctgcagtgtatccttcccaaaatatacttgaaactgcataccccagagggtcgtttatgtaatgaaagaaattactctgatatgtgggcttttaaaaatcatttttaaaggcagtcactgagagattgatatgcaggcacactttaattttaaatgtcggaattagactaaaagaaaatgaacttcattaaaaaaataaattgaaagttaaaaaatcttctcttgtgaaatccaaaatatttccaaaattttgaaactactatttaactacaagcagtactgttgggtactgacttaatattagcgggaatttacaaagacctcttaatcacacatcccccgatcctgatcacagggactgagccaaacttggtggaataagaaaggtatttaaggacaactttaaatgggggcgaagggcggtcatctgatgccattatctttgctgtagtggtccgttgacgaaaaatattatttgcatgtatttgagcctcaaattgttttttagccataaacattttgagacttttctgtcaccagactgcctactcttattactccttgttcagaagtcagtttcttgttttttgacacacgttattccttctttccctacctgccactttcatgtcctaaaaccaggtgttcaaaagcaagcactatggccatgttctccaaactctgtgccaagatattctgtggtgatgcagtgagctcaaagaagtgccctgaaatatttaatattttcaggggaaacagcaacactgcacatacaagcttgaggtaatttatagtttcaacattagatagcgctatatgcctttagataatgtcaatatttgttgtgaagctgtctttgtgatttctatggataaaagaaacaccacatgaaaatcaatgtggagcaggaaataacagtagcagtggcaaatttgaatttgagttttgtgcattagaagatgtacaatatccaacatcttcatgcattccattgttaagtgaccatgcttatttaagaatagaaatattattatgtcaatatatggcaaaaatgatttccaagttgctagtaaattcttattgagtttttgagacctaactaccaaataaatggaactatcaggcatttattttggcctaacagcactgtgaaacaatcgctgagtcactaaggaatagaatttgagatcctctgccacaacagtatgacaaaaataattattaaaattgtgaagctgtgcagctacttcttgaaatagctctctctgtgtctgtatgtatatatacatacatatagcagatattgagcagaactttaaaatacataaactgccttttatctttcttatatagtgtacattaaatatagaagataaagttgggtttatttactattctaatggaattttctttaaaaacagagaactgtgaaaacattttaatgttttcttcactgcagatatcagaagtcttcaaaatgtatagcatgtactctagagtgtctacccaggctgactctattccatagaaataaaaagtttccatatgacccagtgggttaacctagctctgagtgactccacatggattgacatttgagctgtcagctaatgatttgcacaggtggaagtaagagattataatgaggtctcatcctccactgcaaatctgactaggagttttgacccattcttgttcatcattcagtcttcttattttattccttacaagaacattcgccaaaccttccagaggtttgtcaatatctataaaggaaatttcatagacttcaatatgatattcaagatcctctttgatctgtaatcaacctatttttttctaccttacatcctgccacatcctcctatgatcctataatccaacaaaatgaaactgcctcttttatgaacaggtcttgcacttctctccctgtatactatttttttaaaattctctctttcacttggatgtcctccttctgtccaagtcttcctgcttcttcacagctgtgctcaaatcctacctcttccacagagcctccacactttctccctgccatactcattctttcaccttgtacatggtataacatatacacagtcttgtgttttactatgtttgcttcacatgtgactttctccgttctgttacttatatgctttacgcttatgttttcaaacctctcccaaacaagtacagcatgcattcacgtctttctccacccacaactttaaatcatttgtggtaaatgtctgcataaatagatactcaaccaattattatcagactatattggaacagattatgctacaaccaagatggcaaattataaagacttaaggtattatacttccaaggatgagtctcatttatcaggggcccttatggagcttatctatcccaactcttgccactaccaactttttctactgtttgaaatttggagaactcccaaaaatgtcttcatccaacttttctttttccaccctctggccctaaattgaaagaacttgaacatattcttttgtcagaggttgctcttggtttatacccacaatttgtgcaagtagaataattggtgtcttaaaatacatattcctggagctgacttaagacacacagaattcaaattttgtgaatattagctattatttttattattaaaccagcatctctcagtccacagaacactagtcttcagtgagatattcatataggtttagataggaatgattctactcgtaaataatttgggaaatagtcaccattacatatctttcttagagattcaagattttaataaacatgaaaaaagtctttgagaagtcttgcaatctaatttatttaatttgtttaactcaaactttcttcaaactgattggaccatcaaaatccctttgtttccatatatatatgtatatatatattatatatatatatataatatatatgttatatatataatatattatatatatattatatatattatatataatatatatataatatattatatatataacatatatataatatatatgttatatatatatatattatatatatatatatataaccattagcatttcatgctctttgaatttgaattgggaaagtatctatctgtgactcttcttgatcatcagttttgccaatttaaaatagtgagggaaggtcagttgaaagttattctcagaaaaaacttatattgtaaaatgtcctttgtgtatgtatgtatttccctcaaaatggctcagagtcacctgcattcagtgcagaggggctgtgagattgaaaatatctctggacccacccgaagagggtgaaactattttcctgatcttacatatctcagtcttggaacccatgtctgtctgttctgcaacaggttccattagccaaggttggctggtaagagcctagattatgctttctgcttaggttggtctagaccattggcttgaactgtaggatgactttggtccctaagacaagggctgctgcccccagaatattgtctttctaagtctgggtaggctgctatttgaaggccaacactaaaatgtattcaaatgactcatctgtgtcctctttaaagtgtgaattagtgcaggcactcattactcacctccctccctttagaacaagttgcttctgacaacagtgagcgaaacagctgtgtgtgtgtgtatgtgtgtgtgtgtgtgtgtgtgtgtgtttctataaaagaaggattcttctactatactagaatgtccccaggccgtgaaggagattgagctgtgtaaaccaaccgtgccttatgctctaggggaagaaaagaaatggagaagagaacacctcaaccgaatttattataacaaatttctcgggataataaaagacatcatctcagccctagagggaaagtaggttatagctcagctaaatgtccttgtctaatgttgcttaaccccagctaacatttcaagccttaagtaaagtcccgtcagtggcacattttggcctgtttagtaatttcattggggacattcatttgaatgaattttttgaatctgatgaagactcacatcagtcattttcagattaaagcccctagtgtgctgatttctgtcttctcctgtctgtttgattctttaactaagagagcagaagaaataatatattgtataattgctctttattacaaatttgtaattacatgttacacttggcaacaactgagaagagaagagatgtagtctagaatatcagaggcccggggcaaaggtcaacaggaactgttttggtaatgggcaaggtggttttctcagagatggtcttggcaattagatggcaatggaaattctagatcaattgagagacaacctctagagcagcatgcagtccaacaacttgtatcatcgtcctcagtcactggcatgccatattctgctcctgtgacctccatgagagcacatgctggcaatttacttggatctcagcttcatctttcttcttttgtgctttaatctacacatgtacctctttctccacttggctctcatggagcagaagtttctgagaaaatggtgctaaggccaaaagagcctaatttctttagggcatgttctctttcttggtgtaagggggctatgacgtattctttttaagttcctaattctatatttcactaactatgtggggaaagtcaatattttattgccatcataaacaaagagaggccatttgcctcttgatgtgtcgtgctctgtgtctctactcatgcagttccttttgcctggaaagttacttccttcacaaatgccaggacagcattttcagcatctctgcatctgtagagcttcttaccaaatccaagaaaagtagagcacccctgctttcgccactactgtatctagtacatgctcttttacctcacttgtcaagctacaattcaatcccttgtctatatttttatctcctctcctaaactactattttacatactttatatttttatttgtacctataacaatgccaggcttaaaataaggattcagaaatatttgttaaatttaattgaacaaatattcaaacagttgattccctatgtttttgaatattctttctctaccagttcattcagtatggttgtgtcttaaaatgccaatctgtaagaatttaacatttttaggaagcttcatatattcaggatgttacatctcactatctggtattgatagagctgcaaaagtaaaagaaaacattgtgtaatttttaaagaaatggataatcacaattttttccgttgaaattttaaaatacacatatttctgaataatataaataaaaaagtctgttaacacagactcatcagaaatatgctattgcttaatttttatatatgattatacagaaggatctcttacccaaatattaaacaattttgttgctttatttattatacacatctatctgtgaccctctcaaaataaaactatacctataataaactatggaaaatgatgggtagtaatgaaagtttcccatctggaaaagcccctggtccagatggatttgctaattacttttataagatgtttaaccaacctttgaagaatattccaggcatgtttgattactttacattaccaacatttttggaagtaccattgtgggctctcaaactaaactttataaatgatatggaaatggtaaaatccagaaaattgtgtttcttaagaacatacatctttcacaagaaatgctaataacacattccttccaaacctgagcccagtgataaaatattttttcattgaaaggataattttaggacaaccaggtggaagaaatatgttacctcatattcataaaactaattacattaactttcactaaagtgttaataaataagagttcttaacatgtgctgcaatatatgctattaaaggtggttgtatgctttccacgatttgacatagaattagacattttattcaaataaaaaataataaacaagtagtaaccaatatactatgatctgagggcaacaaataagagatcatgtcataaattatttgtttaaccggttatctctcatgccagaaatcttgcaattaggtatttattccttttaatagactggcattttcagaatcttttattattattatggctgtcaaattgaatggtgtactaattataggcgtgtagctgactgtattcttatatacagtgggaaattcactacacagccttataaaattttaagatttttataacaaataaaatggtcctaaaataatatatgagaagatacatttgtaagccacttagagaagtttactttattaaaattaagtgcccaataggatactgtactaaattgaggatatgtatattttaacgtcagatgagggatttgggaaaagttaagagcctggctgtagaataagtaggacctcactctgagtagagaggtgatacttgtacagacagagggcaacattacagtatgtggttggcctgcctatacaacatctatgaaaagtcccagacattttagtgtcagtcagacctgcggaattctctgagttttcattttctcatctagaacatgcagttaataacgtttactttcaagtgttattgtgaggattaaatatctgcctgggatatagtaggtatatctaatattgtgttttttcctctctctcactattcatctacacatacacaaacacacacagcattttgattagagcagagaatttgtataataatctgccaggtcagatatgctttactacatctcttttctctgctcattgtttttgtgtcacaaaataaacctcagttttacttgaacaataacctgtccggaaaactatatattaatttatttatagagtcaaggggatatatcatatcaatagttacctaagaaagtaatgtttaataaaaaagcttacctctgtccatatttttgtgccatgctcaaaatgtcaactgtttcattttcaaataataggcaggtgttaagataattttgtatgtatatatgtatgtgtatatgattatatacatccagatatacatatatgcatatatctatataagaatatgtgaatgaagaatgtgtacatatatatacacagatgttatatatataatcatatacacatgcatatatacagatatatatatacctaaatttatatatatatatatatctaaatatatcactgctgctggcaatagatagatataacactttaaagaatgcattcggtgctactggtatgatgctagaagataaagccatatgcaaatccttcttttccctttcttaatgatatatagaacaatttaaaaagcataagatactcataaacttcattcacatattcttttttaaatttcgtttttgtaaaagtcagtatttctattgcagacaatattacaaagcatgggatttcactaaaaggtaactgtaaagaccattaaatttattttcctgttttcaagaagagaatgtttaaaaacttaattattaatattttatataaaaataaaaattcccctcatctctccatttgccttctatctaaccctggagtaactacaaataagagcatgcaatattactctcctcaaacttttctatatagtttaatatgtgttaatgtccaacttttttattttaaaactatggtcatacttatacattcagtataagagataaaattcactcacgccactctactttttaaaatgtatagaatatatacatttgcctcatttaaaaaacatttatatatttttcaggttgtggaagctcaaaaatttaattgactgtttctatattgataggttattgggttgtttccaatgtaccgcaattacaaacaatgctttagcatagcaaaaactgttttacaaagtgtggtactataaggggctgcatgagtaggagcagtatgcccttgcctggggtctgagaaaatctgcacatgacaaatactctcatggcccttatgagtgtcaattatttctacatgaataaggctgagacttaagtggagaatccatattgtgaaggcatgtactaagacggagtgacttgtagagtataattctggaacccaacaagctacattctgacactgaattaattgtacatatgaaagaaataaggaatagggaaatataacatataactgaataactaaaaatgataattcagaaaatccaaaataatctacaaaaaaactcttcctgaaaccagtaagtgattattgaaaggttgcagaatataagactaatttataaaaattagttacttttatataccaacaatgaaaaagtggaatttgagattgaaaacacattaccatttattttagcacacacaaaaatggaatagttaagcataaatctaacaaaatatgtataagatccatatcaggaaaactataaaactttgataaaaaatatcaaagaagaactaaacaaatggaaagatatttcatgttaatgaataagaagactcattaatgtcaggatttcagttcttcctaacttgatttatagacttaatacaatcctaataaaaatctcaataactcattttgtgaatattgacaaactgattgtaaagtttatatgaagtggcaaaagacccagaatagtcaacacaatattgaaggaaaaggtggagggctgacatatccgacttcgagacttcctataaagctagttatcaagacagtgtagctattggcaaaatgacagacaaatagatcaatggaacagaaaagagagccaagaagtagatccacatacacataatcaagtaatttttgacaaaaaatcaaaggcaatacaatagagaaaaaatagtcttagtgctggaacaactgaatacgcacattaaaaaaagaatttatatacagatcctacactgctcccataaatggactcaaaagcaaacatagacctaaaattaaaatgcagaactgtataatgagtagaaaataacataggagaaaatctgaatgaccttaggtatggtgatggctttttatatacattaaggtatgatcagtgaaataaataattgatagtctgggcctcactgaaattaaatacttctgctctgcaaaacccaaaagaatgagaagacaagccacaaactgggagaaaacatttgcaaaagacatctaataaaagactgttattcaaaatatgcaaacaacttttaaaattcaacataagaaaccaaaaacctgattgaaaaaatggacaaaatactttaacacagccttgataaagaagacatgaagatagctaatagatatatgaaaaatcttttaacatcataggtccttaggaaattgcaaattaaaacaacaatgaaatattactacacacctatattagagtgtccacaatgcaaaatattaacaacacaaaattctggtaaggatgtggaacagcaggaattctcatttattgtggtgggaatgcaaaatggtacagccacttagaaaaacagtgtggcagtttcttacagaactaaacatattcttaccatataatctcacaatcacactcctttgtatttactcaagtaagttgaaaacttatgtccacacaaaaatgagcacatgaatattcgtaacagctttgctcataatggcaaaaaaaaaacttgaaagcaatcaagataccctacggtagatgaatggataaactgtagtatatccagatgatgaaatattattcagcactaaaatattattcaacatgagttatcaagccatgaaaaaacatggagaaaccataaatgcatattactaagtgaaagaagccaatctgaaaagctacatcctgaattattccacctatataaatttctagaagagacaaagtatgaaaatagtaaaagtatcaatagttacccagagtaaggaaggaagaatgaataggtgaagtatagaggacttttaggtaagtgaaactaccctatatgagactgtaatggtggacacatgccattatacattttttcaaaacccatagaatgcagacatccaaagttgggtaataatgtttcaatgtaggctcattgatgctaccaaatgtaccattctgttgggggatgttgataatggggcaggatatgtaggtgtgcatgcagaggtttggggggcaatctgtatttcttcatctgaagtttgctatgaaccttaaaatctgctctaagaaataccttctaatagcagatgactgaaatgaaataaacagtgaaattcagaaattattctattggatgctaaatcttgaatattaggaaaaattcagatggttttagtttttctgctcttgtttatgtgagtatttaaatttgtataaattcagttcctaggtttgattctgactgcataaatgaccccacagtttgctttcctgaatagatggtattgattattttgtaactatttctttaagcccactgattttagcattttgactgaactaacttactacttagcagttcaaagagagaatgaaagtggacaattgttgtttactttcctttagaaatagctggaggctaaatgttaaaggtgagttttgcagctctgatacagtcaataattgtggttaaagccctaataaactgttcaagattaagtggcatacaaattcaagcaaggtggctccaaaatttctgttaggagcacattataagttgtcatttttatagagttagttatgtgaacctttcaatatgttagattacactattctattccaaatctaggtatgaagaaacattcttccacaggggacaatatccactctcatctgactcttatcttgaggtcagaattaatggagtgaaggtatctcaatcttcccctaaacttggtgtgataaccaaaaaaactcatgtcatggaagaatacataggaaagctgttccttctttgcttcatttcctttttataattggacctctgggcagtgaaataagacaggatggcttgatctatgctttctatgtgaagatgaggtacaaaacttcactttctgttaaggttatgctaattttacttccaagaccctgataatttagttgtacaattcatcttctatagagagcaatgtggtagataacccacattcagaattaattaccataaatcagaagtatattcattgtattactgtgagatctttcatttcccaggaggaaatgtcccatctacaaatgaaccctttacaggttcaattatatcttctcatttcttttctctttcaggcacagcataatgtctataattttagctttatattttcttttttacagaaagtatccaactgctaggaagtaagcccaattatcactagtgatagaacaaatagaaaaatgacagtgttcctcaaagctatctgcttagtataagtctgcagctgccttttcctcatgaccatttggttcaattaagtgaactgcatttgagatttattattgaacaaaaaaaagttgactggggctggaaaaaaaataaaaaattgtttctctttaccatgaaatgagtcttgctgctgcctacatatatctctctaattggactgcattaatcatagtgaatgtgctagatgtatattgaccctgtgtgataaatagcccaaactgaataattctgagtacctcatgtttccttgttcaatatacttacgcagaggaaaactaataatcaagaaataattataatttcgttcactatattcaatctttcttaggttttgtgacttttcataaacaaccaggttttgcatctggaaaaataactcaaccacgttataatcttcctggcatgtcctagtagattccttggtattttaaagtcaatacaatatctctaacactaagtaaacattattggtgttcttagctatccaagtaatgttcaggattagtcagaggaactacatacttaatttaattaaacgtaaaataattccttttcttggggttctatcctaactttcaggttttaattcctcttgttccctacagctggggttacacttgacctgtaggttcagcttagccatagcaccacagtcaaggtaataaagtttgttggtttttattatcccatcatctggatttaaaggcaactttaaaaccttttgatcctaaagtgattctggagtcatgaatagactcctgccatggttgtaagttttattcttcctcttgctctccctgaatgccttggttgttttatagtcagatgtctccagaactgatcagcttacgagcacaagcaaaacaatattaactactgaaattcgctacccctcactcccactggcaaggaaatgtctcaggtccattccatgaacatcttggtcaatcatttctccaccagtccctcagagaagtttttgaagattaatgtcttgtgtgacactattaatgtgatactgttaatcattcctcacgaagatattttctagaattttaacttagaggaaatactgaaaatgaagacagccttttagagaaaagtgtcctggtgcaatggaaaagaacatagattcttatgttaggatcttggctccgttattaactagtcatgtgaccacttaaccttaacctttcccagcttttatttcattttctaccaaatgtggacaataatgcttttatcaaaggacttttggaaaatatgatgaacagtatctggcacagaatagatgctcattaagtgttagctatttgcctattcttttttgcaaatgttagacaatgtcaagctaacatagaacaatatctaccaaatatgattgctattatccttggggagatgacagaataaattttcatgaataggcctaaaaataacattccatttcatttcccaccacctagtatgtaatataaaacctcacatatttggcatgaatagttttgaattcatttcttgaataacattgtgtattcttttacaatggaaaatattcaactttttaatttttttctctcttcctctatatgttctgaaaatagtacttgtcttgtcactttttctgcattcttaaaataagacatattcacttttcctcaaagttaaatattaccatacctgcctcacacattgctccatcacattttcctctatttcctataatgctaattgctcttcctctgacttctcttcagtctataaagaatgataaagactcatctattctaaaattttttttctcaaactatcactcaatatttcttcttttcttcattggtaactaattggaggaataatcacttgatggcttcatttcttgctctctccagacattccttgagtctaaacccttggtaaggcattagcaattgtgcaagtgctaaatctagtggtcacttttattcagatcccacctcatctctttctaaagcacttgattctgttgaccatttttttaattctttctattcttgtttccagggccagcacagcttgctattgctcctttggtcatttcatgtcttgaccccaggcttcccctcttacggagtactactaaatgtgtttcttatggcactaactttgatcctcatttgtttcttcatcttagtaaatgagatgcataatctcatctgctttcatggcctcaactactctttgtatgtagatagctctgaaagctctatatctatctatatctgtatctatatctatatctatatatctgtaaattagtgtatcttctcagtccacaagtacattttaaatttcctggtctgccagaggcatttcagactcaacatgctcaaaactgaaatccttgtatagcctcatttccattgccatcccccacccgatacttcccatcctatgaattctatcctaaaaaatgttgttagtatacataaattttctgtggtaaattcttttgtgacaacccggatattctatcctcttctttctcccacttcacatttcattggtcataatagccaattaattctacttcaaatatgtgtagtgaattctgtttccttaccatctccattgctactgacttacatcatgattgcaactattataataggctccaaaagggatttttaaaaattttacttgcttttgttatcagatgagtcccagcagggctataaattatactgtcaacaatacagcaaagactaaacctcctagcatcatcttcatggccctgccttcatagttttgctactactagcatttccatttcatttttgtttcttctcactctacaaccctaatctccaatcattttgtaattatcgcagaactcataatgtccattcacaactctgagttttgaacacattacttcctttgatgagcatacgtttttctaattactttttcccttaaaaaattcttacccatttcttgatatcactcaaataaaacatgctctatagaacctttcctgatgcccccaaacctagttagttcttcccttttttgcaatccattggctccttgtctttcatttgaatcctaatttcactgtagttgtcattttgcacatctgtatcccttactgaaactataatataggccagtgtctcatttttctttgatctttctgttgatagcatagtgcctgaaaaaatgatgctcaaaaaatgaatgagtaaacagaacagctcaaggcagtcttgaaactactgaatatatatatatatatatatatatatatatatatatatatatatatatatatatatatatatttgtctttggctgggcatagtggctcatgtctgtaatgccagcatttggaaggctgaggcgggcagatcacttgaggtcaggagttcaagacaagcctggccaacatggcaaaacactgtctctgctaaaaatacaaaaatcagctgggcgtagttgtgtggacctgaagtcccagctacttaggaggctgaggcaggagaatcgcttgaaccttggagcagaaggttgcattgagcggagatcacatcactgcactccaacctgggcaacagaacaagactctgtcatcccaccccaaaacaaaaggtatttagtataggaatgttggcataaatgtttatgtgctagccccatttaaaaatgacccagttgccatgtgtctaactactatttcatcgtcacctttttctccacaataattgctgtaatatttattaatataatcagtactataaaattttagtgctaaattatatgtctcaagtttgcagattaccagattgtagctacttgataatttttctatccagccagacttcacaaggaccagttattgtggccacagagtaggaaattactcagtacgttatcatttacggcagaattatgtttataaatcatggccttgagagttttctcattaaatctgtgagtctaaatgcttgtggatagatatgatggctaagcataaatcatactaatgaaatggttaactaaaggtcctactgtgaaacagatttatatttaaaaagattattatttgcagcacttttgaaacatatcagttgaataggagcacagaagatatttctgagaaacacatttgtataagtctgttactcatattaagatgtggctaaagtaagtatgtcataatcagccaggaaactataggaaacaaccttgacacttctattaagaaggtgcaaacataccagtaaaaatgagttcatttattagttctcagatgcctttgaaagcatgactttttttttttcaattttaattttccccatctgctttccaaacactgaagcaaaatgtttggaagcaaagtgaggctgcctagtagagacttatcatggttaaatgcagcacaagatttcctattaatattttaatttatctaccactcttggcttcatatgagcaaacatgagaaacaaagaccactgtcagaccaatttgtttctttccttctatttattctgtcctataaaaggaatgttttataaagattttttcttcattatatcttaagagattattcatctactctaaaattttgttgtcggaggtgatttgtaaacacacttgaacatatttattcagtatattatgctattttatccatattatgctatgctatgtatgtaaaatataaaatcactctaccctcctctactctggaccttttgcagtcaaaaatgtctattttcatactttgttaaacattttaatatagacttatcctttacaactaccataataaatacttaaaaaacacgtaaagatcagagtatttccatagtcattaaccagcacttggcctttaacgtggtatatctgtgtgagtctgataaaacctgaaaaaatatttaaaaacagaaaattattaatcaatattgtgttcacactttcattgttaattataattgaatcaaggtatctgtattacaaaaagctattgtccaacagtaagatgttatatgcttgaatttcataggtaagttaaatacatgctttgtttttcttggtagtcaacatggtttggctgtgtccccacccaaatctcaccttgaattgtagttcccataatctctacgtgtcatgggtgggacccagtgggaggtaatttaatcatgggggcagttaccctcgtgatgttctcatgatagtaggcgagttctcatgagatctgatggttttataagggacttttcctccttttgtttgacactttctccttgctgccactatgtgaagaagcacatgctttcttccccttatgccatgattataagtttcctgtaggctccccagccctgccgaactgtgagtcaactaaacctcttttctttataaattatccagtttcaggcatgtctttattaacagcatgagaacaaactaatacagtagttacgtcatggaaatagagtttactgaaaaacacatgggctagcaaatagttaccctctagaacacaaatacaaatgaaattttaatttctaaatggtaggtatttccttttattaattaaactaacaccatccttcaaaaatttataaaaaattgtcatacaaacagtgatacatgtgcatgctaaagataacttggttcatatctgaagtcaagcagctagcaacttattttatgtgttaagcaccaaaactactagaacagctacattgagatatgattgacaaatcaaaattatatgtattcaatgtgtacaatgtgatttcatatacttagacattctgtcatgattttcataatcaaatccattaacatatctatcactacccacagttactatttgcatgtgtgtgtgtgtctgctctcttcaaattttaagtaaacaatacagcataattaactatattcatcatactgtaaattagatctccaggacttattcatcttacaattcaaactttgtaccctttgtacatctccctatttacatcagcccccagcccctaggaaccacctttctactttctgctttttgaatgttttaaattccacatataatgagatcacacagtatttttctttctgtgtatggcttatttcactttacataacgtctcacaggttcaaccataatgtcacaaatggcaggatttacttcttcttaaaggctgaatagcataacattgtgtacataaaccatattttctttatttatctctcagcagacacttaggttgcttccatatcttagctattgtgaataatgctgcaaaaaaacatagcactgcagatattatttcaagaacctgacttcacttcctttggatatatacccagaaattaggttgttgaatcatgtcgtggttctatttttaattttttgaggagccttcatactgttttccatgatgatcataccaatttgtattcccaccaatggtatacaagggttcccttttttccataccttcaccaacacttgttacctcttgtctttttcataatagccattcaaacagatgtgaggtgatacctcattgtggttttgatttgcattatcatgaggattagttatgttgaacagctttccatatgcttgttggttatttgtatgtcttcctttgaaaaatgtctattcaggtcctttgctaatttttaaattagattatttgcttctttgctatttagttgtgtgagtttcttatatttagatattaacgccttgtcatatacaaggtttgcaaatattttctcccattttgtatgttgcctttttatgttgttaatgtttttctttactatgcagacattctctagttggatatagtcacttgttgatttttgtgaaaaacaatgtcaaggagttttttccctattttcttctaggagttttagagttttggttctgctatgtaagtctttaaactactagatcatttgtagccatttattaataacatatttatgtgtatccagtaccagtcttaattttaacgttagaaagccaaactcggttaatgactctgtatgtaaatactttgaatcaatgattagcatgaacaacaaaatattttgaacgattagcatgaacaatgaaagttaacatgtggaaatgatttataaacatgggagattcatttgctaattatttttccagtgatgaatattataatatcattaattcgttaggtaatcaagaaatatatattttgtgtgctgggcacttctctgttccatagccacaagatagagtctttgctatcagtgagattatatcattaaattttaaaatatgaattggtcatagaaatcactgagctctaaccaagatcttagttacctaagaccacactaataatagcaaagatatctcaatatcatatgctgttgtttcattcagctgcaaaatttatatttcttcttaaaatttggttggtatcaatttcctaagaaacttaacaggtaacattaaaagatgatatacactgaaatacatggccaataacatttctgaggcatatgtatggttttgaatatagataatcacttgccataacaggattatcgtaacactgactcaagagtagtggtgatttttcatcatacagtatcagcctttagaagagaaaccttaaacttttcttcaaaatgtagaaccacttataagatggttcttttaaaccggaaatttgagagactgctttctttacaattaaatgcagacataaagaaatgtcaggctttcatgtccttgaagaagatgcccccaacggaggtgcaaataactttgttccttgaataattactgcaaaacatcttaacctttagctctgaaaatttattagagattttgattagattttaacttaccaataacataaaacgggatttcccagtgttttttgaaagacctgattttgtaatatgtgattaacttgttaatatgttattaaatttgcaatacattacagtaagcaactataaagtttatattgcttatggttttcatctgaactattttttccattggtttgctatttaaagggtaattgtgaataaaaatttatttactataattactttttttcaaaatgtcaaaacatgtttcttatttcggaagatttataaatttaaagattcttataatattttctctctttttttaggttttctacaggaaaaatcttatctcagaggatatatatgtgtatatgtgtgtgtgtaatatgtgtatatatatgtgtgtatggtatatatatatatatatatctcaaatgaatgtcatgtattataaatttcttgatttttaaattcatttaacctaatttatgctttgcaattacttactacttatatagtaagaggtttcccaatctgtcaggtaatgtgaataagtaatactggtattttatctcctcagaagattcatggagctttgcagctttgtattatctatgagacgagggcctactgaaaaatatagtgacatggaaggatcctgaaaacgtttcattctccttagatactctgtaatgaatgaacacttttttttttctttcccatatctctctcaatatcatctcattcacttgaaatccttccaagttaactgaagcataactggttctttatctctattctgtgatagaagacttcaaagtcaagaaatttaaactttttgttcatggccaactttgtcactttccgcatgatgtaggaagatttcccatttaccattaggtgactgacatacattgtatatcagtaacacataagaggttttctttctgttagtttaccaagagagtattttttttaaataaactttatattttagaatactttaacagaaaaattatgaagatagtacaaagagttctcatatactccacatccattttccctattaactaacatcttacattagtatggtgaatttgtctcaattaatgaaccaatattgataaattattattaactaaaatccatactttattcagattgccttagttattacctaatgtcctttttctgttccaggattccatccaagataccacattatatttaatagtcatatctccttaggttcctcttggctgcgacagtttcttagactaaacttgtttttgaagatcttgacagatttgaggagtactgatcaggcattatatagaatgttcctctatgggaattttctgagcttttttgtttgtttgtttgttttcatggttagattggggttatagattttgggaaacaaaacctcagaagtaaagggccattctaatcctatactatcaacatgatttatcactgctgattttcatcttgattacctgcttaaggtagtgcttgttagctttctctaccaaaaaatattccccgcctttccttatgtcagtttctcctctctatcctcacgtacacgttggaaagaagttactgtgcacatcccatatggaagtggagagttatgctttaccttcttgagagtgaaataaccacataaattatttagaattcttctgcataggagatttgtctattcttcatttactcattcctcaattcatttacctatttaatcattaacatatgtcagtatggattcatgattatttattttatactttgataatttaatattattttatttgttgaatatattgttccagatttggccattgggagctctttcagttctctcctatattccttttacatactcccatcattgtttgtttgttctttttttttttgcattttgtttcttttatgtccttaaatttttacactacaagctgtcccaggcatatcttgtgtagttcctgctccagtactagaatcacccatttctacaaggagattattattattattactgactaatgctattagaaaccacatatgaaagttgaatgtgttcattgctactggtggttggttttaggccctctcagttgacagagaaaagaaatatacgtatataccgtaatacccccttatccttcttcagggatatcttctaagacctcagtggatgtgaatctcaaatagtaatgaactcgactgctggcaatcagaacatgtttctattcatgtcttctactcacaaatttaatgccttttccatcttaactaagcagttatgtactgcagttgtaacttttgcagtttgaggtacaacagtaaaattaacactaatttcctttttcttctttgcaatttcacagataaaagatcttagcaacctcagcattcagttttttttaaacctaaaggaatcacttaatagttttcatttggcatattcaaatggccagcatcagtactcttgcactttggggtcattattaagtaaaataagggttacttggacacaagcacctgtgatactgccacagttgacctgataactaagaaggctgttaagtgactaattggagggcactgtatacagtgtgcatttgccttatatatggaggattcacatcctgggagggatgacatgaaatttcatcacactactaagaatgttgtgaaatgtaaaacttatgaattgtttatttctggaattttccacttactatttcagatcacagtttaccagagataactaaaaccatggaaagcaaaaccaaggctaaatgaggagtactgtacactaacctgtgtatatacacatacctacttctgtatgtaaccataaatatctgtattaggctaatatgagttcatactcaagaaagtaacttttatgtggctccttgttatggattgaataaataaattccctaaaaattcacatgttgaacctctgacaccctgtagggatgtatttggacgtaaggctgctaagaaaataaagtaattaaggttaaatgagttcctaagggtggggatttgacagattagtgttcttacaaatagagacaccagagcgctctgtgtgctatttctctatgtctgtgcacaaagaagaggtcaacgttaactcataccaagatggaggccgtctatcagccaagagacatggccttagaatgaaacttaccttgctgacaccctgatcttagacttctcagccttcagaaatatgacaaaatgaatttctgttgtttaagtcacccaatctgggtattttgttatggtagcctgagcaaactaatatactccatgtgcactattaagattaggcataaattttaaatttataagctttaagattatattaaaataaggtggtcatgaatctgaatactcacgtttttattcagatttgccaaagaagttttaagtgaaatattaggcaataaagaaaaattaaggtctaattagtaagtacttgtatcaggtaactttaagaaagtaaaacatgtattagttaaattaaatttgatttttaaaattatcttaacccaaaacagtgttcaaactttcaaatttctgaaaataagcttggtggctcacaatgaaaagctgggtaatcaggaaaataaaatacgtcctttaaaacagatttcaggggaagaatctaaattttatttaaacaaataaagtaaaagttacccttattctaattaacactttctgttgaaaacatacacatattttattacaaggctggaggtaaaattatatcagaagtatagcaaatgttctaaaaacaacataagaagccaaatgagtgaatctttacagcttactcccttttttaataccatttttttcttgaaaataaagtgtaactgacagttctgtcacaaaaatatactctatcattgtaacataaatatgcagtgtagttctacgtattttaaaatggtagttgttgaggagaaaacagctgttttgaaagtacatgaacaaccaaataactacttgaaacatactttattgcaagggtagctatgtccaaataatgaagagagatttttaagagactattggagcattctttttcttggatccttctgaaggggaaaaaatgacttttctctcaaaagtaattatattttattgtataaccagatggtagtatgtgtcatgacataaaatgtagaaaaacactaggtttacttcaaagagaagcttaatttctttgaaatatttctttacaaccagggtggggaacacggaagcttgtctgtgactctggtgcatcctagaactctgatcagggcttcgaagcataattcagaggcaacgcctctctctatgcccagattatggccccattttcacattgtaaagcctctctttttagcctattgacaattatgactttactactcaggaggttggattaattttctggaaattaaattttaaaaaagcttcctaatattacatgatacctcaggttttttgtttgtttgttttgtttttggtaatgaggactcagatgatctcatcgggcacattctcagctttgaggtcaatacctagattattaaactaccaatcatggccagttaatggggtttagagttatgaaacagaataaattctatgattaacaaaagggctataaaatctctagactgctggttctgcaccatgaacttgtactcatattacagttcaggtttatattctgagtttaccattttgactttatatctccttgggacaaatgttctcacatgacctttaattactgtactgtcagtggaacctaggaaatggacatcattagcagtcttgcctgggtaattaagaagtaagttcagagggataattgctccatcattatttctctttaccttctgacaaatttgattttttaaataattgagttgaccatatgttcaaatatatgcaagtagcaatgcattattttaatttagaaatttgtatacacacaaaaactatgatcatttattcctcctcctcctccaccttgggaaagaaatggggatagagtgatagtagagttctaattatttaaatcagtttcagattgatgttatagatctattttgcattcacctcctgggatttatgcctatgtcagttaagagagagaatgtagaatgaagaggactggagcttttcaaatgtggctctgattgcttttgacattttaaataaataagaagttttttgtgttatcctactgttccctaagggacttacgtagatgaatcaaggcaatgcagaaatgaatttgaacaaattttacattacttttgattgtcctagaaggaatccaaaagcaaagcctagactaagtaatatgggaggttctagaagatattaaaatgtggcatgagacagctccatctaaagcaattagtgttaagatctgaaatctggggcagtctataaaacttctttaactgttcaaatctctgcacctttaagcagactgacttggaaaatgtatttcttcctgaaataggtctacaagagttaaaatgcactgcatgttcatagctacttctggcttcagactgtaatgatatggatgagagtcaggggccacagtcttcccaaatttctccagaaatttcccctttatctccagagcctcttggtcttgtatcaaagattcagaagttcactgttaattggaagcctagagtcagactagaatttatgataaaataatgataattaaaataattgtttctatttttctgcaatctttataggccagaaaatacagagacagagatatggttttgggtcttgcaaacataatgaagtagaataagatgaatgaaaaaacagaaaagaggccaaatcttacttctccccatcatctctggatgagtccttttagtccatgatgagtttaaaacattgaaacaaaaaaatcccaataaatatcaccaaaattaaacaagtatttatacttattaaatgttattgactatcttccaaaaagacatatagattgggaacaggattatttcaggtagtttccacagaaatatataaatataattaatcccagaaatataatttttagttaagagttacacattattactaactgtaaaccactagaattcttcgttatcataaaaaataataaaatccaacattgatggttggttaaggagattaagaaagtttctctttgttagtaagaaggatagaaaaaatattggaaaattcaaggtagaaagatgagagtaagatattaatataagagttaaatgactagcttaggacattggcagtggggacttacacagagataactatgtgtcatctactgttttaatactttacatatagtagatcatataatccttacacagccctataagataagtattcttccgttttatagaatttaagagctattttaagtttggtttggataattcccagcacaatgtgtgacacatagtagatgctagggaatatgattaaataaatcaatgacttaaaatgtgagagacaatggatgggtaaaagaaaactccacatttttaatcttgggaaactgggagtgtagtggcactgatagaaagagtgaagtcagaaaaggaagaaagtttgaacttaggcagttgataaatttagtatgaaacatgttattaacctaaaggtttcagaaatagaattgaaagagaaacaaatgcaagcagagttttatcttttattttttttggttctccatggcatcacacaaaattttaaacatcctttgtacatgaaaagatttgaatatatgctgattccctggaatgcttatttctgattctctgagacaaatctttgattcataaccttttctttttaaactagatttaatttctcctgtgaattttaactttcatggcagatggaatacacttaaaaagttgtaatagggtaagatactggcttaaacgggacagaaaagttaaaagaacatttaattataaaatgtctaataaccattttcattgactttttttggaaggttgcagagggaacttgaagtgttttgcaatgctgcaaagattatgataaccaaatcagtagaggagcaataaagaagctgaagcaggagggaaaagataaggattattgaagggaagacaagagcatgcagaagaaaattcccttagcaatgggctgtttatatttaattcctcctcttctctgaattgtcctgaattatttacatattgaataattagaagtcaaaccattagctgttcaatagaagttcattataaatttgtatataagaaaaagttataaaatatgattataccacaaggcagttattaatcctgtcagcaataccagcttaaaaatgtttccatcacaatgagcatgaaataaaaggagtctatttttcttaatataaaagacttaaatgtgtttgctaattaatatactttaagctgcatggcttctttgccaacttcattattatcctaatcatttcaggttctactataattataatgtagatcctgactattggcagatgaagattatggatggtaagaaaaactaattgtgtctccagcaaatatagggaggtgaacggtaaatccaatagaatagcaaattgattgatcactacatagagtattaattttggtaatgaacatgatattttattatttcaatattagttaattagtgaaaaagcaaatatgcagaaaggtagatttacagcagtggttatcaaccaaagggtgattttgccccccagaggacatttggcaatgtctggtaacatatttaatgattttcaagggctgctactggcatctggtgggtagagcctgaggatgctgctaaataccttataatgcccaggtcagcctgcataacaaagatttttccagtgcacaatttcaatggtgctggctagtgagaaactctgatttctagtatgaagttcttacagttatttgtctttaaatttttcttatttgggatttaaatattgctatggactgcagattatttataactctcaaaagggccccttccttttttgaaaggtcatatgtgcaaggtcatccatacacatcttaatgattataaaatgataacatcagtgacttgtgcccaaagtatttttgattaaaggtgaatttccattggtgtgatcttattattttctccattttatgtttataaatggatagaatagacacatatgtgggatgagggaaaagacacgcatgtgggatgagggaaaagacacatatgtgggatgagggaaaccaaagtctttatgttcttgagcaacaaaaacttcttactgattaatctaacttgaaaactaagatctaatttatacattttttactctacgtgacagctataggcctaaatattcctccacagtatgtacatagttaactattatctcgtatgctgttcaaattgtaaaaaagtttgttactgacacacaatttttaaatttactactttatgaatctgtttaattctgtccacctctatggccactgtcccatattctcctcactagacatgtttggtctcttgccttcttccaatccatgagctacatggtacttagactgacttttaaaaatacttagggtatgtcatgctctacttaaatttctcaagtgatttcctttgtacttgggataaaattcaagatacttaaaatgacctacagggcctctaaatagtccatcccctgcttctctggaactaatttgtatacactattttgtatcttaagctcctccttccagatcaatgtattccagtgacacaaattttacacttccttccttggaagctttgaatatgctgcaatctctttttagacagcgcctcttcatcattatgatctctgtctaaacgtcattttgctacataagctttccctgacagcaatggactgaatgtttgtgttccccccaaattcatgtgttgaaattgtaactccaaatgtgttggtagtaggaggttgggcttctgggaggtaattaagtcatgaaggtggagccctaatgaatgggattagtgtccttataaaagggacatcagagagctctctcacctctgtcttctgctgtatgaggatacaatgagaagtcagccgttggataggtagaaggctgtcaccagtacctcatcatgctgtgccctgatctcagactttcaatttttagaactgtgaaaaataaatttctgctgtttataagccatacaatttatggtattttgttatatcaatccataatgactaatacagtaactctgctcattgaaaattaggggtacttgctttaatcttttacgcatattgttatttatatcacttaattataatgtgcaattatctacctgttttgtgagtgcttggataatacacttttcccactagagtgtgaactcaccaaagcaccagcactatgttaatattgttcatctatgtctcaatggagccttattcagtatctggcacaaagcaggcactcaataaacacagaagtctttcatataatttaagattcttgtgattaattaaccttttattattcataataactaggtacaatctttaatctcctcagatgactaattttacatatatgattagaactatgttaaagttttttctcaaactaaataagatataatttttgaggatgcattgaatttaggcaacataatcaagagctgtcaaaacagatttcatgctatttttagccagagactgtgccaactgaaatgtgttccatctcaaacaataataaggtagtttacctgtagcattaggatagtgagacaacataccagcagttctattctaacaacgaccatcataaagatggtggcacagaactagactgagtacttactttaaacagtgagaagcataacagtggggatacatttcgttaccttgggaaattttgtggtactgcatcaagctactaattcacatttacctgtgttgttctgtatttacataatttgtcatttttgaatctcgagttcatcattttactttatcccttgaatattgcttttactgaagccgacttttgatggaacactaatctgatttgtctcaattgtttattgcattgagaaatagggattactatggacagaactttcatctggctataaaattgtattgattgcactaattataggtataatggtcatttcaaagaaaggaattgctgtaatgggtcctaaaaactctatgcattcataagagatatgtccctagaatttcccaaattcatacttttgtgaataacaggtcgatttcacaaatgtccagacaacatctagaaggaaactataatgagagcagaagctgagtttaagatacgcatttgtttgttgatttgctatgttggttcattcactatttaaagtcaagttactgatcagcctgccgtggctgtaattcaaaacacatctttagcaaattgataaattataaaatatcatggctctttcatattgctcatacataagttataaatgtcaagggttatctatatggttactaagagcaatgcaattggtttcagaagtcatcaagttgagataaaaagctttcatcacaattgctgataatttcttctttttttaaattgctttttttcccgaaaatatgttatggcatttccttctggccctatctgacaggaattatcttctatgtccttttggcaagttaggaaagttagcttagaagaaatatgtctcttctattgcatccctctaccatgtcatacacacaattgttattgataggcagctctctttgataataattattttatttttacccttctccagctgcatatgcaaaaccacgtgtgaaagtggatgagatgtacaggacaaagtttatgcattttaggttgcagataaggcccatgtaacttgattcctgcttatatttccatgttccgccttccccactctcccacttttcattttttgttccactaatattgaccacatcatgttttgtagttttttttttcttttttttttttttttgtctttcctggtgttctgtcctttgccttaaacattctcccactgactttcattatttttttaattggttaactcgtatgtatgcttctttactcagctctgatattacctttttcctttgaagccatccataattcctcatagcagttcctcattatttttttaactagttaactcctatgtatgctcctttacttagctctgatattaccattttcctttaaaaccacccgtagtttctcatagcagtgtgatgtaactcttctgcaaatctctagcaccctgcacagacatttttgctgaacttgcttcactgaattggtatttttagtttacacatctgctcctctctttagattctatgctattcaagggcatgtcctactatactgcttgtcagtaaatattcattggcttcataagagaagaccttttcttttctattttttaaatctaatttgcaaaggcattagcacaaaaattaccccccaaatcaatgagggagataatttggaaataaactgaatgaagccaaactacaacatattcgcaatgcaaacagactttctttgccttcagtccagttccccattatcctatttttatacatcaataaatactactaatgataatgatgttaataaattggtttggtttgtcattctcaaatatcccaaaatacacaattggtttcataaaagacatgaaattttaaaaatcacatatggggaatatgacaaatttgactacagttgacagtagtaaaatacaattattcaagtagattacatgcatgttacatgtgtattttctatgtttctcacttttacaacaaataattcttgggacaaagttatgccgtaataacaataacttttcagtaactcaatacgttattcactattgtaaaaagctatcttacaaaatgatgaaagcctgctgtgatgtggttatgtggattttactaaatgttttgaataagcctatcatctacaattagattcaagaaaaatgggaacagtcaacatgtggattggtattgagattttaatgaaaacacaaaagtggaaatttggaagtgcacatccacatttcctcagcacatggtacttgagggaatcctaaagtgaaccaagatacagtaatcactttcatggtctcagataaaaagtgagaatgctgtttacaataaggcaaacaaacaaacactggcaaccacattgcccttgtttgtagattatctcctaaacataaaattcaatatttttctgatgtaatgatttaatttccctttaaggaatacttataaacagttaaaaagacagattgcattacggggcttctagcagtaacatttgttcctacttctttctactctccaactgggctcaaggagggaaccctttccaactcttttagctattgctactaatttttaccttcatgttctaaaattgaagcaattaattcattccaaaatggttattaatatctcccattttccaggcactgttctaggcccatgattgagcttagaatctaaaaagaagttccctcaacaatagattttataaattagatcataattggtgacatatagtataatagaggatgattgttatgggaaaaagaaaagaagactaggatgagatgaatggggagtcataggtgaaaaataagtttgtaattttgagtaaagtgatcatgataatctttcaaagaacatgacatttgagcaaagacttaaaggaggtgaagacattcccatttggatgtttccttagagttcttttttaatctttgtgcatttgcaacttttattctctgcttttcctattttagactttccttaagtatctgttgatttttgacaactcatttggatttaaggatgtggaacttggagcattttagatgctctgtgtacatgggcaggtcttattggtgggcaggattcattttatgataataaagtagcaaactaatttctgttggaaagctccaaatattagtatcttattttctctagaggattcagtttctctagattatatatttccctagaaatatataatatatataatactatataatctctagattttatatgtatattttcttaccttggagaataagcctggctgctggcctaatggaaaggaaaaagagctgacagtcttattgttcattcacaggtttctgtttaatctccaccctccaacgttcttggtgtccttgcatccaaggcccttctcaataatctctccatgaaaggataggggagaatttttattgctttggaatcggtggtgggttagtcacttggctgcacaggatgggagtctgtaatctagttgccgaactgtgctttaaacagatttgtccactagttcccttagttttcggtcaatacttcacgcccacctgttagagtccctagtcccttcaattcctgagcctttctggaaattggtggaaaatcaacttgcttctcatctttacctcctctttctgcacatttcagcttcttttgtctcactaatacagtacacatatttcagacattccattttccaaaattgtcttcgtaactcttacctagctgcagtttcattttctattctgtcattgtagatatttactttttttgttctttaacagtaatcttggtaggttttccagagaaagcagcaataagatgtgttaagtgtgccatgtttaaacagaagacagtaaaattcaatcaaataaacatttatttgggctctatttagtgtgaggcactgtataaggtcttaattggaatacagatgttattaaggtaacctatctatgctgcagagattcagtttagtgtggaagaaaaagcacacccttgcttaactctacctcaaatcagattgataaatgccatgccatatattggattcaatagcgcctctctcttctgtctcaccaatcacctttaaaagaatatgtccacctagaacctcagaacacagtgtcatttggaaatggagtcattggagatgtaataaacttaaaatgaggtcatattgaattaggatgtgctctaaatccagtgattagtgtttttataagataaatgagagagagaaagatagatgtagagacacaaaaaagacatggggaaaaggccatgtggttgtcatgtgacaattagaagaggccatgtgccaatcagagattaaagtgaggcagctgcaagacaagaaactcctgaggccaccaagagaggcaggaagaatttttttcctagctctttcatagggaacacagccctgctgaaaccttgattttgatcttttagccttcagaatgtgaaataataaatttctgttgttttaagccatccagtttgtggtattttcttacagcaatcataagacactaaataccagtcataacaccagtacagagtacaataagagaacatcagtagaacagagcccaggaaatatgaagataagaaccctaccaaaaccttggcagttgcctttggccaagtggaaattctatgagtaaaaacatgtttgacattattaagctatctggcagaaactcttgaatatttaagggctgattttccagtgaagatttaaccacatgtacatatttgcactttaaaatgacatgttttctcggctgggcgcagtggctcacacctgtaatctcagcactttgggaggcctaggtgggtggatcacctgaggtcaggagtttgggaccagcctggctaacatagtgaaatcccgtctctactaaaaataaaaaactagctgggtggggtgtggtcacacctgtagtcccagctacttgggaggcttaggcaggagaatctcttgaacccaggaggcagaggttgcagtgaaccgagatcacaccactgcactcccgtctgggcgacagagtgagactccgtctcaaaaaaaaaaaaaaaaaaaaaaaaaatccatcttttctttaaaatcatcaataatatcctctgaatatacttgagaaaatgaaggcacacatttttagggtcatgcagccattatttatgaaagaaaatggaatgctattgaatgcattcttggtcatgaattttcttcatataaatagaaacactctcatttttggggagccaaatttctaactttgttagcattgagagtaaattttaaagaagtattccattttactattataatccaaatcgttagcaagattttctcagctaaagcaagagtaatggtgtttggcatgtacatttgaatatctcaaaagcagagattaatgcttaagaaactgaagtctaggaagagacaaatcttatttgacaaattctaaagacattctcaaagaaacaaaaagtgctggtgaagtaagattcaaattgttaacatttgttcagcaattacatgtgaattaaccagcctgtcaatatagaattgatgtgcctgagacatttcaagtaagctttgtaatctaatttttaaaagttaaccaaaagctttatggaagctaaactcgggaaaccagctatgattgcaaacacatggcagttagctgaaaattgtttggatggagagaaaaacggcttcatttatcacttgtaagatcaaacatttccacttgagtagctcacactatataaatttggttcagtttctctcttggaggctaggcacgtaccagcaatgctttctttcaagcttagaaagtgaagaaaccttcctttattctgttttaaaattccacagcctcatccaagcctaaattttagcttacctccattcctatgtcttttcctgcaccatctttactcataagcttaagggtacgattgctaagatagaaacctgaaagtcttctttagctatctctcatccctaacatccaatcagtggctgtgctgttatatcactaatctcatgtctttgccttttttccattctaactactgttgctttaggtagaatcccattatttcttgactaccccagtggtctctcctagacaattctctatactggtgccaaagtgatcattctgaattacaaatccggtcaagttaaaccttgctgaaaatccttcagtaactctgcataactttcagattaaaattcaaaatccttagcttaacacacagaaaaatttatgatctatcatttgttaattgaccagtatcatcttcccaaaacctcattgcacttcgtgtctgttctagttctactgaaccaccagattaaaacctgggagcacattctgtttgcctccacagcgactttgcctatgttctccccttatgcttgggataaccctccccacgctgtgtaatagcagacaagctatcctgcaaaattctattcaaatgtcatctaactgggtttatgaactctctaggtttactttagctagttactcagcttaatatttgagcttatagcctgtgaacaaattgatgaaaaagagaatgtataactgtggcattttgaagtaaatttcactcttaccatgtgtgatctaatttgtgttaggctctttttaatgcgtgattttgggcaaatacctacctaatcctcagattgtgatcaagtaatatcaccaactaatgacacagaactcatattcattttcagatcattcatgatttcatgacacaaatcctagaaacacattttaaacggaacacgtgtttgtatacttacaggcagtccagattacagatatgagaattgcaagaatattgctacaacatgttaaacatatactataatggtctttggatggccaaaatactaatcgtctcagcatcatttaatatcatgttacttattgaagcatcatttcttgagaataaatcattggaaagagaagcataagatgaactttgtactgagattcactttttgtgattcttcatctgctctcatctggaatagagccaacctattaaagactggtatttgctatctagggttgctatttactatcttagccttatcaatggaaagaatcccaaaatggattgaaagtagctttatcttctatttaccggcacctgattaaaatacatatataattaggcacttatttttggaaagagttattaaaatggatattttgatacaatttaaaacataatgtattctacagatgaaatattttaatgttgaatttttatcacatgaatttatttaaactacaaaattttcaaacactgtgaagcatgctggttaataagcattagagacccaaaatatcattacatgttatttaaagcagagtcttcaaactattgtggtgagatttatatactagcacattttccagaaatatcaggtaatatttaaatctcattaatagcaattatatgagtgatatattaaaacaaatcatttagctgatttgttttaggcatttatttttcttctcagcctttctgcaatgtacaaataaaaataaaaaaccaagaatttatttgaaaatctttcctccttcaaaaaagatattattttatcatgaagttcatgttgtctaagatgtagccctagaatgatttggtgccctgttcctgcctgaactgtatgtttttgtttttttttttaatttttctttgctctcccctatctcaaactcagcacaaatactccagtttcctaaaaggtatagatgaacagtcagtaaatgaatggaaacattgcaaacaaaccaacaacaaaaaaaacaaagaatgtaatctttcaggagaatgtcacaagccaacattatgtgctagcaatgatgccaaaactatttcagctgctagaattgtctactttaccttatctcatacgttcatgtgcctgcattaaaatacatattctaatgtttataattttggtgtcctcagcgcaaatatttccactttattggtctcatacagccaggatgcatttctttgaggctacagatttaaagaaaactctcctagcacatcaaagagagactctaaaagaatactaacccaccatacacagtataatctgtggctctccatcttgtctatgctatcctgtaaaatttttgcagagaatatttgaaaagaatggtacaacgttattctgctaatgtagtctctcatccatactgccacagcatcttaggtagtaagaatttcactatcgtatttgttaaaattagaatttccaaacttattctttttactccaatcttggaatagtggctctattcttaagtcagctcagttttaatatggagtaatttaaataggactctgtctgcttgaggtggatcatggatttcctccttataatggtgtgaagatttttttttcccttacataggattaagtttaaaatcatgttgtagggtttggaagcttatctgaaaactttctcaactaccccagaattctacaaattgaatgggaaaataaaatattattctgaaaagaaactttcacagaggagtccctgcagatctcatttttttccagactgtgtatactaaggcagcaaggtcacataggtcgttactgttttggatctgctgatgtttgtgaagtgtggcttggagaggaaagtaggaggacagagaaagcatttggggatttaatgaagaagcatattagcatgtgccatagtgggggcaggtttcaaggcagcatgatggaagacacacaccttgcagtgctgagacttttatctcatttccacacctgccttgtcaccaatctgcagactagtagcatgtggccctgcttggggtttcttctctcttgctccttacccattctctcttcactggcctgtactatctacaagtgaaaggtgctgaaggtaactgatcctctgttgtatttctttaaaagaaatcaacaaacctgatgtgacaatcatgtctttagctgaaaaggcagaaagaaatactttaatttgaaatgtatttaatgagccgttattgaatgcctactatatgtaaagcattttcacagataatctcacattctgggccaggtgtggtggctcgcgcctgtaatcccagcactttgggaggcggaagcaggccgatcacctgaggttggaagttcgagacaagcctgaccaacacggagaaatgccgtctctactaaaaatacaaaaattagccgggcatggtggcaaatgcctgtaattccagctactcgggaggctgaggcagtagaatctcttgaacccaggaggcagaggttgtggtgagccaagatcgcgccattgcactccagcctgggcaacaagagcaaagctgtgtctcagataaataaataaataaataaataaataaataaataaataaataacattctcggtgggaggcccatcttaaatatgaaagtgagtgctcttaggagagtgcataattcagcaaccttagcaaattaatatgagtactgcaattcaaacccttctctgagtccaagtttgtacagggcaaaataggaaaaggcaaacgccagcaattactagaatttattgtttgtttagttgctttcatgaaattatctcagaacaacacaatgaattagctgttttcattcttagttccaaagaaaaactaaaagttcagcaagattacataagaggttacaaaaccaggaagttgttgagcaggcacccatgtcaaacacaaaatcattatattatgttgtcatataataaaagatgtattgactctcaggagaggtctgaatattatgtacagctaccagcatattaacaactaaacaaaagaaaacactgataaatgtcaaacaaataaaacaaaatcatccccctaaaacttcagacacaaggctactgctccaatgtctttttattttctaagttttgaaggtctaataatcctgaattacattaacaggattctccccaaaacccctgttgcagagaaaataagtaaaggttattatcattttgcttaaggagaatttagaaggatgctttcttgcatgtgattttctaaacctaccccataattagctataaaaatgagattaaaaactcctctctgacaaccaaatcgttccttaatctacaatgttatcattatagaaatttaaggcttgtagctctaccattgttttaaatagaatacagaatcactctcctctgtttgaaaaatcactgaaaccaattgacctgtactttgcaagcaattgttttcattgactgtatcctaggtagataaaaatagaatgtttaaagcaattcattaaattataatcagtaaacaatattcctaatcttgcacattaactttttataccagtgtcaataataggttttaagatccattataaattatgctaaatgtagcaatatacactgcagttttaatttgctagtcctgtttattctcaacaaaggaagtgtaaatgtagtatcttcaatgtgttttcaaattaaaaattttaaaatccctcacatttagttagtgcctcacagatcataaacattaagcttgatttcagcaaatcaaaatatttcatttgatcctaaaaatagctaactgagatgtgaagtatcagctttactccacccgtttaaaaattgcaggaactgaagttcagaaagattaaataatagaggtagaatattgaagcatctgggattgcaacttgagtctaattccaaaaccatgtaaattcaacgcataagattaagaaaattctatattacaggggattttaaaagttgtttagtcaacacagagactgacttctacattgtacagcatgtctttgaataacatcattttgttcaacatcatcttcttttaatgtagaagagaaaaaaatgtatttctggcatggggctactgtctgtgtggagttttcagctttccccatgtctgcgtgggttttctctggatactctggtttccgcctacatcccaaagatgtgcatgttaggtgaattggtgtgtctaaatagtcacagtgagtgaatgtgggtgtgagtacaccctgtgatgggatgtcattttgtcccaggtgggttcctgtgttgtgccctgagctgccaagataggctctggccaacctctacctaaactggaataggcatgttagaaaataaatgaatgaatgaatgaacacaaattattgtcaaataattcataaagtatctgacaatcatacaaatgcataacaataaacaatgcagcacaaaagcactcagcaagcctgccatacttgtgattgtttatttttgaactacgtgttagtcgcaggacatcctcacaagttttgctttgcaaacatgtattccttgatttaatccaccaccactatggctaccattactcatggattgacacaaaattaggtaaataattatctcatttttattaatctttcttaagtgtatatatagctcacatttatttcaatgtttaatatttgatgcatttggggtctttattttgaagttcggtgatgtttttgtgaccaaaaatatagcgtaggaacctaactctatctcaattagcctatgataaacctggttttgctgtgtgtcataagttgcagtttccggtaagttactgatgatgttaaatgaggacttaactgtatttgagaggagagcaacaagattatttaatataaatgtgttgaaatatgtatagatgatctctctgttggaccagttaagagttagaggagagtaagttcagaagaaaactttattagtttgtggtacaattgtacctgaaaaacagataattatctattgtcttgagttcacctggaaataaagaattagcgtaaataagtgtcagatacagaacaagaaacttgacctcagagttcacccagcaaaaggttgagagatcctggtaggaatcatctaatgatgaaatctagcctctgtttacttcttcttataccagtgttagagtggaatccaaatctagctgctcaatgcacaatgcagtccatctctcttaaggggaggaggggtggatgcctattaggtatagtaattaggaagagtgttttgctgttggaaggtcaggcagagaaggtgtttacattatatctccgaaagggcttctgataaaaatttattcaaaccaatgcctcagtccacaggcaaagaataacaatggttcttcagctaatcaattggaatggtgcttatggcactttaggaagatttctatatctctttaatcctcatacaaaatttattccaatttagtttcacgtgttgatttctttacatattcaggcacacaagcatgcacatgtggaaacaagattcctttgtctgtggattctttccatgtgctcagtatattttaatgttcaaaatctagctgtcatttagctagttaaatgagcaaagaagctgttttactctaacaaataagaggaaaattgtttatttctcaacatttcctgcctattgtcagtactagcataattttcaccattatttgtttgtttgaaggtggtggagatattggcatgtgcattattaagatagtctgaatatggtaattttcataatgagatttattgtatacgcctcctggaataaaaagaggactgctctattctgaagcatttaaatggctgtaggatagtaagattccattatttttaacggaacaaaatttgtattctgagttcattagaatactgaatgagttgaagaaacaagttctgttcttacatcactcatgtaatgaggtagtatataaaaaattcagttctgtggtgtcaaacacatgggtggaatttaaatggacataaattagtagtaaatgtcccatcaaagaatgcaggtgattttttgttgttgttgcagtttttggtagtttatgatttcatggcacatggcctggcttgacaaaatgttatcaaatgaatatagagtagcagcttaacatgtgataaatgtaaaaggcttcctgtttttccctcatgtctccagtgcctagtatagtgttttgcttatggtaggaaggtaataaatgcctgttcaattaaagtgaaagaatataaatgcaatgggattgaaatacaacgtgtgaacaatttgtccataaactctgagccagtgtcgaaatgaatggtttttattttcattctctaatttaacaaaacgaatctaaaatatctctagagctatttactctgttttatttatttttatatatgtttgaaataagctgatgaaataccataggcacaaaggacctttttttcctcgtcattgtcttctttgtttctccagatatccatcacatttattacagtaatttactttgtcaatctcagcatcctgatcttgcctttctgctcattccagcttcttatacaatctcatcaccaaatatttataatacaactcacctagattttatttatttttacatcaacattttaactaaggccaactaaagttgtcatttagaattttcattgatcttttaccacattattttacagtgaacatatttcccctttcttcttctttgtagctctttttcagcagcaaaagataaagaagctgaatttcaccaagcttattgtgttgtaatatataactcccaaaactttttatatccttatctgaagtattttctcgtatttgatatacagctaaattaaaaggggagttacaacttattgaatgctaccatatcactgtgattttctgtatgtgtgtatgtatatacaacttattattgacaatattgctacaaagtagatattactatatgccagtaagttaaacacttatctaggataattaggtttttaaaaattgtagaaaaggaattttaagagcctgcccatccaattccaaagtctatgtttttctatataccacacattaattccaaatatagttttgaaatagggctgagtgaaaacctagtctgatgaaattcacttttttgggggccactgaatttttgattccctaaatatactgatttattgacttatggatcatgctttatatattaactttcatctcataataatcataaacacatttgctactgtagaatattccttgccagtacataaccgtctaaaaaacaaaggaagaaaaaaaaatctctgtgactagaaacaagttgaatctggggttaaatccttatgtttttcttgttgcttcatataattttctgtattatagtagcagacaacttttttttttttttttttttttttgctacatgtgagatgctaaaaagttacacaaagaacctcagctacggaaagcttttcttgcgaattttctcaatacatttttaattaattgacatatatctgtgcccatgtgaatcttttagatgtccacataaacaaaataaagtataccagtatgcaatttatatcataaagctttatgtttagtgcacatgcctgtccatagaatcctaaagaaaactctacatattgacagtcaattaggatgtgcttgcttgaaaacacccttcatctttcatcttataccactataaagtacgttattctatgagatattcagtccatgagattgctacacaaataaagcatgattctccacccctatgtctccctctcctcctctctctctcccctaccgtctctcttatactcactgtttctaccacagagaaatacaatatctgacaagcaaacagtttcctaaatatgaactgattgaattgcagacacatttttcaggttagaatactttaaaactctgctattagaaaaatcatttatagtacacatagagcttctgaaagaaacttatcctcaaattaaaaacaagacttttattagggtaatctatagataagtcaaacaagacattgcttgacccaaataaaaaatgttggacatgattaaccaaataactctttgtggcatgtacacacaagaccagtttttaccctatcatgaatcttccaatgggcttttgtaggggaagagtaggttaagagcaaaatagcccaatcaactatgccacttttcttccaagaattgtagcatgaaattaagtgagcaaaattggatgcatggaatgatgcccagcattactggtatccacataaaataacgatacatgaaatattaaaataacacaatcagatgcatttcccaaattattgtcatcgtatggtaaataatttcccctgggactacgtggtaattcttttatgagtcttcagtgaatgatctgtgatttggcaaaaactcttgtctcttcactgagaatattgagatcatcaggaacaaactctctgtctctaaagttacaaagtcacttatataggaatctgccctcatttctttctctacaatgttgacaaaacatggcccttctctccttcaaggaaagtgtctcaagtgttctctggtcttttttattcgcatatactgatctagaagcttgtttcaatgtttattttctatcacaatattttcaatgttttactttctactggttcatttctctgaaagtacataagatttctcattcacttactccttaaaaattggttatgtttcaggttttgtcctctgctcacactacaggctttccaagaatggcattactcatgcttatgcttcaacctattactatttactaacagcttctagtccactagcttaagctaaaatcccattcattcaaccacctgctaaatatctcttttcccttggaagtttcacaagcatgtcaaactcaatatttctaaaacaaacttattattcttccttaaaactttgcttttccttctcaattttctatgtgggtgaatgcaagtgccctaggctttcttttaactcctttccacaattagggatgaagttctgtctaccccacctcctaaacgtcacatctgcttgtgcctcataagtcattgctattgcgtctatggcctgcactaattagtcttctatctggtcttcctactcccagtcctgactctctagagcttatactccacattgatgctgatgttatattttgaaaaaaatttcagttttgattgttattccatgttcctaaatcctttaataatttttctatgcaataaagtaaaaacttatttacctgaagcacaaagccatggatcaccacagatataaaatggacctgatcaaaattcatgatattaataatttttttcatcctgatagattatgtgcattttcataataacaatctatcaggaagaaaaacaaacattaaaataggtatttttccagccgggtgcggtggctcacgcctgtaatcccagcactttggaaggccaagacaggcggatcacttgaggtctggagttcaagaccagcctgatcaacatggagaaaccgtgtctctactaaaaatacaaaattagcctgatgtggtggtgcatgcctgtaatcccagctacttgggaagctgaggcagaagaatcatttgaaccagggatgcggaggttgcagtaagccgagatcgtgccattgcactccagcctgggcaacaagagtgaaaactccatcaaaaaaagaaacaaaaaacaaaacaaacaaacaaacaaaaacaaacaaaaaaccaaaaaaaaaaaaaacaccaaaaagtattttccctcaatacttgttaaaaacaagtttgccacaattaaaatacataaatatgaaaccactttccaatgtgctagttaagagtcaggaaagtagtgaacttctttgtaatatctgaattgactgatattttttaaagtcaaataaagaagactataaaatgagattctaaaattccaagaaatgatcatagtttgaagtaatggtatttttgtttcttcttctcacctccaagctccagtttgtgcaaagaaaccaaagtattacaaaatgtaatactactagcatccaaatactttagatctatcctagaaaacactagattttaattttttctgcaaacgatttcaaagaatttaaagtataatcactttttccctttataaacacagactcaaatttcaggatttgataaaagtatctcaatttctaattatagcctatgttttttaatacaacacagacaacatccagacagttgtctacttttaatctaatctacttttatcataatataatattatggacagcagtaatatgtgtactgaagttcacagtggaggtgagctccttgttgacgttcaaatgcaatgataatcaaagtggataaactctctgctcttcatcccacctgcaggcttctagattcatgcattgatttatgccagctcaatcttctgacttttcatcaagatgtgcaatatacagtgccttcattatgaactatagtttcctctatcattataagaaacacaagttaagtaagctttcctcaaacagcagtgattgctttcaagttcctgaacaggctgcaataggcttgacgaaaaggattgatttatcactttttaaatagattcttaatctgcaaatcaataaaaatgtttcacttcagcagtggcacggggtgaatgactcacccttgaaaacagaatgaatgaatgctgcctttcttcctttctttaatatactcagattgcaattgtgcttttgctttgcttgtattacttgctaaattccagtgtttgggagtgcctgagatttcagcctggtttctccataaatcaagtgaggggttgaatgttaatctgctaggactgctattttaacactgccattcttcttgttatgtaataagaaaattaaactcaaacaatctttagttggccaaagataaaaataaaagatgaaaacacacagatgtggagaacattttgtgccaaagtgacacagcatttgttagtttcagactagcagaaattctggtaatttaaatgttatacaatcggctttgtaaattctaccaaagagttaaattaaaatacataggctcatttccccatatgtcttctactcttcatactttaccaagtgtatagtagaatctaaacacctcttcttagaggtagctcttacgtagttcagaagtctgagttaagtactcaaaaattccaaaaagaaggcactttagcctatagtcatcaaaagtttctttaaaattttctaggagtagtgataattaaaataagaaaaaccaaggaacctcataacaaacagctggtctgatttaagtatttttgaataatttacaatttaatttagccagtctctataacaaattttattcccatacaatttgaattaagtaactgcatggttacataaagtccttttttaacaatagtaaagtgaaatagtagtggcattttcacttcaattatatcattgattccaaaaaggaaacttcctaaagatatattagctaagaagttcatcactaatgtttgaaaacttctgaaaaagtacctcatttttgttttaaatgaataataatgttttatttgaaacagaataaaaatcaactcaaatttaggtatataagaattcctttttgtaatgtcaaaaatgttttatttattctagatttagaggcaccatattttatttcttccttttgttcttatttttcccatgttttaataaaaaggacactttggaagacctactttttttttccctcacatatcatcacccatagacaatacggagaagaaggtggtgagattgggtatttggttcttatttaaaagctatgtttggtgagaaccccatatactgggcatgaaacttatacacaaaaagttaagcctattcctgaaaatcctcattttagaaatatattatctaattattaaaataaagtaaggaagaaagcaggagagaaaactaaatattgttataaatgattggggagtcctcctggtctctgttcacacttcacttacatctgtagtacacaccagtcctttacaccgactctctgaggaaaactacccttcccatccttcgtctactatcctcctgatctcacactgcctggattgagtagacctttctagtgaccaatgagtcataagacagcaaaaccatacaagtctaaactcctcttagtttattattcatccttgtagttcaatccagtagacatttccatgggataacacattatttggcttctaagttttctacttttatgatacctctacatatttgggaggagtaatgggagggctcaaatttctcttcaactactcatattttaatttgattgagaatttgtattttgtccaaaagccagaaatgtgccagataagaatttgtcctctaaattacctaaataggctccttcaagaacagaaagtgaacagaccttgcctgcttgccttcaatacctgttaataaacaatatgggtcagtgaatgttcaagaaatagaagccaatgattacagcatcagtgaaaatgatttaatgataatttgtgagtccaacactgagacacaaattaacatcactgcattaggtatcttcttgtaaaatctacgtatgaaataaagatacaaaattcaagctgtattttgatttttctcatgattctgatgtatgtggtacatatactatttgggccctaaagacatttaaaagttatctccaaagctcagaattcattaaaggaggactctgggctgggtgcagtggctcatgcctgtaatcccaacactttgggaggccgaggcgggtggatcacctgaggtcgggagttcacgaccagcctgaccaatatggtgaaaccccatctctaccagaaatgcaaaatcagccgggcgtggtggtgcatgcctgtaatcccagctactagggaggctgaggcaagagaatggcttgaacctgggaggcaaaagttgctgtgagccgagatcacaccattgcaccccagcctgggcaacaagagcaaaactccactgagaaaaaaaaaaggactctgtttttgttaaaatgccatgtatgcatatctgatttttccataaaacacattctaagaagttatagtaattaaaatatttagcttcagagattgaccattttcatttacatctaactttccagtatttagtagcgatgtaacattagcaaagttatttattttctctatcttgatttctacatttgtagaatgggagttgtagcagggtctatgtcatatggttgttgagaggattaaatgagataattcatgtaaggtggttagcacacagcaagagctaaatatatgccatctattttactaactttatggtaatagacctaattaacttgattttgattgaggtactttatcgctctcattaaaatatacattaatctgccatctaatgtttattggcaaggcactctggtaagtattacagtcttaaaagtatttgccataaataattagcaaatcactagaagttctgatttctcaaggcctgaatagttaagcagttattttaattacacaaggctctaagtgtacaggcaaaaccatgacctggaaaatggacatgcttttgagttaaatcaacaaaatggtcttaaagtattgtagcttaaagatgtttttaaacattccaaaccagtagagtcctatgactttcaccagtaaaattaattgtcttcgtattctactaaactttggaacgataaaagctactgattactgggcatttgctatagaccaaggattatatacatgttttatgtatattgtcatacataattcacaattttcctgtgagaagagtatattcattattgtacaaaaaagaacgctaaagtccagagagtttaaataacacatttccaagtcacgtagctagtggcaagatgtggagtttgatttcagtgtacaccttaaatatgtcactataccatgctacttctcatatacctaggtttatgtaatagaccattttggtattatcttacgcatccagcacatttatacagcagcaaatgtctaggagtaacatatgcatgtcaggatctcggccacatgacttggatcactgccctgttttattaaatgagtaaatcagtgcaatgctacaggaacactctagatccttggtatgagggaatttagcacttgtggtttcaaccgttttgtagagacttcaagggtctatgacatctagtaatctgtacttttgttgaggtgaaaatttgaacaggtactactatactggcatgtaagcatgtaagagtgagtcatttagaaagtgtggagacctagctaaaaccaagatttgcaccttgacatattccacagtatttctgtatgcacatttacttgagttaaatgatttttaaaaatgtctattctgttaggtttttaaaaataatatataaaccttccaagaaaataaattactagtgctagtctgaaggaatcactcaaatttttaagttactgtttacaattttttttgcaacattagggtattttgaataccctagggcactttactatggccagaatatatcagaatgatgtatttgtgaaggtgctattgtattatagagcaagatttgaataagattttcctaattataccatccaaatcattactctgtattttatcacgatgagaaaaaatcattggttttattttaaaaaagacaaagacaagacttcatatgatttgttaaatcgataataatgcttacaaagttcactgagttggtttaatcaaatcttttttacttatcatctaattttattcttgaaccaaccatgagagttaggtagaagtacaattatcctaaccttaaggttgagaaaatggaggcttagagaagttaagtaatatgccaatgctaatcaatataatctgatgtcgaccaggtcgtctaactccacattcagtgcttccatttttaatagtctattttctaagaatttttctaacattgttaaccactattgaatgagtatctgataccaattcgagaaccatcatactatcttatctcaaacaaattggcttctttacttccactcataatagagaccatgagatcatctgatttctcttaggcagttccatatgcattctctctcttgtttatttttattatactttaagttctagggtacatgtgcacaatgtgcaggtttgttacatatgtatacatgtgccatgttggtttgctgcacccattaactcgtcatttacattaggtatttctcctaatgctatccctaccccatccccgcaccccacaacaggccctggtgtgtgatgttccctgctgtgtccaagtgttctcattgttcaatgcccagctatgaatgagaacatggagtgtttggttttctgtccttgtgacagtttgctcagaatgatggtttccagcttcatccatgtccctacaaaggacatgagctcatccttttttatggctgcatagtattccatgtagtatatgtgccacattttcttaatccagtctatcattgatggacatttgggttggttccaagtctttgctattgtgaatagtgttgcaataaacatacgtgtgcatgtgtctttatagcagcatgatttacaatcctttgggtatacacgcagtaatgggatggctgggtcaaatggtatttctagttccagatccttgaggaatcgccacactgtcttccgcagtggttgaactagtttacattcccaccaacagtgtaaaagcattcctgtttctccacaacctctccagcacctgttgtttcttgactttttaatgattgccattctaactggtgtgagatggtatctcagtgtggttttgatgtgcatttctctgatgaccagtgatgatgagcattttttcatgtgtctgttggctgcataaatgtcttcttttgagaagtgtctgttcatatcctttgcccactttttgatggggttgtttgatttttttcttgtaaatctgtttaagttatttgtagattctggatattagccctttgacagataggtagattgcaaaagttttctcccattctgtaggttgcctgttcactctgatggtagtttcttttgctgtgcagaagctctttagtttaattcgatcccatttgtctattttggcttttgttgccattgcttttggtgtttcagtcatgaagtccttgcccatgcctatgtcctgaatggtattgcctaggttttcctctagggtttttatggttttaggtctaacatgtaagtctttaatccatgttgaaatagtttttgtataaggtgtaaggaagggatccagtttcagctttctacgtatggctagccagttttcccagcaccattcattaaatagggaatcctttccccatttcttgtttttgtcaggtttgttaaagatcagatggttgtagatgtgtggtattacttctgagccctctgttctgttccattgatctatatctctgttttggtacaagtaccacgctgttttggttactgtagccttgtagtatagtttgaagtcaggtagcgtgatgcctccagctttgttcttttggcttaggattgtcttggcaatgtggtctcttttttggttccatatgaactttaaagtagttttctccaattctgtgaagaaagtccttggtagcttgatggggatggcattgaatgtataaattaccttgggcagtatggccattttcacgatattgattcttcctatccatgagcatggaatgttcttccatttgtttgtatccttttttatttcattgagcagtggtttgtagttctccttgaagaggtccttcatatcccttgcaagttggattcctaagaattttattccctttgtagccattgtgaatgagaggtcactcattatttggctctctgtttgtctgttgttggtgtataggaatgcttgttatttttgcacattgattttgtatcctgagactttgctgaagttgcctatcagccgaaggagattttgggctgagacaatggggttttctagatatacaatcatgtcatctgcaaacaaggacaatttgacttcctcttttcctaagtgaataccctttatctctttctcctgcctgattgccctggccagaacttccaacactatgttgaataggagtggtgagagagggcatccctgtcttgtgccagttttcaaagggaatgcttccagtttttgcccattcagtataatactggctgtgggcttgtcataaataactcttattattttgagatatgttccatcaatacttagtttattgagagtttttagcatgaagggctgttgaactttgtcaaaggccttttctgcttctattgagataatcatgtgttttttgtcttcggttctgtttatgcgatggactgtgtttattgatgtgtgtatgttgaaccagccttgcatcccagggatgaagccaactcgatcttggtggataagctttttgatgtgccgcaggattccatatgtattctcttaagtgaactccacaataactctgatataactatgagggttgaggaaaataaggcacagagaaagtgtgacttaatgaagggaaagacaggagcccatccaggaagccgtatcttttagctttggatactgtgatctttcactcaaatatctctttgatgacaataggaggaaatgataattcatgtggataatagagaataagaatgtataattctgaaattacctatggattgagagaaatttttttcaagaagggtttgaatgaaacaattaacaaagaattatgaaatatttgaaataaaagttgctgtgcatataactctacctttatgctcgttttatcaattagaaaacagagattcagagacattggctgatttttctatgattgcaaagctagtaagtgaggggtaataattataattagaaaacaaatattcgaacccttgatcttctgaaaataaaaaaagaaaaatgaaaagaatataaattaccataaaacaatgtttaaataaaaatgacaagcatgagagcattgaagatttttttttttaaatgagcaagtaagataaagacaaatgaatcctgaaataaactagaaaataaatgtcagggattgaaggtagaagaatctcaaacagaaatatgcaggcatcccacaagatagaggggaaaaaaaaggtattttttcatgatttactagaagaaactatttcaccttataaaaacttttaaagctatctgagccttctggtgtagaggagttagtagacatgagcagcccacttctcttgtcccagaagctaattacctatgtatcaaagcctgtcaccaagtaacagtgtcctagtcactattaggttgggagcagtgtatggctttgaaaataagccacaaagctaaagggacaaagtaaaaagaactcactctgtgtttactaaagaggtcaattgattttaaaacatgcagctgttctgtagtttagcaagaacaatcatatatagattcctgggcagaaaatactccatctactgaaattcttggtaaattattaaacagtaatcacagactcatttatattgagtagaagcaaaaagattaaaaaagaaatcccatatgtaaacaacaagaatgtaaattaaatctgcctctagcagattccttcaattctgctacttcttttggaatattccctgttctagtctgtttttcttgataagcaatcaaagtattaaatatgcttcccatagtgtctaaaacaaccgaaatggaaacagttatttgacctttgttccagtaatttttttccatttttttcttaaaaaatttacgtttgtggcacaacccaagacactaaatgataaatctacaaatgttttcagagaaatttgcaagaagtacatgaaaatataagtagcaaagcacatagtataaaaagaagcacttttaaacagccatatccatgacagatagtaataacatcttgtattcactgaaattttgtttctattgcaagaggtttattctaggacaaggtacaaaatgagaatgtgggaaataataacaataataagactttcctatattgttgtaattcaaggatagagctcaagaatacttctattttttcactggataatacacggtactatgtttcaattaagtccatcttcagcataaaatgtatgatagcatgtacatcacgggtgtccaatcttttggcttccctgggccacgttggaagaagaattgttttgggccacacataaaatacactaacactaacgatagttgatgagctaaaaaaaaaaaaaaaatcacaaaaaaattcataatattttaagaaagtttacaaatttgttttgggcagcattcaaagccgtcctgggcccatacagcccacgggccatggactggacaagcttgatgtacatagtttttgtgttgtctgttgagtcaaaagagtgctattgatgattccatttaaaattactctaaactctgtgaatttagattaagtagatttgaatccaacatgacaaatcaaaaatttaaaagttagcaaaaaagttgagtttttaacacttatatttaatattctatttaccggagctaatagtaaacagggagaatggtaaagttttaaggaagaagagacactgccaaatagtggcatgtaggaccatacatactacattcattcttacatgtagtatgtggtatgtcacttacatgattcacttttagacatcttttgttattgttgtttcatatcaggatctttaaagtggagacagcttaatgaattttaaagtgaaaagaaaatatttccattccatcttattatatttctttaaactcaatttctgctttatgttcagatgcttcaacctggctggtaactttaaatctgtcaatttagcatatgtgtttatattgaaatctcacagaaattatgagcaaaacatggtcaaattttctttttgatcacattttcttttgttgttgttcttgctttttttttttttttttttttttttttttttttttttgagatagagtcttgctctgtcgcccaggctggagcgcacggcatgatcttggctcactgcaacctgtgcctcctgggttcaagagattcttgcatctcagcctccccagtcactgggattacaggtgcctaccaccacatccagctatttcttttttttttaagtggagacagggtttcactatgttggccaggctggtcttgaactcctgacctcaagttactcacttgctttggcctcccaaagtaaagggattacaggagtgagccaccgcgcctagcatttttgatcaccttggttaaagtgataaggagtgaaacttgaagattgcgtaaaaattgacactatgaggagaacactttttttctttctttatctttttgttctttgagaacatctgtcagaaaataatgaacagtgactctgggaaaattcagctatcctcttcccaaaaccacctccaattgtgcagtaatgtatctcagcaaaacttggtaatgacaacgagagtcatcccagtttgacatcacagaaacaggataatatggctggctacttacttttattgtttgtaagttcatgcaaaacaaaacaaaacaaaacaaaaaacaaaaacacaaaaaaaccaaagtctttatttgcaagagaaaaagatttattcagagattacagtctatatgaccccatttcatcttttcataactaagagatgagttttcttcaactttattaatgcttaaagaacacagattccatgccctttactgtgagataacagtagacactagataatgttcttaaaaagcattttgaatgatgaagttggtttttaattaaagtaagtttaatacaattacaattattgctattctctgtctggatatacaaaagccaagaataattaaacagctcctctcatcctaaccccatagcctgctttacagaaaaaccttctatcttctgttagagaatgtcccaaggagggagctagagagaatatagaagaattacatggatcacataattgttacaacaaactagatgaacatccagtttaccattatgatttagaggtttggttcttcacagctgttagtttcatcttcagatactacttcatattgaaaactaaacttgcattaatgcaaatgggttttcagtaaggttccattagctgttaagatttaaatacaatttttgaacacaatcattcatgttctacataagccaattccctcactgagaaattcctagggccctaccttctcagtcacttctagctgctaatccctgtcatgggtaagagaaggtggcttttccttgatttccccaccagttctcacaaagaacatttgtagactaaacaggcttgactaaaaatttaggatggcggattgggtttacgtagagaaacataatgccctttagccatggtgtcatgttatcactggctatcttttgtctcaaactccagaccctgccatgccatctgaccccctgcttctcttttctccttatcttccttgatttcctgacacccaaaatacatgttcattccttacatagaacagttttcctgttgtcttttcccacaccactggcttaatgtctgccttctattctcaaatgactttcctttaaaaaaaagttaaattttaagaacctctgattgaagctgtataagaagaaatacatatacatattctctccacctgccgcagactttttaaaataaggttatcttcaattaagtcaagtacagtaacctttgggatttatattctatacatataattgaaattatgacttcccatcgagcaattttaatgtatggccacattaagaaaaaaacttgtatttaatgtgaaaactaatagtcatatagtaaatacaataagtaatattattaaaagtctgttcagtacatctttaatctttaattgtataaatgtatgatgatgctattaataacacatattgattcatttttattaaattttgacaaagagttaattttgtcctaggataatcaatacccttaaatggaacaaactcatatataatattgatttgtagagagaaaaaagtcattgaatttttgcttaggggaataagtgaaattatctataatataaatattgaaaagtactaattcactttttttctaggaagaaagagacatgggatatttctagtaatattgatttattaaaaatgtcatacaggagcatttttggggaaaagaagagctttttttttttttgaaatgatatctttgcagcaattaacagaaagcttttcctatactaggagctaaataaatgttaatgaacagagtaaatctggtcatttggttgcatggaataaaaaatcctgggcaaacttgctcagataagagtctaagcaaacatgaagacctgcagttgggctgaaatacagtaatgtatgagacagtttcaaggactagctattctattcatgtctcggattgccatgtgataatgcttaacatgcgttctgttctcttctctccaaaaccagctttcacttagtttcccctcttttataactttagcttgcaaatgggttaggtttgctactatctctcaggctttcctgatgtaccttgtctttttccacccccatttccaatttactaagtttttaaaatgttttaaattccttaaatagtagtatgattgcctggctcattctttctcgggataattcataggtggtagatcactggcaggactatgcatagagagacattggattatctgcgcatctaatcctatcaattgaaactggaggaggagagcacaagttttgtaggaataaagatttcccttaaaaggaagtattgtcaggaacaggcagtataacagctctcaggagagtagatcgttatggatgatctctgacctataaaaggggtatgttttacaaattgaaagccagagaataccgtcttgctaagattctcagagtgtaccaataacaacggctatctaatacacgcaggtaacatttacagaatagaagtctcttcttgtttcctgcctcccacctctttcacacttactgtcaatcactgaatcaaatcatctcaaataaataggtgcagtgacatagcagaagaagggcatgcacaattggggctgttttggggcttgggagatcatccatcatgttagacatgcatactaattagttcatgttgatatgcccaacatagcaaattctggggaaactggaggggaagtttggggaaaattaatgtgacctagagttgttgcttgaagaacatccccccacctctttttctctatcaatgggaggaataaaaggctatgctaattacatatttgttccctctctgcggagtctgcatggacagctagtctgttcacatgtagaggtgaggaggatcactaaagacaatgacagagagcaatacacagaaaatgatttcatgctaaaaataccaaattgtaagaatgtggatatctcaaatatatatttgaatcagtcatttatgtgcttgctttcctctgagatggtgaaagccaatttagcaggtggagagagagagagtcagaaaataatcatttccagaaacagcaggtgaatcatgcatatttttatattcacatatatacactcacaatgcagatagcttgaaaaaatatttatccctcagataactagatgatctacatacctcatagtatattccattttgtctagttgctatcaataactaaaaaaataaccacacaatatatttaaattaggatgcaaaacagatacctattatcacactgtaccaaatatagaaagtaaatgcgatagtcgaggaaagataatctgtttcatttatgttggagatgaaaacaaaattaagaaaatagaagtaagaaaaaaaaaaaaaaacctctatactgagcttgggagtctctccccaggattacgttgttcaacattttctagtgatgctaaggatagaaacaaccagctcttgaactttgaagtaattggttcacagctgtgcttatactgagatggaaatatgaaaatacatttgtacagaggagggttttttttttggtagttgtaatgaaagagttgtcaaattaaacgcaaactgctgtaagtaaaataaattacatgtggaaattcaattcctgatactttcatcaagtggatacatgtgctatatttccagaaagaatgctaacattaatcataaaaagaactcttacgctgtgttattctcttatgttagttagtgttaaggaagcaaaagtgatctaaagtgattgttagatatttttgtatccaaaaagcatggataagacactgaatcggtggaacacagagcacttcaagcatttattaaatgtttgagctgttcgggagggacataaagagtacaaagaccacatttctggctgcagagatacttcaaatatacctgggaaggcaagattatcacatttgagagagataatatagaatacatagataatcagaagagcaagatcagtggggctgaaataataagaaaaggctttgtaggtgacatagaataagggcttgaaatgtggctgcagagtaacagaaaggcagaaagaaggcactttagggggcatatgtctgtaaagtccatggagcaaagaatgcaaacaggcacatgaggaggggagaggatggagtaaagacagagagagtatggattgtttaggggagaataaaagctacatagagagcattgggctctctatatgggctacttggaaacaatgatatataaatatatataaaacatatatattatatagtatattatatatatatatatatatataaagtctgcaatgcaatcacaagtggccacatgatgaaaggtgggacttaacgcagaattaatataaaagaaaagcactggtctggaaatgtaaagaagatctgaaacttattccagctgtatgactaacataccatgtaatcttgaacgtgccacttggtttcctgacagttgatagatatttccaactccaatattaaccaataatttataatacattcatatgaggtcaaaatttaaaattagctaaaggaaaacactaatttgtagatgtggttggaaaataattcctctaagtaaaattattaggaaattcagatatatttgccaatagtatatattacttaaacactggaacacctaatgctaaagagaagaaaatattgatggaatagaatatttcatagtctcttcgatcctcaatgtcgtgcgttccaccagattagaatctatgtgagggggaggaactatgactaagctagtctgtacatttaataatgcctggcacaaagaaaatgcttaattttatcaatgttgaaagaaaatgcctaagtgtatatgcccgtaatgtatacttcatattaagttttatcagaaataaaaacatagatctcgtcatcaattttaaaaatttacttaagtctcactccaaaatgataattctatcatagttgcttaacaataaaacagacatgatctcagttgttgctgtacttcaggaacctacaattaagatggctcatataaaattagccaaaaaacaaaaagaggattgatggaactgagaagtatttatgtctaggtgaaagtgatcttccaagggtatgtgtacaaatgtgaagcaagcatcaggtcagtattctaaaagttctagtttaatgtgaaatagtctgttaatcacctagttgatttatctagtggggatttcataatagtttccctaacttttccatctgtcaagttcagaagtgacagaataaaatatttgatggtctggtgggaagatcaggaagaaatcagttacgagaaataaatgggtctgccactttctcttgtggggtttggatatgtctccttatctctctgtgcctgtgttaactccatctataaaatggatctaatcatgttacctttttcattggtagatatcagagattattcaaatcactgaccacattgcctggtacacagaaagcatttaatacatattagtgtctattattatcatgatcatcatcatcatcatcctcatcccaaccatgttgctttgttcagaagtgcagagaaaataaagatcttccaaggtaccattaagacaagtaaatagtagtactaggtaagaaatcaacattagatgcttaccaatatgagcatataattcaaaataagttaatagtaatttttaaaaaaaaccttatgaaggtagagtaattggaaatgtgatcttatgtttcagcttacaaaatgaataaaatgcacctgtttcaaaagcaaagacttcacctgtctctatactcttaatatatgctcatcttgtagttaactgcagctcagactaatattaatattctccaactgacaaaattacatcaactgaaaatttggtttttgcctgatattccgtgttagctttgctattttcaactgaaataagcattttgaaaaagccttaaaaagtcattgtcattcctgattgcagttcatattacattacctgtagaatttcatccccagttgaattactcatcaccaatctgatcattcttccataattagactcttttggtgaaggataaactctgaatgttaatatgagaacactagatttagagtgaagaacaagattgaaggcaatttttgaacttatcattaaaatttttacctttattgtcatagaaattatttctcactacgtgtttttaacgggtagtgtacagtagacacaaacccatcttttcacttgtatattaagacattaccttactaagtctgtttgaattgttcttccttggaacagtcttttaaagctggtatttattttaaattaaataatcaatataaaggacttatgaatttaacagtgttaaaatacaataatatgctattttgaccaaatgttacacacatcaatcacatattcattgtttctttctttacttttttattcctttctcattcacttttggcccaagaagcatagaaatgaattataccttggagaaaaattcattcaatcctctcttttacaaatgaggacccagaaactagaaaaacgtagatgtctaaacttcaaagcaatttggactttcaacttttgcaacaaaaaacacaactcagcatctaatgaaatgtaacatgttcaaatacacactaacaagggagtatgataacataatattcatttccaataataggagagatcataaacttggataaaataactttcaaaaaagaaagaaagaaatctaagaaattggaatttcaggaaaaaatgcacaaactcaaaaaaagatgttaaaaagaatattacatatatttccatcacaggttaaagatacgacacacacataatcttttattttcattattacggagaaatgcaaagatataagctttgtaaccgcctcataagagaaacaaagataggctctttgatgtatctttctaaagctacttcctcatgtatcttcctccagagagagttacacatgtttagctctgatgttatctctggaaagaatgtagagatgttggtcatacagataaaagaatgatacacattctcaaggcagaatcctttgcccatgtgagttggaactcagggaagaatgttgtgctatcaacttttgggttcctaaatagaaactgaatcataaacttttcaaggagcatatggcctgacgtcgcacagtgatcttgatgtccaaccaggtgatgatggtggacaggctggctacatagttctttactccaggaccaatttccatgcccttcccatatccctaaatgataaagttcattatttcaacccatattaagcaaattattctctatatgggttggcaggtaatatgtgttctgggatgaggataatcatgctttgtatacaaaaccacatttgatccaggcagaaatatgctaatattttttaaatgataaatatctatgagatatattatataactgctttaccttatatgtgcctgtcaacttttaaagtaagctcacttttaaaacgcccttgaaatttatactttaataattgtcataaattatgattattaaattatttgactttaagtctcatctttgtgatagtttatatgagtaagacatttttcagtgatggctccctgttgtgaacttcgacagctattattatgctgttcatttgacagaatatatataacagctgtatattttttacacatatctttatataaactaatagttctttaagggaagacctatatagggacaatttaaaaatttttaaaagcaaaatacattgtcaaaaattttctacacataacagagtggaggctgacctagggggtcaatgggctgtactttcccaacatttctttcccaaccttggaaacagggaaagaggaatgctttctgagaaagaaactatgaagtaaatcagagattgggacagaaataagtgatgccaccattaactgacaaaatgcaacattatgtccaatcactataactaaagaaacaatgtatccaaaattgtagtcagcaatgaaagcagggtaaagggaaaatctgagaggcaggtgttggcagtgtgtcctctcctgcaggtagggggtgctctgttgtacttctatcttcaaaaagaagactttaatagatcattaacaagagccattcaaatcatctaactcttcttgttctgattttatgcatgccaagaacactcccagttacaattttcttcccatatagccaggggatgattttacttagagttatgtttctcactttaaattaataaatgaaaatgttggtttaaattctagtctctgagaatttgcttaatatgaatctacctttaagtgatggacaacctgacaaatcgcatacgtgaacctgcaaatttgaaggccaagacttgtcctgtgatgactttgccaagaagatgccactctctgggggagatttctgggcagccagttggctttcctcaacggcaaaaggcttgctggacaatgacccttttcatttaaattgttctcttgataactatattatgagttatcttgctaactacattataagtttctctatcataggtacaaattacctcacactttgtgcttctaccccagcaggtactaaataaacagaggttgttatgatgtaataaaatgcaaccataaaattataaaattgcggaattttactttcttcatacattcttttcctgtctaaaaaacacatgcattaagaggagataactttgatcaaaacaacaacctatgtatttattcagaagacttttttgtttcatgtacaaattgctccattcaaataaaaaattacatctgaaaaatatccccatacaatgacaaatagtcattatggaaaagctgctaatttcgtgtttatttattgttcatcacagcctctagagcaatgctcagtgctagtgcaaagaattattcttatgttcaaattcttgctgtatcatatttagaagacaaggtttaacagaatgtaggcttaatagtctattccatgttaggaattccattcttaagaatatgtggtacctctggcacatgtctaattcagattgcagcaagatgaaaataggtatctgaaaggcatattttaaacaacgagttgatttgcatattaatgcctgaatactgaacgaaactattttagaattttacaaaacaagaaaggctttaggtttttttagttaaaaaacattttaattttttaaatctaatgtttttatattttataagatattctttttcacagaaactggtagaaagatacagaaaagttatattacctaaaaattcccagctaaactattggtataaaattaactttccaagctcttcagcatttattcaaaatttttaaaatctaaagccttctcattatcaatatttgttttcaaaacttccttttttccaatttcttttctattatactttaaagttttgggacacatgtgcagaacgtgcaggtttgttacataggtatacacatgccatggtggcttgctgcaaccatcaacccatcatctacattaggtatttctcctaatgccatctctcccctaccccctcacccctcgacaggccctggtgtgtgatattcccctccctgtgtccatgtgttctcattattcaactcccaaaactttctatcaaagagtggccaaaaatgttacatgagaaaaatcgcaagattcctgctactttaaggatgacatattgtgctgaagaatctaacgacaaatggtcatatcctctgttgagctataaatggaaaatacactttaatcttgtcagttgccagtgccattgggagggcttctccataggcatgaacaacacaatgacctatagctgaaaatcaactgaaaagaatttttcatgttaatagaggaagcatgtaaaaagctaggtgagaggctaggcgcggtggctcatgcccgtaatcccagcactttgggaggccgaggcaggtggatcacgaggtcaggagatcgagaccatcctggctaacatggtgaaaccccatctctactaaaaattaaaaaaaaaaaaaaaattagccaggcatggtggtgggtgcctgtagtcccagctactcgggaggctgaggcaggagaatggtgtgaacctgagaggaggagcttgcagtgagccgagatctcgccactgcactccagactttcttctttgaacacatgcttttccatgatttgagctggagttaagttgacgaatatcactgggtctgatctatttctataacctgcaataagtgcctggtatagtcctaactcacagttgttacataacacatatttactgaataaattaaatgtatgcattgacaggttagcaattttattcaattatttacatcaacttaattaccaagaaacacttagaatagctactgaatatttgcttacgtaagtaattgtacagttgtttctcaaaaaacctaagaacattgcttattaccctaaatgattgcttcagaatgaaagatgctcactactttgagactatagcaatggaacatcatggaagcttttagtagcaaagtgaaatacagtggatataataacaccattggttttaggtcaatttataccaatatatataatcataaatatgaagactcttttttacatgctaatctattttggaagccttttatcattcagcagcaaacatactttaattgggtaggctgtatgtaaatttatttcaagataggagtgactgtgagaagacattagcaatacaaagtctcagtaagagagatagataaatggcactctaggaaagagtgaaaaataacagatttaatttgaggtaaggcactctagaaaccgctaaagacagtaaagtgatactgactgatggggatgactggctgaaatggaggaaaattaacagcccataatcaatatgtggataaatgcctcccgtttaagacagaaaaacagatgttgcatcagaaagtccatgatactatgtgcatataagatatggaatgaaatccaagactataatatgaagtaaccaatttcttttctcagaacactgaagatttgctttagaagagggttatgttattttgtgactatttaaatctctttttaaccttttaattatgcttattatacattatggataaaatattaccaaaaattagttcaaatgtaggaatgacaccgaatgctacaagtagtagttaacctgaaatccattatccaaagttgttcagttaatgggatctatccccatgcaatatattaattactgctacagacttggtgggtgcgtgatcacactgtgagttaatacagagtacggaattcaatatctgttagaactaaagagctatgaattgaatagagttggccccagctggaaagctgttggacatgctgttggaaaacaattatatttccttacttataggaattaataccaccagaataaacacaagtcaatggtagctatgcgaagtaacaagaaaggattcacttaaaaataaatttcattgacaaataaatgatttttcatgagctgttacattcctgaagaaggcatataattcattttacccagctaatcattagaataaactactagtgaagaaaacagtgatagtaacagcagtttttgaacctaaatacacagacctcttctaacaatacaagtttcattctcttcaatattgaatgtggtatgtatacaaaagctttccttataaaaggtagttgtaaatatgtttttaaggaaatacattaaatgttttgctaattgtttttcaaatcaagaaaggaaaaataaaattgtagtaaatatttatgtgtatatatatatatatatcacaaaatatataatgcagttgtagattgtggccacttaatgcaaaaatggtgtttctggtgtttttcctggccccaccagcctttcttcctttcagctgctctatttaacctccatctgtaggctcagcctgactcagggccctgagatgaatgttactttaggcagatgggctctgaaagaaatcctttgttagaaactctccattcagttgttgctccaacgtgaactcattatccccccagggcgcaggtgtctgttagtaccccatctcctcctttgtgaaccccacttcccactgactgcattactattcagtgcccatgctcagacacagacattagtagcctggtttcctggcacttgtcctgctggtaatagatggacatctgccaatactaggattttggacttccacttactgcttggctgacccacttgaattgacatcctggttttgtatcttgagtttagatcttggataatagtgtttatgctttacttgaccttagactaatcttctaatttggaacctgagggctggaatgatcacttcttatacccctttctgtattaaaggatacctgtttgcatttgcataaggaaaataatgatatatgtagactgaaagaattctcaaacacttcaagattttatttattattattattatttttattttccaagacagggcctcactcttgtcacccaggctggagttcagtgtcgcaatctcgactcacagcaacttccacctcctgggttcaagtgattctcctgcctcagcctctccagtagctgggattacaggcatgtgccaccatgcccagttattttttatatttttagtagagacaggattttgccatattggtcaggatgatctcaaactcctgacctcaagtgatccacccgtcttggcctcccaaagtgctgggattacaggtgtgagccaccacacccagccaagattttaagagaaaagtttttcagtagcatagaaatgacaggaatattggacaatatccttcttaataatgaaaagattgacagatgttgtggtcaagtgatattcaagcaatactgtcatgctttatagaactcccacatgtagtttattataacatattttcatgtagtatttccctgggtccctgactattttatgccactttacttgaattttaaaaagaggtggagaagatggggaaaataaatttgtatactattttttgtttaagatgatgatacagggttaaaaggaaaagtagagaaaaaatactaacaggagtaatgttagtaaataaaatgtattataggtgacgagattaatacatatttggctatatgctttctaatatggtcaaagaaatgaagaaacatgattggctacatgtgtatggaagggaaaagtagagctgttgcttaaagaaagtacagcctttttggggatactgagtcctgtgaaaaccacttcctagtaatcttgatgtaaaattgctgttgaacaaaatgtggttacctgagtatcttccaaggcagtctcacaaattgtatatctctgactttttttttttttattattatactttaagttctgggatacatgtgcagaacatgcaggtttgataaataggtatacacgtgccatggtggtttgctgcacccatcaacccgtcatctacattaggcatttcttctaatgctatccctcccctagccccctaccccgccaacaggccccagtgtgtgatgttctcctccctgtatgtgatgttcccttccctgtttccatgtgttctcattgttcaactcccacttatgagtgagaacatgtggtgtttggttttctgttcctgtgttagtttgctgagaataatagtttccagcttcatccatgtccctgcaaaggacatgaactcatccttttttatagctgcatagtattccatgatgtatatgtgccacattttcttcatccagtctatcactgataggcatttgggttggttccaaggctttgctattgtgtagtgctgcaataaacatacttgtgcttgtgtctttatagtcacatgatttgtaatcctttgggtatatacccagtaatgggattgctgggtcaaatggtatttctgggtctagatccttgaagaatcccaactgtcttcctcaatggttaactaatttacacacccaacagtgtaaaagtgttcctatttctccacatcccctctagcatctgttgtttcctgactttctaatgatcaccattctaactggtgtgagtggtatctcactgtggttttgatttgcatttctctaatgaccagtgatgatgagctttttttcatatgtttgttggctacataaacgccttcttttgtatatctctgacttttctccaaatgaggtttgaattacacaacctaatgacttaagcaactgcaaatatcaaagtttgaaggtagcattggagaaactattttttccagtgtcaacaaaatcagataaaacattatatcaaacaagcagtgctatgaaaaatgtttcattcgaaaatcacaaacaggagggaaccctttttttttttgaggacttcaggtctatttccacagtgaaatgaagtgaaacaaatatattctttttaaaaatagcaatgaaatgaaagtggggaggatgtttctcttttcttcccagtttcaactaaatgttatatcctgggtgaaattctttagggtccaataccaatgagaagaaacaggttatctaaattttcctggggaagcactccaactttcttttggaaattaaacttttcacttatttttcttcctaactgagcttgcacacattaataatatgtatcttaggtgctatatatgtttatcttctagatagccaagtatactgaaaatgcacatctctcaattacacaaatacattaactccaaagattattttgttacattggcatcagacatgacaacttacactaagaaagttaactcatctttttgttcaagtcccttgcagggccatggatgaagctggaaaccatcatcctcaacaaactaacacaagaacagaaacccaaacaccacatgttctcacccataagtgggagttgcacagtgagaacacatggacacagggagggggcatcacacactgaggcctgtcgggggtttggggggaaaggggagatagagcattaggacaaatacctaatgcatgcggggcttaaaacctagctgacaggttgataggtgcagcaaaccacgatggcacatgtatgcttatgtgacaaaactacatgttcagcacatgtatcccagaacttaaagtaaaataaaagtaaaaattaaaaaaaaagaaagctaactcatctttttaatgaataaagtatatatatatgcatttgtgatacttgtgttcagcctgtattcatgactaaaattcacaaatgcagataaaagatatctagaaggtctgcaccacaatgtttctgtattctgaaaattaacttacttttaacttttaaaaactttaagttaaaacattttagatggtagatacaatccaaaaggcaagttacctgaatatatttaatattttttattttgaaaaagttttataatttatttaaaaaacttctaatgagaaaagttctacttgaaacatggtagttaagaaaaaaaatgagatgtacctgtggggccaataaatgtatataattattctatcaataagaactcttttcaggaattaattagaaagccagaggagtttctgaaaaaatgttactttgttactaattatagaacatgaaaattggtggggaaaaattgataagggacaaaataatgccctagaagtcatatatttgaagttgggaagttaaacaacagcctacaagcaattactgattttccagacaggaaagtggttcatcaagaaagtctcttgagattttctgactctgaaagtgagattttacaaatgctaattttaggacaaagtaccatattcacacattctttcatatgaatattcttccttactgataattacttgcacttagagatatattatttcttaaaattttaaatattaaacatatatttcagtaaaaatgtattatctaatccattagggcagccctcatcttctgcaagtctctcttcagaggttacagcagtaggtttttgttaaagtaggtttttttgatcagtatgagacatgggcagaggaggcatgaaggcagaggctcaagtacaggttatggctgggaagttacacactaggaatggaccctgggctatgattttgacttccaaaatcacttactctaaataaaatattttttttacttgaatattttcatgatgtagtatatttttttaaagtgctttcttagaatctatgactctgttacagaatttgcattaatgcttataactcccccaaggtcatcccatatggctagattagcattgaggctaaaataatcatgaattctgaaggcatattatctagatgcaaatcctgatcataatggcttccagtagtatggtcttggattactcaaacattcggttcctccattttttcctctataaaatgggaacaataatgatatcaacttcagaaggttattacaatgattagattaacaaacattaggttattgtgatgattagattaacaaacataaagtgcctggtacataaaagcattatgaaagtatttctattatttctctaaatagtggctctttgatatttcaatgtacttctttattcatgaatctgttcattattttgttaacagtggaactctttttagaagatttcaggtgaaagtacaacacgaaaaaagatctgctctttaagagtatagaataggggccgtgttctggaagctccctcacgtagtgctgtggaagtctctcacaccccagagcataaatagaagacaaattccttaataaaatattaagtgcagaatatatcttcctagccatattctcctgagatgcctaaaggagtctagtgatctactaacaaggtgtttacaatgacatttatcatagaaaaaagattcttccagatatttgagaaagaaaactgtacagcaaacacaagtttacaatcaattagaaatatgggagggtcaatattcatgtgactcacacgtaacataatttgatcttgagaaaaatttaagaaaaagtaaccaaaaattaactgagagaaatgtgttaaaaatgtacaaagttattaccataataattacaaaaccactaatgcaattaaacaactctatattacgattgtaagtacttatttatgagtgatgcttatttccaaaaatttgaaaagatggaagatttatttaaagccacttacaaatgtccagtctaagtatgtaactctagttgttcttaaacatacggatgtatataaagcactctataactctatgtttttgaattgtgcctttgtatgtttttatttgtactattctattaaatacataaagtgccttaattttttttttcttttttagacagagttttgctcttgttgcccaggctggagtgcaatggctctatctcagctcactgcaacctccacctcctgggttcaagatattctcctgcctcagcctctcaagtagctgggattacaggcgcctgacaccaagcctagctaattcttgtattttcagtggagatagggtttcaccatgttggccaggctggtctcaaactcctgatctctggtgatccgcccacctcggccttctaaagtgctgggattacaggtgtgagccattgtgcctggccaattccttaatcttaacacagcccctggggcaggtgtgttggcgcacgcttgtaaccttaacactttgggaagccaatgcaggagcatcacttgagcctgggaggttgaggctgccgtaagctgtggtcttactacaatgcactgcagcctgggtaacagagtgaggctctgtttgaaacaaacataagcctcttcaaaatgtttgaaaagatgattagattttattttacacatgaactctgttgcatatattattgatgcagttatttatctagaagtcttatactttctatacttcagaggactctctctatgtgtatatatataaatatatatatatatctatatatctatatgcatgcatacatataagtgtttatcctacagattatgttcttttaacacaatggtcaaaatgaagaataacaatttctgttcccttcaatgttacattgttatgtttttattttcctttttatccctcagggtaaaaccatttgctaagtggcccttactatatacaggtgatgcagagtgggtgtttctgtttcacttataaattttcattattctttagctattacacagagtggcaagggaaaaacaaggcaatatccatgcagttacactatattgctagaagaatatggctataagttaaatatatagcagcagataatggggaaaagggtgagattttgattcatggtacatctacattccactaataactattcaggttataatggtattcttatgaatttcaacactgaagcaaagtgtaagcagtgtttgttgaaattcactcaatagtgcttcactctgtaaaggcactaagcaatgactggaagaattcaaatcatcactactgtggcacacagctcattaccactgccattaaaagcgtcctatgtcattgcttatgtccttttcagacacatcatagtgacatcagtagccattactgcctataaagtgaccaaaaaaaatcagagagtatgtcaccaaattttagacttctgttttagtatgcatattcatctactttgtttaaaaaagcaaaatccaagtgtgcacaatcaagctagagagttgattgaataggttgctaatgcattctttcaatgttcccaccaaaagaaaaatagcatatttgaatttgatttggtatctttagaaaagaagcaagaatgttacctttttatataggtgagaacaaattaggtattctgttgctctctttgggtgatctcaatttacttaaaaaatcctttggttagatagctataatgtctctggcactgaaagttgtgactagaaaatagttttctactttaaaaacaaatgtcttggctttcctccaacatttattttcaataaatgcctacgcatttatcttgcagtaggagaccattatccagtcacaatgctcaattcctttgacgttatctcttaagtaaaacagtaatgttaagaataaaggacttggtgattgaaagagtgggcaagtatgctgggtgggtgaacaaatactgtgggtgaaaatcacccctttaatcatcatctgaagtgggaaaagcacatgttttcttcccttcagacacactgtgtaatgggacgttggggacaggagttggggtaagagtttgtacccaagtacaatgtctagtaagtccagattccagcattttcttgaataaatggcatcttcacctactctcatataacttaatctctgacattatttggtgctttatgtggcttctcttgaacatttgtgctatggagattcacacggattataacagctctgaagacctccacttgtcctaattagggtgctctcttaataaggtccctctgtactacaacaatctgtgtgctgcttctcttcttccaattgtcagtggagatttttctcttcctgtattttaattaattcaggagactaaacctattttaataggaagtagtgtctgaggttattggtatctatgtatatacatctattatcagatttattttctgtattttgtagccaattactattacagtggcgggcgggtatcatagtgccattgtgaagaggagatccattatgaaaaatcagtaggtcagtggggatggaaatatgtttaagaaaaaataattcactcgacgtaaatctgatcatatcacttctctgcttacatatttcacttaataaatctcttgctaggtgttaaattctgagctccttaacatagaatggcaagaaactttttagcatagaacactaagacatgccaagggctagcttatctaccagtctaccactactttgggaaagcagtatcagactatcagtcaccacacctccaacccccatcttgcacagggaccataaactgatattttgtctgtctaatacagaaacactgcaagcaagctttaagacaaatccttttgcctcccaagaagattgctgccacaggtaaagtgatatagaagtgccacctaatgtttacattttagactttggaatcccactcaaaatgtaacaaattcaactgtctgatggttgagactgaaaattggatttttttcatttctctaagtttttttttttttgtatactaaagtttgagaatgattgttttatggctttattcaattttactttccttaattttctcacactcatcacctccagtgataataatctttctctttcctaatttctatatcaccttgtttataccacttaagtggcacccatcacatgttttttttttgtgctataaataattgtaaatatgtctcatcacctatggggacagaatctgcatttctcatatactagcacttctgcagaacttatccagaaccctagtccattgtaaaaagccatttcatgatcacacaaaaacttaaaaggaagcactgtctatatttaactttcagagtagaggggtatcctgaaatgtaggctatccagtatcagcatagatgtaaccttggtccttgaaactcctttttctgaaagctgctttcagttatgcaaatgcttgaagaggtaggaacggaaaggaccccaggagctatgctccagagtggtcagaaatcctttgctgatgtagaacacccaagtcttccttaggataatctgtgagaaacatcttttttcagccttagtatcataaaaaaatgttcctctcctgaacaagcagttaatttttgtcatatagaaataataactcttagactggattctaaggcattctgacctttatacaattagaaagctcagaagcaaataagcagcctaactcttataggtgcagaggtatgtgatatggatttctgcatacaaatgttattcctggctttatttttggacaaatggacatttattctgattttctcaatagtttgccatacccttttgtactgtatcaactcctctgtaagagtctctaaatcctttgtgtaattagctgggattcaagcaaagggaagaattttaaattatttgcatccccttttgtgtcaacaatctgttttcttctgccagataaggtgtcatggtcatcactgtaaaattttaatttttgtatacattggtcataaatatctttggtgatgtagtatcctctatattttctacggttcattctcctcagatggaccagaaaggaatctgtgtggcccttcactctgattactactcttttattttaaatatgaaattgaaaatatcaaatttgaaaaggaacttcaaacaaaacactatagtacaatataaattaaacagacattattaacttaaataacattcatgtcatgttaaagtagtaaaaggaaaatattccctcagataacgaggtcagccagtctcaatattttaagatcctctttttctgagagtgtccagttgtcatcaaaaatgaactctgatgatctttcaattacagtgctttgggcaagtttttgttcgtttgtctgtttcattttagattgctaaagaatttctgtgaaagttcacagaaccactggtaccctgaagtcaagtctcaattacctttggcttggggaatagggttacatgaacacttgctggtgatttccaggcatcccttactcaattccctcaatattcccaccaccgagcttttcttagaagggctgttaacaagaaaccaaatgtacagatttgagttttgcctcatttcacttctgcaagattacagaaggaaactgaaatttctaaaatacatcttgtaggaaagagaacataaaaagaggaaacaaaggtaatcagaacacagaataactggcacctgaattcctgggtatggcctgcactgggaatgcactatagaatctgaagggattagtcaccatttattgagcttgtctagaaggagagcaggaaaagcagaaagtacttgggaatgagaacaaataattctatgcattagatgtattttagttctacaaaacgcaaaggacacactatctgaacttcctttcaggtgttcacgtgaaccttcctaggtggagggctttattaatcagggaggccaaataaagcctagacaccctgacacagaacatgttactgagtcagtacagcaaaccaagaagccttggaaagatacacatgttagctgaggaataaagaagactgaaatacttatcttctcttttcagttaaaaaggatttgtgacatattgtcttaaaacatattctctagtgtatgtctgtgccaaagattataagggtcaggagcgtaggctatggatttggtcagctgggttcataatttggactagtcattttggactcattgtttaaactctctgtgcctccatttctgtatccgtccattggagataacatgaatatccaccttgatggactatatgaggattacatgattagtctggaacacagtaagagcttcctccatgagaatcatatgattcatattttaactctatcttcattctgatatgcaaataaaagaatactatattgttcaggctggtcccaaactcttagccccaaggaatcctcctgccttgacttcccaaagtgctgggattacaggaatcccagcctctgcacctggcccttgcattttttatcagcttgatttttgtcccccacatatctttggaaccattccctatgtgcacatgaagagcaccttcactttttaacaattgtatagtacatcgtagcataactataaaataatttatctgtccagctttgtattgctggaaatttaggttgatagctcgtaaacacaaacaatactgccaaaaaaccatatatatatatatatatgtgtgtgtgtgtgtgtgtgtgtgtgtatatatgtgtgtgtgtgtatatatatatatgtgtgtatatgtatatatatatctgttatgttttcccaataatcaatatttaatatctaaggcaaatttattttttctcctggaaattacaacaaaatctgcctcatttgttttcataacattttgcattctttggcttctggagttagtccagagacaaactcttcactctgttgccttcacacaaaatagctggttaagttttatttgtaaatctcagtagattcctaacacactcagagaagaaaaagcaaactcagaataatttaccaaatatgaatgtagaaacgtgtaagcatgacgaattaatgataactatgaattatgtctacatagttcacattacagtaccatagtctcagaactatcttgacttctctcagagttgtaataattttaaatgtctggaagaagattctcttcttaaatatgtaggaaaggaattgagaaaaagtcatgcataaaaaaggtaggacgtggttctttttgcttatggtttgagtgttcactcagtgtttttatagaaaacgctaaatttataataactctaatggatacaaaagagaaaacactcctcattacttgtactgcttggtgttgttgtatctttattgttcttattttcaatgataaaatttgaattaattcttcaaaattttaatgcagggagaaatcatgtgggagccctctggtggccaaaacaatgctattcaatgttcactagagaagttcaggctcggtcaaaagactgtccttgaaatcctaaaactttactacctatttcatgttgatatatttagagtatcttgattcaggttaccaaagtgccaaaatattttaatgtctgttaccaaactcttaaagtaacattttcagtgcagaagtcaatattaaaatgtataaaaatgttgtatttttaaatgaacatagaatcataggtgactttagagcaacagaactattgaactacagaattttataacaggaataaatcttagagttaatctagtaaaattcacccatttaatgaacaaagaaataaagccagtttaggttaaatactttgcatatgtctcagagtaattattagaagggctggggctgggagtccacttctatatattgcaatcttgagtgatctggaaaaatgcggtcatttaattttgccttaatttcttttttctattcactttacataggaccttgtcttacgtatatattggccttgttttcatgcctttaaaaaaaaaaatcctgcttctgaaagttttctaggttgagttaagcatgagcatcaagtattttatagtttaaaggtaaaacagagaaataaaaacaaaaaagaaaacaaggaatatattagttttctattgctgcctggtagattaccacaaagttggcagcttaaaacaacacccttttattagttcagaatttcaaaagctcgggtctgatgggtctctcttcctcagctatcacaaggctgaaatcaaggtgttggctgggctgtgagtcatctagaagctctgaggaagcttccaagttctttcaggttattgaaaaaaattaacttctttgtgatggaatgactgcggtcactctttctttctcgattttggctaggggtcactcttagctcctagaggctgctctgagctccttgtccccacatggcctccttcttctatgaagccacattgaggaatccccattttggtgaatccccccacacttcaactcacttttaggaagtgcaagagctatttataggccagttttacccatgatggttcctctttcttaaagttaactgtcccatataatataacctaatcatgataatgactgttccatcatatttacaagtcctgggatttgtacagggacatgtatgggtatatgaatcctgggggctattttagaattctttctaccacaacaaaataaaattttcttactaaaatacatctcagttcaaaggaagattttatacacttttgcagcttttatacttctttcaatatcttaaatgtatattttatcatacctacagagatcatatattaataaggtcttgtaatatgaaaatattggctttacaattcaataacttttcaaatgaattttaaaaacctacatttttttttgtggtaggctctctcctagctgggaattcatcagtgaatgaaacaaagtttccttcccctgtagaacttacatgctattggagagcgatagataatacacaactatagccaataagtaaattatctaatgcattaggaggtaaaaagtgctatggaatgatagtaaaggtatcagggtaagaaggatttgaagtatcagcaagggattaggtaagtaagatagcatgaagtggggtaccatgggtgcttctcattgagaaactgagatttgagcaaacacatgcaagaagtgatggagttgtgcatgaagatatctggaggaaaaataatggagggtgaggtaacaactagtgcaagaggcctaaggatagtccatgcctggcattttcaatgaatagcaaaggaggaaaatgtgacagtagtggagtgtggacaaaaaagaaaataaagggaaaggtaccagataattaggtgccattgtagagtatggatgaagttggtggaggatggtaacaagtatgacttaagttttagaaagaccactcttgcagctttattaagaatgagttgtatacaatttggtgagtgtggtatacacttgtgttactatcaccacaatccaggtaataaagttatctatcatcttcaaaaggtttttgggtcctttattttctggtttttatataccaattatacctcgaaaaagctggacaaataattatatattatcaactgtaaaagatgagaatgaattataatggtacaatggtagaagcatggagatccatcaagaggctattgctgaaatttaggctacagatgactatggtttggaccagttttaggagcggaggtgaaagaatgggcttaattatgaaaatgtgttgaagatagatcttcatagcattttttatatattggaatgtcatgaataagataaagagtgggttaaaaaccatttttaggtttttggtataagtgactgaacacaaggagttgctatcatttgagatggagaagatgagaaaagtcagggacttagtttttggacaagtttcattttatatgttttctagatattcaagtggataagtcaagcaggaagttggatatgtaagtctggatttcatgagaaagacagggcctggagatgtaaattggaagtcacaggtatacagaaggtgtttgaaagccatgggattgagtaaaaacacaagggagagaatcaaggtataaaatagaagggtactaatgactgaaacctggagcatttcaatgttaataggtcagaaggatggtgaaaaatgagtaaaggaaacatgaaaagagaaaccagtgaaacagaagaaaagccaaagtgtgtagtatcacagacgccaatagaaaaatgattaaagaggaaggagtgataaactgtgtcaaatgctaccagtaagattaaacaaaatgggtccagagactagagcattggatttagcaatattgaggggattggtgacattgacaagttttagtggaatgatggagtaaaagcctaactatagcagttttaagagaagaggtataaagaagaatcacagaaaaaggagtatagacattaatttcaggaaattttttctgcaaaagaaaaagaaccaaggaatagggagagtgaatctggcagaggaaatggggacaagacaattttgtgtatgtttttttaatcttggagaaataacagcaagtttgtgtggttatagaaacaacctagtagaaaggaaaaattgatgtagaagagagaggagagctgctagaatgaggtctttggcttggcggttgagggacatctaatgcagattattcttgttgtataacagcactggacttatttttttcatgacccatcacagtctattgtataataaacaaaccaagtgaaatgcaaacacacatttaaaatcatcagagcatattcattatgaatcatatgagtgtttgccaccatttgcaatagattttactaaataaggccagcttttaagatgtcattttctccatttcaatcacgtttgaagaaagaattgtgttggaaaaagtagtgatggggagaagtaggaatatacaagaaggttaattatgtttatcagaagctgcatcttgaagaaacatagttcaagagtcagaagacccatgtttgagtttcaagtaccactgactagtttttctacatttgcaaagacaatactccctctaggtttgattttcattatgaaaaagaaatacattctgttgatgatctccaaggtccattctaataaattcaatacaaaaacattccctgaatttctgctttgtataagagataagatataaagctggcaacttgctaccagtgaggcagcagaattatagttaacaaacagaaaattagagggaaatacatctgtaaaataaggtcaagcaaccgggtataaagcatccaagggggatttgggtctcaaatataatatgcaccttctgccttctctcattccttctcttcatttatcaatccgtcagtagactttaattctcttatgcctaattctgttctaaatatacattagagagctttggaattaagaagtctcttattttaacggattcccagcaaacagctgatttagacaccagcacaatctggtttcataaatactgtgagaatttatgggtgtctggaataaaggatgatgtgcactaagtgtctctttcagttaggactttggggatgtcaaatattcttcttctgttgaaatgtaaattcctgcttctactcatggacctttgaatttaaagccagataaaatttaattcattttaccaatttttattcctaaaggtttgtggacttctcatgaccttttgtcacatggaggatgatcttgtatgtaatcattaggtctgaaatgaggaaagcttggtgagaactttgaatggcgttagtcactatgcctgggaaatcatatataaggtccctttgcagctttcagaagacctgaaatgtggctaatgattttaaaagaccatataagaatcagagagcagtgtgaggtagcaagtgaatgagggaaagaagcaaagtgattaaatataggtcttttggctataaggtaccacaataaaattattaaatcagaggatgtgctgctcaatagtttttaaaataaaaaaaaaaaatgacacagttaagagggcaatagtgcagactattttaggttgaccctgtctcaagcaattggaatatatttgacattataaaggcattataaatatatttattgattggacttgagtctttatgtctttccttttttttcccaggtaacatctttacctaccacaaccatttctctgttctctatttccttttacatttctattctgtaatgctttagaatttgcactttccaaagagagaaactatttctctggagttcagctgaacagaattcttcctgtgaacaggctatacagaaaaatatgagatttttctataagattttttttgttgctattttacaagcaagaaattaaatcacatttctgaccacaactactggaaaatcttttgtttgaagacctttttgaaacagcatattctcctattctttgcattgctgttcaaaggtacttgtaacatttggaaaaacatattatataggcaattttttcttatttaggttatattgcctgttgtctatttaaaaatatagaccaaaattatttatattatgctatttgcttattacttttccaggtaatgaaattatttgattttaagcagcatgtattctttttggtgctttaaaaatataattgcttactataatgaaatcagaaaagaatataccaggtatcttgctatgtatatctataatactttaataaatattcctggaaacattttagccttgttcatccaggaagaatttggaaaagctgattttaaataataaaaagctcagaattaaaatgaatgtcatatttttgcctttacagagaatcaattaagttgcaatcctgagtatgtacttgctaactatgccaatagtcataaaagaactgattggctcccatgctccagaaaaccaacttatctataagcttagctattctatatctcagaagtcactccaaaaacccagagagaatggtagaactaaaaagtacatgttgagaagggcctgcgcctgaatcagattcagtctttgtgattaatccaacacctttacattctgaataacaatcattaacgtcattaagctgcttgtttcttaatcgcattcttgtataggaaactcaaggcgagacgaaccaactctgagaagcccacaatcaaagttgattgcatccaaccttactgttgcacctctattaacctacaagctgtttgggcagggcttctaaaaacaatttcaggataaaaactgtctccttcagattttgctgcacttgcatttattatgaattttctggaaattatgaagcagaacagctaatgatcccatcatagacagccattatctcaaactgtgaatactggttgtcattttcagagtcaacagatgttgaccttagggtggcaacttttccttcattgtatgaacctaatcaacattatatccttcagttttctataaaatgcactatccaattagaaggtaagctttttaaaaagagaggtctaaggttaaaatctcatttaagctgcattagtctaaatgtggctttgggctatttttattagctgaagctatttatgatttttctaaggaataggaaaggacacttcggggactacaaagaaattgatttaatggtatgcatgacttcacattcaatttctataaaaatgtcccctgataagaggttgtgaagatttctaacaatctctctcttttcatctctgtcctgatcttcataaaaacagtgtttgcaaacacatagctaaattgacaaagacttacctaaagaacaattctgcagcatggctgggattcaataattattacccctcccaattaaactgaacttgaaaccaactaaacctagtcattactcacatggagatgtggtatgaaatcctgagccctgtctactttctgtggaactcatatacctcatttgaacttggttctaagctgattttcttcagatgactttcccaattaaattccatttgatgctgataatgactttattgacatctgacttcgtttgattttcatgcatctattcaatcatttttattcagcaggtgtacggagtgcctgctgcgtggaggcaatatgctgggcttcctcaaaaaagtgaaagaagattcagagacacttactttcacagctactacagattagagaaaatgtagaaagaattccatttcaacacaacataattataacttaagaaaacatttttatatgttttttgcagatagtctctagtaaggatgcttcagtgatctggttacagttcattttacaaactaaaaatcccatgtgttttcatggcagaagtcagatttcataacaaaaatgatgttttcaaatttaatatttgtggtaagtacaatgtgtttagattttaaatttccttttaatggaagtgattctaaaaatctgacagttgtttgatatttttcattttgagcattggacagctgaaaaagactatttcctgtagactgacagttgtataatagatgggaaaaaaaaaaagatgattggcaaagccataagagagaaacaataaaaatagggcagtccttacctcaatttaacagaagcaaataataggaaaaagaaatctgaatctatggaagcttttaccttagacttaggcaagtaaaatcccatttcctaaggggatgttttaagcaaatttatactaaactctttttcctgaaaataaatattgaaagatttgattaggctaagtttgtgacaaggtctatgggagtgtgaatgcatatttatttacatctctgaaataggtaaattgggaaattatctagaagtaaagctgataatgagaaaaatacaagatgtgaattaagtataaagaaataaagttatttagtagcaaaaataacaatctagtcatggtatcaaaattaatatgtaaaggtaaaatgttatttagcaattataagttattttcattgtattatattttctataaataatggtaaattcctgcttgatgatagatagctttacagtttttaataatagatacattcattgaaaaagatttccaagtgtattatgtgaggaagtggatttgataagtcaagagtactgttattcagaaatatctttcacttggtgacagggaaatatagcttaaggcaaagcactgaagccagatgtgtacacagaaattaccttaaattctactaaaacgatgtaaaaagaaagaactgcagtgccaaatagagatgacttggttaatatttgaatacatggccaaatattttcagtcctgaggttctcaatatattgcatataaagggataatttccaggaagaatacagctaatcatgtcatgtttaaatccattttagtttttgtcattagaagtgcaggtaatttgggggaccctataggtcaaaggcttacaactcaattgtaataggaacttaaatgcttataaccattcttttcgcatataatccttacagttgaaaatgcccaggcttttctcccttcaattcatttgagatcattaccaccggggatatctttcaaaaatatcaattcagtcatgtcatattgctgcttattaatattcaataattccttatcataatatttaaagctgctttgaatttatttctagattagtattatcttagtgtcctatattttagcctttcctggcattcctcaattttatacctgattaccttgttcatagtgttttttaaaatgcaccatggctctttactgccagattcaattctactgttgatctttttttttattgatacataacagaggtacatgtttttggtacatgtgataatttataaagatcaaatcagtgtaattgggatatccatcactttaaatatgtatcttttcttcatgctagaaagatttgaattattctcctctagctattttgaaaacacaatatattattataaactacagtcactctagtgtggtcttgatctttcagtctcaagattaagcatactatctttctcatgtccacatggaagattagatttctcccttggtagctttttgatagtaactactattcaattaaatattatacaactatttatcagggcctaccatgaatgagaaaacttctagaaatgggcatacaggaataaacaaggatagaaaccccctagcctcctggggtttttctcatatatgttggatatttaccataataattcataaactccttttggaagagccaacgttagtcattcttgagtccaatcagagagagtttagtggaaaacatggcacttgttcaaatgttgacttaaaaaaagatcgagtggaattaaacttctataatattgttaattcccacttggaaaaccattcctcttttatatcacaagtcagtaacacagggagggcatcgcaagggatggcaaatatgtggttgggaagtaagtatatattatacattcatacagtatttctatagtatttcctcaaaagcttccgtatttatgactttttgagaaatagtagcagattctccctttattataaataaatatataggcatataaaacacaaataagtattgggatcctaggaaacatacgtaaggttttgcctcatactttgttaagggaaaaaaacaacattttaaaatatcaaccaactaaaaactacaacacagtgtgatatctacaattcaaggatgatacagttcaaggatgaaatgtatgagagcaagaatggggtcccttgtggtacttcattgtcaacattgtcagaaaaacatcaactaatgtgtcttgtataacttcatttctaaaagatatatctgtcccagatgaataaaaaagggcatactctctgttcttgaaattcacttacccctaagaacaatttttagttgactctcaaggggccaatacgtgctcacagcctgccaatagaataactatccattgtttctttaaaatctataatacttttgaagtctattaactaggatttccttgatagaatagcaaatgtgttgatagttagcaggcttaacctattgccttttgaaagtgatagcataaatcagctatacatttctatggagaattcacttttaaaagaaaagaatagatagaataattaagtgtaagaaaacctttcttattggtgtaaagagtggtcagtggtggaacgtagattcttgtaaatccttttatcaaatgtttaaggagttatctaattaacaggaggcagctccagtttattaaatactattaatctcccagtttattacccttttccttgagagttctggaactgtgctaacaaaggaagaataattatcaggaaatcagtactattttgtgctttttttttttttttttttaactgtacttgtggtcacattagaactggatatgacatatctttttttggttgtttcttgtttttgtcattcaaaatagggaatgataaggccacaagagcaattactgatcaacaccccaaaaggcatctaaaatgcctctcagaatcataacaagtcttaacattctagatagttgtaatggacccagatttagaaatcctcatatacaagctggcatcatatcccttatacctgaagaacaaaatctcatactaggagatctgaaacaaatggattctcaaacatttctatctctattttacttagaaattaactatattttgctatgagttgtagcattttatttttaaaggttaggaaaaaccattatgtcgatcataaattgctagaacattggtgtagtttcagcttttaggggactgagattggctctctgttcaaacaaaatcttaggtgttagtacaataggtaaagctcatagatgcagggtttttctagctaagtggaagtggtcttggcacataggcagtgtgtggggcctgaagctcaaatattcagcagcctttcctacaggtgaccactctagattctctaagagagctttgtgagcctgtagaatctccacaagcaaaaacttagaaaccatcgatatatttttttcatcaaatacatttgacaactgagggaactaaggtccagcgacagtaaataacttttttggtgttgatacttaattatttactttgcattatagttttaagcatttttccatcttattaatgaaattataaaaaagtgttcatcctttgtaattcattatatccccacactgtctgacacacggcattttatggtattagttgaaggctaataccactttagaaaacattttacataacttctataatactttacatatttacattatcagtattgtttaccaatattttcatgtgccgatcttcagatcaaggcctattgcctctcttaaatcaacatgaaattagctttgggaatagaaatattgagtctaaattgatagactgatcgtttttctctgttgtggaattagctgcctaacacagttttatatgcacataaagtctgtgtagaagtattcactcagaattcatatacaggcactgttctataccctggattacagtagtaaacaaaattgtgaagagaattttcccccgaagtgcttacattctaatggagggagtaagacacatatggcaaagagaaagtatgtcagatattggtgagtgttggagaagggaatgtattttgagacatggacagttgcaattttaaagaaagttgttgggaaggccatattagaaggtgatatttgagcaaattgttgaatggtatgaggcagctatccctgcacatatacgagggaagagcattctatgcagaaagaaaagtcctaggctgagaaacggtcttgagtggcagaggcacagtgaggattatagctggagcagaaagaaagaggaaagttatggaggcaatggagggagaaaggaaaaccaacagtgaggaaggaaaaacgagcaaggaaaggtcccatttatataaagacctttaggctgctataagaattgtggctttattcttagtgagatatgaagcagagggttttgaggtgaggagtgatgtgacctgacttcatttcggaaggttcagtttgtgctgtgagcagtgttgagtgtggatggaataaaaacagattaggtagaaggccctttcaataatccaggcaaaacctaatggtggcttagactggagcagcagcagagaagggtgtaggataaggttaagttctaggtacattgagattgtacatctcacaggattctctgatgaactggatatgactgtgagagtcaaggatgactcccatcttacctgagaaactggaaacatgtcaccgtcataccctgtgctggagaacactgagtaatatgtgctggggctcagacagaggttaaatactatcagcagagaggacaaatacaaaatattggatcacagctttttaaaattgttctatgttacagggaagttgccacttagcttaagatcatgtgtctctattatatgaccagagatattgactaagcctcatatccagcagtgagatttaaaaggtagtgttttaagtgtgtaaatgcaaacatataatctttcacatatagttggtattagccttaatagagactaaagattatttttatgcactgaagaaataatgtctttattcattcacctctattttacaatttttaacagaatattgaaaatataaacagttgtttaactcatgaattccctaattgtgcttttctgctgaggatgttggcctgctttctacctttatctgaggtagttctataaaattccatttattgcaggggagtatggccaatacaactaaatggacagctgttcatactggtttaaaatacattataatcaaaagcttttaataaatgtctatgttttttcaaagcaaagattatagactattaaatgggcttaaatagacaggtcaagaaaagatcagccaaaggttttgcctccttccttgtgtgctgtcgacctacagcataacccagtctctctatgggtctctcaaacagacatttttcacaactaaaggcctcatctccaaatctataacccttagaatatctaaactctagttatattatacagcattcttaaaatgatgaatataaataaattaattcattcattagaattgtggtaactgaacatagttacaagaaaatattattttgatgtaaatatagcatggatctttgcagatattaaactataatattataaatctttacaaagatattctgagtaaaattctgccattgaagttatcaaagttctgaggctacaaaaattcctaggaataagtctattgcatgagaattcaaataccctacctatctaatgaacaccagatcatatatggaaggaactcctgtgaaataattaccaactgaccaattttattaacaaataaaactaaaaaagaatttagatttattaggttgcataaccgactatatatatggcttacacctgagtgttgtaatttttttaagcagggattctttttggtgaggatttacgagacgttttattttctcctttgaaaagtattgattttgaaagctttataaataaacagcactgacctatctattcttgaatcattgagagtaggtcacctgtggacagcaaatgattttcatttcctggaggtaaattttattgaagagaaagcaaaagaaagggaaagcttaatttataatgccaagtgagattactgaaattcagcattttaaaaacttctgctctatagggtttgagaaagcactagctcctaaactgaaatgaataggctggttctgtttaatcagacagaaattttataaaatggccattagtaaggaaaattacaggaaatagaaacatatcatccatcatcataccagttacatttcttatttgacactgattttagtaaatgaaatatgcaatttaaaataacgaatcattaagaatatggaaaaattcttccgagtaaaaaagaggttacaaaaaagacaaaataaggtcctcattattagtaaacatacatgtaataaaaatgaatagagctaaatacattaaggtaaaaaaaaggtcaactgatctttgggtaaagagatactgactttttttttctacttttgtgtatttcctgaatttatctcttcactatgtataactggttttggaaataaaaatgaaaaaaattacaaaatgtcctgcgaaatttggtagtaaaatgaaacaaatctcaggatattgtaatacattgaaaaatgataaattttaagaaaagtttaaaaaataaaaaccctttgtcccacagaaaatgagtttttgatttataaatgaagaaagctaatataatcagtgttacgtggggttatttatatttatacatatttatgctaaaatttatattctgatgaaatgttttttaaagtttctacaagggagaactagaaatctatatagattacagtgggggaggtggaattcactagaagttaactggaaggaaaacaagaatacaggtaaaagtatcatttcaaggacatcagattttagtattttacagtaaataaaaggaaaaatatacatattttgaaaaatgtaaaatattcataagggacaagagaagaaagtcttctttcaccacattgacattttggcctacaattatattgtatttagtgaaataaactctctcccaattgtaagtaaagttacaaatgaaatacataaatttgataacaactttggatgtttttccaggtacaggatctgtactgttcaactgaagtctaatttttgtatatattagaatgagtaactatcattggaagtttggcattaaaaaaaacagtagattgccagaagttaaatttttaggctatacaaatgggagctgtttccatcaaaactgccagagacgtgttcggacaaaaaaatagctccaatttcctgggtgtggagaggctatcacaggctcacatattatatgctaactcgaatttgcaaagcaatctgagaagcaccaaattgctgtaataagaaaaggtgacatttgtacaatctcacagtctttttatgtattctgttcctagaataagataatagaggtctattttctgtctcttccaaaccctgtcataagggagagctactagcacacatgagtgcccaataggtcatatgaggaacaactgggtgacatcgtatatgttgacgtaaggacagctcagtctggcatgattaaacttctgaaaacatattattcatctttatttagggccataaactactcaatatggatcccatttcagtgtgtacattttatttacataattcggcccaaatttgattttaagtatgtcaaaaactgatcaaggcccatggggtaaaacgttagacctgcatttatatcctacttcttccacttattaaccaagtgaccctagtaaattcacttaacattattgggccttatctccttcaactttaccatagaaattatgacttgagcctcacaggattttatgaggtttatatgagctcacatgtgaatgaaatatactagcataaatcgggcataggaaaagacaggtaagataataagtgttagtccattcattccttgttaggaatctacatttgcatcctttcatctactacaacactctgagagatgtaacatatttcctttaggctgagccatttactgtagcagtgattcttacaatgagtgttggggactgatgtccctagcaaagaatattaaagtcagagagaggctaggttgaggcaataaagatgacagtttgaaaaagtcccaaagattattcttaaatgtcccactcttagggggaactcttgaaatcattttggtggactaattcagttaaaggtaatgacactgaataataaatatgaacctagggtaggaaaaatattcctatttttagggtattacaaacaaatgctgcaatggatatctttttttaaattttattattattatactttaagttttagagtacatgtgcacaacgtgcaggttacatgtgtacacatgtgccatgttggtgtgctgcacccattaactcgtgtcgtcatttagcattaggtatatctcctaatgttatccctccccactccccacaccccacaacagtccccagtgtaggatgttccccttcctgtgtccatgttttctcattgttcaattcccatctatgagtgagaacatgcggtgtttggtttcttgtccttgcgatagtttgctgagaatgatggtttccagcttcatccatgtccctacaaaggacatgaactcatccttttttatggctgcatagtattccatggtgtacatgtgccacattttcttaatctagtctatcattgttggacatttgagttggttccaagtcttccacaatggttgaactagtttacagtcccaccaacagtgtaaaagtgttcctatttctccacatcctctccagcacctgttgtttcctgactttttaatgatcaccattctaactggtgtgagatggtatctcattgcggttttgatttgcatttctctgatggccagagatgatgagcattttttcatgtgttttttggctgcataaatgtcttcttttgagaagtgtctgttcatatcctttgcccactttttggtggggttgtttgctttttttcttgtaaatttgttggagttcattgtagattctggatattagccttttgtcagatgggtagattgcaaacattttctcccattctgtaggttgcctgttcactctgatgatagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggatttttatggttttaggtctaacacataagtctttaatccatcttgaattaatttttgtataaggtgtaaggaagggatccagtttcagctttctacatatggctagccagttttcccagaaccatttattaaatagggaatcctttccccattgcttgtttttgtcaggtttgtcaaagatcagatagttgtagatacgcggcattatttctgagggctctgttctgttccattgatctatatctctgttttggtaccattaccacgatgttttcgttactgtagccttgtagtatagtttgaagtcaggtagcgtgatgcctccagctttgttcttttggcttaggattgacttggcgatgcgggctcttttttcgttccatatgaactttaaagtagttttttccaattctgtgaagaaagtcattggtagcttgatggggatggcattgaatctataaattactttgggcagtatggccattttcacgatattgattcctcctacccatgagcatggaatgttcttccatttgtttgtgtcctcttttatttccctgagcagtggtttgtagttctccttgaagaggtccttcacatcccttgtaagttggattcctaggtattttattctctttgaagcaactgtgaatgggagttcactcatgatttggctctctatttgtctgttattggtgtataagaaggcttgtgatttttgcacattgattttgtatgctgagactttgctgaagttgcttatctgcttaaggagattttgagctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgtccattcagtatgatattggcggtgggtttgtcatagatagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacatttattgatttgcatatgttgaaccagccttgcatcccagggatgaagcccacttgatcatggtggataagttttttgatgtgctgctggattcgttttgccagaattttattgaggatttttgcatcaatattcattaaggatattggtctaaaattctctttttttgtttttttctctgccagcctttggtatcaggatgatgctggcttcataaaatgagttagggaggattccctctttttccattaattgtaatagtttcagaaggaatggtaccagctcctcctgtacctctggtagaattcggctgtgaatccatctggtcctggactttttttggttggtaaggtattaattattgcctcaatttcagagcctgttattggtctattcagagattcaacttcttcctggtttagcgttgggaggttgtatgtgtcgaggaatttatccatttcttctagattttctagtttatgtgcgtagaggtgtttatagtattctctgatggtagtttgtatttctgtgggatcggtggtaatatcccctttatcattttttattgcgtctatttgattcttctctcttttcttctttattagtcttgctagtggtctatcagttttgttgatcttttcaaaaaaccagctcctggattcattgattttttgaagggttttttgtgtctctatctccttcagttctgctctgatcttagttatttcttgccttctgctagcttttgaatgtctttgctcttgcttctctagttcttttaattgcgatgttagggtgtcaattttagatctttcctgctttctcttgtgggcatttagtgctataaatttccctctacacactgctttgaatgtgtcccagagattctggtatgttgtgtctttgttctcgtttgtttcaaagaacatctttatttctgtcttcatttcgttatgtacccagtagtctttcaggagcaggttgttcagtttccatgtagttgagcagttttgagtgagtttcttaatcctgagttctagtttgattgcactgtggtctgagagacagtttgttataatttctgttcttttacatttgctgaggattgctttgcttccaactatgtgatcaattttggaataagtgcagtgtggtgctgaaaagaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctgtgtaggtcacaaaggacttgctttatgtatctgggtgctcctgtattgggtgcatatatatttagggtagttagctcttcttgttgaattgatccctttacaattatgtaatggccttctttgtctcttttgatctttgttggtttaaagtctgttttatcagagactaggattgcaacccctgtctttttttgttttccatttgcttggtagatcttcctccatccctttattttgagcctacgtgtgtctctgcacatgagatgggtttcctgaatacagcacactgatgggtcttgactctttatcccatttgccagtctgtgtcttttaattggaggatttagcccatttacgtttaaggttaatattgttatgtgtgaatttgatcctgtcattacaatgttagctggttatttactcgttagttgatgcagtttcttcctagccttgatggtctttacaatttggcatgttttcgcagtggctggtactggttgttcctttccatgtttagtgcttccttcaggagctctttttgggcaggcctggtggtgacaaaatctctcagcatttgcttgtttgtaaagtattttatttctccttcacttatgaagcttagtttggctggatatcttttcaagtggaatcacttggtcaaagagtaatgcacactctccattttgagaaaccttttaatattaccccacaaaaaataccagtttagagtctcacaaaatatgaagactttcttcttctacatctctgcaaacactcaatgttatgtatctttaattgccactatctctgatgccatgctcaatctgacagtttatgttccttagccatcaaattgtatttttggaactaatagttttcacagaggctgtatagtacaaaggttaaagacatggactgaagacctggactttctcagttcaaatacctgttctacctctttttaggtgtgtaatcgtggacaagctacttaaactcccagtgcctcagaatcctgctaaatttggtgagagaaataagtcaatttaagtgactttctataatttatatgcaaagaagagtacctaacacctagaaaccttgtagaaatgcttgttattagtatttgtattagtttcttagtgctgctgtaacaaatcgcatactacataattagtggcttaaagcaatagaaattacaattctagaggccagaattctgaaatgagtcttatggggctaaactcaaagggtattcaggactggttctttctggagtctcccagggagaattaatttcttgtctcatctaacttttggtgactgtcagcattccttgacttatggtcacctcactccaatctctgattctgccagcacattgccttctgctcttctctaatgaaatctccatttccttctctcttataaagaaatttgtgattacattagagcctatcaggataatgtcttcatctggaaatctttaattgcttttgcaaagatttgactatgcagggtgaaattcacaggtgccatggtttaggacttggaaatctctggggacttttttcagcccagcccagtgctcttttacattttatattggaatacttgcattattttcatgtatttgttaattttttatatattatggacattatattttatcaattatatataatgcaaatattttctcttaatgtgtcttttaatttggcttacggtagctttcataatacaggcattttaatgagcttatcatttattacaattaacacatctactagatggaaataaattaagaaaaatggtacatccatattatggaattgtacgcaaccataaaaatgtgcatctaaatattaacctaaaaatattccagaaatattaagtgacgaaaaagacagattttatgtaaagtattccatcatatatataaaatgatagactgcaaaattctagatagctgccaagggggacaggaataggaggtaaaataaataaactgttactttttaatctatattagttctatttaaaactttttataaggaatatagttatatgtaatttctataattaaatttttaaaacaggaacattaaagtcaaaacaaaattatatttaaggtgctatagaatttcaaaagaagaagataattacttatttctgggaaaattgaaaggagcaacatttgagaaaataaaagcagttttaactataacataaagtaaaagcatattccagaaagtagtttaataggatgaagctgaatgagggtaataaagtaaggtaaagtaaagggaaataatgacgaaatgcttccactgaattaagtcttagaaggccttaatgtaagacagtttacatttatttctcccaggttaaaaccctcaatacgttgtaacaaatggacaaactctgactgttcagagtattgccaagtttacctaagctcttgtaaaacaatgcatatacaaagaacaaggcaccagcctgagagtgccccagggccatctttgtcttacattgggcaaggtctgaaacatcaccattttcatctttcaagtctcctaaatgctctcatggtcttaagaccaatcatgaaagaaattattgttattaatatcctacctgcttatcaataacaataacagaagggacaaagaaatttgaatttggcttgatataaaagactttttaaagaattggatatcatgagcaaaaatatcatagagattcagtcatgctctcaattactagaacttttttttacaaaatagaacagattaaacataggtctataaccaaactctgtgtgtgtatgtgtatgtgcgtgtgtgtgttggcacatgtgtttcaaacaaaacttgaaagaaacatttttgttaatatcataaattttctacatcatactgaaagacaatgtctgttataccaatgttcacagcagcattattcacagtagccaaatgtggataatccaccaatgaataagtgaatgaaatgttgtgcaggtatccaacaaaatatgattctgccttaaaaaagaatgaaaatggctgggcgcagtggctcatgctataatcacagaactttgggaggccaagtctggcagatcatgaggtcaggagttcaaaaccagcctgaccaacatggtgaaaccccatctctactaaaaatataaaaattagccaggcatggtggcatgtgcctgtaatcccagctactcgggaggctgaggcagaagaatcacttgaacctgggaggcggaggctgcagtgagccaagattgcgccactgcactctagcctgggcaacagggcaagactccgtctcaaaaaacaaacaaacaaaaaacaaaaaagaatgaaaatatgatatatgctataacataggtaaaccttcaaaatattttgctatgtgaaataagtcagaaaacaaagaataaatatggtatgactccactcacatgaggtatctggaatagctgaattcatagagacataaagtaggatgatggttatcaatggcagggaggaggagttattgtttaatggatatgaaaagtcagtttgcgatgatgaaaaagtccaggaatggataatgatgatggttgcacagtgttaaaatacttaatgccactgaatggcacacttaaaaatcggtaaaatggtaacttgcatgttacacatattttaccacagtaaaaataaaataaaatgtctgtcaggatttaaaggccattctccttgtaaagaaggtagtgttaagacattttcataatataaagcgcaagaaaatgagaacttgctcatcattattatttagtagatcttaacattctactataccatgattccttttgattatgttacgtatttcagtgttaaaaaccattgaataatttgtgttgagtgtatgggcttgaaaaaagtcttcattcaaaatcatttttctactataatctatatgtataggataggtaaaattgttttctctatggcaaacaaatgcctggatgaccactaatgcaagactgtttgctcaggtttgagctgcctcagtttcaccctcctataaaatttgactttggctatagacaacttaatcagtgattactaaaaaccaaaccttcctccatcagtcaaattatcctttaaattacaacatgcatgcaattatttcatgaaatgtattgacctacatagtgtttaggactaggaattaaatttcacctttgagcccaagcccattaacttcacttaaaagaaatttggtgataggtatttaattactgatatcctacagaaattgacatttaataaagtgaaacatttcctaaacactgaagagctttaagatatgaaatgaaacagtctatgtcttgaaaatgaatccagtcttaaaaggaaaaaaacattaatagagtcatgttcaaaagcttttaataggactgtaagactgaaatagaacccctcgggtctcttattataaagcagtataacattttgttcacagtctcaggatgaaaaaagaaaggcgggatccaatgaaacaccaagttatacataaaacataatgtggaaaatatatatcctttagtattcagtaactttctcagtaatcccatcttaatagacactaagaaaattccaaaaaatttgggctaggagaccaaatctcagatctatattctagggagcactcaatataaaaactgaaaattttaagtctcttgtctgcagggaatgtggaaatttttaaaaagcatcatcaagctaaaggaagaatttggctggagaattgatgttggctatggcaacatatatttttttttaatttcaaaaggagttaaaacaattttaaaataaaacatataaaaacatccagttataaggtttttatgcataaactaatcatgtatgcaaatacatgtccatacatagatatatatgaatacagtatctttgtgcatttagtatagacattgaaattactataactatataaggaacaaaacagtagtcctccatgaacaaaaaatacgtcttgtgctaattcttcctggtatagaatgccacaaataagatgttttcctgtgattatcaacaattttcatcaagcatcttaaattaaaacattaatatttgtcagcaagtgaggatcatagaaaaataataatattaatttgttgagaacttagtatgtgctaagtcctttatatacatcatctcatccatatatacaactctgtaagtttggcattattattgatcctattatcagagaaacagaggctttatttggatatttgtttaaggccacatggccagcagagccataatccaacccccagctttacataaaactaaagcttctggaatggatggatgactatgaaaaatcccttcagacattgactacaaacagcttaacagtggcccagttaagcggaaaaatgttggcacagatgaaacaaggtgggtggtgggggctcagggggtggtaaaagtagctacaggaagtgagagaagtaccacagttgagacacggcagggtcatacctattaggcatacttcttaaaataatattttaactctcaagaagaaagcacctcttctagaagatttttgttttgttgttgtttcttaagactatttttttttaaagagtagttttaggtttacagcaacattgagaggaaagtacagagatttcacatatactccctctcccacatatgcacaacctctcccatcatcagtatttctcaccagactgatatatttgttaccgataatgaacctccattaaaacatcgttatccaaagaccacagttcacattagggttcgctcttggtgttatacactttatggatgtatattacagagtagtttcaccaccccaaaatcctctatgccccacctaatccacactgcaacccctggcaaccactgatcgttaaatatctccataattttggcttttccagaaaatcatatagttgataatacagtatatatctttttcagatggcctttttttcacttacgaatacacatttaagtttctccttgtcttttcatagcttgacagatcatttctttttagcagtgagtattccattgtctggatataccacagtttatccattcacctagtgaaagacaacttgattgcttccaaattttggcaattatgaataatgctgttataaacatctgtgtgcaggttttctttgaacatgttttcaactcatttgcataaatactatggagattgttgcatcatatggtaagagtatgtgtagttttgtaagaaactgcaagctttcttcctaagtagctctaccattttatatgtctactagtaatgaagcagaattcctcttgtcccatatcctagctagcatttggttttgtcagtgttctgggatttttacattctaataggtgtgtagttgtatatcgttgtttgaattcacatttctctaatgacatatactgtgaatcaccttttcatatgcttaattgccatctgtatatcttctttgctgatgtatcccttaaaatctttcacccactttttaattttttcctattgttgatttttaagtttcttatatattttggataaccgctccttatcagatgtatcctttgtaaatattttctttttccattctgtggcttatcttctcattctcttgacattgtatttgaaaatcagaagtttttttattttaatgaagcccagcttatcaattatttctttcatgttctgagtctttggtgttataattaaaaagtcattgctatattttgtcatctagaattactcccgttttattttctctgagttttatagttttgcatttatgtctatgatccatttgagttaaaaatttttgtgaagggcataggtctatgttgagatatatatatatatgatatatatttgatatattttatatatatatatatatttgcctgtgaatgttcaatgtccctctcccatttgttgaaaggattatctttactccattgtattgccttttctccaccgtcaaaaaccatttaattgtatttatgtgggtctatttctgggctctctattccataaaattgatctactttcctattcttcgtccaataccatgcagtctcgattactgtagctttgtattaagtgttcaagtcaggtaatatcagtcctccaactttgttcttctccttcaacattctgtttgccattctggatattatttctctttatataactttagaatcatttcgtcagtatccataaattaaccttctgaaattttgattgggattgcattgaatctacagatgaagttgggaagaactgacatcttgatattatatcttcctatccatggacatgaaatatatttccataaatttggttttcctttgacttcttttgttatagttttgtagttttcctcatatagatcatttattttttgttagatttctacctactgtttatttctgaagtgtgctaatgtaagtgttattttgtttttattttcaaattccacttgttcattgttggtatataggaaagcaattaccttttgtatcttaaccttgtatatggaatcttgttttagttgcttattagttctaggagttttttgattcttttgtatttttgcatagaaaatcatcttatttgcaacaaagatattttcatttttttcttttcccttctatatattttaatttcgtcttgttacattaactaggacttcaaatgtggtgtttaaaggtgtagcgagatagggaatcctttcttagttgaaaacctttgagtgtcttaccattaagtttgaagttagctgtaggttatttgtagagattctttatcaaactgaagaactctccctatatccctagttttactgagagttttaatcatgctagacatctctctagacactactttcactgcatcccacacattttgataagttgtgttttcatttcatttatttcaaaatatatttaaaattgtcttgagatttcttctttgacctgtgtgttatttagaagaatgcaatttattatttatatatttgtttttaattttaatttttgtgggtacacagtaggtatatatacttatggggtacatgagatgttttgatacaggcatgcaatgtgaaataagcccatcatggatctcctcatattttagaattttccagttatctttctgttattgatttatagtttgatttgtgatatgaaagcagacatttcttaacttctatttttaaaaagtttgttcacgtgtgtttcacagcttagaatgtggtctatcttagtaaatgttccatgtgagtttgagaagaattttttttgccattgttggatgaagtgtctatagatgccaattatatccaattgatggatagcgttgtcaacaacactatgtacttgccgtttttctacctgacgtgtctgactatttctgatacaggactgtcaaaatctctatgattgtggattcttccatttctccttataattctatcagtttctgcctcttgtattaatagtttaacactctatttttaggtgtatatatgttaataattgttacgtcttcttggagaattgacctttttatcattatgtaatgctcttctttattcctgatacatttatttgctttgaaatctgctttgtctgaaactaataatagctattcgtatttcttttgcttagtgttagtatggcatatttttcttcactcatttatttttaatcgataaatgatttttatataaatgtggcttccctatagacaacatatagttgggtcttatattttgatctactctgacaatctctgtcttttaatttgtgcacttagaccattgttcttcaaagtcattattgatatagttgttttaatactattaaatttgttactatttttttctatttcttgtccaagttctttgttctcatttgtgtccttcactcttttactgccttgagtagttttaattgtacatttatacgattcaattttctctcttttcttagtacatcagttatgctttttttttttattttttttttgacagggtcttactttgtcacccggctggagtgcagtggcataatcacagctcactgcagtcttgacctcttgggctcaagtaatcttctcactatggcctcctgtgtagctaggactatatgcatgcaccaccatacccggctaatttttgtatttttgtagagacagggtttcaccatgtttcccaggctggtctcctgggctcagcaacctacccacctcggcctcccaaagtgctgagattacaggtgtgggccaccacgctcagacagctacacttgtaaaaagtgtttgtttttttttgttgttttgttttttgttttttgtttttgtttttttttgtttgttttttagtggctaccataaagtttgcaatacgagtttgcactatagctttgttatgtattttgaaatcaagaagtgggatctccagcttatgtctttttttccccaagattgctttggctattttgaatcttttgtggttccatgtgaaatttagtattgttttgactatttctgtaaaaaaaaaaaaatcattggggttttaatgtggataacattgaatgtatagatcactataggtagtatgcacattttaaaaacaccaaattctccaatccatgaactcaggacatctttccatttatttgtgtctctttacatttctaccatcaatgctctgtagttttcagtatatgagtttttcatttccttgtttaagtttattcctaagtattttactcttttttgtgctattgtaaatgggattttttttcttaattttctttttgaatgattcattcttagtttatagaaacacaagtaatttttatatgttgattttatatattacaactttgctaaattcatacattagttctgatagttttaggggaaaaacttcttgacattggttttggcaatgacattttggatatgataacaaaagcagaggcaacaaagcttatgcacagcaaagaaataatcaacaaaattaaaaaggtcatctacgaatgggagaaaatgtttgcaaaccatatatatgataaagggctaatatccaaaatatgtaagaatctcctacaactaaatagcaaaaacacaaataacccaaatagaaactgggcaaagggcttgaatagacatttccccaaagacaacattcaaacaaccacaaggcatattaaaagatgcaaaatcaaaatgaaaaatgagatatcacttcacatctgttaggatggttttattgagaaagagagagagagaataagtgtccatgaggggacagagaaattgggactcttgcacattgtaggtgggaatgtaaaacagtacagctattatgaaaaacattatgcagtttccttaaaatatcaaaaataaaacttatcatatgatttggtaatcctacttctggatatacattcaaagaattgaaatgagaatttcagagatatctacctcccatgttcattgcagaacgattcacaatagccaagacacaaaaacaaccaacctaaatgcccaccaatagataaatggataaatgaaaatgttgtatatttatataatagaatattatgttgccttataaaagaagaaaatcttgtcatttgcaacaacatgggtgaatctgaaggacattatcttaggtaaaattccctgccatgtcaccaccagactgtgtttctatatttcttaaatttgggaattatatttttagatcaaaataactttttatgaaatcctaccatttttcttttgtgatttggcacttttcaggttttgtgctattatataactttcatatcatttccagagttattctccaactagactatatactccctaaagacaagaaaattgtcctattttttctcatactatccaatgaaccaatacctgctttaaacatattaaacatttaataaatatttaaaattttatttctgagtacaaaataagtaaacagatggcagaaagcatactatggacatacaagttcaccatgttatatccttaagagaatttgtataatgtgatttacaaagtactaactgaacttattaattctagaataaggaggccagaaaatatcaccaacttgctcttcatcatcctgagtatattatttgattgaggcaatgccatgtttggaaatgtcttaatgctttaagcaatacattattaaagttaaatgatttggctaagaaaaaattgtgattcatatattgtcactttttatatctatgcttacatttatttttatgaaaagttatcataagcttttatgcggtaccttaattatatttattggtaagtgtagggtaagtcctgctgcagtagcaaacaggcccaaatctcaagttaatatttatttctcccttacgctaaaattccagagtccctcagcaaggacgttcagctcacaatggggactcagggatcaagtctaatagaagagtagctaccttgaatcctgataatcattgttccagaaagaacaaagcattctgtgtgtttttgcaacagtaattcaatgcttgttccagaagtgatatctaaccctgctcagtatattgaccagaactaaacacaaggccctgtgcacacacaaaaagtctaataagcataaacctatatacgagatacagtttgccaacaaccacattctattactaattatattgaattcaaacaatgaagggacattaaaaacttttcacatacttttttttttgcttatagatacataatttatattttacaaacaaacatatatctcagtgtgttacttacataaaatcagtgaactagtaggtatagaagatgatgaataaatctaggcttctttggattttcggtgtaccatgttgtgtattgtaaaattttgtgtgcagtttacgtcaggtataaaaggttttatgttgaagatgatatttgagcagaagactaggctttttttttttttttttttttttttttttttttttttttttctggtgggtcaacaaccctatccaagagatagttcaatgtagaaacatcatttttgtatgaatctaacactaatcacctggtatgttgaggtcgagtttttgagctcttgcagtaagtattcactacatttttatttaacttgtaaaatatgttcctttcatggtcttggcacttgtaacaacttttctaattaagccaactcctaaaaaataaataaggagattccttgacatttaaaaactgattgctttcttaccctggttgttaatgtttcttgtaacttgtagttgttggttgtttgccaatactaataaaatgagctccttgatcactaaatattattatacagactttctattatgatgaattttctcattgctgcttttttcatgcttcactatttgttttcagatttttagtgatatttctatttggtgactgttgcagaaaacacccttatggaatgagacattagaaaagaaagtgcctctgaaacaattatgcattctgaaactctcaaacactttaaaaagttgttcatagtatctctcataattgattgagcatatatatgttcaatatatcattttttctaaacagtgtttcaaactttgaagtatttatattttttctatcaggtgctatttgggcaataggaaatttatttcctgactgaagctctttcataggttgaacaaacacaggtcttccaacataatgccaggatgtagacataatatcaacagaaaaaaagaataatgaacccacatgttctgtcttcatttaccaagtatccacttgtctgaaagcctttaaagtaatttggcattttcacctatattcatttggactttcaagcactatgaagacagccagaaattttagtcaaacatttatttgccacagttttcctccaggatatagactatttttcttccgtatgatcaacagtcttcaaaacgtggtcccagagagtaaaataaacaagaggaaagtgagataaatgagaggaaagcgaagtactagacaatctttcacaaggatctcaaaatgcttacagattctacttttgctttaagcctaacctgggtcagtaatcacaggaaaccaatcctttcatatatattttcaggaaagtgtgtgaaataaagttaccagtcctttcagtgagcaagtatttcatccataaaccttctagctactctgtggcatggctatgtgcatgcttgtgtggatgcccagactggacaaaccttagtgaaagtgaatacaggcaagaagaatgatcattctcagtatgctgggtaagggaacacccattaaaccatgtacttttctatgtatttaatatacattaactcatttagtcgacataactttggggtgaatgtcacttttaaattccgctttccatttgaagaaataatcttgtaattaaagtgaacagtccaaagatacatagaaggtaaatgttagaggtgtcatttaagcctaactatgactccagtcttatgttcttttaaaatatgctgtatcataaaacaagtatgaacactcaccaggagcctcctttgtatgtgtatctatttgcttctggaatagctgtgttgggagatttcagaagcccagtatggcctgcatcttatatgaaaatacttacctaagggaaaattttagacttcctactacaaaaagaggcaactatttgtttaccccaagcttaggtgaaattgtattacctgagtcctagtctgtaggcttagttacaatgacagcgtccaatatatgtttccaatgacatgcatcttctagatttcccttaatcctatgtgactggaatgaagtatgtgagcccctggcaggcatgagtctacagactcatgaaccacatggggattcatcacctagggttgctgacctgctaaaatgcctcacattgaaccaatgaggtacggcactgagaaaacaacttcaaatgcctctggtatgtcaagcaacatattttagtagagaagactccagcaaataagagaatgaagagtgagggtagatcccggtaaaacgaatggtggttgcattagcctttctggaagcttcaacagggcagtggtgagactcttggtaatgattaagtcttccaagtcaatcattttgaagactaatatgcattttataacaatggttattatatatatttgtagaggaggaggtgagagagttgtagcaaaatgcattttaaatagcaaaatatgaggaaaaattaaaatatttcctaattttctaaaaattaaaaccttcacatgtacataaaatcacacaaatattatgattaatatttctgtgttcattgttaaattaaccctctggatggggaaaaaaagataataaaggcaaggagtaggttatagtttataggtctgaggcttcatggacatttggatgtactctggtattttatgaaataaaagggaactgaaggtccatctcaggctcctgagccccaacacagaggcattttcccttatctaaagggagaaatgaaacaaccctttatgcaaaatctacagaatgagaattccaagaatttgtgtcctaacagctcagatgagaaataacataacttatttaacgctcagagggactttgatgtgagtgcaggtgctaaggttgattatttgttctttcctttgtcttagccagaatggccaaagacctacatttacaaaggcttacattggaatgaattttctgcaacagtaaatggaacacagtacttcagctagggcatctctaatgttttcagtgtgtgtttatgtgaaatctagtaaagacccagagaaataaatgttttatccttcctggcaaagactattttaataatacaagttggtttttcagatttgttgagagaatttctattaagcaagtggaagcacagtttagggctagagtgtctcattttggtgaatgttattttttttctttagattttaattaagttatttcttttgaaattaaaataaagttattgaggacatttattcgtttccccttttatacctagagtacagacttttttctttttaaagagaaaatgtttttatttcaaccttatttttgaagggtggtttcactgaatataggattcttggctgaaaaaaattccctcctctgcttttattaatactttctagaaatatcacatatcttctttaaattaagtgagcagaaaattattgtccattatggacacttcagaggcacttctgaaagtgatagtacatgctattatttgtcacattgaaacaggaagggttcctttgtccccctctcagggcctatgggatgggggcatggctcacttcttcagctccccactgctcaatcctctaggggagcatacagatgggcaggctgtggggctccgaccctatggcaatgtctgtggtaaaaatgaatgtttttcatttcattttcattatggtaaaaatgaatgtttacagctgaagccccagtgggcatgtgttacagggtgctcttttagtttcccacctataggtggcctgtgttaaccagcttaattagaccccccttccttatcacaaggacagagggatttctgtatcccggagtttcttgccttgctgtactggaagaattggatcacacgtgggcttgggaaattagtgcaaggttttattgagtagaagtagctctcagcagatgggggagccagaagggaaactggttttccccatgaccagccgcttgtgtcttcttccattgacatgttcctcttgctgtccagcaacttctgtccttaccttgctagggtcttgggtttttataggcccaggatgggggttgtggcaggccagggtggtctttgaaaatgcaacatttgggcacaaaggcagaagtgcctgtcctcaactaggtctgtggggatggagctttagccagggaccacacactcctctactcagcacttcccttcccctcttctgtatcatttaaagggaccactctcttcccttcccagcactaatgtatcaatatatctaaatgcatagcatgctaataattgcactgggagaagagacatgaactaggactgtccaagtaaactaagatgtatggttaccttagttttaagcaacagtcaggtactgaagagaaagcaatggtgaatgattctaaggcttcattcaatcacaggcttgttctcatatacaagtttatgaagaaacatgactaaaaaaacagattgtaccaggaaagttttaaatatacgagctgaaatctgccataaaaaaattaaataaaaatattttattccagtaattataggtattagtctaaggaaagtaagtagcatatgtatactaatgcattttgttaatttctccaagataatttctcaaacactcagaaagaataaataataaaacaggctttctgagataatgagtataagggaatgcaataatattgccagtctcctgaaaaaaaaatctttcacagtgggcattttaatcaggatcattagggagagttggtgctgaacaataaatcagtgtgggagaaaaaatatatatgcatatatttcagtttgtaataggagtctatgggattgtctctgactttgggcaagtaactaaactttttctgtgcctcatttttctcatttatgaaattgatataataatagtgcctccattataaggttgtggtgaggattaaatttgataatatatgtaaaacatgtaaaataggggtaatatatctagcagcatactgcttaatgattgcttttattatgttctcaaaaatagtaaaacgcagctgggcgcagtggctcacgcctgtaattccaccaccttgggaggccgaggcaggtggatcacctgagattgggagcttgagaccagcctgaccaacatggtgaaatcccatctctactaaaaatacaaaattagccgggcgtggtggcacatgcctgtaatcccagctactcgggaggctgaggtaggagaattgcttgaacccgggaggcagaggttgtggtgagctgagatcgtgccattgcactccagcttgggccattccaactccatctcaaaataataataataataaaaaaacattaattatgttccagtaatttatctctaattgcaataactttaagtttcaccttttttacttgcctcataaaatgagatataccaaccattgagaagccttgaatatatattcatgtgtattatgctgtaaagaaaaccatttgatactgtacctaacagacagtcattctagcaacagctaagtagggaatccttgaatagagtcctagaatattcatttacttgtttatttctataatttgactgtccatttgtgcaacaaatagttattgaacattcactctgtgccagagcctggggatacaggaggggatattctaaacaaagtcaatcctttcttatggcttccctagtttctatagattctagtattaaaggctggacaaataaatagatttatcaaaggcaaggtaggtaagtgctctggaggcaatggaaaatagattaagagcattaagtgggataagaagagacagaggtgggagaaaagcattgcggtagggtgacatttcagcagagacttcaaggttgctaggggaagtcacatgctgttatgtgagaaagcactccaggtacagagagcagaggccaaagtcctccagcctgacattggttggggattcctgggacagcggggaagccggattatcttaagcaagtgaaagaggaagatggaggtgggaaaccatgtcagacaggaggttaggtgatgggcaactttgaaggccattgtaaggacttggctttcattctgagtaagattaaggatccattggagagttttgagcaaagattatgtgaattagaatacagaagtacttagatttttacttttaatatacttattaagagaaatgggaaaacaaattcctgggctccatgaaatactcgtccactctatcagtcaatggtagattctgtcttgcagttctccaggccctctgaacagctatctaatgtcctaaagtattcatagaaacaataaaagataagagagtaagagaaaagaagaaaataattttaaaaatttaaaaatgtgttattattgttattattgccttaggacaggtaaaagaggtaagagatcaaggagataactcttggacaagtagatctcattacaacttttagtacagtcacagatgctttacatgatcaactgaagcagacttagtgttgcttttaaggaggacagcaggcacagtcttatcaagttctgaatttcctcacttggtcaagcagttgctgtgtgactttgaaagagttattaatacattagtaatctgtgtttgtttcctcatctgtgaaattcagtaaatccatcttacatgctggttgtgaggggtagtgacctggcaaatagtaatcacaggcaagtgtttgttgtcattgataacaagattggatttctaagaagatggtgttgattgcaagatggtgtttatcaagatatcttgataagatagtttttattgtgagatgcattattaagttgagctttgctttaagcataagagactgcattaagtgcactaattgacttttaaatctatttaattttcagaaatgtcaaatatgaataaaaatatgaaatgaatggagggtttatgatcagggatattctatgttacacatttactgctttatcatttaaaataagcccccaaattgaaagtgagtcaacatttgacatatcagtattttccaaggaataatttgtgtagccagttttcaaaactagaggctataaactactctgatttttaaatgatattgataaacaaggagacatttcattttttaaatgactaatgtgattatcaaaataaaagaataaaaaatataagacttgatttgactaatgggtaaaacatgaatgccactaggtaagactatttctatcatgacattaccttaaattagaaatcactaattatgtatgcatgtgccaaaatataactactctagcaagtgatgaatttgcatatacaatgattttaatcaaggcacttctttgattgtacaattatctgttttgcatacacaaaatctgaattctgtacatgtgagtcctcatttgtatatgcaccaaattattttgttggtgcaacttagaaatctctacttgatatattagggcattatttctcttccatttatagtaatatgttttcagtttttattaagtagtaaaaccaaactccctggaaaaacatgggaggtgggccctgcctctagtcataatagagggaaatgccactgtatttctattctgtgttaagaaaaagcaaaaagtttcttctacacaccgtttgttcctttctgccttcttatttggaatgtatctcaaaatttaaagaagactttggttcacagagagaacccttgagtggtaatcatattgagttcactcaattttccacattgttagtctgtaaatgatgagagtagggtgttgatccttactactcttaagcaacagagaaaatttagaggtggtggaaagtaccaaatttatagtcctagagacaaatattctctgtagagttcctgaaaaaagaaatagccggaaaagcagtgaggcaaaactcgttatttcattatggtcttgctggacaactgagactccccttggccctcagcgagagcagtgtgctacatacagtaatctgggcacattgatgaccgcagtgtaaagctcttagtaagtgggatgtttgttttgtagttaagtcatcctgacaggcccattgggtcataaacctgcttacaatgcaaagttattcacaacctcaaaatgagacttctgtacattacagataggtcattggtaacagcagaagtcttagctttttaatcattcaaatcaagatcttttctgcatatttgggtttggtcttgaggattcaactgagataaaattgtctcatatcagtagatacaaaattaccacggtccttctgttgtctacctgcctgcagatgtgtccttgcaagaatgggatcctatgttaggtcaagagtagaattctagcttgtaaattttcagttttgctacctttgctgtgactctagggtaatttgataatcaggctataaagagatcctttcaaagtctctgaattttcgaactttgaaccttgcttttacgtaacactgaattttctataatgcatttcttcttggctacatagatgacccactgttattggaataagcccaggtcaaatttgtctatgatgtctcttcaacaatattttgtagtctgttttcttccagtcttcactttcaatctcctcagggagggaatatatagtaatgaaactatattacagtaattagagtcagccacattgagacagccaagcaaaaagggcttcctggagaacctctgaccaacctgcacactgggagaatggggtggagccatggaaattcctgtcatttgcagaggggaggagcctggtctcttaagttcctgtgtgatggggcgggagctggttaatcggcttccctcttgctcagctgaaagtttttctctttttccttttttacccaataaattgttattctcacccttctatgtgtccacgaacctaatctttcctggccatgtgacaagaacctggttttagctgaactgagaagaaagccctgcaacaacatctggtgtgatagactgaaccatgcctccaggtatgcgtatacttgtcatctttctcattaactctgggtttgttcatataacttattttgaccaatgggacattagcaagcttgataccaggagaggcacttgcaatggggattctcctttgcaaaactccttggagctgagctgcatgctatgcgaaaaaccatgctagtctgctatatggaaaggatatatggacagccattggaaggtgactcaccatatagaaagaggggccacatggaaaagaactgagacctccagttaatctcttagctgaatatagttgcatgagatccctattgacacttattggagtggaataactgcatagtcaatccactctcagcatcatgaggaataacaaatttttattttaaggcactgagatttagggtggtttcttccatagcaacagataattgatatagttgggttaaattcagcctccattatttgctgagctatgtgacttggtgagtagtttaagctttctaatcctcagattcttgagctctaaaatacactgttatttccacaaggctgcggaatggattaaatactgaatataaataatttagcacaaggcctgagctatagtaagtgcttaataagtggtagtaattaccatcaatttcatcatttcagtcaacatcaccattatcacaaatatcataactattagcacccatgccaacacgaactccgcaacattgccaccaatactttcctgatagctagtgctttcatgatgcccttagtgtctactgccacggagaaaatcaacctttttcattaagacatttttaaaccatacatacacacaaaactttaattttttaaaccatacatacacacaaaacttttattatcctaaaatatgatgtaataaaaataagttatttacatgtccctttacatcatttaatcagattactaaacaggtaaagagatttgacaaaatcattcagaaagcaaatggaatggctatatttgaattctgtgtcttcgtgtcattaatgctgagaccttttaaaaaattctggttgttctaaaaataagagcttgcatctctcactagaaggacatctccataggggaagatattttattgcctttagtgctctattcctagtgccttaaaaattgcctagtatataaaagctcctccagaagtgtttgttgaatacatggatcaattcacaactgattggaagtttacaggacatgtattgtgtagccagaatatctgagtttgaatctcagttctaacacttaccagttacgtaaattttagcaatttaatatttttgtgccccagttttcttatatgtaaagatgataataatagcacatattatctaggattgtccttataaatatgaaactctgaacagtgcctggcaaatagtcatcaccatgtagctcttgttattatcattatcttgttatattgagctctattggtgcatagaatagtatatatacattattgatttaaagaacgggaatatgtagcatattgaaagaaagtcaagagagatggtgttgtgtggtctaaaacaatggcttccaagctccatttttgattaaaatcatctgggatgattattaaaatccagatccctgcccactctactcctccttccatgctctatatttgtaacaattgcaccaaagatcatgtttgcatagtcagctttggaatgcagtgaaatcaaatgaattttaataatgcatgttcaggtaccatatgatttaattagagaagctattttggtacaggggtttttccattgacctataaattcaatcctgtggggagttgtgcattctaccatgtctccaccatgtgccatttggatgtctcctctctcctttcttcctttcccttcctcccctcatccatagagagaagatgactactcccagttgatgctgaccctcccaggaacatgaaacaaaaaaaaaaaaaagtatggggtctaataggtccttgctactcaaagtgtgatccacaaagcagcaacataaacatcacttgagaacttgttgaaaatgtaaaatttcaggccctaatgtaagggattttcaactccatttcctgatataatcaccagggagctgaagcatcaaagtttagatgttaggcttcatttaccttgagagactctgagttaattggtttgggtactacccaggtctaactagccttttcgacttcacagttgattctgatatgcaacctggtttaagaaaggagagttttagcagaaaacttcaattgattttgaaacttctacttccatggccttcttcaagcacctacaagactctgggtttcagaatattcttcagatttccttgtaccagtggaccagtggcagatttccttgcaccaatttcctcttgaccccattattcatggttactaaccaaacctgccaactttggcatctacccccttttctcagtaatcttgagatctgaactagctgaacaaatagactggaaagcattcacaacgtcagtaggaatgtggtacgaaaccaaaagcattttatcacattttcaagcaaaactcaagtactttcaagcataataatgacgataacgtctacttgtattatggttaggactatctacccccacaaccattgttgttgctttttgtaatcggactattgcaaagtgatatgattgcctttgaatagattgcagtattagaataatatatttatatttttgtaaaatcttgtattttgttcactcacaaattacttgactgaaagagactgactttcttcaatcctttacagtttaccctggaataattaggtaataagagggaaaacagacatagaagctagtcaagacccagttctttttgtatgtgactcaacaaaacagcatttttgctgtaaatcttaagataatctttgaacactgaatcaagagcactaaaagtcaaaaccaaatcaaacgtttgaaaaattaatgtcttgattgaagtcccttggggagccgtcaaaggaacagagttatttatatactaccttactatttacagcatggtctttaaaccagcagctttgtaccacctaggaactaatagaaatgcatattattgggccttacttcagctcagattctaaatcagaatctgcgttttgaaaagatagcccacattattcatagacatattaaggtttgagaagcaccaatgtaatatacaataaggcttttaatatttttttccaacatttgctttttcttaagtcacaccacatacagcatcccatacagttgatctattatttcttacccaaaacctatgtaaatttttttacgccttcaaaattgttatcttcctgccaaccagctcccactctggccatttcttattttaccaagcagtctagtctgagggaagggggaggatgctatacaaagacactctttcataacattttccttatcgcaattgaataagaacaaaaaatgcaacactttctctcaatctgctctaaactggtaaactctcaagaagtaaaatgagtaacaattttatgtagagtcttctttctctaagtctggcaatgtgcagagaatccttgaaaataccagtttaccagtactgtgaaagcacacaaatatgttgtgtttattcttccaagagagacataaatgggtagcaacttctccagagattaactatattgttccaagttatatccactcatcttagtttccaatgaataatcatagcaatataaggcaattatgtaagctaaggaatgtaaattcttttttcttctttctcttatggtatggatagtagagaaaacaaaaaataatttttgtgtcagtatccactgggtattctgctatcaatctaaaaactataaagtatttcttgtaactactaaaagagtaactaacaacaggatattacttttctagttgattgagagattgttaaagtttgagtaagtgaagcatttgtgaaaataaacatctctgttgacaaaatctggttgaaaactaaagtcttacttttaattgaaaagaagaaacaaaacatcctaaaatgcctaatgaactgccagaaggaaactcattcaaagaattttaaccaaaggttttataggtaaaataaaacctttagaatatcaaaaagaaaagtattccgtgcagacataagatgagcaaaataaacttaccacagttgttcagttaatggacaggcaccatcatctgaaacaacaaaaatgtattttgatattgtgatcataaaaactaccaaaacctttcaaattgtcttcaaacacatgttatggacatatctatagaagcaaaataaaattaagtaagcaatgaagatacgttatctgacctcaattatttatttcagatgaaagtgtttcatcaccaccatttaaggagtaaaaaagatattagttgtttattcaaaaatcttttttataggcatacctggcatatatatgtattgcaccaatattttcttctgatatatatgtttaaaaggcaggcaaaaatacagagtcatctctttaatacaatcttggtcctggcacaaacacaatcttgaattactggtcctaattctcagctctgacagtgccatatacaccaccttcctgagctcaaaaattctctttgttgcctacctaaaacaaactaaagtgtttagcatagcattcaggagctttagtaggttggtcctattctaactgtttatgattcttttccataattctccagtgcatactcatgctacctttcaagtttatctcccactattttcccttgtacactagtctcgaatcataagcccaccttcccttcctccctccctccctccctgcttctctttctcccttccttccttccatacttcggtttacttcatttgctctgcctcaatatttttttctagccattccttatggccagctcaattaacatttcttcaatagaggttgtcttgacacctagagaagaaattattctctttctagatgttcccaccatattttatatgtttattacagtatttatcagattctattttgtgtgtttagcccatattggtgtttatgccttaaccctgttcattgttccctacccagaagacttcctgctatgcctctgaaataggagatgtccagaagattctagttgagctaaaggagacaatttatttagtgtatagatagcatatggtgcacattttccatattttgtcaatcattctttaagtgaaaagtgcaatttccattgcagtttctggaataaaacttgactgttaaagtcatagtaatataccctatgaacaaaacttcttagtttaacaaaaaaataaagaaattgagggtgaagaatgtcctttattgataaatgatttttagaaaaattctttaagactttttcaatcatatgggaatacattttatttttatattttttagatttaaaaaacatgttttttccccccacagggttaaattttgtataaaaagttagtgttttgaggaacagtgatagatttgctttggcctatgaacgtggtcaccccagcaccaagatggaagttactggcatcatcttagaaaagagaacttatcttcttatggaaaatgaaataataacattgccttgttgctaattttatactcctagccaactatgctagatcagactctgcctatatgaagcatacaggtgtattacatacccacaatgtctcatacttcactattcttcagggcccacaaccactttagacttcaaaatgttggcaaacaattttgtgtagttactcgtattaaggttttctgtgtctaaaataattataaatccactattctgctatttcattaagaacttttcttactgtttcatgcaatatattacatatcaagagaaggtattactgaataataaaattttaagtaacagaagtaaaaactttagcataagtatttaaaataaaagcactggtttcttaatttggtaagagggaggactttattaggttctttgtacctaagcatagaatgtgatagttcaacgttcagcttctcagattttgtgcttttcattccaatcccctctggttctcatcataggaggaacatgacctaacacacaattacaatttttctctaaagtatttgtgatttaaagacacccctacagtagaatgctactcagtaatttaaaatgtgctggtaagtctagattattattggacattttcccctccaaaggtcaaagttttcaaagtgttctgatatggcttggctgtgaccctacctaaaattcatcttaaattgtagctctcataattcccacatattgtggtagagatccagtgagaagtaattgaatcatggggggcgggtctttcccatgtggttctcatgatagtgaagaggtctcatgagatctgatgattttataaaggggagttcccctgcacacgctcctttgcttgctaccatgcaagacatgactttgctcctcattcaccttccgccatgattctgaagcctccccagccatgtggaactgtgaatgaatcaattaaacatctttcctttgctaaattacccagtaaacagctttcctctactaaattacccagtcttgggtatgtcctttattagcagcatgtgaacagactaatacatgttctaaatagaataatcagaaatcatggaagtacctttggaaatattaataaaagtgaactgaatttttgttataattattaatacctatcatctatattattttgactttctttaaaaaatagagtgtggacctaactttacctactagttttttttttttttttttggactggcacaggtagatgagtaaatagaaaaatatgagttgtaagtacccattgatttattgctgacttgcacaatatgttaccttccgtgccagaggtaacatagttgggtaaggaacagcagagatctatggcttcctacaaataatgactcaatggcagtcgtctattttactcaaatggtaaccaaaatttaactaagatactctccccagagagaaatataaagcagggaatatttaaatgtccccagtatctgttctgaggacatttaaaaggagattttctttcacatgattgaaaacaccagataataggaccaatcaaaatccgtccttctaatactacaacatattttcaatgacgtataattgttaactgtggatctaattcgctacctttatctaaccaaaaaaaaagttttttttcagttcaattatcttttccattcatttccaaccacatctccccaccccctacagaattttgattagctcctgagagtggcatctggaaaatatagaaatccttccagttaaaacagataattactaaatatataactattgattgagagaagaaggaagatactgtaaacaattttggagcttttgctttgactctagtgatgctggtaagagtgaggaaatggagtcaaaccaaatcaattgatttatggatagcatatgcacctacagaaagtttctcttaaaagaagtttcctgagaacctttcagatgcaaatttattcaaataacctttagaattacccatccacttctccatattcgaccatttaattcttataaagggtgtctattttctataaaagaatcctggcatttgaatgcaggaacagaatactaagttggatattgtcccaatattgtgatcatatgatttgttggaaaatacagtgaagaaaaaattaaatatatattattaccttctctgtatatctgtactaggcaggtggtaggaataaacaagctatttcagtattgacttgtagaaccaattatagaaataattataaaaataaatgcaaataggtacccattctgggcatagaaaattatttttgcaatgaaattcttatgagtttcagtaatatcactgaaatacatacatgcatacataataatctctgtctctattacacacacatacacatacgcacacatatatacagatatatatacacaagtaatcagagaaatccccctcttttctaattacatcagatttctctgtcctttggcatttcctttttctcataccaaaactccagtccttatttctcatatcagtcaggactaagtccaggacttggactgaagtggcaaaaggtgaatggtaacggggaaaggaactgagtatgaagggtaattggtatgactgaccttactatatatatattgtttaaacagcctgagccaaaaatatagaccagcctttctctgtaaaacaagaagtccaaatgttatatcttattttttttttttccctgaaatacaaataactcttcctccagtcattgatacggtttttctacgtacccaccggaatcgcatcttgaattgtagtgcccataatccccatgtgtcctgggagggacccagtaggaggcaattgaatcatgggggtggttacctctatgctgctgttctcctgatagtgagtgagttctcacgagatctggtagtttattaagggatttttccctcttggctcggcaattctttctgccttcatgtgaagaaggacatgtttgcttctccttccgccattattgtaagtttcctgaggcctcccaagccaagcagaactgtgagtcaattaaacctctctcctttataagttacctagtctcaggcagttcattataacagtgtgagaatggactaatgcagtcataattgtgagttcttcgtgtttattacagggcaaacataaaaatacaaacgaaagttggttcatttttgccaaaaagttgtgtcagatattgtaaaccgacagtaaacgatcttaatgcaaaacatatttgaaatactggaataaaatatgacaaatgctgtaatgcatccttgaaaaaaatatagtacagaaatgtccagtggccaaaactgaagaaaaaagtggaaatggttaatatgcagtcagtgatatttggatgttccctgcaacatttgtcaatcttaaagaagagccttgggatctctaggagaagtgataaaaagtctctcctaaaaatctgtcacaaatgtttcaggtttgaatttataccacccacaaggacaaagaaatcctaaagggagatttaacaaaaaatttcttcctgtgttgttacctcatacatttaatcaccaaatttctctggaagggtacattctcaacagaggacacttaggatttataaatataaaatcctgttaagtacaagctcaaatccatagttataaaacacatgaggaaatcttgagtgaaagtcagtacaaggatcaagatcaagattagaaataccaaaacattgagataatgcaattccaaacatagattatgaaatgagtatttaaaattattaaaaataaaagatgtctgagcaagtatgtgaaagacatatcaaaaaaaaagacaattttcagtgggtacccattttcagaaaaatgaaataattgaaactgagtaaataaaccaatatattaaacacaactaaaggaagaattaatgggcaggcagagctgaagaaattatccataatgttgctcagagaagcaatgaaaaataatgtagtgagagggcatatggtatgtgaaaattacggtgagatggttcaacatttgtctaatagggagaaaaaaaaaaaaaaaaaaaaaaacaccaaaaaaaaatgaggtgccaggcgcggtgtctcctgcctgtaatcccagcactttggcagccaaaggcgagtggatcacttgaggttagaaattcaagaatagcctggccaacatggtaaaaccccatctctactaaaaatacaaaaaattagctgggtgtggtggcacaaggctgtaatcccaggtacttgggtggctgaggcaggagaattgcttgcactcaggaggcagaggtctcagtaagctgacattgtgccactatactccagtctaggcgacagaggaatactctgtctcaaaaaaaaaaaaaaaaaaaaaccaaaacaaaaaacccagaactaatcttaaaagaataatgtacgaattgtgatatcacatgtataagttgtgatacatttctaaatattgttatattttctctctctctttctctctctctctccaggaagcaaatcatatccgaagtaagatgcactccttagattttgaaagcactgcataatcactctccacacctccatgcacttctataaaaaatgactctatttcatttctccctgttctcttacattgtaaaaaatattttaaccatgtgataaatccagtgaataaacagtggtgtaatatcaaacaaatcagtaagtaaatacagtgggataaaatgagtaagataatttattaatttttttattaattaaactaaattttaaatgtttgtttataaaacgaatatttttaacacctaatatgttttgtattctattttaggcattggggatatagtggtaaccatgtggacatgtttcctacttacattattgtggcatggagaggcaagagaaagaccatacacagctaaacaaataaaggaataagataatttcagataattagtgaaatggagaaaataaaacatgtaatatagctcaaaggaggaatatttagattggatgggcaggcctgagcaacacagaacaagccagccatgcaaggtaagaagacagaatgtttatgtaaaggaacagttagtacacaaggacttgtgtacacttatattcaagcaacagaaagaaggccaatgtgactagaatctagtaagcagaacagagtggtaaaaaatacatttagagaggtaggtggccagattaaggagtgcaagtaggccagtgccaagaaatttgggtttatattccaagggcaatgcaaagtcattggagggttttaagaagttgagtgacattatggttttgtcttaaacatgcctccggctactctgtagaaaactgaaagccaaggaaggagcaaaaactgggagatcagttttgaacctttccaggcaagagctggtagtggtttatactaaagtgtagctggagatggagaaaactggagagattggtatagatctggaatatattttgaaggtggaacaagacttgccaatggattagagagtaatgagtgaaaaaaagatattaaggattattgctgctttggaatattagtaactaagtggatattagtggtatttactgagatgagcaacactggaataggaaaaatacacgtttactgtatctgtatcagctgtgttgattagcgtcaacacacattttagccattttaagtgggacatatattagatacatgagtacaagtgtcaagtaggaagttggatgcggaaacctatagttcagtggagagtctaggactagagataaacattgagaatcattatcacagagaacatgtatgaagtcaagggaattggagagtacataggtagcacattagagagtttaggccagagccccgagaagtcctgatattaagagtgggaactgaagacatgttgcaacaaaattatgtggccctgtgctagatgggatggtttaattcagtcttttccaagtccctactttatgccacattctgtgctttctgccccagtgaacaaaatcaactggtttgtggtttagattccctaaaatcatgtttatttccccatcatttctggattcaggataacatcccggtggcaccctaatgatttgtcaattttaaccagctctttattattccagacactaagcatttcttataggaaacactctccttcatttcctcccaattcctttcaaaatctaaaactcacaatttcttcagtaggaataaataaaattatgatattgattttctctgctatgcattttgggaaaagcagatacaacaaatttacaatgtagttgcagcttaatatttttctctttatttgatcctatttttgcaagttataactgaacatggaaaattgcaatggctccttgattaaggtgatggattctcaggttcctcgagggttaccaattaccatagaagttgtaggcaaagcaacaatgtccatctaactccggtagaagaaatcaggtgaaaataaggaaaatcattagaatccctttaatcctaaattaaatagaactgtgtagatagacatcactagaaacacacttcatgggaaacattctgctctggggcatgctttataacattagcctgggtaaatctacttcagtttcaattaataaaattgtaaattcaggacttgtgctttagctaagttatagttcgggtttgtgctctgttagattattcttttttaaagcaaaataaagctgtgaataaagcatgctctctagaagacattattgtggttggtgcaaaatcgaatttttatcctgtaccttgggggagacagtttaacaaaatgtattttcccccattatcatcattgtttccatctaagaatgttttccaacactgaaatcatttttatgtagccttggaatgtgtattgatgtttgtcctttggcttttctctttcttgagataatttgtaatttgcttaaacattgtaaacactagagctttgcatattttctgcatgtttactaatctgtttgtgctaaaaaaattgcaagtttgccatttaattttgctattattttccctgtgcattaaaaatgtattatttggataactttggtttggaatatgaagggctaatgttaaaatttacctttgcactctatttaaaggaataaaatatactgagaaaattgaatagctaaaataggattttaaggagaatgtttgcatacctaagaagacaaatgtttttgaaacacattaaaattatcacctgaaaagtgctgttaaaaagatggtaagggccaatcattgtttaggccattactttgatttcggcttagggactttcaaaatctgccttcttttgtctctgtctttcactctcaattagaaggcttagaacattaagcttgaagtaaacactaagctgaagttctattccatgaagtaaataaacagaaagaattaagaaagtaagagatagaagaatactacatggttgaaaaatgtgagccttcaagaaatattaagaaaagcaccctccatcttttctacaaacttctaccttttcactgaaatcaagacatctcacatttacgatatttactcatttatccactgtagatcagcctctttctttcttcacaatttcaaactgataagagggagaattttgatatatttgatatgttcttgagttttcaataccattcccaaaagcaagaggattaaagcaagtttttgagagcagggagcaggattgaaagagtgatgtgggataagagagactgacaaagttggatgcttgaggaaagagtctgtggggaaggagaatattaatgagcaattttatagtggagataaagaatatgtttaaggaacagtaggcttgaaaaaaatatctaatatgaactctttcttctttctttttttttttgagatgaatgtgtcttccgtagaaaaggcatttttttctgattcttgtctattataatgctgagcactggagctctggagctcaacagattagatttgaattaggagtttgccattagcattgtgaaaattagtaaattacttaccctctctgaacttcagttttctcataagtaaataggaatagtaatagtacttatttcataaaatactgtttttggataaattagataggcttaccaccaccatttaagttcaatccctcattacctgatttataatactgtagattggcttatcgatatctgaaatttaaacaaatcacctaaaagcatgtctgtttttggtgtctggcttttttggctccatttctgagcatcgaccatgatgacatcatatatgataattgtttactcattttcattgctgtgtagaattctaatatatgaatatacaatggtgaattcatccaatttactattgatgacatttaggttgtttctacctaacatgattataaataatggttctataaacatatttgtacgtgtttaattgtgatacatgtaaaagtttgttgaaaatataaacagatagggtatctacattgagtataccagatttatcaaaataaaagtggatacctctgaataataggatatgaagaaatttttgtcctatcctaaattttccacaatcaacacaaaatctatttttttgaaattgttataccatagtgatttagaatatagagtcaaaaagccaaatttcacttttagtgccactgtttattccctctgtagtcttcacgctgctaagactcagtttctttacttgttcctctgtaaaatttggaatcagagtatctccctcacatgatttttgcaaggaataaattatctaacacacataaactcatttcagttccttgtacacgctaatcattccataaaagctagttgcaattgtattactatatttatgataaaagaactttgtttcctttcctctcacgtaattatcttgtaaaattttggttagatataaggaaaaattatagtgtagtaatttttttaaaacccaaatacttggaaagtggaagacttttaatttttattgaccttataagaacagggaggcaatctgcctgtggggtaagttacccagaagtacagctaaactggttaattttaagagacaggattctgcaaatgcatgaacagaagctatgaaagtaacattggcagtagagagaaaaaaatacaggaaatttactttatcagtatagtgattgaatcattactgatgcttctcacaactttgtttttgtttttcattgttttcttaaacattctgacagcaaaggaaattattatatgtgcaaattgggtatcacttcttaaacttttgaatcagctggaaactgcactcaactgaaccagagaaatctaaaacaaataaaataccatttatgagaaagcatttaagaaaatcataagcacgacaagcattttttcccaacccatacagctcaaatataaatgattctaaaatgtatgtgccatgtttacaaatgtgcccttattgagattcatacctgcattacttgtttgttcagagccctaaaacattataataaaattgaaactctcactctcaattagcggattcatttcaattaagaaaggaaagcaaaagaataattttcatcagcttccacttacttcttagtaaatgctgtgataaaatatattttaaggaacccgacattacattaagaggcattatattaaggaaagaatagggatctgggttatcagacagaacattgtttgaaaatcaatactgccatttactagttttagattttgggctgtttttcttatctttcaaaaataacaattgtgaagattaaataaaataatgaacataaaacatccctcatactgtctggcacaaagtgcgttctcagtaatcatattttctttttcctgtcattctattttttaattatttccttctaagtaatataaatttcccaatattggtattagtctggtgtgttagagactttttatatcatgcaatgtattgcaaaatatattaaggccttttaaaagatcagtatttatcaagaatataagagactgaactttctttcatcaaaacttagacacaattattgaagtataacttttctgaaatgtgtctttattctagaatattcttatctgacaaagatagatgagtaatattctcatattatgctttcttattttaatataaagacaaatatatgtgtgctgagcttatctcagtatactgttcctacaatatttttataaagtcaggggtattctatgataatattttatgcacctgccactcctcttgcatatataatctaaaacaatatccaatagcaagctttaatatatcttcatcattgaatgtattacattggaattaggtaattttttatgcatatgaatattttattttaccttgagtttctccaaatctggaactgtttgcttgggccactcctagtaacatggtccagtaacctgacatggaaatcatttaccacttcaaatatgcagtattaaattaaatataattaaactaattcaagaccagtaacacagctggtgagtaaacagaagtaaattcaaaaaacaaattaaaggagactgctagaactgagagcacttaaaatttctactgaaaaacaagtcactaagatgagctcaatataaaaagtacaagccacaaaagcaaaggaacccaccataagggagaatcagtaactacaataagctgaaaaatttacttcccaagaaatcgtagaaaagcccaggactggttactttcaaatcccagtagagtaccatgggagcagctgattttcaaatttgctgtatgtcagtatctcaatgattttaatccatatataaactcatattttagatgaaaaatgtctaaggtttctaatattttttcggcatatacaatacagataacgataagaaactttggtctaacattgaatctaaatattttatttaaaagcatatgaataaatgaaatgtgtaatatgttggcctgtctgactaccatcttttactacctgcaagaagaaaatatgaaacacatttttaataaatgttttatcaaacacatttgtaaggtaatatggcacaatgaaaattatagtaaggttcactaagcagccttatacaaattcaataaatgctagatgtctttaaagacagcatcagttgcttagataagtgaagtagccttcctgaccagaggttactggcacaaatcaatacaatgaaatatgcattcagtccatatggtatttcagtaatgggtgcttgaaattcagtacacagctttgctataaatcacagacagaaattatattaaaagaaagttcgttctgtgatttgaactcagaaatcaatggaaatgtataccaaaaataaaatacttttagacatatacatcaaaagaaaaatgatttgtgtcattgccattcatatttcatctttttgtttcctatgtccagcttacattggatcctttccatgtctccctttccccacacagaaatacacaagcattccccattgggaagaaatccacacatgtgatccttattaaaaatataagaaaagcaaaaaccagagtagccagaacccgactatgaattccttgctaggaaaagaggggcatgtggcttttgctggtggagggaaaagaggctttgaaacaggaagttttagggattagaattagaaaaagacaccataaagcaaccatgatgctggttcattgaaactgtattttagttttgttatttatacacacttaccctaggagttgaataatgacaacattttactactgtatattaaaactattattgccacatgtcatgggcttcccaacatgctttcctgcatacacatgtaaacaagaaacacatgcagcagaactctgcgaccacggttgtgctacaaacagaagctgctgtgataaactgactgggtgatgttcagtgacctaaattgaggcttagaataagtgtgggcgcgtgcctgccttcatcaaatgaaaagtaggccaaatatacatgtttgcttttttttcccaccacagctgcaaaacctctttgtgtgtgtgtatgtgtgtgtgtgttggactagaaaaataaatatgccattaacctgaaaaagaagtgaaccacaaggtgggtttccatcaaaatagacataaaatagattacatattaaactccagattgggacatagtttgtgttcctattcaattcccaataatatattagagtttgcaataaataataaattccctgaggatacatagcattgtgtctttttttttttttacgataattaaggcaagggtgaaaacaaagacttttgtctcataaaattgtgccttctaagattaccacccaaatataaaataaatcctaagctagcaaactatgttattttcttctcaattgtaagcattttctgtgggtttgtgtggaaatagtgcctatgaagatcatcatcaatatccagaactgtctaaacaaaagcagccaaattactcttttactctaaaatatggttggatgtaatacaatgccacttactactaggcatcattgaaatcattaaacatgaagtggaaatagccttttgctaacgtttccgaaatgagagctaaattgttgtatgctgcgaagttgaaaggaggtatttgctgtctgacacctgaaaaaaggacctaaacaggcaacttccattaccaccagaggcaaatggcgagaatgcctgcctgttaactgagagcatttctcttaatgttttaaattaaccaaagaattcacaacacagagaatttcagcactatgcacacacaaaaaagatccctagggaataaatgtgtgtttttgaaaagattttctgtgtagggaaatgaaatactaaatgcatagtgaccctatgaccctgcaagcaagagggacctgtggaatcacttagaccaaccctgtcattttacaagtgaagaaactgaggccaggaaaaggtcagtgaaggatgccagggccacatagtgaatccatgtcttatgaccacattcacgggatctttctgctatgcctagatgtctgagccagcagagtagaaaaaagcgattatacagccaaattttatgtaaaactcaattttatcccaaatcatatatagcactttttttcttttcttttctttttttggccagaattacctagagtcagtttctgttttacaaacagacaaatgacccacttttatattttaataattatgccttatttcaaatgataataaattcgctttttgtaaatttggtatttgtggcaagtgacaagtgtaatatgataccacactgcatctcaaacacccatgcctactgaaattgttgcctaattttctatgtatgtagcttcctgtcacttgactttacattgccagcactgcagccactgtggttgccttcccagcatgcagcccatacaggtctgggcacagatagagactctcatcccccaaggccattataatctcagtctgttctcttctttagtaatctccctttcacatttcctacagttactttcccagcctcaggccactctcctcaaggccctcatctcatcccagtcactacgcgaaggggtttagactctcactccaccaactccaactttcatcccaaatttgtcttcatacacacctctcttcgctctattaaatatatttttacttgtatttgtttttctcagagtaccttatggaattctctgttctcatgcgccatcccccaaaagagtagctctcttttggcacaaaatttcacatttttgataagacagtctaataaattatgggctctggtgaaccaatatgttagcaatttctggggcactttttgtactctctcaagaacttctgaacacagtgtcttaaaacagatgaataaatctcactaaggatatttcagaggaaagatcaatggagggatatagttttggcagtggaacttagcagtccacctcatattataccacaatgcatcagatactccatcttgatgtagggttgttattccatgcagctatttgtgatgaggacagtcattttgggcaaacaagttataaaatatcttgcagcttctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggtgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgcagcttcttattttaaatcatgtttctacatttaactggttagtaataagcaagaaatgatttgcacaaatacaattaaatggaaccttataatggactatgctgtcagaattttattattaaaggcttattcatcattatccaaaaaaacaaagaaaaccaaactagaaattatataaactctctgttttgaaaaagtctatgagcccatatcacctatttgtttatcagctgaacattggtggcaatcttggttctgtcctttttaaactttatgaacttggtcaatacataaagtttctttaagctctgatttccttacttgtaaagcacaggagagggatatctgtctctgaggattgttaagataaaattagataacatttttaaagtagtaatcacactgtctgccacatgacagtcacttaataaatgacaggtggtattatatttcacagtgagtttgccctttacatgtaatacataattactgataccagtccaattttggactttagggaatgaatccacatttataaaactgagagaattttcagggaaagagtagaattttcccttgcaacaccttttttctttttcctttagaaatgagtattgcatagctctattgagaattcacctcctattatttaaaacaacgtttgattgggttcaaactctctcctgacatcttctcaaaggacaatccaaactcttcaattatctttttcacatacatctcaaaaggtattctgagtgcctgaaaggcaataattcttttcccttaaagttttgaattccatctgatgaagatattacacttagtggaatagtaccatgtcacagaaacaatagcttaaattaacctctcactgtgttcagtcaggttctttcttttccttcataaaagttgattcaatgcttttgaaagaggcaagattggcaaggatggagaattaaggtctttgcatcaaaaaataggtactgagtagaatgagtagcaatatccttaaaattattggctacagaatatcaaatacatttagggaaggacggccttaaggaggtggtggtaattgagtcttcctggtacgtttagtccagggatatatcctagggataataatcagctctattcaacatggtgagtgttggtttttaattaaaaacaaacaaaccaacccatcttcatcatctcttagatacactgtgttgcaagattagaaccatcatatcaaattacatggaagaaagttttgacaggacaatttaccctcaagaatttcagaatgtgagactcaaacctaaaataattctttaatcaacaaatacttaccaggtagctatcatctcccaatcttttatttcccatgaggcactgagaataagacaggcatgctccctttttctatggagttgaatggaaagagggagagacatgaaagaaatagaaacacataaaatttaaaagataattacctgctggccaacattatgggcatatgacgtatgtgatcacacagggctctgactttagaagggccacacacttggcttaatgctttacttttgccttcctgaaactctttataacttttaacgagaggactgcattttcattgcattttgaactggacctaattacgtacttgtttattaagtattgtgtaattatgtagtcagtcttgctcagatagcaataactgctatgcaggaagtaaaacacagaaatgagatagagaaaaacaggggttatgagtcacagagttccttcagatggcataaaaaagacctctcttcctgtaatcccagcactttgggagacgaaggcgggcagatctcgaggctaggagtttgagagcagactggctaacaaggcaaaactccatctctactgaaaatacaaaaattagccaggtgtggtggcatgtgtctgtaatcccagctacttgggaggctgaggcacaagaattacctgacccctagaaacagaggtttcagtgagccaagaatgcgccactgcactccagcctggatgacagagcaagaccctgtctcaaaaataaaatagataaataaaataaaaaaattttaaaaaaccctctctaatgagatttatgagccaagaattaaaatgtttgctaaattagtggatctcacttcattcccttataagcaactgaatataaattcaacagacactgatttaatacctaacctgtacaaaaagccataagattaccctttagggattagtaataggacaaaatttttgacccagtaaatttaaggtgaaaaaaagtactcaagtagttctcaatctgttctttaatagagacactgagagatatgagtatttcagtagtggaagtgaaagatacaagtgtttagaagagcaagaaaagcctttaaaagcaggaaagattgatttcattgtcccggttagtcgggtaggacggggtagcaagcacttcttttccagggaggacagagcatcattgaagtcccagaaggaaaaaaagcagagtgcttttgagtaacagtgagtaatgtctaagtttatttacaggataggatagatgtaggaaatgtttttaaaaaacaaacaactgggtgcattctcgtctcctgcttttctcttctcacctttacctaataaattgccaagtccagttgattctgtcttctaaatatctcttgagggcattgcttctgtcctacttccagcttccatcctctcatttctagatggctgaatcaacttcccaactcatctgtcttcaattaggcctcttccccagatcggttctcttgtctgaaattagagaactcattctaaaatgaaaatctgatcgtctcatggttgggtttgaaatctttccatgcagtgttatgagtgggtaagtcttgattttgaaataagacagaatgtgatttgagtcccagctctcccacttaatagctgtgctctttaatgagcctcatgtcctctctgatccttggtttcctcatggggagtttatgataattaaataatgtatataaattgataacactgccttgtgaacagagcgtgctcggtgaatgttattgctgtcagaacacgtccaattcctttgtgtggcttttaaggctctaacttagttggtttctggtttcctctctaatgttattccttgccttattctccacttccacaatatgctcaaggacgtgctctcccttttcctcaggactttaacatgctctgctttctcctaagaatatctgtcttccatgacttatttgtactattcattcaatctattgttgttctacccatttgataggcaggaatactcagacactacttggcccgatgactttttcaaagtcacatggtgactagcagaataaagccataaaccagcttctgttggttcaaatcctgttctcatttcctgtaagacctattatttcacaattttcagatgttcactgggaaaatatttgtttttttccctcaatacaagtactttcacaatataaattgtgtctgctgcactcatagttaatctgggtttctactaacagcttatgtataccaagtaagatcagtgaacaaaataaaccaatgaacaaaaacctggatatactgcttccccttccaagcataatcttcaatttcggggttaatgaagctgttatcccattctttggcggacacataaggcagccatttttaagtttcacttgcttcagctataaaattggtgctacagaagcagactgttatttttaaggcatttagggaaagctgtcacagatacaaatttaaatggaatgttaatctgcttggtaaaattagagttttaatcttaaagtctgaggtaaaataaattcagattgatatagattcattccacaaacatcaataattttccattatgttaaaatcaattctaattttacatgcaaacaacagattcaagtaaaaaccttagaggtttgtgttctatcacaagcatacttattttgggtctgtgcaaatccaaaaacatttggaacagctgcatgttctccttgctaaggaggggacaattttgctttgatgcctccaattctaaaaaactccagttcattctttctaattagccatcatatttagtttgaactcagggtcttaaaaaaattgaaagaaacctgagggaagttgagttaaaaaattatagtcacaacaaaacttgattaaaagcacataaaattatctggaagtagcagtatttgtagtgacatgggaaatgctagtctatttttttaaaattgcatttagaaagtcatttaacctcttcaaaactcaagttttgtcatctataaaatgagatcaacttgccaatttttaagactttgtgtcaggattaaataaaatattgtgaaagcactttgaacatacctatgctaatcaaatataatgtgaaatcatttcatttcatactggaaaaggcaaataaatccttcatttctcttttctgttgataaaatatccaattagatcctgtttccaattgtcatctgattttggtttcacctgaaaagttttcgctactctccactcaaattctctaaaaattcgttttctctatgaaatgttctgagtcctacagcttttgtttatcctttctcatctgtgtaagagcatcttttcaacttcaatccacatacataagacttgcatggcatctcattttcagatcctttagaacagaacaactttcacattgcctctgggtgcctggcaaagtgttaagcatgaaggaaatgctcaatgatgtatttctgaatggatccattcacttcttgagaaggccaactgggttttctgcttaggcatcctgatggttattcatagtttcttatgtctaaaatgaatctagcccagagttagccatgtggagattagtactagagaaaaccgacataactcactggtcatgttaggatttaaatatctcttgcaccttatattaatgacaataagagctcttatttgaagattaatcttcagtgagagacattcattaacatggggactggcagtagactgacttatccaacattttctagttattagccttgcaacttttgaaagcgacctagctatttcgtatctcaattttcttatctgtaaaatggccatgctattacctgcctcagcaagatgttgtgaagtttaaatgagatagcatacatactattggctacaagtgttcttaatgtctacatcataagatacctgagcaactcattcatttatccatttactgtctatacaaatatggattagacatagtctttgctcttgagcattgaaagtgagatcaggcctaaaatttgatcagtagcaatatcactatatttgaaccagactggtttaagagtacaagagaagaaatgattaattttgcatggaacttcaaaaggatatgtgctagaaagaaaggttatttgaattgggcttttagttgataagcaagtttgttttaataagcagaaagagtgtagtggagaaggaaacgactttctagataagcaataaatgatcatcagggcttaattttgcagaatattttgtgcaaaaattgaatgagaacacacatatgaagatgctacaagagtattctattgtacaactgggtaagcttagttttatgaattctaaagataggccccttatacacacacacacacacacacacacacacacacacacaagcatgatatatatatataaagctaaatatagtctgtatcatttatctgtaacataatgacatatacctggaaaatgaagacagtctcattgtaagaaagaataatatattcagataattaaaaattctatcagatttaatcaagctatttctaaacaacaaaataggagtagctggttttaaaatagcttatgatttatttgtctagtcatatttaatagaaatactgtagggttatattaatgactcttcaacagttttattttagttacttgataagtgaaagtaatattatctctttcagaaataattaacaatgtaaaatcaggtccatgatgttgggaaggtttgggaaacctataattctgcttagaagtaaacagtttaagaaaagccccaatatgtatattgtttataaactttaacagaagcagtatatcatcctttctttgttcatgtttttgatattataagaaatataaaacccagtttattagttactggaatttgtcaaggacttttcatggctggacctacattaacacagatggcaaaattacaatttgccttcattattgtgttcattaacagcaagaaattcattataaagatgactgcaaggaaaacaaaatgtaattattagacttttgtatgtaaacatattaaacacttaatatcatatgcatttaagaaaaatattttatagatatataaagcattttgctttatttatcaacaactgaacaaagtataacatcaaaatacttttaattatctttgatccagcaccgacgtaagactttcatatgtaatatctaaattttgatggtaaggaaaggtagttactcccaggttacagaaaaaatatatatatttttaaaattctgtaaccaagttaaactgatcttttaaaatgcacatagtgtaatgactaccagacactataatatttataaaatttctccttgttaaagtttacccaaaattatcaacagattaatcactataaagcttaatattttagaaaataactataattttaattgacacaaacaaaatatcaactaatattctgtagtggatctgaagtgtaaactattttagttttcacaagattagctttatctaatgaacagcaaatatttagtaaacttttaaaatataaagcatatttcttcattgctgaaaataggtagtaaaggatttctatgtgtgttcaactagctgttactgcctcccctattgtttatcatgataggttctagcacatattggtgatagttcttaaagtagtacttctatactactgccattatattttaaaatacctacactgtaatcggggaatacaaatcaaaattttacaaatgtgaataactttgggtctaacaatttggtttgaaaacagttcagatagttatacaaatatgtgtgtgcactgaatgtttaatgcaagcttctttgtattagtgaaagttggaaacaacaaatatccattgatgacactgagcaaataaagtactcacctctgcatgtatatgacgacgtacaacataaccaccaaaataattatgtagctcaatatttatgacatggaaagatgcccatgatcgattaaattattaaaaaacagtatatcaagtcaccaaatagcagtgatttcacttatgtatctatatatttgtaaagaaaaaatatcttttcataaatgcagataatttgttaaaatatttgaccagtccttaacagtggtcttttttctcagtggtataatttttgtgatatctcttcaatattttatgccttcataaggctgccatttggttgtgcatgccttgtccataatagaaaaatacacagcttctgcaaacactttacttccatctatcagaaaactgacaagtttaatggtcaattacatatttgtaaatatacaatttatgaggtctaacagttgatgatgctacttagagttgtcccatccataacctcgagagccataaacaatggccctgcctttatatattgcctttaacaaacactaaatattatttctaaaataaaaacactttaattctaaaaagtccctaagtagcaagtaatagtactgtctttgtgaaaaaaaaaaaattataccagtgttacatacaatataaacaggaaatatgcacgtcaaaataataaaaaaattaaatatataattccaaattatttctctctccctatttcttaggaatcacgagaaagactaagactgactaaaccataaaatatttctgaaaacgagttgttaagatttgaattgcttgaaatgtctttgtgtgcctcacctgtggtactgccaatttcaaatacaacaaaagtgttttcttattctttgttctgggcagaagataatctgaacttagaaatacaccccatgcctctggcttagcaatacaccacttgggatttaatgttctattttaatagaggtttgtcacatcattttataatgaacactgaactggccaaaggtgaaaatgatactaaccaaaagaaaatattcatgcaatacagtcagctgtacccttattgaaaagctcgtttggtattgtagctaataggatttgacactggcgtctcagcagtcctggcacattcttggcacatggtgtgcactcaataattctttcttctccctgatgatgaaatgatgctcagagatagtatattgatgggaaatgaaagtctgatccagattgatggaaaagaatggagaataaaaaacaaacaaacaaacaacaataacacaaacaaaaactgtaagtgacaccagtattgaaaaaaaaaacaaaaaaacagtaaagaatgtgaaggagtaatgaaagcttttgacatctatggacaggtatttaagtcacatatttgagaatatctgtaaacatgttttgagtgtgtactgtgtgattggtactacactaagagctttgtatgcatcgctttgttcactattcacaaatatgtgagataagtacaattattatctttattttaaagatgagaaagctgagacacgaagggcacaaagaggttaagtagcttgctccaggtcacacagctaaggtcccagttctgtacgatttaattcttggttcttagccattatactatcataaagaagggggtgtgaagtgaaaatcaaaatatgagttgcattattttcatttctagctatgatggagtagcttgtagtagaccaatcacctgcttagagctactagaaaatctttattaaaatacacacagacaaagaagcatttttttaaagcactggagagctttgagcttgctaggatgttaggacaaagatcccggaaggacggtaaattcattggacgtaagacatacataaatactgtccatttttctccttgggacatgagctattttcttaagcagttaccaggtagagacagtgatgtcagatagacgctgccaccaacagaagctggtagagctttctgcactgtcaaatagctagggagacaaaaagttagggtgtatatctattaagatagctacgaattgagggattgagatcctgacgagagaagagaggaacccaggagttagcccagctctttgagatagttttccttgagacctttgcagttcttaagccttacaaggtaaaaggctatgaacctaaacaaacaaggagctgaaaagctgactggagctgctggcacctttaagttgttacagacacaaaaattagatttgagagcccataaggaaggagagtccctgataaacatgtcaggcccttagttgggtccctcttggcgtataacacaaagtttggggaaaccagaacaaagctgagtctagactttgaaaattctaaacctcatcctcttcctcatgaagttcttgtttggagggatatattctgattctactccatctgcctgctagaagatagagtgaatcttctctgtagcttctacagtttttcacacaatgtccagtatatgaaatgaaggtttgtgtcctcctcgaaatgaagccttaacccccaacatgatggtatttggagatggggctttggaagttaattaggtttagatgaggttagtatccttataatcacagaataagagaccagggttctctttctctccactacacaagtacagagcaaaaaggcagccttctgcaatccaagaagggacctgtcaccaggaaactgaatcagccagcctcttgatcttggacttctcagcctcaaggatttgaggaataaattcctgttgttaaagctacccagttaatgatattttgtatgacaacctagggtagagaattaaatgcaatatcaccaggcatacaaaaaatgccgtgagaataagagacaacagaaacatactcataagtgatacaaatattagaatttccagatacgcactgaaagtaaatgtgttaaaatagtcaggatggcaacagagataactgcatcagagaaatggaatctatgaaaaataatcaaacaaaaattctaaaatgcaaaaaactgcagtaactataattaagaacccaatgaataagttaaattccatattagacagaattgaagagggaattggtgatttgaaacataaagcagtacaaaatattctagttgatatacagagaagaaaagaataaataatgcagaaaaaaatacaaaacttacgagaaacaatgaaaaggtctaacatacttttagctggaatcctagcagagtggattctataatgcaccactccaagattaaggcagtcattctcccaagtgctggaagtattggcaactcaagccccttggccaaatcctactctaggaattttccttagccaaagatatatattttgctcaaggctgcattccatcttggaaggctgttgacatccagtgactagttgatgcaatgacatgaagatctggaccacttgaagggacatcctagctccagagctgcccgtggaatggctgaaaaatttgttgccacttcatcacagttttacttctctctctgcccattcagacttctttactccttatataaatgctaatgctgagggcactccccaaattcttatctcagagtctatttcctgggaaactaagacagttggtgctggtaatgttcgaaagaagcaaacactaaaatgggattttggaatctgtcaacctaccagctggctggcaacggtcactggttgaaggtgaagtgctgaatagcccacggcattgtgtagaaattccatagttcactggggtgaagtggggtgggatgacatgtagaagaaaatgctgttgcttgtacaatctctcaggtttttgagaatttagggatactactaattacaaagataatagaatcagaaggcttctgataaatgccaattatgcaatggagaaaaacggtgaaaggctaagggtgactaactaaaatcaaaattaattaaaaacaaaagaggctttctttcacagcacataaagaaatataattgtctatctagcctgaagaatctactgacaactgttagaattaataaatttaggaaggtcactagatacaaagtcaatattttaaaattgcacttctacagaccagcaaaaataaatcatttagaaaacgacaatttaatatatgcatatatactatgatggattggctgcaaagaaggtcaccaacaatttcttcatcctgtatacctatatcaatgcaccaatcaagaattaggttatttttacctactacttaaagctggactgggtctgtgacttgctttgaccggtagatttcagcagaagtgttattatatcagttcttagtttaagcttaccaaggtcttgcactgctgtattcatttttgaaagtaagctaccaaacatagaacttgggctagactgtctaatcatgacagaccatatgaagagagtaagaggccatatggaggaaaatcaatgcatcccagacaatagccagtacatccattttattgtggtgatgcttggctcccagaagaaccatggcagctgtcatcaggagagacataccaaatatgctgagcctggcccagttccatgacgttcagaatcatgagcaataaacctaacaaactttgatgatggtgtgtagtgcagcaatattacatgtgcatatatataaaatatatattataatatcttatacattatataatttataatataaaatatataatattataatatcttatacattatataatttataatataaaatatataattatatatatatgtttggtgcaaaagtaattgtgggttttgccataaaagtaatggcaaaaatcacaattacttttgcagcctcctaacatatacatcagaatagacagttcacaggctgacacaatgtggaaagcagcgtaagatcacaggtacagagaaaagagtaaaccatgccatgaacttacattactaaattttatacttgaaattacatttaacaatgatgcagatatagttttgagcaaaggtagcttcttgagatatttctgcatacagattcaattacatttggttaggaaaatcagcatcttgaactaataacaaaactggaatttcttcaccactaatttaagaagaggagataaaaatagtgttgagttgatttttatataataataatgtgaagaaaaaatgaatgcaacaataaaaagaatgaaatcaaaaagaaacactgggggaggttccaagatggccgaataggaacagctccagtctacagctcccaccatgagagacacagaagatgggtgatttctgcatttccaactgaggtaccaggttcgtctcaatggggcttgtccggcagtgggtgcaggacagtggatgcagcccactgactgtgagctgaagcagggtgaggcatcgcctcacccgggaagcacaaggggttggggaattccctttcctagccaagggaagccgtgacagacagcacctggaatattgggtcactcccaccctaatactgcacttttccaacagtcttagcaaatggcacaccaggagattatattctgcacctggctcagagggtcccacgcccatggagccctgctcagtgctagcacagcagtctgagatcgaactgcaaggcggcagcaaggcttggggatgggcgcccaccattgctgaggcttgagtaggtaaacaaagcagctgggaagctcgaactgggtggagcccaccgcagctcaaggaggcctgcctgcctctgtagactccacctctgacggcagagcatagctgaacaaaaggagcagaaacttctgcagacttaaaggtccctgtctgacagctttgaagagtgtagtggatctcccagcacggagtttgagatctgagaacggagagactgcctcctcaagtgggaccctgacccccgagtcgcctaactggaaggcacctcccagtaggggccgactgacacctcatctggctgggtgcccctctgagacgaggcttccagaagaacgataaggcagcaacatttgccgttctgcaatattcactgttctgcaccctccgctggtgatacccaggcaaacagggactggagtggacctccagcaaactctaacagacctgcagctgagggtcctgactgttagaaggaaaactaacaaacagaaagggcatctacaccaaaaccccatctgtacgtcaccatcatcaaagaccaaaggtaaataaaaccacaaagatggggaaaaaacagagcagaaaagatgaaaaatctaaaaatcagaacacctcttctcctccaaaggaatgtagctcctcgccagcaatggaacaaagctgaacggagaatgactgacaagttgagagaagaaggcttcagacgatcggtaataacaaacttctccgagctaaaggaggatgtttgaacccgttacaaagaagctaaaaaccttgaaaaaagattagacgaatggctgactagaataaccagcttagagaagaccttaaatgacctgatggagctgaaaaccatggcatgagaactacgtgacaaatgcacaagcttcagtagccgatttgatcaactggaagaaagggtatcagtgatggaagatcaaatgaatgaaatgaagcgagaagagaagtttagagaaaaaagagtaaaaagaaatgaacaaagcctccaagaaatatgggactatgtgaaaagaccaaatctacgtctgattggtgtacgtaaaagtgacagggagaatggaaccaagttggaaaacactcttcaggatattatccaggagaacttacccaacctagcaaggcaggccaacattgaaatcaggaaacacagaaaatgccacaaagatactcttcaagaagagcaactccaagacacataattgtcagatttaccaaagttgaaaagaaggagaaaatgttaagggcagccagagagaaaggttgggttacccacaaagggaagcccatcagactaacagctgatctctcggcagaaactctacaagccagaagagagtgggggccactactcaacatgcttaaagaaaggaattttcaacccagaatttcatatccagccaaactaagcttcatacgtgaaagagaaataaaatcctttacagacaaacaaatgctgagagattttgtcaccaccaggcctgccttacaagagctcctgaaagaagcactaaacgtggaaaggaacaaccgttaccagccactgcaaagacatgccgaattgtaaagaccatcaatgctaggaagaaactgaatcaactaaggagcaaaataaccagctaacatcataatgacaggatcaaattcacccataacaatattaaccttaaatgtatatgggctaaatgttacaattaaaaaacacagactggcaaattggataaagagtcaagacccatcagtgtgctatactcaggagatccatctcacgtgcagagacacacaggctcagaataaagggatggaggaagatctaccaagcaaatggaaaacaaaaaaaaagcagggattgcaatcctaatctctgataaaacagattttaaaccaacaaagatcagaagagacaaaaaaggccattacataatggtaaagggatcaattcaacaagaagagctaactatcctaaatatatatgcaggagcacccagattcaaaaagcaagtccatagagacctacaaagagacttagactcccacacaataataatcggagactttaacatcctactgtcaacattagacagatcaatgagacagaaagttaagaaggatatccaggaattgaactcagctctgcaccaagtggacttaataaacatctacagaactctccaccccaaatcaacagaatatacattcttctcagcaccatgtcgcacttattccaaaactgaccacatagttggaagtaaagcactcctcagaaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataaagaaatgaaggcagaaataaagatgttctttgaaaccagtgaaaacaaagacacaacatacaagtatctctgggacacatttaaagcagtgtgtagagggaaatttatagcactaaatgcccacaagagaaagcaggaaagatctaaaattgacaccctaatatcacaattaaaagaactagagaagcaagagcaaacacattcaaaagctagcggaagtcaagaaataactaagatcagagcagaactgaaggaaaaagagacacaaaaaacccttcaaaaatcaatgaatccaggaactggttttttgaaaagatcaatgaaattgataggcagctagcagactaataaagaagaaaagagagaagaatcaaatagaacaataaaaaatgacaaaggggatatcaccactgatcccgtagagatacaaactaccatcagagaatagtataaacacctttatgcaaataaactacaaaatctagaagaaatggataaattcctggacacatacaccctcccaagactaaaccaggaaaaagttgaattcctgaatagaccaatagcaggctctgaaattgaggcaataatgaagagcctactgaccaaaaaaagtccatgaccagatggattcacagctgaattctatcagaggtacaaagaggagctggtaccattacttatgaaactattccaatcagtagaaaaagagggaatcctcccttactcattttatgaggccagcatcatcctgataccaaagcctggcagagaaaaaacaaaaaaagagaattttagaccaatatccctgatgaacattgatgcaaaaatcctcaataacatactggcaaaccgaatccagcagcacatcaaaaagcttatccaccatgatcaagtgggcttcatccctggaatgcaatgctggttcaacatacataaatcaataaacataatccatcatacgaacagaacccaagacaaaacccacatgatagtctcaatagatgcagaaaaggcctttgacaaaattcaacaacccttcatgctaaaaactctcaataaattaggtattgatggaatgtatctcaaaataataatagctatttatgacaaacccacagccagtattatactgaatgggcaaaaactggaagcattccctttgaaaactggcacaagacagggatgccctctctcaccactcctattcaacatagtgttggaagttctggccagggcaatcaggcaggagaaagagataaagggtattcacttaggaaaagaggaagtcaaactgtccctgtttgcagatgacatgattgtatgtctagataaccccactgtctcagcccaaaatctccttaagctgataagcaacttcagcaaagtctcagcatacaaaatcaatgtgcaaaaatcacaagcattcctatacaccaataacagacaaacagagagccaaatcatgagtgaactcccattcacaattgcttcaaagagaataaaatacctaggaatccaacttacatgggttgtgaaggacctcttcaaggagaactacaaaccactgctcaacaaattaaaagaggacacaaacaaatggaagaacattccatgttcatggacaggaagaatcaatatcatgaaaatggccatactgcccaaagtaatttatagattcaatgccatccccatgaagctaccaatgattttcttcacagaattggaaaaaaactactttaaagttcatatggaacaaaaaagagcccgcattgccaagacaatcctaagccaaaagaacaaagctggaggcaccagactacctgacttcaaactatactacaatgctacagtaaccaaaacagcattgtactggtaccaaaagagagatacagaccaatggaacagaacagggccctcagaaataataccacacatctacaaccatctgatctttgacaaatctaacaaaaacaagaaatggggaaaggaatccctgtttaataaatggttctgggaaaactggctagccatatgcagaaagctgaaactggatcccttccttacaccttatacaaaaattaattcaagatggattaaagacttaaatttcagacctaaaaccataaaaatcttagaagaaaacctaggcaataccattcaggacataggcatgggcaaggacttcatgtctaaaacaccaaaagcaatggcaacaaaagccaaaattgacaaatgggatctaattaaactaaagaacctctgcacagcaaaagaaactaccatcagagtgaacaggcaacctacagaatgggagaaaatgtttgcaatctacccatctgacaaagggctaatatccagaatctacaaagaacttaaacaaatttacaagaaaaaatcaaacaaccccgtcaaaaagtaggcgaaggatatgaacaaacacttctcaaaagaagacacttatgcagtcaacagacacatgaaaaattgctcatcatcactggccatcagagaaatacaaatcaaaaccacaatgagataccatctcacaccagttagaatggcgatcattaaaaagtcaggaaacaacaggtgctggagaggatgtggagaaataggaatgcttttacactgttggtgggagtgtaaactagttcaaccattgtggaagacagtgtggcaattcctcgaggatctacaactagaaataccatttgacccagccatctcattactgggcatatacccaaaggattataaatcatgctactataaagacacatgcacacgtaagtttattgtggcactattcacaatagcaaagacttggaagcaacccaaatgtccaacaatgatagactggtttaagaaaatgtggcacatatacaccatggaatactatgcagccgtaaaaaggatgagttcatgtcctttgtagggagatggatgaagctggaaaccatcattctgagcaaactatcacaaggacagaaaaccatacagtgcatgttctctctcataggtgggaactgaaaaatgagaacacttggacacaggatggggaacatcacacaccgcggcctgttgtggggtggggggaggggggaggggtagcattagaagatatacctaatgtaaatgacaagttaatggttgcagcacaccaccatggcacatgtatacatacgtaacaaacctgcatgttgtgtacatgtaccctagaacttaaagtataataataataataataataataataataataataataataaaagaaacactgaaacaaagaaagggcacgcaatatatatatcatgcattgtgtgagaaagtttaatcatgaagcagtgtttatagaattagttctaaatcaaaagtagaaggtaaatgggattgaacatctggcaatctagtattaaaagtggggagacttccagaatcagacactggcttatctatttctgaagcatgtcagtttctaatttatacagtcttaattggcagactgttgggccactttcctttaaggttaaaatgtactttgcatgcttagttaatatggtgagccaaaggaactaaaagacaaacttacaattatttttaaaatgcttctatagacacctgggtggatgtactattatttgtagcctaatacctcagtttaaaaaagggcaatattgatccaacaagaaatagcctaattttgtgatttactgaagagttttttaatttactttgcagctctctctgaagatcttttattcttttgaatcacattgaaaaataaacccaacagtgcagacccatgcctctgcctaaggggaaaatgctttgttcaaacagaaattagctatttagatatttaggatttcacaatgctaagcaatacatatggactttctaaagtatcatttaatgaataatgaagccactttaatacctaagaaaagaataagccctcaaacatttcaaagaatcaatttaatttgatttcttatatttcctgtggcataacaaagaaaggattacagccaacactgaggagaaaaagtggagttttagagggatcaggaaatcgttataattcccagagttgcagacaatgctttactttcaaatattcactaagagcatccctcagattcagaggccgctgaaatagtcactgtggtagaatcagaggggtataatatgtgtgtgtttccgaatgcaagcgtgtgtataagagtgtgtgtgttaggaagggcacacaaaagataggacaaggtagataaggggcatccagagaagaagaaaaagtaaagaaagtggcagagaaccttcaaagcaaacacatgctttatcctcagagatgattttgcattgccagacctcctaccaacatgctttttgaaggactcgagatgccgatacacttaaaagaagtttgtatgtcatcaggaacagttaaagcttattgaagtgttgatctgggatcagtaggaagtcatccttttcagactgaactgacacacatgaagttgagtcagaattacgttgaggatttataatgagtattgcagaaaccatttttcaggacaatgtttatacttaaagtggctttattaagaaggcttatacatgtaggtcacttattcaatgcaatcaacaaggattcttctctttttatttttttaaagtgcttgtttttcctgttttgactttagaaactaattaagtaaaaagtggaaaattaatttattatgaggaaaatttttattttgattagaaacttttccctaacttactggaaatcacaagagtcacaataagtcacaatgaagcaacagtcacaatgatacttcacaaaatagattttacacagatacatttctgaaaaatcatcttcttgattattactgcatacatatttacaagtcgcaaaagaatagcatgccactttaattttagtaccaaaatggccattgcatgtaagaccacagcattaagtcaccaaattggataatttactttaaaattttagtgtcaaataaagttgtatctgatagagacagatctgcaacattcctaacaatctttgtggctgagggtttggccactttttctaataagctcaaaaacgcagcgcagttttctttttaacatgattcagctaaacagaaaaatcattaaaataatttgcctagacaaaggcaatcctcattgcagaagccccagaatatcgctttacagaggacattctgtcagtctgcggttttgcatatactaaaaccacactttctggaatgtgatcaacaaatggctttacctattgtaatatgagtcctagagtaaaaactgaatcaatgaaaactaagattaagtattctaaattaatgtttgtacaaacagtgcctagatctctctgagcttcttcactagagaataaaaacaatcttaaccttagggttctctgtatttaaaatagcttatttaatgcacttaaccagggaggtgaagtatctctacactgaaaactataaaacactgataaacgaaatagaaggaaagataaataaatggtagggtatcctgtgttcatgcattggaagaatgaataatgttaaaatggctacgctgcccaaagtgatctacagattttatgcaatccctatcaatatgccaatgacaataccaacttcttcacagaaatagaaaaataaggttctgaagtttatatggagccacaaataatcccaaataatcaaagcaatcctgagcaaaaagaacaaagttggaggaatcatactacctggcttcaaaatatactatacagatagataaactaaaacagcatggtactggcataaaaatagacagaccaatagaacacaacagagaacccagaaatatatgtatatacaacaaatcgtaccccataaatatgtacaattacaatgtgtcagttatgcacattttatttaggttgctctggtctcagtgacattcattgttgttactcaaagccagattatatattatttttatatagtataatatataatctataatatatattgttatatattatataatattcttatcagatagttctgatttaaagtatcctctgttttcattagactttgataataatacctgtctcttcatagaattctttgtcattgaatgaataaaatgttaaagacaaagagtatttaagaatcaagttatggagtaaactgataattaggtccagataatttaaactcttttaatgtatttcctaaaattttggcaaattttagaccccgctttactttctttattatttctattatcattattttttgatcatcttggccctgacacccccaaacaagaattgctagtaagtgggaaaaagtttaaactttaaaacgccaggacccggctggttgcggtggctcacacttgtaatctcagcactttgggaagctgaggtgggaggattacctgaagccaggagtttgagacaagcccagtcaacatagtgagaacccccccaccccacccatctctacaaaaaattaaaaaattagccaggcatggtggcatgtgcctgcagacccagctactcaggaggatccctcgaacccaggagttggaagctgcagtaagctgagctatgactgtgccaccacactccagcctggatgacagagcaagaccctgcctttttatttatttttgtcaacagattttaagtgctaaggatttgttttattacacttcatcatctttggtaaagatttcttttattggatttttcaactgcctttcataactattttccagcaagcacatgtaagtaaaagttgcatatatcatatttatctatgaattattggagataaaatatgactataataattgaatattaattaatattaatatttggttttcaatacttattacatgtaatgtcttagtaagctttggatcctttattagaaacctgtgggatataataaactaacttatcatttaagtaatatttttacccatttttaattaccagcaaaagatttaatattgttgaaaagcaaagtaatggaaatcagatgtctggcacaaaaagtaaatagtgtatgtattagaaacttctttagccctgtttcccattcaattagctcacctttttctccatttctgcctgctcactttcctgtagatatataccctgacctcacctctacttctgctctgacttcctgatccttccaacacccaaccatgtattacctagaaatgcaagggaataaatattctgtaggatgaccctgggtcaatgggggatggtagctggcaaataaagttccttcttctattctttgggtgaacaattctgaggtgtatttcttctttaaaaaagtatctgcatgataagcttctagttgccctaagctgtgaccccctatttaactcatccttcaatggattttcactctttctcggtttcactccttctagttccctcctattccctgagacccaaaataggactacctgcacataaggcccttcttaggctctgcttctcaggggaaaagactaagacactggatatattgaaccctttaataaggatttatagttaacactgactgattagatacctacatactggcaagaattaaactctccctaatttcatccttgatttttggatggagtttacagatgcatcctaaaataatttcctttaaatttattggtaaaatgtaaatattttaatacattttatacttaatgaaagtctgttaattattagtactcttatacaaaggcatatgtgtcattgttccctcattcaaaaatggcacatttcaggaattgaaaaaaaaaatctctctacatgaaggaagtagaagttggaatattttatgaacatttaaataattagcagtgtcattaattttacacagcacatatgcatacattttcagtcaagcaaatctgtaccgcagaattttccacactggttcctggagacttcaggctggtgttatctgtctctttttgcttatataccaaacaaagttactaaggcaaaaaaaaaaagcctgtctacgatacctgaacccatggcaatagtatgaataaagaatgtcaggaaagctgctagcctctctgactactttcttcacccttctatccgttgtttgtgttatgtagtacaatgcagatcttttccttcattggaaaatatcgtcttgctttcttaaagcaatgtaataaactctaatatttttgggcagcgaattcactgggacactatattcagtgcacattctgcctttattggcagagggctgagagggcgatgttaaaagttaaacacaaacaacgaaatatcagagaatgagctcttccacataacagattttatcatataactaaagatggctctttgaaattctagatttttatttttaactcttcttcttggaagttttttcaaaatgtattattacttattttactgatgtctttcacaaaataagctgaatataacttataatttttgattgcactgtcaccaggagctattggctagatggctgtaatcacaatgatgccccctgagagtaatgaggtgtatcaggtttttttatgcccatgtcaaagggtctgagactgttgcgatttttaatatattttaaaatttcataactacattcttttctctattatctggcagatttttctgttttagtagtcctgcttgagggttcttccatcttgggaattagactatcacacttcttgggatcagctgaacttcttttaagatgtaaattattcaccaacttctgaatcacattaaagataaacagattgtggcatctcttataacttgtggtgtatccatggtggtatatctagagcagtgtgatttgacacgggactgagatctgctgctctgggttcaaatttcacagttaacccgaggggatatgctgatccctccctgaacttggcaagtctgtcagtcaacaaaggtttaattgtttactcatttcaagtatttctgcttcttatagtgctgtattagtgggaggctaactcaacaaaaattcattgtctcacagttctggaggctacaactttgaaattgcggtgtctgcagagttggttccttgcgaggcctgtgaagagagggtctgttctaggcctttctccttagcctgaagttggctatcttcatgttccgatggctttccctctgtgtgcttctctctgtatcctaatgtcctcttctcataaggccacagttatactggagtagagctcaacctaataaattcactttcacttgataatctctatgaagatcctatctttagcatcatattatgaggtattaaaagttaggattacaacagaatgaattttgggaagatacaagtcaacctatagccagtgcctacagcaaaagactactactattcatttaacaaatattttaaaataacgtatccaagaatcatgttagggataagggacacaaccatgaagctatgttctgtggaactgagaaataaataatctcatactgttattatagaatattaattggaataaagttccttctgacttctttctaaatatgcattgtgtgaaagtcataatagactccactttactgctatgaaaataatttatatatgtacaggcagttcacaaaggaatctaaatgtgttagcaaattgtataaatcagttagttgtgtactgggccaaccaaagcatctatccctctaagtctctggactatgatgccgagctttatcaaaatgattgctaattattcactatgactactactggatattatgaattagtatttaaaaagttaaacattatctttacagttcttccaaaattgcaatttgagaagaaaattatgtactaatattagcatcaacattctagtgttaaataattaatgtatgtgagtactaatttctttcaaagtataaatgcaatattctaaattgaacataaatgtatcatttgtataaatgtaagtttatataaacttttctatgtatcaaatataaaatgggaacgctctaggacagcatttaaattcaactttatcattatcagtctgtggtgttaatatggaactaagtcaatatcctatatgaaataatacactcaaataaaatgccaagtaatatttctgtgcaatgttccataatcattttataaacctcatctcattctcttcttcctttcaaagataagaattcataaagtagtataaagtagcattaaaatatatatggcttatatgactccagagcagaaaacagtttaaaaataaacaagatctgttaatacattagatttttttttaatcaatagaagtttgaagcataagaaagaaattagtgagtactctcccacaaatataatcatttcttagggtacagcaccccacttattagaaaattcattcatgcataacatactctgatgaagatactttgatttccaaggctaccagacatcccaaagaaactgaggatcaggagtcttaggtcttatctaacaatttatcaggtaggacaactgataaggtggaataatgtgataaactattgggtatcagattctgttttcattttactctgaacaacctgctgcaaggagactaccggaaacagatcattttcaacaagctcagcaacagcatgtgagtaaacacaataggaaactgcttcatcagccctttcagcccccagattagaggtgcattccattaaaagccaagaaaagtgaactgttcttcagatcccttactttggtgtcagataaaatcaagtttggcaaagggctatttggcaaaacagtgaagattcttaccttcactacctaaagactatcactgtgaagacgaagagcattaatggtaatcatagatactgacactttatttgtataatttcattttatcaatccagtaattctaggaagttggtacaatttttatcccattttgtagatgaggaaactaagtcctatagtgagtaaataatttttccagtgtcttgcagctgggaagtggcagagcaggattcaaacttgatgtcaaaacccagcctatttatgaccatcatcatgacatagtaaagtcactacaagtcaaagtctatacctccagcttcatgaaagcaaaaggttaggttgtcatgcagtctagaaaccataaaaattccttcaacttaatctgattgaattctgcattttaatacagttcaatgaaaatatcattatatataagcattagataagaatcagaagtccaatctcatggaggatagaagtaatgttattgcataaattcctaaaattattaccaacttcagcttttaacttgtaaatattcagcttggaatgtttatcaaatttgtgtacgcacaagaaatttactgtattttatttttaaattatttttcctttggtttgtccatttgctttgtcgtggtttgtacttgttttcttcttcataattcaggcttattttcatctatcaaattgttaaatgcaaaagtgaaaaggtagaaaggggcaattaatttgcatggtgggaaaaaagagacaacagtacaaagagggtgtctaggagagtcaatagaatttgcaaaaaagcaaagccattattcaatacatatctcttaggcagaaagtgtggtccataacagttgtcaccgataacttcagatggaatctttaaaagtctccaaggaatgatactggattcagcagtatctatttaccgatggtagacattcttccttaaaacaatattatcccaaaattctgtcttcaagaaatctatttgttcattaatccagccattaattattccatatttattgagtatctacttatcttcttgtgttaaacagagataaaatgatgatcacaaaattgtttcaatcgcaataatatggcatggcaagaccaaggtataatgattcatgattatgtttagcacatgggcttttctgagttggagtttagaatgcggaatatttatcaggggctaccctaggatcagcatttgaaggggacgaaggaagtatgatgggcagagcgtgaagtcaagctgatcttcaggcctgctgttagcctagtcaatctacagaaagttccagagctgaaatgtcctgtgagacttcccctcattgggccaaaatggctgggtctttatatcattatctcaaccaataatttaatatggttcatcttaccttggaaagagtgtgaccttgaatgaggtgtctctctacagcttaagtgataccaaagatgctatcaactgagcactacctgacgacaagactccaggcagctgagcaacaagcctatcctcgaagcggtgtgggaggcataactatgtccatcacaccagtttctaaggcagtgaggtgcaggagggtatgagttagggaagaagggcttcttagagtaaattaagtttgaactagaaagatgaataggaagaagacaggtaaaaaggtagaaataaactgctagacaaaagaaaaagtatgtctgaaattctctattggaaagataatgctgtctatggaagtggtggaaagtatttgagttcagctggagcatagagtgctgaggcttcaaaaggcaaaaggtgatgatggagggagaaactaggtgatgaactaaatgatctgttctctgctgtttatgaatgagatactcatttcaggaattatcatgctgccctttccatggagacatatctgccaggctatcaatataacatgttacactaaattctgaatcaatgaggccactttagaataatttagagttaaaaccgaaaaaaaaatccacttttccaaaatgaatgaatttggcattaatgtcccttttgaatatttatgctaaaatgatatcattatgtacagtgctatttgattaccactcaagctttgcagaatggtgtcatgctaaggacaattgttataagtgataaaattgcttctgctgaaacatcgcctatgtgatatggtatttgagcaatagcaggggtgttctcctttgcttgggattctccttactattcccaaaataagtaatggaacatatttcaagatatatcttattcaaaatgttctcacttccagagcttgaaaacaaaaatctgtatgttctctcagagtcagaagtctgtaatgcgccgggcgcggtggcgcgtgcctgtggtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagaagtctgtaatgctactggtgtcccctaattttcttatagccacagttcctttcgcctgagctcattacagagacaaatatccattagtgacaggtaacttttcattctaatgcgcctgtagtactgatgtctgggcctctgagatattctattttgcacctgaaattagtttctgtgttacagctctgaatttgtgataagaaaacagatactgtaatttagataaactccactaaatggcttgactgaaataaagcccaaatgaaggtataaatgactgtcaagttctctggggtacagttagagaacaaaatagctgatggattgttatttatctgtgcatgtgagtttgggggatttaattaaagatgttctattatattttcaaagtctttctgaagctgtaaatcaaaagctgaagaaacagagaatgttgccattgatcaaaaaaccagatctctggccatactgggaatgtcttcttttggcggtggttttaatgtttctgtttagtgttttaccctaaacatgactataaagaaataaagggaatctttttggtataattatttcctaaaggattatttgagccattgtggtgtgcatctgtacatttttatccatacatgtaacatgtatgtttacatatgtttatccatatgtatgcacgtacatatatatgtgtgtgtgtgtatttgcttttcttagtgataagtattctttcttaaattggctttaaacataaatccccaaaatgtgccacaagtagaattatgcaacaaaatctgcatcacagaagaaaattgaacccaatataaaatgaatttcaaaaatagggccattctatgttcttaatatccattcctctttaaaaaaaatcttcaactgttactaaaacataatggaagtattatgtgagctaattatacctggaaaaatcatatggcataaataaataaataaataacagcatggacaggatcccaagggtcaactaatctgttctctacttctagttagcattgtgacatgtatactattattaaaccacttcagaaactaaacagaaactactcttttgtagaggattaaggatggtcacagttctttgatattacttgcagggaaatataaagtctgtttttggtcgctttgaatccagagtggcctgtaatggtttaggccaacagaatgtaacagaagtttgactttgccagatcaaggccaagcctgtgtgtgagaaaactggcaactttggctggcctcttcaagccctgggttgttacgtaagaagtctgactacttgtcagaaagatcgcttggagaagccatgagaacacatagagaagggggtagctcagctgacccagccctctagctgttctcaccaaggtaccagacacatcgctgaagctattctgtatcttctagtccactccagttcccaactgatctagttggcacccatggaatagaagtgccaagctgaccctctggaggtcctggtcctcagtatcagtaaaaaagatgatgctttaagctgctaagtttacagtgtattgttacacagcagtggataactggaacaagcttgaaagcaagactgaaacatgcacttatattcattcatgtttttgaatgcatagggacttttttgtctactatacataatgacaatttttctaactacagtggcaaaataaaatcatatggactttatcttcattacagctcagtcaagaaaaaacaggattggactatttcttgagtaagtcatcctgtttggccaaacactgtataatcaacttgaatttattaaatttttagaaagttttgctgttgatttatactgtgtaccataccacttaacatgttctttggatttcgtgcatctacttttttttctgaacaactaatttgataggagagttctataatatgctttacttttttgacttctagttttttattttaaagaagacagagacctcattagagattaaaatgataaaatgagtccgataaatatgaaaagatttgatatctattttttgtgagtctttcatctgagttatgtaaatccttcaaacaataatctctcctatgtgatcccatctttaattctcagacccaaaggactagaactatgttctgtgatattgtgcctagcatggcattttagagtttgcagatgctccataaattggtagaatgaattaacttgattcaaatgattgccagtgctctaataaacacagatgtttttatggatatgataacattttagaattaaggtataggagatagtcaatattcttggcccttttctattatttccaaggagactttctgaccccaagttagactggggtaggagttacaggtaataaaaagaacaaccttttccctttcttcatactactctaagaagctctttaaatatatgcttttagaaatggtgcagcaaattctagtaacttttatattttaatttttgatagctgcaaattatgccccatgtaagcaaatacttgatctctacaactattagatttatcatttaaagaatacatgcctacttgcaagttaaatgtaaattgaccctactttctgacctattttctctatccttcatttgttccatttgaccagttttaacctaattttcttgctctattatgtgtatcttcaaatagtgttttaaattatttcttgatcaaattttaaaaaaatgagtgagcaacaaacacacaaataaatgaattggcatgtgatatgacaatttgtaagatttttgcacttggtaatatttcacaagtttagttgatggatcctcattggtatcagttttaaactagagattattctggataataaatgggtaggtcaaactgtagcccattcacatctgtctctatgagaatcctagaaccaagcaatcatgcctcttacctaccatacttatctgtcccacgtttatccctgcaaatggacaatacaaattaaagctagtcagttatgcatgccattgatggatctgtttccttgagatctggaaaaagtggttcttcctttttacatttctttctcatggttggttaatccttagagaacaattttcacttggcacctgtattagtccattctcatgctgctataaagaactgctcgggactggataattcataaatgaaagaggtttaattgactcatagttctgcatggctgggaagacctcaggaaacttacaatcatggcggaaggggaagcaaacacgtccttcttcacatggcagcaggaaggagaagtgccaagcaaagggggaaaatcctcttatcaaatcatcagatctcatgagaattcaatcactatcacgagaacagcggcatggggtaaatgcccccatgattcagttacctcccatgattccctctcctgacacgtgggaattatgggaactataattcaggatgagatttgggtggggacacagccaaaccatatcagcttcatatagattacttgaggtctttatagacagcagaaaagtatagtggtaatattactttgggtgtcaggaactcttgtgcttatgcaagttcaaatgtgtaagaaatggttccttagcacagttgtgcagaacattgtttagacaaaaggaagtgagaaacaatttaggcaagcttttccataaagttaattcaactgaatttaaagaactccactttaaattatgttctattttttaattcatttgttttggataaagattattttatgaaagccatgtggtaagaaatgacataatattttgtttgatatttgcacgtggcacctccaagatgatccttcaaacaaaacaaaacagaacatgatgacaagaaagtcaaagttcaagaaagactacacttaagaaattccctgagagttacaatcatattaaggttaacacaaattcctaaagaacttatacatctgtcctcccaagtgttgaggatttaatagtggcctaaagataggtctcttcacagataaaacaaggaagagaggataccttatgttccattgtgacccatctacttaatatacctgtgagggaagaaaatcccactgtaagaatgctgactaagctcagtcttgtatccaaactgcttcacacctcctgagactttcgtgaggttttaacattaggaatcaatgtggcctttggcaaatcattccacacaactggaactctatttctttattcaattcactgtctcttcaattgatatttattgagggcacattattgagcacccagtcaatgttattgtcaatggtgccacagaagggaacacaatagattaaaaatccctgacctccaaatgggatctaattaaactaaagagcttctgtacagcaaaaggaatggtcaatctacagacatcttacctacataatagaagtgaatgttcacaaactatgcatttgacaagggtctagtatcccacatctataaggaacttaaacacatttacaataaaaaggaaaagaaccacattaaaaattgggcaaaggacatgaacagacacttttcaaaagaagacatacatgtggccaagaagcatatgaaaaaaagctcaatatcactgatcattagagaaatgcaaatcaaaaccacaatgaggtaacatctcacaccagtcagaatggctattataaaatgtcaataatataacaagtgctggcaaggctgtggagacaaaggaacgctatacactggtggtggaagtgtaatttagttcaaccatttgtggagaatagtgtggagattcctcaaagaccaaaaatcggaattactatttaacccagcaatccgattactgagtatatacccaaaggaatattaatcattctatcataatgacacatgcacatgtatgttcactgcatcactattcacaacggcaaagacatggaatcaacctaaatgtccagcaatgatagactggataagtaaatgtgctatatatgtaccccatggaatattagacagccataaaaaatgagatcatgtcctttgcaggctcatggatggagctggaggccattatccttagcaaactaacacagtaaaagaaaactaaataccgtatgttctcacttatatgtagaagttaaatgataagaacacatggacacaaagaggggaacaacagacactgggacctattggagggtaggaagtaagagggaggaaggagaggatcaggaaaaataactaatgggtactgggtttaatacctggctgatgaaataatctatgcaacaagccccaatggcaaatgtttacctgtatgagaaacctgcacatgtacccctgaaattaaaagaaaaaaaatttagttctcaagggacttctacatgttcccttaataaaacatgtgtcatttgattacaattgctatggggtgctagggtacctcagtatgtgaaataggcagaatatggaagaacgctgttctagggaagggaaagatgagtctgaagacactgacgtagaaatgtgtctggcatgttcaaaaagcagcaaaagaggtcagtgccgttgggccagattaaagaaatgactgagtgatgaaagatcaaggagatgctcagaagccaggccacatagtcttacagactgcactagctttcatttttggtgaaatgggctactattgaacggttctgaaaagaggagtagcacgaactgacttgtgtttgaaggggttcattctgctgctgtgatagaaacaggttttggagaagaaaggaagggtatgaagaccaggtaggagccccatgcatttaaatcagggtagtaacaatggaggcagtaagaagttgtaaaattttcaaaaataaaaatgatcaaatcacatttatacacttagtcaaaaagcacttaatgaacactctgatacggtttggctatgtgtccccacccaaatctcatctctaattgtagtccccacacgaggagggagggacctgtaatcctcacgtgtcgagggtgagaggtgattggatcatggtgtcagtttcccccatgctgttttcaagatagtgagttctcatgagatctgatggtttcctaagtgtttgcaagttcttcctttgcagttcattctctctctctcctgctgccttgtgaagaagatgcctgcttccaatgctgctatgattgtaagtttcctgagtcctccccagccatgtggaactgtgagccaattaaacttctttccttcataaataacccagtctttgtatttctttacagcagtgtgaaaacagactgataagcattcactggatgccctgctctaagagttacacacataatagggaagaaaacaggtcagctcttacttacatgggcatgatatttaatggagtcctttaagaccaggtcagcctacattcttggtgtagttcaaagagatccaggaaatttactgttttcagcagggggattaaacacacacatgcacacacactgtggtataggttgtgattaaaaagcagggtggctaatggatgaggttgctaatcattgcctcgtcttccatcagcaactcactaagaagccagtgaaaaaagagaatgttgtatctaaaaaatgttagttatttgcacagatgtctgctctctctgaggaattcctatctccactttcagcttcgcaaagcatgtccctttatggaccatgttattaatgaaatggaaaagaatgtgcaagaaagcctactgttgtctgaaattatctttacttctatactgccgctggcaataactgtctcttctccagaattccagaacagtgaattctttcttcacgagattaaaagcaaaacaataaaaacaaaacagaacaacaaccacagggagaaaaataacttaccattttggaattatagatattgtattttgagttgtgctgatgtgtactacttctcagcaattcaatctttttttattaatgtaagattatctcaaacattattaacagattgcctaatgaataaggcaattctccatcttgtacattcctccaaacccaataaatcagtgagaaattcaaattgctatatatatatttttaagctaccagtagtgaattgtaattgctgattggatgtcacctgtttaacagcaggtcataatggtctggaaaactgagagaatataaggaacctgccctgatggagtacagcctctgtgaaggaaaaagtaactagttcatttgagtcctccagcagaccctttgtctagaacctcgtccttgcaaacatatagtgtgtaagcagggggattccacatttgctcattcacattgtctagaaacttatggctaaatgatttttggatgtgtattcagacataacctcaattatatcttatagcagtcattctttttttttaaatttcaatagttttgggggtacaagtggtttctgattacatggataagctctttagtggtgatttctgagatattggtgcacttgccatctgagcagtgtacactatatacaatgtgtggtcttttatccctcactccaacccacccttcctcccaagtccccaaagtccgtcatatcattcttatgcctttgtgtccacatatcttagctcccacttataagtgagaatgaacgatatttggttttccattcctgagttactttacttagaacaatggcttccagctccaaccaaagcgctgcaaaggccattattttgttctgttttatggctgagtagtattccatggtgtgtgtgtgtgtgtgtgtgtgtctgtgtgtgtgtgtgtgtgtgtattacagtttctttatccactctgattgatgggcatttgggctggttccatatttttgcaattgctaattttgctgctataaacctgcatgtgcaaatatcttttttgtataatgacttcttttcctctgggcagatacccagtagtgagattgctggatcaaatggtagttctacttttatttctttagggaatttccacactgttttccacagtggttgtactagcaacattcccaccagcagtataaaagtgttcccttttcaccacatccatgccaacatctattattttttgactttttaattaaggccattcttgcaggagtaaggtggtatctcactgtgattttgatttgcatttcccatagctatttttcttaatcaggaatatataccagaattacttttggagtttgttataagaaagacatatgtaaattcttatcatagatatgaatattctgattcagtaaatatagcatgcctgagacctaagcatttacataatgaaaatgtttcctagaattttgttttcgtaacttgattgacacaattcaaaaaactgtatgaagaaaaattaaatatgtattaattgtacatattatgggggggggtgtgtgtgtccctgtaaaattatcttttaaaaaagagaacaaagtaatagagtttactaccaaccatttttcactaaaataaatataaatcaaaataaatctttccaaattgaatgtctaaaatccaagaaaaaatgatgggcaaaaatactggtgaatatttgagtacatctaagtaaatacatacatacatacacacacacacacacacacacacacacacacacacagacacacagtcaaataactgtatcctttaaaatacatcactgagctagcaagacaaaaaagtccacagaggtcaaagaataaaaaagcaaaaattgtagaagttgttcagtaaatgccaaagtcagcattaccctctctaaatgaaatcttgatatccttgagcatctgtttatataaggtgcaatacacagaaggaaaagcccaagttttaccccatgtatggagaacactagaagacatcatgtaaatctgagaacctaaggaacagcaactcagtataaggtttaaagagaaataaacacaaggctataggaaaacacttcatctgtcttgattttagcattaaatagaaatattaaataattcaaaattaaaacaaaaaatgaaaccacaaaattttaataacaagaattcatgcaattttgcagtttgtttccatttttgtgttacctattgagcataaaagcaccatgagaagaattaaatcaatggcgaattttcactggacaaaatgcaacttcaatatagcctcaaatggtttacccagtaaaatgtttcctagaaacatgtccctgcagtgaaaaattacaaaataaataaggcagcaagttggtatgaatgagagaaagtagaaatagaagaaaaatcaaactcacatagactttttatataaaaattaacaaccaaacaaaaggttatgtttcaaaaaaacccttaaaatatgagcaaggagttagaaagcattaaattaataaagtacacttgaaaagcaaccaaatagtttttttagaaataaaaaatacaaaaattaattttagaaagttagaagaatgggttgaatttgcgctatagatacaactgaataaattagaagatgaatgagaaaaaattcattacagagagaagaggagatgaatagtttgaaataaaataatatgaagagaaaattaaaagttatgtctctttgaatttctagaaagagatagcaaaaagaatagaattatcatacgtacagtataaaaaatatttctagaattgttggaagatataatacctcacacccagaaagcccaaaatgtctctagcaggagaaacaaatatataacaatctatacctagcagtttataataaaaaagctgaatgccaaaaacaaagagatatcacaagtaacaaaatagaaaggataaatcaacttaagatgtgtcatttaaaccaataactatcattttgtcagcaaaaatggaaaccaattgacaatagaataatattttcagtgtgttgattgatgacaattctcaacctggaattctatactcattaaaaatatcttttaaaactgagaacaaagtagtagagtttactaccaatcatttctcactacaataaatttaaatcaaaataaatctttccagactgaatgtgtaaaattcaagaatgaataatgggaaaaaatactggtgaatgtatgggtatatctaagtaaatatggaagtatacatcaaaaatgaatatgataagatttggggtaaaataaataagaagtaaagaaaaaccacagaagttggcttaacttatgagaaagagagaaaaaaacttcccatagctaacttactcatctttatacaattatcactcttaaattactttgagcattaaatagaaaggatttgctaaggattcacagacttaaagattctttgtgtaaatttagtaaaagttaaagtcaattatcagatatatcacataattataatatgaagttcacatatccctaaaggaaaatgtaaaataataatttgcttaatatttacaatgggaaatgcaatttattaaagaacactaagctatttctaattcaataatatccaaaattttatttgctcaagctcttgagataaatcacaaaacaagcacattctttcaaaattaaaatacagttttaacattaaaactccctcttttgaatctggacttcatatgatttttctgtatacttaaattttgtgtgacatttaactgaagcctattttattttttttttttgctccatatacatactggaaatttaatatccataagatgtgaccactgatacatattaattatccaaatggaatggaaattaatattgctgttaaaacaagactttcaacgcccccccacacaatgcattgcctgcaaacttaaataatgttatgccggacatatttgttagtatgggtaattaaacatctttacaagccatctatatcatgtagttacatgcttaacctcattttataatcattccatgcggttgcatattcagaggctgccacatttatattaataagcaaatattaaaagtaaaacagaattatttagatttccaaataatttctgaagtccaaaaggcaacataatatcataatattttataaaatattttttaccacatcattatcaccattttattgttgaaagcacatctgtgtcggggaaatattcatagaataaccattcaaagaaatattcagaagattcaaggttgccttattaaattacagtctaaggggattcttattactaaaggtaactcttggtaattaccaacatgaaaagaacaattccatttatatttcagtcaagtgcaggaatatgaggtgtatatgtttgtttactgttctcttcaatagcttacaaaaatatggatatatcttaacagatataagtaacataaactaaaaggtaaattgctttaaattaatctgacatttttggatttaagggaaaaggaggtttcaaatatttgtttaaagcatttctttagtgaagcccataaggagatataagggcctaaagagctttcaaagagaaactcagaaggataatttcatgagtgccacattactcttcaatccatcactgctacatgtgttagtatattactctacatgagatccacttctaaaaaatgtctttccagtacttcatttctctatatctgtcatatttccatgtcatcctcttttctttaaaatttcagttatgttccctttttatattttccttatttatatttcctgaaagaatttcacgacagattcttacagaaaaaaaagtgtaagacaatgtttactatgtaaaatgagaaaaatgaaaatatccatttttaaaagcctaaacaaattgagcatctttgagttgttagatatttccagtgatgagctaacaaaggtttaaaagctggctttctggggaacaaaaaaagccctgatttgtagcttttacccattttcttgaggaaatactcccggtttggctcttttgaagccaccaatgtgaaatctatggacatggaattgggaagacataccagccacccattcttgcaatccagtatgagttggctctagcatatcactgcagtattttgttataaaatggctatggttctgattattcccaggcactacagtaatataaaacaattatggtttgaagaacacttcacaattaaactctagtacaattacactgaattccccactactgatcagaaattcaagtgttcccattagttcagtaagaattttcaagataagcattttagaattgcaaaaggttttgaatagccaaaagaaatttctcacatgccaaaaccaagaacagcatactttacacaactgtaactgtaaattacatatagtttattcttaactgtgtatatttgtatagctattttgcattacacatactgtaaaagttaacaacattctacaaacatttagcaccgactatgtgttagtctcaatactagatgttggcaaaagacaggtgaatcagatgtaaatcatgtctcatatatacatatatatatacacatatatatatatacatattatgcatgattactggttattaaatgtatgtaatacaagcatttcattgtttaaatagaatctgtataatcatggcccaagtgagaaacttgaagaagagtgcctaagggcacagatttattctatttccaaaaagaaaaaacaacccaagtattgcgttttatctatccccatttcctgataagaattttaatggacaatgttgaaatataaaagaagtaaacattaaaaatgttttgttttccttaaaagttttactttcataaatgtggtaacatctggtggtagcatagatggttattctgcagttgatattctaagtaaccctctttttttgtttaacagatatattagatgacattgagagatgtagatgggaaaatgaagtaattaggcaccttgcctcattttttaaaatattaatttttaaaaatattaatgtacatgatacagatatgcagagaatgaaaattatgcacacatacagtgataattatgtctctctagtttcattttgatttttatatacaatattatatatttatgtaaaatataacatcataacaataccaacagtgcagaacattaacaatcattccaacacaggttaaataagagatctgtaatcttatctcagtacagctactctaaaagtctggagtttacttttacaaggcccccaaaaggcctttcaagattaatattatcattactcagctgtgttaattagctggtgaatcatttaagcctaaatggagatccaagtaactgaatcagaaatttggagctttcccaaagaagcaaagaaaataatcctggagtttctagattgttcaatataaaggggcaaaagcatggaataggttgtagaaaaaaaactctttttgacttcaatatactaaatattataaaaacaataagctactgtgaaatagtttttcataaagttcaaacagaataagcaaacacaaatggatgctactagagcagggaaagagggaccacatgaaggcagtgagcaaggcattgattaagctgaaggttgttcaataactgctccttaattgattaaaagaaaggccaaccttgaacaatcaatatttaacccattaatattactacttgccatatttattgataaatgttgccaaagttaaattggcaacaaccaaacattaaagaaaatactaatccaagcctgaaatataacactttttccaataaactgttacaggtagaatacgtttatttccaaatccaacacatagaatataatggaaatttaattataacaactgaggcatgtttagtcacattgttaagaacataactcagttttaatcatctctgtagttcaatgaaacaataaactaaaggagttagagtggactgatctgattattgaaaactacaaacacaaaccccaatgtctgctgatgtctaaatgcttccaggtattgattaggaataaaaaaatatagatcagataaaccgtacagattgctttagataaagattaaatacaaaaccattcaattcctcccaataagttggtaaatgacagagagaaagaatgtcagtcttattttctccgcttttattcatggcttccctgttcttacatattttcatttaaaaacccaaaccaaaccagatggcagaaagaatatagagttaaaaatgtattacttatatgcctcaaggtctctctcaggtcactattagcctctaactatcacctctaaactttaataagtaataactaatgtttatggagtgcttattatgagctatacatttcatacatatctgtattttttcatttactaatcttaaactgctacatagtaaataaaattaatagggtcattttatagatggggagactgagaaataaagaggttaaataacttcttaaaagtcacccaactggtaaatgtgggggttataattttaactcctgaagttttattccagaattgagaccttgagctctttactaaaatgtgatattttcaaaagaagagaggaaggaagaggataggaaaaaacaaagtaaagagtagtgataaataagacaccacaatatcacagaactactgtaacaggcatgacaagtttggaaaagtaggtccaaatggcatgcccagtcatagggcaactctctctgtaaggacaatgagttgtctcctaggatcagtaagaaaatcattccaacaggacagcaatagggtagtgagtaagtgaagtactaggtgaagtacaagggagcaaaggaagacaaaagaggaaacagtacaattggtacttatttactctgttaccctccttgcttattaacatgaagttccattctgatgataaaaatagattaatatttgcctagacaaataaaccccaaaaaaccctataaattcaatatagtcctttatgataatcggtctctctaaactcagttctaagatccaaaaccagatttatcaaagtcctctcttgggcactgttataattcctatttgactaagtataagaattaattgaactgaaagtttaataatggctgaaaaatataattctgtgttctatatttcagtgattggggttaaagaacataaaattaaacactctgaatatcagaacatccaaggaggctatgcaaaaatttagggcatgatgtattatactttattctggggaagattttatggggctccatttgttcttttcttcctttatgggaaagatttcactgtgatgtgagttttagagacatgttccaatatacagtttcttttgtacaacatgttacatatatttaactctaatatgcaaccattaggttttttccatacattcagtcattttccaagtatctatatttttaaatgttttcccccaaatacagggggaagataagttttactgggacaaattatgtatgttcccctctcataactttaccccagggcattttttccccaaagggcatagagcagtccactaacactataaattatatccctactaccatcattggtggtgtttcccgtctaacattgtcatgtctaaaaattatttaaaatgcaattttgaagtagaaaaagtatttcataaataataagtggtttcacattatgtttaaatgtgatcattaatctataaaatttggtgagacaattatgctttgaaagcagttactgatttagttagattttctttagaatgttaagaaaatatggattagaaaatacataatccatacaatgttttcagagcatagaagttcctttaaattacactctagatataatctaggtacgattagtggtaaagtaccatgtaataacatgagactttaataaatgagtaaacaattcaagtgtacaatggaaaatatatttcacttcatatgttcattattataaagaaaataaaaatgtttctgtatctgtcaagaagaaatccaacattgtaccactatttttttagtataaaacgtttattttttactaacattgtatggttttaacaaaaaaaaattgtaaatggttttgataggttgatttaagattttattcttttaggctaactttgtataatgagtgtgcatgtctttacttcaaaatgtatgaagtgtatgaaatgtatgaaaagtgaaaaatattgtgtcaggagacagaattataaaagcttaaaaaaaatcatgagttgtttgttgttgttgctgttgtttccccaagatggctaacttgggacagtggatgccagctatctcagaaagacaaaaatgaccaagtagagtggctcactccttaatcccagcactttgggaggtcaaggtaggtggattgcttcagtccaggaatcctagacctgcctgggcagcatgtagaagccccatctgtacaaatgtacaaaaattagctgagtgtggtggtgtatgcctgcagtcccagctacttgggaggttgaagtggaaggattgcttgagcttgggagggagaagctgcagtgatgtaagattgcaccaccgcaatccaggctgggcaacagagcaagaccctgtctaaaaatgaaaacaaacaaacacatacacatacacaaaagaaaataaatcagagttgcaggtgaatggtcatgctttaaatggaaaactgagccaggacctatcagagagcccacgtgaagaagctggggtgtggaaaaggaaaccagaaagtctgcagaggtggatgcctgagaaactcaaagccccatggaatggccccacaggagatagtgtgttggctcatatgtccagtatatcactacagcaaagcagtatttgagaaagccaccacacaaaagctatcaacaaccaaggaacccatacatcatactgaatggggaaaagctgaaagcattcccactaagaacagaaacaagataagaatgtacacttttaccactcctatttaaaatagtagtggaaatactggccagagtaatctggctagagaaagaaataaaaggcatctaaattggaagagagaaagtcaaattatctccgttttctgacaaaatgatcttatatctagaaaactctgaagattcttccaaaagactcctagatctgataaatgatttcaataaattttcaagatacaaaattaatacacaaaaatcaattccatttctgtacatccaccattttcgagctgagaacgaaaccaataactcaatcgcatttaaaacagccacaaaaatacctagaaatacttttaaccaaaaaggtgaaagacctctacaacaagaagtataaaacactgaggaaagaaatcacagatgtcacaaacatatagaaaacatcccatgctcatgaataggaataatcaatatcattaaaatgaccctactttcttaagcaatttacagattaaatatgatccctatcaaataaccaatgccatttttcacagatttagcaagagcaattcaaaaattcatatggaacccaaaaagagcccaagtagccaaaccaaacctaagcaaaaacaacaaagacagaggcatcacattacctgacttcaaactatacttcaaggctatagtaaccaaaacaccatggaactggtacaaaaatagacacatcgatcaacagaacggaagacagaacccagaaatacagccacatacctacaaccatctggtctttgacaaagctgacaaaaatgaacaatggggaaaggacatcttattcaataaatggtgctaaaaacacctggctagctatatgaagaaaagtgaaatgacccctatttctcacgatataaaaactagctcaagatggattaaagacttcaatgtaagacctgaaccattaaaaatcctagaataaaacttaggaaaaactcttctggacattgacccaggtaaagaatttatgactaagacctcaaaagcaaatgcaacaacaataaaaatagacaaattatacaaaagagcttctgttccgcaagagaaacaatcaacagagtaaatgggcagcctgcagaatgagagaaaacttttgcaaactaaccatccaaaaaagaactaacatccagaatctacaaataatctaaacgaatcaacattagaaaaaaacaaatccattaaaaagtgggcaaaggacatgaacagacacttctcaaaaggacataaaaatggcagcaaacatataaaaaatgcttaacaataatcatcgaagcgatgcaaattaaaaccacaataagataccatcttataccaaatagaataactattattaaaaagtaaaaaatagcatgttggcaaagatgtggagaaaaggaaacacttatacactgttggtgggaatggaaattagttcaaccccctatggaaaacaatatggatgattctaaaacaaataaagataaaactactattcatcctagcaacctcactattgggtatctacccaaaggaaaataaatgattttatcaaaatgatacctgcactcttacgtttattgctgcactattcacaatagcaaagtcatgtaagcaacctaagtgtccgtcagtggttgactggataaagaaaatgtggtataaatacaccatggaatactatgaagtcattaaaaagaataaaattatgtccttggtagcaacatggatggaactgcgggccattatcctacaggaataactcaaacagaaaattaaacactatatattctcacttataagtgggagctaaacaatgggtatacatgaacataaagacagaagtaatagacactgggggatctaaaatgtaggagaatggaagtagggttgaggttaaaaaaaaactacctatttggtactatgttcactatttaggtgatatgttcactagaagcccaaaccccagcattacacaatatacccatgtaacatacctgcacaggtacttcctgaatcggaattttaaataaaatcatatcattgtctaattttacatagagaagttgtctgtattttttattaccaaaatatgacttttaaattaatgtccccaaatcagcctctctcaagtcaagtagcccagggagaagatttaatggaattagagtagataaagaaatgagagaacatggaaaaacaaacacacgatatacaaacagaatggaagaaagttaatatgaaaagggttcttaaccatttgagggtatttgaaccatctgaaaatgtggcaagagctaggggtctattcaggaaaatgcccatatactcataccctcaaaaggtctacaaaattgtaagtctgcattattcctagagaattgtacagcctcacaaaaattgttcataacctctatgttaggaatttatgggccagattgaggcagcaataatccagacctagagtgaaggcatttggatgttaaacagtaaatgaactgtgcagagaatagaatctatgagcctttctgtaggcttctctcctcgttctcctcacggatgacttctgatccttcaggtctcaatttaaatactatctcctcagcttctttaaccattatatttaaattgggacttctaccttattcctccttccttgtattatagtattaaaccaaattactttgttgtaatctattatagtagttgccataacttattaatgtttgcttctctatttttgtcttcctgatctataatatctatgtcttgtttgttattatgtctccaatatgtgatatattgatctgcaaatagtcgactcacaataaatatctgttgaattaaaaagtatgagtgagtagactttcaatatcgggaatctaaaggacttcaaagtattatataattctaccttcagccaccttttaggatttttgagagaaaagggagtttagaactagagggctagagttaatagtaatttctggcagtgaactatgcagccaagaatggaactgacattcatttgaaatgtgaaataatagttctcatttgtcatagtcttgggtattcatattcatgtatttgtaactaaaagattttgcagaaaggcaataaatgattcaccagaagtcattgtcataaaattatatgtttaacatattgaatatgcacttaaaattattttagatttaatatatacagataagttaaatcagatttttaaaacagataatttaataagagtagaaacaaataacaatccaacaataaaaaccatgcacatgactcctccagggtggcctgttctagttgcctcgttgttttgcagatccttctcccttatgttcaagccccttctttaacttttccttttcgatctccctaaatgctgtacttttccagtttgtgacccaaatcacctaacagggaaaaatgacagtgctcacacttcggagtatagcaggtgacatggcagatgatcaatagagatggaaattttggtgggatctataaattctcctcctagacactttatccctcttctacccccttagtctttaccaaaagttcttgtctgctgtgacccacaaaaaatgaaagaatcatcacatcagttttctttgtcaccgattgtatagtttaaggaatttaaacattttcagacactatgttttactgaactgactaccaaaagtaaaaaagattgtttgtggcatctagtttccaagagactaaataggaacaaaagcctttgtggcacctagtttcgaagagactaaataggaacaaaagcctttgtggcctcttcagactgaaccacaggtcctggtattaattcaactttctaccttggctctcccagttgtgaggtcatttggatgaaggattacagcaacattcctttggaaatttgctttaagaatcaggcagctagggatcattgaatccttgaagtttaaatttggaaagataaacaggaataattgtcacaacaacaaaacagcaaggacaggctacattaaccaaatctagactccttcactacttctggatgagagagtgggttggaagagggagggaggggcaggaagagggagatttggagagagctccagagagagagagagtgcaagagagcaagtgagcaagcaagcacatatgagcaagctggaggtggaggaggcaggcaaaggagaccaaaatataaccagagtatgtaattagaagtttagagtcactttcctatcacctacttcctttaatttctaagactgaaaaaatacaatccaaagaaaacatacaattttttaaaaccttctatttttatttttattttttttaaattttacattcagagggtacatatgcatgtttttttacatgggtatgttgtgaaatagtgggcattgggcttctagtgtacttgaaactggcccaattttctgatagagctgatacttttcgtttcttttgaataaacacagaagtttactatcctaagtcttaaaacttgagaaacttggatttgtcttatctgagttcctttcttaggaaatcaaccatcaggcctcccaaatagtatcaaggaactgaagcttaccagatcaccacatttggacagtgagacaccagacccctcactcatcatgactgcataaccagctacctgcttcttgttaactaactcctctttctttccactccctaattcctgttttctcaaacatggttacatttattcccaactatattaacccttaattttagttcgttgaagagatggatttgagtctgatctcacttctcggctgcagcactttaataaagcctccattccaggaaacactcattgtctagatgatttgctttctctccagtgagcaatgggacctagactgaactctggcattttggtaacatacccatcacccaaatagtgaacatcgtatccaataggtaatctttcaaccttttctccctctcaccctccctgcttttggaatccccacagcttattgtttccaaaatgtagtaaaagtataaatagtgagtttgattaattctcttactacttatttttatttagatttgtatagttactatcattgcattttaagctgtttaattatagaaacaaaattatcattaactcttgcctaattttcatctcctgtgactatatattgctctgtgtttaaaattaaggcctttctatgagtcgcctgaagtctaacacagcatgagacacatttagtggtatgttttattgcttgaatttatgaaagtttctgttattcctgcttggtttagttcttaagtctgatcaccttaacattggagagtctatcaaattccatctgttagttgatttccaccccgggaatcacattatccagtcaaatataaaatccatctgcagtaaacatgagtttttagcaatgagtacctttttatttatttattttcttccttaaccatgattattcctccagtgttttgtgtcctttcttacccaggtcttaaaggtacagcaaaaagtgacttatgctcctcaattccctaggcttaaccttatgggatgttaattaagcatgtccaatgcaggcgtctagagcattgtgcatgaaacctcatgtgctcattttgcatattttagggtagggttgtaaagtacagaataattgaagtttcttgtgagacaattgaattctggttattcttaaaggtattttccatatttacaaatattactggctacagagatctcctgccccaatggctaagctctggttcttgtattcccttttgtggttttcctcatgatctgtatagttttgatcttaaaatacagcaatatagtttaataagctgtagaaatgtaccaggtaatcatcaatataacagctgaaacttttctagtatgagagaataccatcactcttccaataaaacaaaagccaaagaaaagatgcaactcttaaaactttgcaataaaacaaataacaaatactttatccttaagatatggaaaatgtataatgaatttgcttgaatccctcctaggcataaacaagatggtattttataaggctaagagccaaaaaccaatatgcaaactgattgtttgagtcagaggagtccattactcaagtgtaagaatataacatttatcactaatacataaatgggtgagagcaatataaatttaagtagctatatcagaattcatactggaaaacaaatacccgaaagacaaagactttttctgtctctacaggacagtttagagttgatttccaaattcctgatttttgagaacgatcctctcttccatctttttgcctttttctatgccccaaacccaatgcgttctggatctagaaaaggcaccaaacatttaatgtgagattttgcttaatgaaagaccatttaagctgtcatttcttgctggtgacagtattgttacatctatgtcaggggtgggggaagtggcgatttgcttccatggaaatcaagacagaatgctattggtaaggaggtgggtattagccatgtgctggatcttggtgggtttctcctaatacacccaatcggccacaaccattgcaatacatatcagccacagtgaccacaaattgtgcttattttttgccagagatttcacaaaaatatttaattccatagcattgtatgaatcacactacaatataaaatctagtagccaggtgtgatggttcacacctataataccagcactttggaagctgagatgaatggatctcttgatcccaggagttcctgaccagcctggccaacatggcaaaacctcctctatataaaaaaatacaaaaattagctaggcatggtggcaggtgcccatagtcccatctacttaagaggctgaggtgggaggattgcttgggcctaggaggttgaggctgcagtgagctgtgattgtgtcactctacttcagactgggcaacagagtgacaccctgtctctaaataagtaagtaaataataaaataaaatctagcttatcttcttcccagatcagtgttctagatgaagttgctattatgaatcatatactatacaattcaaaaatattcatctgtagtgaaactgcagagtacaaatcactgtagaaaaaaataattctgaagtgcattagaaagtttacataatttaattgaagcaaaggaactcgctgatgaattattttcatttaattaagggagtgtattcaaaacacaaatctgtgtttcatacttacttttcacatgaatgaccaagccttccccatttctccttgaatgtgtttagtaagacttagggatattctgtatggatagacaacttatttgatagttcatcctttctccaaatatttaaaatatattttttcttaaagcaagtttccatatctattttttcctggactttttgattttctatcagttaatctgtgcaaaatgccttactaattttaattgctacaatttgtgatgtgttgtcttcttctcctcagtctttttttgtcttccaaatagtctttctaatctatactttttgttcttgcatgtaagtttgagttagcttgtcaagtactgagaaaatataccatgttataattttgagaggattttcttgaattttttgatttagccgaatagctgaatttaaactttcctaagtctttccactcatgtataagatgaaatttattttttacatgatgatatcatagaattttggtaatgtatttctcaatacctattttttcattacatttccaaacagttgttactaagatagaagaggacacatttattgtgtcctcaccatcctttcctagattttgtataggaataatcacatcatatagagatgatggttcatttatcttttttttttttttttttttttttaacctaatgcttcccagtttttttttttggtcttctctttggccaaaatctatcctagaagttgaacaggctaggcatggtggctcacacctgtaatcccagacctttgggaggccaaggctgatggatcgtctgaggtcaggagttcaagaccaccctggtcaacatagtgaaatctgtctctactaaaaattcaaaaaatagcaaggcggggtggcaggcacctgtagtcccagctactcgagaggctgaggcagtagaattgcttgaacccaggaagcggaggctgcagtgagccgagattgtgccactgcactccagcctgggcgacagagcgggactccatctcccaaaaaaaaaaaaaaaaaaaaaagttgagcagaaatgaccgcatctcttatctttcataaatagcatgtttactatcgatttcagtagatattcttgtgttaaatttctctcttattttgtacttctatagtttatcttttaaaaagttttaagtaggtattgacttttctgcatgtatttaggaaatcacatagtatatttttcctttaatcagtttacgtggttaattacacaaatatcaaaccacttaattttctgtaaatctaattggtaactattcattttaaaatacattgaggtatttggtatgtcaatttttaacttaagattttgcacacatgttcataagacaggttagcctacacatttttttcctgtaattgtccaactttactattaaacatcactatccttgaatagtgatttaggaactttataccatgcttattttgtggagcagttttgcatttgaatgtggaaatttacttcttaggatttgtagaacttactcctactagacctactgttagtttcctctttccttttctctttctttctctctttccttctttctgtgtaggtagtatttaactattgattcagtttttttatcggtttttattttttctggaatcactttcagtaatttatatatatttagaaacttcatttcctataatatttcaaaaatgttggtaaaagtttataatattgtctttggatttcaaaaaataatctatatgaaatacatacatttcaaaaaataatctttactaagatatctatgtagttatctttgtatagatatgtgcatttagttatatctgtaaacacatacacaagtatacttatgtgtgtgtgttgtttcctgtctttatcctagtcttccaaatatcttttgatatttttcactttcagcactcttcaggcttagctactattctttttctaacttcttgattaggacatatcagttattaatattcaatgtctttatttcataaacatgcatttcagtctatatatgtttctctaattgtttcagcttataaacccagtactttttttgttagttcaaaataagtgatattttaaaattttaattctaaaaatgcatatatatagttagaaatgcatattgtaattttcacatatattgaaaaatggtttggttatatttctgaaattaaattataattttatttttatcagagaaagtcatttacgtaatgccaggcacactgacaggtttattctcaaggcttagtgtgtctatttaaacctatgatttttaatcattttgatcagggcaaattctcatgtgtatgtagagtaaaatatctccataaaggggttacatcaaaatctcacagggaaactgtaccattcaatccttcatcaaatatttatatgtgactttagcatcatagctttagatgactaagagctacatttgtggtcataaagcacttgaaatgtttggcccaaattgggatatgcttatcacatacaatatataacagattttgaagacttagtatgaaaagaatatatgaaatatctcattaacatcctaaaatattatgtataagttgaaatgctaatggatatatgttaaataaatattatatattattaaattcatgtgctttttacttttgtaaatgcagctattagaaaatttaaattatgtatgtgacttgcattatctttggatagttctcatttagaaataatctgaaactgttgtcttctaggagcaatgattttaaggataaagctggcaatgttccccagagaacagccttaaatcaaaagggctcactgggtctcacatgaccgatgtacttgggttccagaaagcctctgtggttaaaaacccatctactgagcttgagacagaggctttctacttagagttggtttatagtaacaatacttcctatttcaaataataatgtgcaataaaaaagaccacatgattaactgatgacagatgaaaaggcctattgagtgctggcaactaatttgagcatatacattctacaatatatattacggtggatgtgcagtagagaaaaatacaaagttggtgctttctaacagttcaaggtgggtatgtttcttcttgaagtttttaaaatgcctgaatctctgcctgggcttcctaagggaagtgtctgttcttattatgcttatatattatatgcaaattgacttgcttattttgtatataatgaaaaatcaaatgcagtcatggcatatgtccaatgaggggtcagaataccgtaagttcataaaaccattcaatcaggaatcattctcaggctatggggaacattatttggatgtaggcagaagaaaggaggtttttgctttgcctgattgttacttctagtaaaagaaaatgaatactggggtggatgaactcccagaggacagaaatggtagagaataaagaggaggcttttatctcaagtgcatacctttgcagaagctgtaataaagtgccagtggtggccaggctgtcaggtcacagtgggttgaatgaactagtggtgttaatagtggatgtgtaatatgatgaggctttttaactgcatgggatattagatttatatttgtatggtcacttctaggattttctctctttatatttgcagcatttttgtagatgtttctcatattcacatttggctgtttctgaaacctaccatcttcatcttgaagtactggaaacagcaagataccacctattggaagaagtttcattgatttccaagatgttatattttgtacagtttcaaaagtcaatatcacattaaagaataaataatattgttatttagcagaaactttgaattctttaaatgccttaaatacaaagtattttattaattagaattggaaaaatagaattttagtcaactgatagagttggaatagaagggttttctaacagtatacacttagtaaaagggggaataaacattttgaaataaaggcagctgtcctcttttccaatggcatggctccattttgattggactgaagtatatggtaccaaacttccaattcaagtgaagaaatctacattctctactaccttaataaattgccatatggattgttttggtattcaggggataggaattggaaatcagtgtaacaagagcctccttcatcatttgtctggagggacacgaatcaatgtgaagctgccatgctgtctcaaatgctaacttattaagttcatatggggaggtttaaaatcaggcaagataaaactacagatttaacatgaataggcttattcttcaatcataaatgattggtgggatggaaacttagactgtagtatctggatcttttcctcacaaatgttttatagaccagaattccaatgggtgcagccatctatcaatttccatgggaaatatcaggttgtaacatgcaggtcttggggtctaacagaactgataaatctgtaaaatgtaaagcattaagtactttgttcttcagtgtctctgcattttgtatccttccttggtcctatagttgcaaaataatgtatcattttcccagacatattttaattcacaatttgactacatttgtgtgcatctatatgtatctatctataaataccaacatatacatatatatggacacacatttgatatttctatgaatgaaggccaaaggaaacaactggatatttcttctagctgaacttattatactgtcaacagtgacaatagcaataggagaatttctcatggaacaacctacaaagcgatcatatttcattggtgacttaataagaatcacaatccttcaattataaataataaatcaaattgttgacattttaccaaaatcaatactcttctcatttcaaataaaaaaatgctccctgaatgaacattaaagaatttattgcttaaatagaagtgagtcactataaaatagaaatgtcaaaattgctatattttaaaattattcctatttattatgtttttgtattcctgatcaagttttctaatcttactatattttgatttttaaatttcattataggagatgtattgctctcatgtacttattttgaacaattcaatgcatttcagttactttatttttctttacacaaacttttaggctaattagaatgcactttaggcattcacccccattatatttcatgcaaaaatgcaatttatataggcagcattgcagcattcatacttctatttttatacatttaaatggtcacatttcatgttttgaagggataagtatatcttgaggattacattttaatgatttttttaactacagtttactcctcaaatcctgtttcctataaatgaaaaacacattgcaattaccagaaaattccatttataaaatatagaccattacctacttatgtatcaaatattttaagtgtctaagtggtatattgacagatataagatggtgatctatgccaatattttaaattttctattctaccttatcattttaattacaaaaggacgtgtctcatttacaagttaaataatacatgagcatgataatctacccctactccaatctttttttttttttttttctttttttgagacggagtcttgctctgtcgcccaggccggactgcggaccgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccacgcccggccccctactccaatctttaggcacttgcaatctcacatacttgagggaaccaacgtaagctgttcagtttgcagccaacctcaagtttctacagcatttgagggaaaaaaataggctaaaataatgattcacaaagttgaataatgcttgctgtgaccagttatcactataaagcaggtgtgtaaaacatcattttacacactcctgaaaaacaactcaattttaatctattagagttttgctttttaagttcccttaatcggcataaaatcctaacaatttaaaactgaaataaaacatttcaactcatcttatccattttcttacttttattctcttatttttagttgacatattaattgcacagatttaagggatgcagtgatatattattacatgtatacaaggtgtaataatcaaatcaggataattagcatatccacacctcatatatttattatttctttgtgttgttaacacttaaaatccttttctagatttttgaaaatatatatgaaattattgttaatgaactctacattactacagaacattaaaatttattcctccaatctagttgtaactttatacctgttaaccaatgtatccttatcttcccctctccctacacttcccaccttctaatatccacaattctactctctacttctgagagatgatttttagttctcacatataactgagaacacatgaatgaaaacatgcaatatgcctttctgtgcctgacttatttcacttaacataatgtcctccaggtttacgcatgttgtattgagtgacaggattttattcttttttatgtctaaatggtattccattgtgcatatataacacatacttctaggcatctgttgatgaacatttaggttgattccatatcttgtctattgcgaataaaactgcaataaacgtggaggtgcaggtatctctttgatatattgattttctttctttggaaaaatacccaggagtgagattgctggagtgcatggtataatagttctatttttagttatctaagaaacccccatcctgtttttcacaactgctgtactaatttacattcccactaacagtgtgtaagagttccctttccttcacaactttgtcagcatttgttagcacttcattctcttgatgatggccattccaacaggggtgacatacttcatcactgtggtttttattttcatttgatgattaatgagattgagcattttttcaaatatctgttggtcatgtgtatgggtttatttgaaaaatggatattcagactttttgtccgttttaaaatcttttttttttttttgctgttaagtttttaaatttcttatatattctggatatttagtcctttgtcagatgggtagtttgcaatattttctcttaacctacaggttttctctttactacattgttttgctttacggaagcttttttgtttgatatagtccatttgtctatttttgttttctttgcctgtgattttgaagtcttatctataaaatctattagatgaacgtcctgaagtgtttcccctatatttacttctagtggttttatagacttgggtcttagtttaagtctttatgcattttcagttgatttttgtagatggtgagagataggggtttaatttcattctgctgcatatggatatccagttttccagcaccatttattgaagattgtcctttccctaacgtatcttcttggtacctctatagaaaatcaggtggctgcaataggtaaattaatttctgatttctgtattcttttccattggtctatttttctgtttttataccaatatcatgccgtattgattatgatagctttatagtacattttgaagtcgggtccagctttattctttttacacagtattgctttggctattcaaggacctttgtggtcccatatatattttagaatttttaaaaaatttcagtgaagaattccattggtgttttgatagggattgtattaaatctatagattgctttggtcgttacggtaattttaaaaatattaattcttctagcccatcagtacaggatatcatttcatttgtttgtgttctcttcaatttatttcatcagtgtcctgtgattttcattgtagacatattttgcttcattagttaaatctattcctagggttttttttgtagctattataaatgagattactatcttgatttctttttcaaatagtttgttattggtgtatagaatttctactaattttatgttaattttgtatcttgcaactttactgaattaatttatcaattctaggactttttgttggagtttttatagatttttacatatgtaagattatgtggtttgcaaagagaggcaattggattccttttttccaatgtggataccctttctttctttctctggcctaacttctctagctggaacctctgttttctcaagtttttacttttttaaggaggaaaacagaccagccaatgtagatgaagtacaggcttttaaaaataaagaatcctgctagaagagtgcacgatcactctaactatagccaggggtgatacatactaccaactgaagtcaggcaatggttctcttaacatagtttctaaatatttctattatacaatactacttatgtttactattttactttctcaacatccacagcaaatagcaatagctaatatattacgaaatctgcaattatgtagggttgactctcagaatatttaacaagcatatgacatgtacagcaaccatccaaaaccaatactagaatgtcattaaccaataaaagggataaccataaacaacctgtatagcctcactctttttacatataaccctatggcactaacagctgttatggaagattttgagtaaaacattgcattagctgtgacattttccatcaggagaaatcgaacctaaaaaagatgaagcaaagatagattttatcagctcataaatccatgattgtgctagtttcttatgtcactgatccatggatcaatcaatgtcatcaggactcaaaactctcttttttctgtcacccttgctcttctctgtgttggattcatgctcagacagtgtcttacgaaatggtagggatcatgtcacctcattttcactacagatgtccctgactagatagcttccagttaaataattcctgaatgttgattttcattagactatctgcatgtttattgaaaatgcccattctaacattccacagagatttgaggtcactaagtcttgtgtgtgacttggcaatctgaagtttcagcacatattccaggttcttctgatgcagatggactaagatcacacagctctagaaataggctttggcctatgttatatataaactgctacctccgcagtggtagtttcacacattgtagggattatcatcacttcttaaattaaaatcttaggtagaactccactacattaaaaagagaaaagaaaagtctcatagactgtacattatatctactgatatattaaaagggccatttatgaatatgagaattgaagttgagaatccaaaaattcataatctttcatcttttggtgagaaaacaggcgtagtgatatgtctgcctcaatgttgcatagtgagctaggtatcagaacagaatccctcagttcagccggctgactcctagtgtgtctatctcttcttgatgtataaactcctgccatatatattttttactggattttgaggaaatagatgattagcaagcaaatatttctattcactctgcccattttctttttaaattgtgaattacatggtgtgaacaaatctagccaggggcctattctcagaagagaaacaatatataaggaatatataaacaaacaggataattgaggattataacagattttgtaaggacaatgaatagtgatgtgttacggggataatcaagggtaggaaatacttaagtagctttcatgtcagtttacacatttgtcttcttagcttgacagaaaactcattgatgtcaaggaccagaacatctttatgtttggttccttcactgctagcatgtggcctctataatataacttatgtttataaatgttgaattttacctatgtataactcctctgctcatactaatgagtatacagatagaaatctgaaattttacataagaaacctaataaacaaagcactgatttttattttttattttttatttttttgcgatggatttttctcttgttgcccaggctggagggcgatggcaccatcttggctcaccgcaacctccacctcctgggttcaagtgattctcctgcctcagactcccgagtagctgagattgcaggcatgtgccaccatgcctgactaattttgtattttcagtagggacggggtttctctgtgttagtcagggtagtctcgaactcccaacttcaggtgatccgcctgcctcagcctcccaaagtgctgggattacaggtgtgagccaccacacctggcccttcataccattatttctaaaccatacaatagcaatgcaaaaaaggtactatttacctgcagtcattaagtgagtgattcagcaaatggtccaagaatgtaggccattggaaaagacagtatttatacccaggactgtctgactccacaatatttttatcccataaaccaaattatttatcagtttactactattcaactgtagtcatctcactaccttcagttctgatgtgtacttgcctctaaccgtaaaggtaggttctgctctatgatgatatcacccattgagattaacagcatgaggatgctcatgtttctcataagtgggattccttttcttacaaactgggaccatttgaaggtaaattgaggcattattagtaattaaactgggacaataatattaaatcaaaactatctgaggcataagaggaggtgtagtcaccccactcaaagaaaatgctttttaaagttctgattattcatttccacacattatttattttactatccatatcactgatatgaggctggtgttttttatcttaatttccaagttgaaagggtaagacccaaaacaagtatgacaatgattattaagtaaaagaactgatatccgtgcaaggaactactactggactctgaaacgtatttcccagtacctaataataataaaattggtttggtcacttattacattatatggtgcaagaatgtaataatgataatgagatctatgcaaaggatgctattagaactgtacattttcttgacaaacgtgtttcaaaaaaaacaacacagccaatgttaaggaagaataatattgcttaatctttgttgattctcaaattgaattttataacatctgtaataaatagttctcaaaaactcaggctggagattgatttgtgtatcttctaaaagccacccaggattgataaccactggtctcaaaaatttaataacagtaatgaaaatattacatttacatttgtactacacatggaccgttctgaaaaatttgtggtctatgaggttatttgttttgattgtctcaaataatttaggtttttttagattatgcgtaaaccttctttggccttgttacagttttagcaataagtaaactgccctgttaataacttgaacatttaagacatttgtgcccgggtctttctaatacttgtgagatttatgctacagattaactgcatgggtatcaaacaaggcaccaatgactgacttcaggcaagtaaggaaagaagtaaaatgacagcatcttcttagttctgaaatgcctttaaggtcttggattctgacattctgagaggttaatagctgaataacaatagtaaaaataaaaacaatgtcatttatcacttattgagcccattaaatgtgaggcatagtgctaagtactttgcatacattatctctaattctaacaacaaacttcattctgaaaatgaaaaatagtgaggatgaaagtggttatgtaaattgtccaaggtcacgcagtaagtaaacagatcttgccacacatttagatctaaccatttatttcctactgtcctgcatccccctctctctctatcccaaagagttagccttttgtaagtgttaatgccaacaaaggttcatagagtattgaataatattaaagttgaaaattaattaatctttttaaaaatttgatgctcaaaatgttgaaaaaaaattttaaaaccccaaatatttcaagtgcctcttctttgttaaagatgctgctcgagtttaatcctcagaattctgctctgttggaggtagttcaagggtgcaagtgagttccatctcatgtttgcttacgcagctgatatatgagctgctttcacataccgggagaaattttttggcaactcttggtttgtcatagtaaacatggcctaaaatatgaataattacatcataacacataatacacaggctaattagatgtggctttctggattcagagaaaataatcacacaatggttcataaagtctgtttttccttatgttttttttctttcataatgtgtactttactcattgcctttagaccattttgcatctaagaagaactagatggtcatttttattgtccaaaaatagttcttatatgaggagataaataagtcacacatacatacatacacacacacgccccccccccccccacacacacacccacctctagcatttggaattataaaacatttctagtgtgtttcatctccattttcaggaaagcaaataaaaacatctcatgccttcgagaaaatgtgaaaactgatgcacacacacacacacacacacacacatacactcattgctgtttttgtatatttcttgaaaactaactcagaattatttcccaataataacagttaccagttgttgaggacttgattcttttcaaaccttgtatcaattaagtccctgacatcattacaaggtaggcagtatttctatgccaattttacaagtactaaaaacaagtcattggatttaattaacttgctttttctatatagaattcaaacttgcaccaacacttttaagtattattagataccattcttccaaataacagaaattatttgattgataataaatgatggcaatcactattgttttatagattgaaaaccttaagtaatttagtcagcagcaaaaacaaaaacaaaacaaaacaaaacaaaacaaaaaactcttaaattcccctatttgtcctctcaggaagatacaaattatttggaaagcactggagttttaaacatcaagtaagtataatgtcaattttctaatgaagatggctgcaggcttatagaaactgacaatactgaatggttatttggtatataaactatataataaaagcaaatctgacaggctactcagaaagactgtcatgccatggactgctacatacttaatttcttctcttttcatgagcaagaataatggtaaagtttgatggcaaaatatctgggatcaattgtcctatcacagaatgttgctatcaaaaatgccatgaaaatactgcccacaaaatttgttcctgggcacattgaaagaataagggcattcatatgcttcaggtattaaatccatcagtccaagggtgcatggataaaatgtgaataattccactgaggtgaaggagatggtgattggtggtattcacagttttcttaaatcatatgctgacattaaaagaaatacattttctcttctaagttaagttcggcttgagacattgctcacaagggagaaaaggcagaattgttcccataaaagaaaacatatattcagttaaagctgaaagcatatttgaaatataagttccttttcaaatataaaagaattttcttccagatctcaaaacacaatgaaagcttatacattcaagaagttatatgcaaggcaataaaactgagctaaaacaataccaagaaaatggtgaaacattttaaaaagcaatatttaaaaaaaatgttagatttcaaagtttgtattgatgtttatagtgtctctttttcttttagtaatttcctgctattgctccaggtttagtaatgtatattttttcaaatacatgatatgtagtacgtaaaaatatataccatatattttttagtatattaagtgctgtggccacagaaaatttccttttatttaggatgcaatagtcttgataaaaatacaacattaacatccatcaataattagagaaaaataaaaagcatacaactaaatgctaaaacatgtggtacgtggactgtctctgatatcatatttgaaagaagaaaggactgctaagagatggaactgtcaaaggattaatcatgctgtctacaggcttccttcatatgccacatgctacccactacctgggtcaacttggataagttattctgtttctctgggccctacgttatctgttgaagacatgtaataatgcctatatgatggatttaattttaaaggcaaataaattggaataaattagaatgtgcactcagtatacacttccatgatgatgatgatggtgataatgatgatgatgatgacagttaagtggtaaagggtggagtgtagcgaggatgagggcagactaggcagtagacactaaggaaaataatgagatatttttagtatttattacctagtaaaaaaatcagacttggtgaggtagaagctggagggtatcaaagtccaacagaggcagattcaattcttgactcacaatcatcactgtgttttcaatcaatttgattagccttgctgatccttagttttctcaacatgtaacacagtgacaggaacatcaacattacagggaaattttgaagataatatgtcaaaatagcataattttctgttgtgctcagcagggctgatttacccatcagacacagtaggtaggactagtgtctagtgcccatagtacatttagaggtctacaaaatgttttaattttaatttatttaaaatcagaagaaaaatgaatataaaaataaatatataatagttaattcaagctggattatattcttttttaaaacaacgcaattgtaaaacatacttggtagtattttttttaatgaagaaagaggtccatgaaggcgaaaatgcctagagctcgcaaatgtcatattgcagtgctggcgttcagttctattcttgccccatttgacacctagtcaatagaagagggctaggccaagagaatcacagaaacagagtttgagctctgctccatacctgaaacctggtagcccctgtccttgcagttatctaaagaaatacttttgatcattttagtcagtttttattgcattttatctaacccaaagaatcttaatagataaaaattaataaaatcaaatctgcttgaattatcacaggtatatttcaatgtttcactttcatcataagagaactctcccagtcaacatgttcttaacagtctctggggagctactctgccacatgaatcccattcagcatctgtatctggccctagcagttccccgagaagacaggtaaggaagtgatcaagaggtacagacaggtgggcgaggttgggagagtaagatcttttggggagaggtggggtgctggaaattttaatagacacaaaattttaataagatctcctctttatcatatacctggacattcctagatatttgagaaaaaagtaagtaaaccagttcagtgaaatgacttaaagtataacacttgttttaacctagaattctagagtcatggtattctaagcatactttgattcaacaatatctagtcttgtttaaaaaattaatgagctttattttttaaagcagttttaggttcacagcaaaatggggtagaacgttgaagtgtctatataatctttgtacccacacatgcaccatttgaagaattgttcttttctttcattgtccagatacttgagaagaggggagtctggcacaaggatgagaaaagccaaagaagcatcacaagtaagcacacattatcttgtaccagcactacagatagaatcatagttcaggtatttactgccattctcttctgaggacatcagctattatccgtagatggcagtggttctaagcacaacttaaatagcacatttatgcttaaaataagcttgtttataaacagaaattacaaatattcacagaagataattgaggctatgaagagacaattaaggctcctccttagggcagcattttgttttgttctatattttactgaaggatttaaatagcaatatcacaattatgcaaataagtaattgctaaagttctagtttgcaaggaagtttaactcaaatgcttctaacatgtagacgctactctctttaaatagtttcttaagtaaagccagtaaaattattggcaaactgcatatttaaaagttgatttttcttctccatcttaatgaaatcattttaaattctgcagttctgtgataaggaaaaaaatctgcattcagagtatgactaaatgctttctaatatattgatatctaagaataagatctatcctttaaaagcattgtggtacaataaatgcttctttgtcttagaaatcatgcatagaacatgacagcagaaagactcagtggagacagaccactttaatttttactgataatatgatgatcacaggtgcatttttaattatctcaccacattgctttccccatcagctgtcactagtaatttcatacagcaagtacgttgcccttatgacattacagaatacaatttagagtcatttaggatgcgtgaagattgacatgtggcttcaccatttgtcaggatgtaaacaagggagtcaatggatttaggaaattagatgccaatcatttttgcaacctagaggtgaggaaaagcatgcataaagtaataaaaatacggaagttttcaacagttgagtgactactgctaagcttactagagtctaaagacaaattaggcaaaggaagcaacttgtgggtattggttgggagatggagagaaaaacatcacattttggtctttgtctcattgctagagggcttatagaatcctcactaggtagcacttgcagtgagtgataataccatgaacatagaggaggctctggatgctctgagcccaaggaataagtaactcatttcctgggctcatggtgttacagaaaacaaagaaagtaatgtcttctttctttttttttttttttaagtcatgctataatcctctctgtgaaaattcgttctctgtttggacctgcctacttctctgaagttaaaattttgaaaatcaacaaaacagcaataaaatccctttgtatcctatcacgtttatgttatattataaatgcttttctagaagtccctacctacaggttttctgtgctaaaaaaaatccacaccatataatagtattttactatcttctataggtgactcatctttgtatcctttttataaactaatgaccagctgcattttatatttaagtaaagaaaaatctttaagaattggaaaaagtaatgggttaataagagattgatttaaactaattataattaataggaaaataaaaattttaaacatttaaaagttctattgtatataatagaatactatacagcaaaaaaaaaataacaaatgaaaccttctggtcatgtaagtcagtctgatgaattcaaaaaatgtcattttgaatgagagatgccaggcattaaggtatacatattttaggattccagttatatgaactccaagaatagacatggtaatagaatcagcatagtagttagttcaggaaaagggaatggggtattttttaggaaaagaagacaacataacttcctgggcatatgaaaatgtactactatatcttgatctggaggtggctacatggatgtctacgtatgcaaacagtcaaattgcattcaagattcatgtttgttgctgaatgtaaatcatactttaataaaaagcagaacaaacaacatttgtttatggttgttattggtttacattcattcagtgcccatatacattatttcatttaatccttgcaacaactctatgagaaagacactgttattgggcccatttttagatgaaaactgaggtacaaggaagaaacaaaattttacgaggtcatataggtattacattgcagaatgaagatcagaactcaaagtgtctggttctggagcctacagtcttgaccaccaagcaatactgcttcttcctattaggtctctatatacccggtttttattttgtagagaagcttcatgtaacagtaaacaataggcttctacagagaaaatgagttattagaagcatcaatgcattggaaattgaaagcaaaaactatcaaagtgggtttctgggatttaaataatttccagtttatgaattatgcatatggatgtgtaatgcttttaactgtaaatgtcacattgttccccaaagtgcattcaagataagccatttgcctcttgcagtttttgaaagatcaatggatgttcaaatgtgtcaaacagctgtcgtttcaggacttctctctccactgtaaaaataatctataatacattttcagaaaactgatacatgttttgaaaacaactattatgggtaaaaaaattgaagcataatccactaattctagacttaatatctaagcatgatttgtaaagtagtaaaacatgtcattatatctctaaatagaaataggttttaggctttagagtactaaatttagtaacatttagaagaaacgttttggaataaaaaataatattcataaatgcagctggttaaatcattatgaatatagcacctctacttatctgtatcaatcttaaattttgatcactttgcttagtgcatagctcattttcaatctttcttctctgaagttccagtttttagtgtatgtttatataatattcactgcattttttccaatccttcaacttccttagttgcttagtagataatctagtctcttacttaacaaagaaattacgtgatcaaataagatctgctcaattttatgccataattccacaaaattctctgcatcttcttctattattttcttctttcctcttctaaagtattgcgattctggtacaagacttatttctccaaatttacactgaacctatctgatccctaactgtccctctcattcagtggattattctgttagccattctagggatatcactttctccactagacccttcccatcagtgtctatgtctgcccaaatctctactgccttcccttgggccgggtggggtggctcacgcctgtaatcccagcactttgggaggccaaggcaggtggatcatgaagtcaggagtttgagaccagcctagccaacatagtgaaacctcttttctactaaaaatacaaaaaatagcagggcgtggtggcttacgcctgtagtcccagctacttgggaggctgaggcaggagaatagcttgaatccaggaggtggatgttgtggtgagtcgagatcacgccactgcactccagtctgggcaacagagcaagactctctctcaaaaaaaaaaaaaaaaaaaaaaaaaaaaaaaaaaagccttcccttgaagtcactatgtgagctccctcctatgcatttgttttcctttcacagagaaccttgaataagtagtcaacatcccttacctttgcgtcttcaaacaaggatggattgttaggctgctgtttcagtctcttttccaccccatcacttccctgcaaatactattcccaaggcaacagtattcttattgcttccaatggactttaacaaaaaaacaaaacttcatgtctttcagatttccagcattatttgatgctatggaaaattcccttcttgaaatattttcccttagttttagacacatacactcttatgctttttttttcctccctcatctctatcgctgccttcttagtttttcttttcttttttgttcttgccccttccttctcaaatgttcaattctttattgtttgcatccctctcatagtcttcaaaccatattccgtctacaaacaggctatgttggcactggaatccaccttctcttaaataacgtacaatcttcagatctcagattaaattttgcttcttcccaaagacgttcattgaatctaggatacacaccctccaaaagctctcttgaaatgtagtatttcccctattacaacacttaacatcatacattataattacttgttcttttgtctgtattcaaaattttactctccacctctataaaagtatgggtcatgcctgctttcttttaccagacacttcacccgctcttatcaccgtgccttgcaaatggcaagttctcaaactgtgaagagatatttgtcttttctggtgccagtaccatattattttaaataaattatagttttaataataaaatagagcaaaccagtcattactcattttcttttttattattattatgatactttaagttttagggtacatttgcacaatgtgcaggttggttacatatgtatacatgtgccatgttggtgtgctgcacccattaacttgtcatttagcattaggtatatctcctaatgctatccctcccccttccccccacccaacaacagtccccggtgtgtgatgttccccttcctgtgtccaagtgttctcattgttcaattcccacctatgagtgagaacatgtggtgtttagttttttgtccttgcgatagtttgctgagaatgatggtttccagcttcatccatgtccccacaaaggacacgaactcatccttttttatggctgcatagtattccatggtgtatatgtgccacattttcttaatccagtctatcattgttggatatttgggtcggttccaagtctttgctattgtgaatagtgccgcaataaacatacatgtgcatgtgtctttatagcagcatgattcattttcttaattcaaaaaaatcttagtttttcatttgcactctcagatttgctttaggaaatgacttccaaatcaattaacaagcccattattttcaatcataattatttattgtagaaacatgataattaaaataatattaaaaacaacccatctaagtaagcatatgttcctcaactgctcttgatatagactttgattctttacaatatatacacttagatttccagtgacagaaggactttctgcttcagttttgagggtcaaaactaagtaatatcagaaagtatccctaataattcccagtatttgatacacagaatctgacagaagtgatgtggaaaatgcacatgtacttcatgaattgaaagataatgagttcttgtcaaaataatagcttgaaattaaataaattctgagtatttttcccatgaggtattttatttttatactatttgtgtgccataaacctatgaggtagactttcctggattgttatatatgttgatccactattattgtaacctttattttgcagcagaagaaatggagacagaaagataatgtagtatctgtctgatgtaaataatgcggaatatttttctcccagtgtcaagatgaatatgtatttccttacactattcacctacacattgcttcacaagcatactatgagacaatgttcatcactccatcactctctggaatatagttactgctacagtaattctttggtgtaattccacagtttaatgtattagtggtctacaatttcttttgctgcttttcatcaagaggcctaattagacccttcattttgatgccatactttccagtatacgccaagacctgctgcctctaccttggctctcccactcagttgtacctggaaagcaactggagaatagtgtttctgctctcaggttctttcactcagcttcctgagttcagagggcaatgaagtcctcaaatctggatgaatttccaccgtcccattagatttttaactaaataaaaataaggctattatttttaaagttaaaagtaactggggaagaggattctaggaagtggaaaacacaaggaatttgtctccccacttaggagaatgcacttgcagagtatatctgatgtaaacattttggaactctgctgtctatttaaggcttgcaacttccaggtaaaggctcagactgggaattgcagttaatttctgatgaatttcaatgctcagcacagtagcagacactcattctccacccctagccacactgcaagcagctgtggacatgttcctgaagcagcttgcacccagattgcaagagtcaggatgggcaaaaagaaccccattctccaaatatatgggatctttgcttggattgctgattgctgcttctgaacatagcagtacaaagaggcaggaggccattattgttgcactactcactattgttataaggccctcactcttggcctaagtgatttccaggagacataaagggccagcactctttttactccatttttctcttttaaaagccttatgaaaagattagggcattcataaataattgcatatatgagaaacagtaggaagtaactgtatgcccaggaaatgacataggcgcagaaaaaatctggaaaactttaagcttacacctgcaactgatccttggaactgacacagcctataacaatcaaatgaaataaaacacgaacattccaaaaaatagcagacgctgtggaaaagagaatctgagttccatagttactacattattagattcaattgcaaagctttcaacaaataacccacaagacatacaaagagagaggaacaaagggaccattcaaaagaaaaaaataaactgtccctgacaaagcttgatgacacatctactaaacagactttataacaaagtcttaaacatactcagagaagtaaaagaagatggggagaaagtcaagaaaacaatataggagcaaagtggtgatattgatttagagctagaaaacctaaaacgaaacctaaaagaaattctggagctgaaaactataataatgaaaattttaaaaaaaggatatagagggcttcaagggaagatttgattaggtagaagaatcagcaaacttgaaataggacaaaaaatatcactgagtctttaaattagaaagggaaaagactgaagtgaacagaacctaatgtatctgtggagcaccatgaagtggaccaatatacacactgtagaataaaagaagaaggaagaaaaaagatgaaaaaatatttaatgaaatagagtctaaaatgtttccaaatttggtaaaagacatgaatataaacatcaaataagttcaatgaactttaagtaagttgaacaaagaaactcgcatcaagacaggttgtcaacaaaatttcaaaagccagaaacaaagagaaaatcttaaaaggagcaagagaaaagcaacttgccacatataagagatcctccataagattatgtgcaaatttcttatcaaaaactatagatgccagaagctagtgggttaatatattcagagtgctaaaagaaagcaattgccaaacaagaatgctatagttggcaaaaccatccttcaaaactcaggaagaaattaagacattcacagataaacaaagttgctggagtttgttaccactaaacctaccctgcaaaaaaagctcaagggaatcctggagggtgaaaagaaaagatgcaacacaatagctagaagctatgtgaagaaataaagatctcaatatagataaatatataggcaattataaaagctagtattattgtaatgacagtttttaattgtatttgtcgctttccacacaatttaatgaactaacacattaaaacatatattactctaaaagctagtattgtaactttggtttgtaactccacattttgtttactatataatttaagaggcatttcaaagaattatttgtttatgattttgggtacacaatgtataaaaatgaaattttgttatatcaacaaccaaaaacagtggggacatagcttttaaaggagcagaacttttctatgtcatgaagttaagctggtattaagttaaattagagtgttataaattcaggatataattaccatggtaatcacaaagaaagcagctataaaatataaataaaagtaaatgagaaaagaacttaaacatttcactacaaaaaattaacacaaaggaagacagtgatgcaggaaatgagggacaagaaaaactatgacacttatagaaaaaaatagcaaaaagacagaggtaagttattccttattagtaattaatataaatataaatgaacgaattgtttgttgaactaattaatatgaatataaatgtactgtctaaatgaactataatgaactaatataaatataaatgaacattgtctaaaagttagacaatggcagaatgaataaaaattaatgatctaattatacactgtatataagagactctctttagattcaaagacacaaacaagttgaaagttaaaggatggaaaaaaacatttcatgcaaatagtaagcaaaagagagcagggggtggctgcacaaatataagattttaaaacagattttaaatcaaacatttacaagagtcaaagaaaaatacattgtatattaaaaatttcaatacagcactaatatatagcaatgaaacacttttgcacctaataacagaccatagagacatatgaaacaaaaactgatggaattaaaggaagaaatagttctacgataatagttggggactttaatagtcaactctgaaaaatgggtagaattactagacagaagatgtgtaaggaaataaagaacttaatataatttaccaactagatctaacggaaatgtacagaatactcttcccaaaaacaacagcataaactttcttctcaagagcatatgagacatttttaaggacaagccatatgttaggttgctaattaagtctcaataggttagaaaatagacatcacaccaagtgtatcttcaaaccacaacaggataaatttagaagttaaaaacacaagtaaaactggaaaagccacttatttttggaaaataacacactcttaactaatgggccaaaggagaaatcagagagaaaatttaaaatatttagagatgaataaaataaaaccacaacatatcaaaactcatgtgatgcagaaaaatttatgaacaccttaaaaatgagaaaaaaatcaactcaacaatctatctttacaactaattagaaaaagaagaacaagctacacccaaagctagcagaaggatggaaacagtaaagagcagagatcaatgaaatagataatagaaaaacagtagagtaaatcaatgaaaccaaaaggtgattctttaaaaggattttttaaactgacaaatctttagcctgatagactaagaaaaagagagagtatacataaattactaaaatgagaaatgaaagtgggggcattatcaccaattatacagaaataaaaaggattataagagaatactatgagcaactgtatgccaacaatttggataacctagatgaaatgaacaaattcctataaacacagaacctcccaagactaaatcatgtagaacaggaacatatgaatagacctataactagcaaaaagattgtatcaataataaaaaaaaaacctgacatatatcttctatatataaaaaccctggacctgatggactcactagtgaatttactaaacataaaaaaaaaaaaaaaactaacataaattctccaacttttccctaaaaatgaagaggaaaaaacacttcttaattcattcaatgaagccagcaccaaatccagcagcatgttaacaggattatgtaccacgaccaaaaaccaatgatgtttattcctggaatgccaaaatggtacaacatatgacagctgattaatgtaatataccaccttaacaaaatataaaacaacatgatcaaactaattgatgtagaaaaagcaactgacaaaattcatcatcttttcataataaaaacattcaacaagttagaactagaaggaaagtattccaacataataaaagtcacgtacaggcataccttgttttattatggttcactttattgcacttcacagatttttttttttccagattggaggtttatgacaaccctgagtcaagcaagtctataaatgccatttttccaaaagcacgtgctcactttttgtttctgcatcatatttcggtaatttttgcaataatttaaactttattattatttatatttgttatgttggtccatgtcctgtgattgttgatattactattgtaattgttctggggcaccatgaacccaacccatataagacgacaaacatactagataaatgtatgtggtctgactgctccactaattggccattctcccatcactctccctctcctcaggcttccctagtccctgaaataaaacaatattgaaattaggccaatcaataaccctaaaaggcctctaagtgttcatgtatcagaataattttacatctctcactgtaaataaagagctatagaagccaatttcatttaccattctgaaaatcctaaggcccttaagaataatgcttaaggtactctgcctgtgctctagaaatggaaaaacaaagcctgtatgacaacacatttgttacactgtagtaccaaatttttaaagcccattgtggagaacttctgctcagataaaaagatttctttccaaatattctgttaattcaccaggaacagagtctactaagagctctgatgaagatgtacaaatatatgaatgttgttttcatggctggtaccacaataaccattctgcagctcatggatcaaagagtaactttgactttccagttttattatttaagaaatacattttgtgtccgggtagggtggctcatgcctgtaatcctagcactttgggaggccgaggcaggcagatcacaaggtcaggagatcgagaccattctggctaacacggtgaaaccctgtctctactaaacatacaaaaaattagccgggtgtggtggcggtagcctgtagtcccagctactcaggaggctgaggcaggagaatggcgtgaacccaggaggcagagcttgcagtgagccgagatcatgccactgcactccagcctgggtgacagagcaagactccgtctcaaaaaaaaaaaaaaaaaaaaaaagaaaagaaaagaaaagaaatacattttgtaaggttatatctatcatagatagtaatttctctgattgacctggataaaacctaaactgaaaaccttgcagaaaaaatttagattttattccaaatgctattaagaacatttgtaattcatgagagaaggccaaaatatcaaccgtaacagagtttggaagattattccaatcctcatgaatggctatgaggggatgaagacttcagtggagtaaggaacttccaatgtggtagaaatagcaagagaaatagaactggagctggaagatgtaactgaactgctacaacctcatgataaaacttgaatacatgaggagttgcttcttataagtgagcaaaagaatgtgttttcatgagatgaaatctattcttggaacaagctgtgaatatttttgacatggcaacaaatggtttagaatattacataaacatattgataaagcagtgacatgatttgagaaaactgactccaattttgaaagaagttatactctgggtaaaatgatatcaaacagcattgcatagaacaaaacttttgtgaaaggaagagtcaattaaggaggcaaacattcattgttgttctaaagaaattgccacaaccaccccaacctcgagtaaccaccaagctgatcagtcagcagccatcaagatcaaggcaagagcctccaccggcaaaatgattaagatttgcaaagtcagcacataaaattcagttgtacttttatacactaacaatgagcaatttgaaataaaaaataaaatacttgggaatcaaggaggtggaaaatttgtaaaaagtaaactatgaaatattgttgagagaagttttcagaaagaaatagaaatatgcctcatgttaatggattggaaaacttcatgttaaaatgtcgatatgacccaaagtgatctatagattcaacacaagtttaatcaatatcccaaataagtttctttgcagaaataggaaacccaaccttaaaattcatatgggatttcaagggaccctggattaccaaaacaatcttgaaaagaaagaagaaaactgtaagattcacactgcctgatttaaaaacatactgcaaagctatagtaatcaaaacagtgtggtactagtataaaaacaagatgcttagaccaatggatagaaaagagagctcagaaataaacactcacatatttggtaaaatgatttttgacaagagcaccaagagcattcaatgggggaaactatagtcttttcaataaatggtactgggaagactagatagccacatgcgaaacaatgaacttagaccccacttcattcattatacacataacttacctcaaaatgggtctaaatgtcagacctaaatctatacaactcagagaagaaaactgaaattagtaagtctgatgatgatagaaacaggcagcagagaaattctaggcagacagggatgggtacccagtaaaatcccaccttcaagccaaaaaaaaaaaaaaagcaacaacaacaacaacaacaaaaacccaacagtttgaaacctgcagcccaaagtgagaacttctattcctgttttcccactctctcccaattggttctttctgaataatgcctttttaccaatcaaatgttgccttttccaaaaaccctacagcccgccctgcccctatcctgtgcctataaagaccccagactcagtcggtagagggagagacagctggacctcagggagatggctggaccttgagggagtgactagacctcggggaagagacgacctgacttaggggaagatgatctgcccttcccatccccgccccgactcccctctctgctgagagctgttttcatcactcaataaaattctctgctttcactatccttcaattgtccatgtgacctcattcttcttggatgctggacaagagctcaggacccattgagtgcaggtacccaaaactgttgtcacactgaccctttgccctcactggcagagggcagccaccccacgtgatgaggcaatgggccaactgagctgctaagatgcctccatctgcagacaatgaaaccaacagaacactgtaacaccccttgtggggctttggggtagcaggcaccccaacttgggtgccacctcaggccccgcatgaagcttgctcctgtgtcagctcccgtagcagctggctggatcctacacttgctcactcacatgctccctccttcaaggttgagcacagcaggccaagtaaacagggtgcccttgctgtgagtctggcaaaggggccgagaaaaatcctgtctcaatgtgtcacaacttttgatttgacagtgttttcttggatatgacaccaaaaacttaggcaacaaaattaaaaaaatagacaattttgactttaggagaattctttaaaattgtacagcaaaatagaaaaaaggagtaaaaaggcaacagagtaaaaagacaaaccagataatgagagaaaatatattaaagtcaaatatttgataagagaaaatcagatatccagaatctatagagaactcctaaaactcaacaacaaaacccaagtcaaaaatggccaaagaactgaaatagacatttctccaactaggatacacaaatgtccaataagcacatgcaaagatgtttgacatgactaatcattagaaaaaggcaaacccaaactacaatgagatatggtaacacacccataaggatggctactatttaaaaacaaacaaaaaacaaaaacaaacaaacaaaaaagagaataacaagtgttggtgatgatgtggagaaaccgaaacccttctgcaatgttggtgggaatgtaaaatgatatagctgctgtggacagtgttatggttattcttaaaaaaattaaaaatagaattaccatatgatatagtaattctactgctggaaatatatcaaaaatacattgaaagcagggtcttgaagagacatttatacacccatgtttagtggcattattcacagtagctaaaatgtggcagcaactcaagtgtccattgacgaatgagcaagtaaaacgtggtttatacataaaatagaatatcattcagccttaaaaaggaaggaaattctgacatatgctacaacatggattttgaggacattatcctaaatgaaacaagccagtcataaaaaaagacaaatactatatgattccacttatatgaggtagttaaagagtcaacatcactgagacaaagcatgcttattgttgaggggtgtttggggaggcagagaatggggaatccttgttcaatgtgtatggagttttagttttataagatgagaagcgtcatggaggtggatggtggtgatagctgcacaacaatatgaatatatttagtgccactgagctgtacacttaaaaatggttaggatagtaacttttatgtcacgtgtattttacctcaatttaaaaaataaagtaaatgagatagtagtgggaactgacttaactatctggtcactacagtccaatctatcaaatttcttctctagtctatattttggtgcatagaagagtccattttggaaatagatttggcattcaagagtcttttagttattgctgtttttaaatgactcactttgatagagcagctcattatcatccccctccaacatgcacaatattgacacgcattcactcaaactaagtttataaacaaaattatttcacaattaaaataagggtgtttacgaacaaatatttttatttggactggttttggtaagaacatttgtccatgtcaacgatcaccatctgtagatgactgttagaagttatctcaaaaagaggagaaataggaacattatctcatttatagagatataattaccacctttatgcctccaccactcaaatgtgtagcacagtacaagtcacatagccagctcaatatatttaagatataatatcataatagcagtaaagtttatccaaaagtagcactgttatggaatgaaactctggaatggtcactgtattgactttgtcaaatattgacttcgatcttcagccagaatcttcacatatcagggcctcagttttctcatctataaactgtgcaggtcaatttaaatgattcacagtgcctttcaacattaacattttgaatttctataagatgagtaatgtattttgcttgcctgagataacagttcccagttttgcacattcaaagggatctttaagtgttttaattggaatccatgaaggagccaggaagcagtttacttaccaagagaagtttcctctcctagctcctgctttacagtagtgcctgcctctgttcaacattgttttagcggcacagttgtaggattttgaattaaaaataaaattatgctctttgagtggcattctgcaagagaagtgattttattgcttaagttccctcttgtattacgcagtcttgtaagccaagtatgaatgttgacataaatgatgtattgcacaagtacaggcttcacagatagagctgtaacttctaaagatccggaaagataaaaagtaaatccatgctgtaatttaaatccaggttataaacttggacttcacctggggtttcatttagatttgataaattatcatatctcagctcagggaactttctccagagcctttcattctcacttcattgacatttcagtaaacagtatttaagaagtagatatgaaattctccttgtttggcctttagtggcaggcagatttactggggttgagaaaagaaaaattttatacagtgtaaggagaaatattttgaggtagtagaattccatataaatatttattggggtaaatttaaatacctcattagaatgatcattcaggaatattttgccactgacttgagaaataaaatgctgtacaaatagaacaatgaacataggcacactaaaatctagtgaataattgtaagacaggaaatgatctgtgataaatacacaaaaattacccaattagaacatatctgtgttcttaattcaaaagtgtccttcattaaaaaattcacaatcacaattaaatcagatccataaatacttttctttaaagagtttaggcttattttttctctctctgtctctctctctccctctctcacttgctcttgctgtctcactcttgctctccctctctttatcaattgtttctctgtcagctcaaaagagtagacattgtagccattatttaagaatttggaaaatagcactaaattgtttctcaaggcaacacagtaaatcaacaatgagcatagattggaagaaaaatcctattgtttctcttcaaagataatcacgacattcagatagtagaatatatatttttcatcatgttgataaaaacattgtgatgttatcaagacgtatgatgttatcccctttttaatggatgaagaaacaacttctgaaaaattgaaaagactgctaaaatatatgtgcattcatggcagggaaagatcatgaattctgacttctccttctgtgtgcttttcactgtaccactcaccactctgtattttcttatatttactgtttctagacatttaaaaatatattgccgaactatagttcatcaaatggaaatctattgttattataaactttacttcagctatcatatttgtgagttattttggtatatatacaaaaactcatttatcttcaaacatttaaaattaagacattatttttgctggtaaagttggctaatttgacatagtattcctatcagtattatttatcagtgaatcagactggtatatgggcaaacattctgtacacagcaggaactcagcaaaacagcctgtttcttctcacagttaggacctactttattcaataatgctgaatgaatacttaaaacaaaacacaagcatggatagtgttaatgccctctagtgtacagaactctcccaaccaaaaacagtgcctgatttctttccttcatttgacactgtctcataaataaaagataagagactaatgaattatagtttgtaaacactagagccaaataataactgctgattgccaataaactgcaatgaaaactgatccataccaagcagaagtgatactgcagcaataaacatttggaagagaactgtaaattaataacaattcttgggctgccccttgaatattaattcttatgaacacagcattgtttaggagtaatttgcagaagtattctttgaatgggctgtaaaaaactgccaaaaacttacttttcctccatttctcagttgcttttccattcctagtactttttgaaaagctacttttcattcaggagctattttatgaaaagtaataaaacattaaattcaaccatctaaagttaaagtgtaatctctcctcccagccatgatagagaaagtcacaccaggcttggcctctcgatgtaaacaacaataaagtagcacacaacatatgaagcgagtatttcaggcactggacgatatgcattccagggtaatgatttttgaaggataacaaaatgaattaggttctacatttccttggatttcttcccagcagaattttcctgatagcagtacaggaaggtacagctaaagaacacagcagtgccactgagttgagactatagatattgaggtttggtgctgctaagttgactggatttggttggatagggtatcaggtaggagagagctctgcagatggcaccacggaggcttgagagtgggttccctgtggaacactgggctgtatataaacagacttgtactaaagaaatattaaaggaagttcattaagcagaataaaaagtattacagatgaagatttggatccataagaagaaataaagaagactggagataataaatatgcaggtagatatagaagacttttttttctattctcttagtttcttaaaagacagatgaatgtttaaagcaaaaataataaagttgttttgggagggtgttacaatagatgtagaattgaaacatttgatcaaagcacaacggatgattctaaatggacttattactgtttttatactactctattttatgtgaaattgttcaatattaattgcaagtacacactgataagttaaggataaatattataatccctagagcaaccattaacaaaatacacactgctatggctaaaaagctacttaggaaataaaatgtattactaaaagatattcaattaacaaaacacaattcaggagaggaaaaacaaggcaataaataattaatgggccaaaaaaacaataaaaagcaaggtaaaaacttaaatataataatatgaataattacttgaaatgtgaatggattaaatattcctattaaaagccaaagattgtcaaattggacaaataagagtcactaaaatgaagtgtgccttaacaagttacaccttaaattttaaaacacagattggaagtaaaagaatataaaaatatttgtcatgcaaatagtaagcagagtcagaaaaagtaggcttctaaacaatataaccagaggtaaaagagaaatatttattaattataaacagttcaattcacataaagacataacaatcatatatgtgtatgcacctaataacagagtttaaatatctataaaaatggccagaaaagtgtgaaatagacaactagcccctcaaaaaatcagtaaatatataaatgatcaaaataacacaatcaacaatcttgttctagttaatgtatatcaactatgcccaaagactggagaatagattttctttccaagtgcgtatgaaatatttactaaaatagactacagactgggcaataccataaaactatacaccttacaaaagattgaatttataaggtgtattttctggatacaacatatctaaattataaataactaaaaataagattcagacaggaccaaaatatttagaaatgaaatggcaaaattttagactaccagtgagtcaaagaagatatcacaaagaactttagaaaatatagtaaacggaaaaatattattaaaaataacacaaaaacaacacagagaaaacttggtgggatgcctctgaagcaatactttggagggaactttaggaaatctttttttgtttttaaaccctctttattgaggtatgattgacatacacatagtctacaacttgatgagttggagatacatacacacccatgaaaccactaccacaatcgatgtcataaacatattcatcacctcctaaaggttccgcttgctctcatttatcatcattttttgttatatgaacacttaagagctatccttttagcatatttttatacaatacattattattaactatagacaccatgctgtacgttagatctctaggacttattcatctggcataactgaaactttttaccctttgactaatatctccccctttctccctctgctgagcccttggcaaccaccattatacgctctgctgctgtgatgttgattgttttagattcttcatataagtgggatcttgtagtgattatctttctgtatctggtttattcacttagcatgtcatccaggtttatccatgttgcaagtggcaggatttccttctgttttaaggctgaataacattttaccatacgtatatgtatttctgttttgagtgtaaaatgatataactctttggactaatactttcttatgaccttacacattcactgagtataattcagtgattccaccactaagtctttaaccaagagaaataaaaacatttgtttatgaaaagaatcaagcaagattgtttatagcagctttattcataatagccccaaactgtaaacaacccagattttcaactgcagaatgatgattaaacaatttgtgaaatattcatgtattgtttataaaaaaggagcaaattgatgatatataacaacatgtatacatcctaaaaacattatgttgaagcaaagaagctacatgcaaaagaatatgcaaaatgagattctatttatgtgacattctccaacagacgtaactattctatggtgacagaaattagaacaagcttgccttcacagtgggattagattgactgcaaaggagttaaagtaatctttctcagtgatggaaatatcttgtgtcttgattggtgggcagactacacaggttaatatgtttgttaaaattcatcaaattgtgtcaaggtctgtgtatttcactgaaattttttgccttgattaaaatagacaagcaaataagtaaataaataaggtcaaagaagggacttggttggtagttgttttaaatgtatcttgtcaaaattgtaattttctctcagatactcctttttgagagttattcttattttagttatagctcagtaatgttaccattggatttttaataggctattttcagttctggtacctataccaaaaaaagttttttttttttatttttcttcttgttataggtcttgaatcacagcacatcatttagatgagatgtgtgggttatgctctgataacaaagtgactcacattttttagtgtctttatgaaataagatctgtttctcacactacacatgccacacatgtcaatagggggcttaggttcaaatgggcgctcaagtatctgggctcataactgtaagaccagatgaaaaaatgtagaggaggccatggaatgtttgctgagtactaccatttctgccacaatgatcatatggtttagtcaactacagtaaatattgcataggaatcaatggtggttataacagatcaaacctccgaatcttgtagcaagactatggtagaagtgtgtaagttctcagaatcaaagtagagtcacttgtgtcaaactctaacaaaaagtaaatatataaagccaggaggctgagaagggagggccctcacacacacatgcctatgattttacaaaggctctctgaagcattcttgggcatgtatgcctatcacagaagactgcaaaaaccataactttacataaaggccattgccaccttacataaaaaaaaatacttctgagaggacatctgctcagcaactacatgtccaaccttggaatggtgccacttttgttatccattattttatccaaagacaataatctcaaaacaattatgtaatccttctcattattcctttaaaaatctttgtcttcctttacctccccaaatgcaccacatagttaccatggcaagggtattctcattgcaataccctattccaaagtaaatatcattttcctttacagagtctctctctattatttgggttgacagttgaaaactagagagattgtagtctaaggctttttctaaaatttataaagacattcttaaatggacaagctttggattttgtagtactttctaagtttttgctctatatttctacttatttgacatctgttttatatgtctttacccaatatatattgctcaaatatgaccacaaaatattccagatatagagatttcatagtcccattgttcttagtagataattcttatggcttatgatgacctacaaggccgcaaattatacaacccttgtctccattccaaatgtatcttaagccatatccccaacacacatttactatggtttcaaaaaacaggtgttaaagaaactcacttcagcacaatacctaccatgtgaaaagcctgcagctaacatcaccatcaaaaggaaaaaactgaaagcattccctctaagatgagatacaaggcaaagatgcctacgctcaccatttctttcaacatagtactaaaagtcttagccagagtaattagacaagaaaaagaaataaaacgcatccaagtctgaaagggagaaacaaacctatctctatttgtgagatgacatgataatgtatacagaaaaccctaaaggtgtaacaaaaacctattaaaactaataaatgatttcagtaaaattacaagattgaaaatcaatatgcaaaaatcagttatatttctttacaaactgttcaaaaagtaaattaaaaaacaattctattcacagtagcaacaaaaagaaatagaatacttaataatgattgcagtagagaggctaagaaggcatcattcttgggcaatccagaatgtctttgttgacagactagctcaacaactacttagactagctggaactagtagtcaaggacacttcctcctaactttctaaaccttgctccctcactcagggtcaagcttgcatcacagtttgattgcccttctggacttttctgactttctatttcctttgatataggtatttcccctaataaatcatttgcatgtttaatcctctcttgatctcttcttggaggacttggtctaccacaatggtttcatttaggactagagcagccgactctcttagattaaataattaatcagcagtagatccatttttttaaatccttctcttctttatagatcatttcatatcgtcacgtcatttttcaatcgtgttggtctactttgccatcagaattttactttcctcttgcaaaagtggcccagattcattgctcaatataggatgtaaatatttagaatccacagattagaaagacttttagcctgactgaattctgaaccctggaataaatttgatgccagatttagtatcagagaaacgtgtagctgtcattattatttgaggtactcaaatattttaataaacttctttaaagatatggctcaagaagcaaaggatatattccttgtcaagtcaatggccatactgcattctatgataggtggcaaggtttcatctaggcatgctcacacagggaatcaataaagatgaaataattataccagggaaaataattgggtactttttgttgttgatgttgttctcatctacttaaaaatgtttaatatatttataacagtgataaaccttttaaatttatttatgatcccaaggaacaatcaatttttaggatatgcttaactacttcgtttttctttctaacatgggacattacaacacaacaatggactacagtgacgggacaatcaccaataaacatccaactcttaaatcggaaatactctctcatccctaagtaggcagaaaaaaaataatttgagagtagataatctcataatctaaggacacaggtctgatttttcagattcaagacataggggcttaaatgataaataaaaataaaaataaactcaacattcaaatgtctttaagtgatggaaaaccaggctaaaaatattcttgttaaattttcaaagctggtttgaatacatttcaaatagtctatagtatttcacctataaagatttttaaattcacgcagcaacctatataactgtctccatgtttattatacattgctttatgcaacatgattcgaaatttccccattcatactgaggacaaaaggaaatattgtacttaaaatttgtagaagcagtagaggacctttatcttaaagggagagcttcagggaagaagagctgattatatagctaaaaaaaagactttcctaagaatcacaatatcttacttcttggagattagttccagtgagatgggtccaatcaatctttagaatcctgcctttttgtccttccagatttatgattctaagatcatgcttcttatatgggtttcttgatgtgaaagaaatgggaaagttttgtttaaataatgtctagaagataacagaaatggcctagagatgaatgtatcagattgtctctagatatcatttctcagcatattcctttttttaaaaattacctttggaatactcaatttgagatggcttagactaacctagatagaagttgaggaaatccatatattttagtggaaaagcacattaagaagttatctggagtaatgcaagttacaaggctctgactgagacatcttctaccagtggtgtttaaaggtatttcttagttgagtcctctgaatgaaaaggccagaaaagtcacaggacctaccagtcttgttaacaaggctggttaacaaacagcaaaatttggaaagcaataatgattatgttttaagattatagaaaattaagtaacccagtaattctatttctagaagttaaaggatgtactcaaagattatatacaagtatacttgtcttagttccatatgtcatagtccaaagacattcaaacaatacatatatgaaacaacagtaaatggatgaacaaattatgttcctgccagaagtttgaattctaggaaataataaaagatgaaattttaaaaagaatttgaatggcatcaagagaatgattctaatataaaattaactgattaaaaagcaggatagtaagcattataatgtcaattttgtctgaaaagaagcaaggatatacaatatatattaatttatctatctatattcacaaacacacaaaattgcagaaactgggattaaatttgttatatattaagaatgctacctgggtaataggataaatagtgctttttattggcttctatatactttcttggattgtctgaattgtatacaataaaaatgtaaggctttgtactaagaacaaaatataatggttttcttagagaaaaataaaaatactcagctgaaaataacctggaaaagaagacaagataaaatgaattataaaagaattagattttctacccatggaaagggagaacagaaagtaaagctagtatgatgattaaggaagaaaaattatgaatgttttatattttacaggaatttattgcaatcagtcttgtgattctattgaattgtgaactaaaaataattatcattagtaaagacaattaggtcatttctgctgtaacaatgattgtagtgttgttataatgtaaataactctaatcttagtgtatgtaacacttaatgatccagatgcagataaaaatctgtttataaagatgatttaagatatagactcattgttcaggttgctatggtaattaaaatctcgactgtgccttcataaaccaaagtctatttgatttttgtcattcgtgtcttgggtagctctgtattcagagaaaacttaaaactcatttcagaaggggaaaatgagctcttaaaaatctatattctttattattgtatcaatagcctaatgcttctatactatcacacataaaattctcaatatttaattgattacacataatttatgtgatattttaataatttataagaaatgtcagcaagttcatacttcagtattttactgttatgttttgttggtctcttgctcttcttcagacacacaagtaaagtacacatacaatcatatttccaaacttataaatgggatgtttttgtaaagataatttttaaatttgtggtttggaacactgtatctattttccttatacaagaagcgctccagtggcccctaccactaatgagcaatacacaggcacaaaagggaaagccaggaggtaacacaattctttcaacgcgttgtttcttctactttccattccccaaaaatgacctttcgtgagtagaaattacatggctattttttccataatgaaagtaaagacaattagatttatgtatattttacagaaaaacaatacaacccaacaacttagaatagctttttctccatatatttctccccataatctactttccgagcttgctaatgtttaaacttaataatgacatttctcctcttacatttttgatgagtttcccttgctttccaactaaagcccacattttataaactatcacttaagtttgcttctttctccactacattttcagtcttctttgagcctcaaaaggtattatatgttctcattttcaattcattgtacttatggatcaatctacctggaagaacattcatccttcagcaactttccctgctcttatctccttccttttccctggctgtctcctattcttcaggacgcagcaggatttaaccacttttgtgaaatcttccttgaatgatccattattaacaaggcattatgtggtggccctcttatgtatgctcaaagagtctgtatatcacccttgcatttaccatatatatattaattacatgttactgcgttcgctaaatatggttgtgaaaccgttccaattgtccaactgttattgcatttactaaatatggttgtaaaacctttccaagaaaaaaaaatcttataaattattaaaatactacataaatgaaatgtaagaggaatgccatgattaagtttaaacattagcaagctcagaaagtagattatggggagcaatacatggaggaaaagccattctaagttgctgggttgtatttttttcctgtaaaatacacatatatctaatttaatttaattatgggaaaaaaacccatgtaatttctgcacactaaaggtcatttttggtaacggaaactgatgtttatggtttcttttgaataaatataaatatagaaattgaccctcctactattaaaacttgagaaagttaaaattgtctaatctgaattcctttctcaggaaaccagccagcaagcctcctagatagtgtcaaggaactgaaacttactagatcatcacaactggacaatgacacaccagacccctcacttgtggtgactgcctaattgatcacctgctttctgttgaccaactcttcttccttagccctccctaattcctgttttcccacatatgattccatttctttcttgctatataacaaaccctaaattttagaccatcaaggagatagatttgagactgatctcccttcttctcagatacagcatgagaataaagccgtattccttggctatcttcattgtggcagtgattggctttctgtgcagtgagtagcaggggttacaccaaactcctggctttcagtaacagttgcatttaccacagtttattgaaactacctttttatttaaaaaaaaaacattaaaaaatattttgctgtcctatacaattactttccagatcatttgcctatttggccttagctctattctctgtccttactgtgtgccttgtatctaatgtaactgcattccccagtttccatttccaactggctgcctgatagtccctaacaagaggccacaaagcaagaagagtgagaaatcagaacacttctccttgtctttcctgctcagtgacaaggagcctcaaaattgctacatctcatccatgtctgtttcccacaggatcacctttacctgtgtatggccctacttcctactgggaacttcttcacattggttccatatgggtggagtagctttctgtttttcacaaatcaaggtggcctcatcaacacttatttggcttcccagcttttgtattttaaacatgatcctacattaaagtcatttttttttcttttttggaactacttagaatagtatctcttttttttaactgcattctgtaagacacactataaacttttaaaaacaggatgtcttattcttttagtttttatcagcaatgagcaaacttcccagcatatattaggcaatcattaaatgcatgttgaattaaattgtgatttacgaaacatagatttcttaataaggaaatatttaaattaagagggatagttagttgctttaatacttgaaactatactggtaatatctgtcacttaaggtacttcattttcatttcaaaatattcagtctcaaaaagaatgcttctgctttaaaaaaagtttggtcctttacttttaaatatcttactaccagccattaagaaaaggcaaaattacttttttttttttctagaaaaaaacatttgccattcctttctttccattggctctgcccacctatttgggcggcctcaccatgatctcttcaggcataatcatgcatccttgatttaccacctcattatataataaaataaaatagtggcaaaacatattttttcaatttggaaaacaaccttaaatgccttaaaatttttactcattttacataattgacaaaaatatcccagagcaagaaaggaaagtttaatcactacttggttttaattttctccatttaatttttctaattaaagatggaggctgaaagtagtgggacctctgggagacactacagatagcaacatttctgccaaaattaatgaagtcgagcaaaatatccactccaaacaaagctcttgtacaatagaatctatgaacaaaggccatggcaaatgcttttcaaaagaaatgtgtgtgatttgcagatagctttttgtttatttttttcctaaggttggactttgttgtattcaattaaaaatatcacactgtatattctgaaaaatatttatgactatgtagtaaatggagacattttataaataccctcatcctctatggtaaagagtacacgtactgatcactaaacaggtattgacaaattggtaacatgcaatgcaaagcttttggtatgaaagaagaatctggtagctgagattcaatacagctgttgtctttaagcacatagctgatgctaggtgaatatctgtaggccatattttcagctgtcaaatggcaaaatcatttgttatccatgtaataaatatctaggctgatagaaatttataatacatattgtttgcctaactgaaaaaacaaaaatcttggtatcattctttgaagatcaagcaaaaggaaggatttttatgaaaatttacaagtgtcaaacgttaaattaaaataaatacagcaacatcaacatcatatctcttgcattgctttaattcagtatgacttgagttctcataaaaatatggaattatatttttattctttctcaaatgtttattaattctttaaacatatattaatactttcaaaattgccatagtttatactttagataattgtattcaataccaaagatctcttttattatttgagacatttctgtaatgtaggtcaaatgctcagagacattttgcaaaaagccaaagttaaactatttccaaacaactttaggttttcccctaaggatgagcaaatttttcatagaagacctaaaactgctatttgcattcttcctatttatccttctctactagacacatggtacataatctaggaaataggtcataaatgcgacttacagaaaaaaatcccatctagaagaacagattatgacatattttggaagtaacttcaatccagtttctatggagccagagatatgtttttcctctcattgcatctcactataagtttaataagagaaacagctaaggacttgttgaactcatgatctctcttattcaaagagacccaacagtgtctagcaaagacgtaattacatgattagcgattgaaaacacaaaagccattgcttcaattagtatgcaagctttcttctgacagaataaatgcagaaatcaaagatgattgagcaggtgattatttctatttttctgggtatatgagtaagggggtaaaaggttatttttaaaaggcttctaagcaagaaaaatataatctttttaaagagataaagtatgcccttgaaaaggtagaagggttatcttcacataaagtaacagtcttttactcaagacagttactttttaataagctgacactatttgttttagcttacagagaatatgtaaggcatttcagtgataaaaatgcaatttcgctttccaatcaaaaacgttaataactatcttttctcatttcgtgagcctctttttggaaaatgtatacaatgacaataaaaatcatggcatcttgtattcacaggagattctttcttaaaattttaaatattaggagatacatgagtttcttttgttcctctaaccctggggactatacacaactatcaacatatctgtggccacagggataatttgactggctccatagtacccatatgtctatggcaaatcttaaacttgggtttctgggctgctatgctgttctctttagagtgcaagaccagatcttttgccttctatggtgatgaaaaaaaaaaacacaataataatcacgagtaatcattactaatgagaaatataacagattttcatgcattctttcaatgataataacaatttaggaaataaattcatttcttccttttagcaaataaaaatctttcttttgggatctagatgtgttactggttaacacatctactactggcctgtaattagtgatctcataaattctggcagagggactcatcttctaacccactaaaataacaagatagtatatgtctgatttatttcctattaaacagtatcagtaaatggccacagtcttttcaagggatataactctacataaaacccaactaggatttcaaacaactataaaacaaagtgatgacttttacagataaaactatgtaagtgctaaaatgtctcacacagtgtgataaaaatgttcacagttcatgctaatatctttgcccttctttttattccatgtgttgctaaattgattactttcctatgtgttatgacttgactatactcaaactatttcaaagagaaaggggatgtttttactcatgtgtatttaacaatagacaatttcattttttaaaatgcttactatatataatgtagtttttatatattaacattttgctttttcttaaagatccaaaaattatttatatacattttatttcatctccatgtactcagtaataacctgataaagatatataacaaaaaaaaaacaaataaaaaatctcagtctcatttgtgcaatattcacactttcctgaatattcttctccttccccaaacctttcatgaaacacagacatgaagaactgaagtaaacaaacaggtttagccaatagatagcaccaaaattccataaaagaatattatctacaatgaagttaaagaataatgggacctcaatgatagtcattgaaagggcaaaactcttgtttattaggaatcaaatatcacctgctggtttttattagcattttcttcctcaaataaaaagggagcgtggataaatgttgatggcagaagagagtaaaaatgtcttgtgaataaggctgttaagatgggagccaagctggtaccagtttcaggccagaaaggctgtggccatctacgttgcctaaacaaattgctttcctggagagccttaattctatcaagtccgaatctgtgctaagtaccccaaagcaaaaagtcccttgtttttgtgctttgaacattgtgaaaatgttgttgcccccaaatttattttggccttttggtggatgacagaaacagacatgcaatttttaaattaggaaggaattttttctcccctggaataaaatttccctcctggttagggctctgcatcagcttcatgaatcctccagcatgagtggctttaacaggatctatcaggttgaagaataatgagaatcataactgagtttttttgatggcatacaggaatacctgaatacacagggatctggatagttatagtggtcctggcaactgtcagtttggagctgtgtgtgtaaaacactaaacagaaagatgaagctagagcaaaagacaagtacttggaattccacacactgtaattacattgttccttaggaagtagacagagaggactaaattttatcacaggagagaaattcctgccttccgaggagttcttgggtgattaatgtccaagttaaaattgctaagtcccattaacttccttatactccatttttagaagaaattgtcacatcatattcttaaggagaattgagatataaacagttacttcgatttccatttttcaactgacatcctaagtttaaaaatgaaggtcctcctcagtgccttactggtaagtttccttgaggacttccttttctgaggactgttcctcctgaccgatggaagctgtacactctgaggcttcaactgcctttgcagcaccgtaaaaaataagcctactctggaaatagctccaaagtgcctagttctctccctttggtggtctctcattaaattgctctgtgtcatacctaaacaaatacttatttgtaaagtgtctaatcaggggctgatttgaggactttttttaaaaatgccaaaccttcatcaatgcaagaggtcatgaaccattttatcatttcttgacttctgctttaatactacatttatatgttgggtagcaaaagtccaacctggtttctctcaatcattcagggagctaaaatccttgattttccagtaagtctcaattaataagcttggtgggttattgttattgaccgtggtggaggtgctggtatagaagtcttttgtaaacacttcaatctatgcctgtagcttgtatgagtgtctgcctccgcacataccatataatcattgcttgcctactctgtttttgtataatatcatgtttttttatttgtttggagtctccaagtttgaatatctatgagattttaaaaacacctggctatatatctaaacctcaatttgattttaatcttaagggggcactattcccaatgcagagaatgaggataactaatttacatttccagattcatttctatccatcaactactttaaaatgaattatgaggaagaaaagataatctgtatacagaaagtttttctatgtatcactacatataagagagaatggtggagatggaaaaattgttcttttctcgaggtggttgcaaaatgaattaaattatgtattctcaacaattatgattacaagatatggaaaaacatgaagaaatatgtaaggtaattataaattttgaaaaccatatattaaataaaattatatctatatgttaataattattacacagatttgcaaatatttaataaagactgctagaaaacatgaaaaaaagtttgatgttcttaagtatggtgagataaaggtgacttttttcctttctgtagattctttatttttgttataatgttctttgtatggtaattaagcaataaaaaagaattactttaaagagaattgtattataaggaaattgaatattgcccccagctaactgacatgagaatatttatgagattagatttcacatttggaagaccaaatttcagattattatgtgaatgctgcaattggaactaatttatttgtacccatatgcaagcattcaactgttgctcaacattcaagctttttgcttaaccttcaagttcttgggataattttgagtatactctaactctaatctttgaaaattaaaattgatttttcctctctgtcttcttgtaccactggatcttattttgtttataccaaaggaaaaaagagtaccaaaatataaacaaaaggaaagttaattctacagtccatctaaatctattttaactcccatccatatttacttaagctaaaagaacatattgtaatgggagcagtgacaccattcagcttttgttgtcttgtgagaaaattatccataactctaaaaagacagacagttatgacagcctctacgttgtgtgaacttgatcgagaaaagatgaacaccttacataaaagattcttaaattctctaatggaagccaacttcatgaggaatatcatttataaaaccataaacttgtttcaaaaaataaaatatatatacatatatatttattttattttattttattttatttatttatttatttgagatggattcttgctctgttgccaggctggagtgcaatggcactaactaagctaactgcaacctccacctccagggtgcaagcgattttcctgcctcagactcctcagtagctgggactacaggcgtgggccaccacacccagttaatttttgtatttttagtaaagacggggcttcgctatgttggccaaggtggtctcaatctcttgacctcatgatctgccctcctcagcctcccaaagtgctgggattacaggtgtgagccaccacaatatcttattttaggcttctggaagttaaattacttcagtccattttatctacactaaaaattaaacatatttatggactcaaacaaaatcaagaagcaacaagctacccaatcactataaatttaggtgatggcccaaaaatgaataagaaaacaaatgatataaacataataaatgctgtaacttgaaattagttgcagtgaaatgaaaccatatcaaatgaggagacagaaactaaatgttagttcaataattagagatattaacactaattttaaaaacattaatttatgctaaattatgcaacatttaaacattcatttatttattctcataacttgtgaggcactgtgccaggtgaagggaaaatgttcctaaggagactctctgtgtatccactacccaactcactgcatagttagaaacaagagacaataaaatatgattagcatataattcagtttgtatggggtagggagacgccctggaaatagtgatgactaatttgaaattttagtaaggggatagactttgtttctgtaaagatgaggtaatgtgacatagatatactaagcagaacaaagagcctaggcaaaaacactgagacgaggaaaagctagagttaattaaagatggcccctataacacaactgttcactttcacacctccagctttcttatcctctgcactaataaataaacagttaatgtttcttcctacaccaacagcagtgaaaaaaaccacttagagtattagaaacactggcatgtggcttgagattcccagtgaaacattagaatccaatttacaaagtataacaaatgaggtcatattgaaattaaaaagcaaggggtcattgaaaaacatcattatttctttttctcttggaatttattatgtaaaaatttccagaaaaaaatggtgcatattaattggtaattacaaattttaacacatatgaccctaattttgaaaataattcaaaccacctggggtgaatagacaatgcttacacaagttatagaaagatttacttagaaaagaaacttctaattcaaattccttgaaacaattgtaataatcttaacctgtgttgtatatgcagaaatatactttaaaagttaaaattattaatttttgggtttctgtaaagtattacttttatactcaatgcattaataactatatttctctatatttactttctaatttttgataaacattgatacttttatagttgtgaagtaggaaggaaacttcaagtaatgactctgctcataaaatgttaaagttctccctaaaacacttaatttgggatttttaacttttagaagcaaattaggtggtaaattcaggatcaactttctgtgatgttgaatcataaagtataagttagagacaaagcagaccatgagtcttcttatgtaatgttaacaagcataaactttatccttaacatgatgagtgaagtgtttcttcctaatatagaaaattcttttttaggctacgggaagattctactcacactagtgaaaatatagtagcattgtcaaaatttgttaggtggatataatgtatagatgtagatgtgtaggagataggtgctttaaaatttcagtcatataacaaaatgcataatgaaatcacaaagcaactttaatacaaatctaagaaggaaggcataatagggtaggtcaatgcagaaattgatattctggcaatgtagttaaatgtagaaaatattgcagcactgattctcctgcctctaacatggaggaatagcaaaaacctgggacccgaaagggcattaaatattttcctcaggaaagacatagttctccactttaaattaaatatgacagaattgtgtgaaagagttttaatgtaatgcatgccagtttaacagaatggacaaggcagcacagtagaattctaagacagaagaaaagcataagaaaaacaagtaagaaagattcacctaggaggcaggtagcttcctatcacatctctctgcttttatatgacggctaaaagatttttataatatatgtccctcccttgattaatttgctctctcttctccatacttaatatgaatatgtattcttctataatgagggcattgttctttctgtatgtggaccattagttatttctcaaaaaattttaaagaattgaaataaaatataattacagtatgttaatctagatataaatagaccaaaaacaattaatctccatgtgtttgcaaattaaaatacttctatataacccataacttaaagaataaatcacaatgaaaatgtataaatattttgaaatatatgatactgaaacattacccatctaaatagtgaaatacagttaaattatgttcattggctattttgagactttaatgcatacctaggaaaaaacaaaggctgaaaatcaatggcctcagtggccatataaaaacaggaaaaaaaaatcagtgtaataaactatacaaagtagaagaaagacaatgaaaataagaacagaaataaatgaaacaaaaaaaaccagagagagaaagaatcaacagttacaggttgattcttagaaatgactaatacaactaagaaaatcctgaaagcctaatcaaagaaaaggaaaagaataaaggcatatataattgataccaggaataaaagaagaacatagcttttgagactacagacattaaaaagaatacaaaaggatcgtatgaacaactgtattcaaaaagttggatgaaataaatcaactcctagaacacaaaccaaaataccaaactaaagaataagcataacaaaaggtatgcaaaataactacaaatataactataaaacacatattgacaggaatgaaagaacatataataaatggagatatacaagatggttcatcaattgaaagactcaatattatcaaaatgttgattcatctcaaattgttctatacattcaacaaaatccataaaaatcctgaaaagttatcatataaaaccgaacaagttgatcccataatttatgaggaaacagaaagggctggaaaagccttgctccactgatgatcacatcttataaagttactgtcatgaagacagtgtggtattggtgcaatgatagacaaataaaataatggaaaagtacagagcctgaaaataggcctatgtatgtagactttctttagaataaagttggtacttcaaaacattggtagttcaaatattggaacttttttcaagtgtttagtttttgtacctactcgtacaagagatgacaatgaagtaaaagtgttctcacctcaatctattttatgacagggtttctgttgaaatgtaatgctttacatttatttttaatataatgttctctgccccagagcacataatttttttgtatttaaatgtaaaaatagactcctaaaagttatatatatatatatattaagttatatatatatattaagttatatatatataagaaaattaataatatctgggaatgaattttagaacatgcatgaatactatgacagaattatctttgtattcaaacctgctcaagtatagtacatgaacagttaataacatatggaaaatacatctccattaaactgagggagacggagcatttaatttacacattcccatgcatttgtgtgttctcataactggaagaaatacagtgtcttttttctactcagctgtttaacattttatgctcgtttgcttgcttcacaataactttcaaaggcgcagactaattttgaaggaatatggtcaacaaacagttatcgagatataaattattttccatttttggcatggtctatcttgaaagtaattggcagctggagaaaccttttataagcaaacaacttctcaacttctctcattttaattgaatgccaataaaattttcaatgtcagcatgggttacagaactgtgggatttcattaaagcagtctacgagtcgtagaatcaagggtttagcactatttaaacaaatctcagcaggcagcaagcagtctatgacctgaagaagcaaatctttaaatccttcagccagtttttcttagttccagaccaactgcaccagaatcatctgggaggcttgtaaaaattgtagatttgtagctcacacctgcatcagatggggtactgaaatcacagatgatttttatgcacactaaatttaaagaatctttaattaaaatgtaatcaaagcccctaatcttttgtttgggagatttagaacctctccataactatttaagaactaaagagcccaaacctgttctctggctgcttgagaggtgttactgattcaggtggtgtttgatccctcacccctgaccccatgtgtgtactgaacaaagtcgctacagcagaaatggatgactaggtctgcgtgatactttttcctcttagctctcaatttcgtggtctgcattccaggatgtttcagtccctacttcttacttgacattccacctctgctacttagtaaacacttacaatccatttgtcacccacattcagctacttgctagtcaactcccaatcataaggactctaaaaagacaaagggaaaaaaacctggcagattattacttcagcatttcccaggtatatcatctgcatcttgaaactggaagaaaccttactgttctttccaagaatgcattgggaagtagtgcttcctaggaatgcactttctctaaaagcaagtaactctgcatacatgaaatcactgttttcctgaacaggggaggcgctctaagtggcaaatgaaaaagagatttcctttaggaaattaaagccctatgcctcgtaaatgacatacacatgtatggtcagaaaaatgaagttctactaaaaaaggaaaaggttaacaaagtaaatatatattatgatcatttctaaggatgctgagacattgctattctgtggtactaattgcactgcaactataatggacctgtttagtgttctttgggggcttataaatactacagaaaaaaaatggtctgttctggccaggtgcagtggctcacgcctgtaatcctggcactttgggaggcagaggcaggtggatcacctgaagtcaggagtttgagacgagcctgaccaacgtggagaaaccctgtgtttactaaaaatacaaaattagcctggtgtggtggcatacgcctgtaatgccagctactcgggaggctgaggcaggagaatcgcttgaaactgggaggcggaggttgtggtgagctgagattgtgccattgcactccagcctgagcaacaagagcaaatctccatctcaaaaaaaaaaaaaaaaaaaaaagcttaaatcagtctataattttgcatattcagaataaagttgacaacctttaatttagatccttgttatttcatttcatgtatttattagtttgctgtttgactagtatacaaattacctaaaggtaaagtttcatttctagctaaagcccatagtagatggaagggcacatatgttgtagagggaactctgaaagatttctaaagggaactatctggacataatgaaaacataacccatttaaccagatagaacgaaaacaagtaagttcagctatagtaaaaacttgaaaggacactactgatgtgttgacagacaacccccaaaaagctttaaattacctttcaataataatagattctgcagagtaggtcttagaaaaacaaaagaatctggattctatcccagtacctgagaaacaagaaagaaaaaagccaagggaaaaaccatgctctctgttggtgtaatttcctgcactcttttctctaatcataataaaaaagaaaaaataaatttttaaaaaggcttttactggagagtaaattacttaaaatcaaaataaagaggtaatcagttgagagttttgaattctgaaacttaaggctctttagattttggaaacaactagagtgagcagcataaaaggaattatgaattgagggatttctccagctgtgccacctccctctggctaagtagcaagttgcctgacatttacaacctgaaaacacagctgctttgcacagaagatttgacagggaaggtggaaaagcctaagggtccgaccatctatctatggaggaggccatgtatatagcagaaaacaacactaatattcactatttttaaaaagtgacctaacttaatcataatttatttatgttgttaaaaacatacaaatgctttcctacaactgaaaaaataaaataggcaaagtccagaaacataatgaattttaagttttataatttttaaaaaaatgcttttttatttcttggagaacaatatattgtcatagaacaataaatttgtggataattggtactttaggcaaagattatatttaattactggtaaattttctttactatcccttgactgatatcttcctgtacactattggaaaaagcagttaccactacatatgaaaaatcacatttgctaaatatgtaggtctcctgtatattggaggggagatattgggtttaatttattcaaaaagattcatttcataaactgaatgaaatttgctgagggcattttagtaataaataaataaataaatattggattatagtgtgtttaatcttcccttgacacaacatatttatctaactcctgttctatctatctctttgcttatctataattcctaagatgtcttcccttcctcacagaagtctggcttctgctttcactgaaactgcccttgttaaagtccttgactttccaaagcaaactatgaagggctgttttcagttcgactcatttacttgaggcacttgacactcttgaccgctccttccttaaaactatcttcaacctctgagacagcatgtggtcctggtttacatctctctgactcctactctgcttttctctctattttacttctcagcttattcctcaaatcttcatatttctcagaaggaattggcattagctacttttgccggcccattaccccgtgtcctttcttttgtaatactcctccccaaccctcagtccatgtgcttccgacgggctgacttcaggagcgagcaggtgacctaagatgggcccaccacagcattgaattccctcagccacagccatcaatcattcatggatggacaaattcgcccagggcagtgaatgcaaaacagaatcaagttatattttgaactgtgggtttctaggctggggaaggtgtactgtatgttaccaagaggaaagacccagcttgaaaacagagccagcaaagggaaagtacccctgagagacagagagagacaatttctggaggtgagtatgggagcccttgggtacagctgtgtctgaaagctgtattagggcttctgcttaccaacagtttgtttctttcctcctttcctctttcccttccttcctccctctccagtctctctctttcttttgcttcagtctcaaaaatcacaacactctaacaaatatgtctaggttctacctttcaccatttagttctcaaattctattttgcttatttaaatattctccttaattcctaaagatttattgcttaatactaataatgcaaattttctaatccgtacgttcgtgtactctatcatttaaactgtagaaaagtcccatagggtactcaacatttgttagaaatgatctgagctcaacaagaaagcttactttccttttgccagattttctttattatttcatattgttcctcaagattcctagaaaccaaacaccatattggtctcagatctatgagaacaattattctatccttaacgtatagtcattttgtctttattgatcctgactgtattatctttgatattttccagagattttaatgcttttcgattttacattgactaaattttatgcaggctgtgcatagaacttgaaatctccgaataatttactaattttggattgattttgggtgataggagttttgtttgcttgcttgtttgtttgtttgtttgtttgttgagacggagtctcgctctgttgcccaggctggagtacagtggcgcaatctcggctcactgcaagctccgccttccaggttcacgccattctcctgcctcagcctcccgagtagcggggactacaggcgcccgccaccacgcccggctaattttttgtatttttagtagagacaccgtttcaccatgttagccaggatggtctcgatctcttgacctcatgatccacccgcctcagcatcccaaagtgctgggattacaggcgtgagccaccgcccggtcgggtaacaggagtttttatagaaactgaatatcatgcacaaacatcatgttgtcttttggaagatctgggtatctggtcctctttgacatttcatagtcctggatttctgccctttttctctctgtagactatattcttgccactaatcacaaaacatacaagaatcccatcccagaccattatatttcaaccaaggatgattaacgcttattgtatattgctaatcttcagtatactgcaatcgatgttccttttacataaagtaaaacttttaaaaaaagtaaattaaaaaaatacagcttccatgagttagagggatgtttcacaaattaaatggaatgccccataaagaaaaatttgtgtttttctctattgagaggaataaattattaataatactaagagatgaaagcaacttatggggaagttaatggagctgtgtttgttaaataattttttttttcaaatacaagtgattaaatcataggttaatctgttcaggaatctaaaaagaaatactttatatttctatagtaaataataaaaataaggcagagaaagtcaaatatctagaaatatgtataaaagagtttgaaaaccttttatatacctaatattagtaggtattcatatttcttaaattttatacctttgtaaacttttttttttttgtacaaacagggacacatgtgtcaaacacaacttgactgctttacaaataggtattcatccatgtaagcatcacctaagtcaacataaaaaacattgcctcactctagaaatcctcatatgttcctttcaaaccatcattgtttctcttcaccctgtgagaatagcatcttaagtagtatagtaataattcacttttcctcttcaggtagatacgcataccaaaggatgaagtttagatttgcctggttttgaaccttaaaaaaaaatacattatacatatttttaagccttgcttctttagcccaacttacatttgtaaactacagttatgttgagtgtgtcataaactatttttattgttctatactctgatattgtaatggcaaaaaccacaattaatgtatgcagcctactgatgatgagcatttgagcttttcaaactattaatggtgcttttatgactatttacatacacgtacttgggtgggcatggacatgattttctctagggcacttatctaggctaggtcatagggtatgcctacccacatgttacgtatattaaggccaaagtgctttccaaaggggttgcaccatggcattatgtaattttaaaaataaatattttatattcgcttcataaataaaattactacgagtctatgtaagatatttaaaaatacagactagagtttttatgcagatgctttactatagtccatctaatcttgaggaatgatagaaagttatcagaaatgtgtaagcaaatttgtcctgtaattggacataactttaatgccacattaaattagtaaagatctgatgatgggatccttatatctttggaatgtacttttatctgaaatatgcttctaagaaagatataattaattatttagagcatttcacaatctttgtggaatttccaaatgagtttaaatagtcaatattatcagaataattaacatgatgagttctgatttctggtcacctaaagcttggcagtttaacttataatgctttatatacctgtagttttcactataattcagatgttcattttatttttattataaaattgcttattttaacccagtgaactgtcaataaaagttggagtcaaggaggtatttcaagatgtataaggtcaaaggtcttcagtttaacatctccttattatttttaccttgccaagtaaaatataatatttaatgagtctgttaaaactctttatggcttgagagctgatttaatttgtatcaaattcaatcattttatatatggatgtgagtgtctgtattgaacaaatgaaattactattcaaagttttgagtttacttttatgaaaggaatatagattactatcttgaatgttttctaatcttaaatcaattgactcttacactacactatggtagtatcacctataagtgtctgttgtgaaacctatgtcaaattactgtgcctaaagcaaggtgtattttgttattcagaacttaatgacagtcagaaataagaagtttaaaatgctccctcctgcctagacaccatgtgaagcgtgggcacttgttgtggcaccatgtcactatcttgtcagtaagaacaaatgtttggtactaactgtctcttcatcagaaaataatatatgttttaaaaaattgtaatcaaaaatttgctagattttttaggggaaaatcaggacaaacttcttgcattattttctaatcaattatcaggatgactccaaatttcttagaattgtttcagtttttgtccagcatgattctctactatttaaaatcttgcttctcttatgtataataactcttcaagcatctatccttagtcatttttatttcttttttatatgttctctttcccaataaggagtttatttatctaccttcaattactatagttacagaagtaattgggaaattttatataaaatatgtctctctttgagtactgtgtttgtccttttagacttgttgctagatattctaccaactccgtaaactcagcatgttagatcagaaaacttctggctagaatgtaataacaaagactcttctgccttaagcaacatagtccagatatgaaataacgcttttcaggcattggataacaagtagtgtaggactatgatcccaaaaagaattaaaacaaaagagccattcaattataccaaataattgcctatagggcatttctaggcaagcaaagggagacaatccagccatcttgtgaaattgaggaaacagaaatcaaactgtggagagtgaaggaaactagattttacagggcagagtaagagagaggagtaagctgcagagagagataattctgtagatcttcaagggactctaccaagcctttcactgagcaattgtctgtgtattcatgagagaaaactaccagagatcagggaaacaaccaaaagaaagaagcaagtaaaaatattcctggaactgtcagagggctgggaataattcatgtttctacctgtgacagtagaaaggccccataatacataggaccgacatcatctagcaccttcagaagaatatttctttagtttggaagctaaattagcttggtctaaaggattgtcaggaactgagaaagctttaaaaaaaaagattgataacaatgtaaataacatcaatttatgtcattgagttcccaggaaagggatggcaaaagtagagaacaaaatacttgaagacatattgcgagaattttcccaagttgctgaaaactataaacctacagaacaaaggataaaaagaaccacgagaaaataaaaataaagaaatcactccaagaagtattgtaatggaactactgaaggtcagtgacaaagagaaaatattgaggtagatgaagaaaaaggaaatattgcatgcagataaaaagaaagaaaggaggcttctcaccagaaactattcaaaccagaagacaatggaaagacatctttatagtactgtgggaaaaaaaaaatccatcattcaagaattttttcccattgaaaatataaaatttatacaataaaatataggagaaaaatatgtgtccttgaatttaccagtttctttctttgtttgtttcttttttttttttttttttgaggcagagtctcaccctgttgcccaggctggagtgcaatggtgtgatcttggttcactgcaacctctgcctcctgggttcaagctcagcctcagcctccagagtatctgggattacaggtgcatgccaccacgcctagctaattttttgtatctttgatagagatggggtttcaccatgttagccagactggtctcgaactcctgacctcgtgatccgcccgccttggcctcccaaagtgctggaattacaggcgtgagccaccacgcccaccgaatttaccagtttcttagattgaaatctaaaaactccaaacaaaaaaaaaaaataataaatggattcattaaaaaaaaaaagtcagtctttgaaagactagtaacaaaataaaaggcaagccaaactaaggctgggtgaaatatttgtaatacatgtatgtaataaaggacatagcactagtatacaggatcttataactcaatgtaaacccaagaaacttaactaaacatgtttttaaagtcattaatttcactaatgaagttatatgaatggaaaataaacacatgaaaagatgatcaacatcattagtcattggagaaatgcaaaacaaaaccacagaaaatcacagtaagataggactacatactcattaaaacagctaaaattaacttctgttatagtaccagattttactgaagataaacagcaactctcactcattgctggtggaaaggaaaaaaaatgccagtcactttgaaaaccaattagattattttaaagttaaacatgcactgtcatataatccaacaattcctctctaggtatttacccaatgaatatatatataaatatatttacatgcaaacaatacataaatatatttacacacactatatatatatatttaaatatatttacactctatataaatacatttacacaaaatatttgagtatttatgcagctgtataaataatagcaacatctggacataaagtttgacaaatgaaaattaaaacacaacataccaagacctatgggaaatagcaaaagcagtgctaagaggagagtttatagcagtaagtacctacatcaaacaaatatacagatttcaaataatctaatgatgcatttcaagaaactagaaatgcaagaacaaaccaaactcaaaattggcagaaggaaagaaatgataaagatcatagcagagctaaatgaaatagtgactaaaaaataatacaaaggatcaatgaaacacaaagttggtctctgaaaacaataaaatcaatgaaacactttccagacagaagagtgaagacccaaataaacaaaatcagaaatgaaaaaggagacattacaatgatattgcagaaatacaaaagaatatcaaagacttttatgagcaactatacactaagaaattggaacacatagaggaaatggataaattcctggacacatacaacctaccaagattgaatcaggaagaaatagaaaaccagaacagaccaataacaagtaatgacattgaatcagtaataagaagtctccaaacaaagaaaagcccaggaccacattgcttcactgctgaattgacttaactttcagagactctgcatcccatgtttattgcagcactattcacaatagcaaagatacagaattgactaaatgtccatcaatggatgaatggataaagaaaatgttgtgtgtcacacacaatgacacacaatgaaatactattatgatgtaaaaaatgaatgaaataatgtcatttgcagcaacatggatggaacagaggtgatattaagtgaaataatccaggcacagaaacacagatactgcatattttcactcatatgtcagggctaaaaatgctgatctcagggaggtagagaacatgcaatgatggataccagaggccagggaagaatatgggtgggaggtggatgatgaggaggggttggtgaatgagtacaaacatacagttagatagaatttgtaagttttaatgtctgatagtagagtaagctaactatactaagcaatgatattttgtatatttcaaaataactagaatttgaactgttcccaacacacagaaatgataaatgttcaaagtgatgtacaccccaaatgccttgacttcatccttatgcattctatgctgcaacaaatcctcatatgtacccccaaaatgtgtaaatatgtaaattacatatcaattttaactaaatgagaaatatgatatatccattctgtagaatgctactcagcactaaaaaggactgccttacttacgggttcatatgacaacatggatgagttacaaagatagtgtcatttcagctctcagaaatgacatggacaaggaaattgagggctgagagaatatgtggcatataataagtacctattagtaattggataagtgattattactcttgtgtataagtgattttgtttgaatgtgagacacaagatactggcagctcatgatatgattcagtgtgattttcttgcaatgttcgaaagaattttgttggggcaatgtttgaaagaattttgttggggtggcaaaaatcttacagaattattgtaatgattacatggtgcatccgtgttctagcatgtatcggtatctcattgtttttatggctgaatagtactcctcgcacagattatgttatattttgtttatcaattcagtgggtgataggcatttgggttgtttctagctttggggtattgaaaatagtgctgcaatgaatatttgtgctcaaggttttgtttgaacacctatttttaattctcttgggagcaggattgctgggtgatataattctatatttaacttactgagaacagttctttttaaataagatgtgttctttgttgtattgatagtatggctgatgaggttacagaagattgtaagtatagatacatgtagatattaatgccttgatataaatctattactgatatatacacacatatattatatatatatttagaaaaaacttgttaacattaaaatgttttaccaatattattagtgctaataagcaaccaccatatgacagattccatattaaatggtaaaaatatgagcataaataaggacaagtctcatatatggttctcgaccttaaaaaaattaaaatctaaatgaatataaaccatatgcaggagagctaggaagaaacacaaggtgaatgtgactcagagtgaggatgggtaaagaactcttatttgtatggacttgagagagaaggtctgtgtggtggataaaatctgcagagatttatatgagggtagaaactgtacacttaaaacattcagttaccaaattaacaaaaacataaagtctgggacaaatgaaagctggattgtttcagagcctagaagtaaattctagcaatctgaccttaccaaaccaagacccaaactggcgtcctgcccaatcctctctgaaatttggaactggactttctgcaggctggctttcaacatggaatcaagctttggttaggtccccacccagctggaagcacagatgtaacagtggtcaaaagattcttctgagactgacacatcagatttctttgagaattcaggaaagctacatgaaaaggctttccaattcattgcatctttgagtctgtgctgctgcttcccatgacatgggagagaatggattttgtgattcagatcattttgcaggctaagagtttgaaacccataacagatggatgattagtgatttatttcaggaaggcttccatttcaatcttgcatcccagtcttccatcccagaagtacacattagcacccttggagcaatcattgaaaaaagtacttacaactgtcaaattatcttcataataacatggcacagtttatatgactggttgcttatgaactactgaaacctctcttaaaatggccattgtggactatttaaaaattttggttttaccacattcattccttcagttgtttaatagccatcaaataatagtgaagaattcagtgaagacagtgcagaagaagtttacagagatgctcaacatccttggcttttttatggatacaaactctggcatgtgtatataataagtgagcagcttatagcattttgcatatagatagcagtgctattacttgtttatatatttctttctcttgatagtgtgagggctccttaaggagggcatatgttttcttcatttctttagcccaaacagtccatagatatcaaacctgctggcaatttataaatgattattggtgagtgaatgagcatacaatgtatagatttcttaatggttccagtgatgactttcaggtaggtctctagctgaatttttcttttcattgtcaaacaatatgccggccaaaatgcattcattactgccacattgatattagcttttgctcagaaagatcaaagaaatgatttgattacctcttattgcaccatggcattatctgtttaattttgatgctctgggttttatttttgttttcttttgggtattttcttttcaggctgttttaaattttttctgtaatttttctatttttcaaatgcattattcagagctgtgtttcccttgaataaaaacaatatttgaaatgaccttcagattttacaaaaatggtatgcttcaaataacacttaatttcatataataatttgttgtatctaattttcacttatttgttcttataaatccaccttaatattaatgatgatctctcagtcactaataatataaattcatgaagaccattgagcaaaggatatttgtcttaataatgatgtatacgtgcatgtttttctgtgggacaagagagtggaatagaaggaagaaggcaaacaaattcagagtatttttcttactgtatgttgaaaaaatttaaaatatacttttccatatttatctcctttttactgtatccttacttaagatgtaattcaattcataataattatatgatgtgtcaagctcatttaaaaaatatgttaaaattgctaaataaacagtggcataggcacacaaagacacacaaacatactcacacacactagcaataaaaccatagcttaagccagcaggatatttaaaaataggggcaaaagagagtgctcttataagttgctcatcctctcatacatcgtgttgctatattcgttgttttgtctagtaaggaagatcattctgacagctataacttgttaatgtttctctataaaatatgatgagaaatattatagatattcttatgatctgtttgacattttaagagtattatttatacaatattgaaagaatgaggacacagtagtcacatgttctttattcttcaaaattagtcatcctcaattacctccatggcagcatttctcatttggctttgtttagagaggtaaaatctctcacgcccttacattcaagtgcctaaaagcacaattgggaaataggatgctaagagacatgaggtgatatttattgacaaaggggatgacagttttatacaatggttaatactgacataatacataaattttttaaaattatacaccagttagaaacaagtgctccattttaacttcaggttctaaataacattgtaagacaccacgttttatttactaactaagctttgcccaggaataacgctttttaaagttcactgagtaaagggaaaaaatgtaatatctattactagcctaatgccagttcataaatagggtagagaaaagtggaaacctccctggaatcattgtacatagtcatgcaggaccacttttagttatctatgtccttcttatttttacttttgcctctatcatataccatgtaattgtctttaaagtgtgactacaactctagcttccattttactcacagctgctaaagacagctatttatttattcagtgcgtatctgctgtgtgcttactgtgcagtcccgggactgcaatacaactgtaaagatgaggaacaagttcccaccgttatgaattttacagactaaatgtagacagcgaaatgtccaaataaaatgcaagatataagtggcagcatctttaaatatggaaaagtagatttgcttttcttttcctttgagtggctaatttgcacacctgcagcctctggactgacacactctgcctcgtgaacttctgcccgtctcaggagtaatttactctgtggatttgttcccccagagagacgagactcaaacacatactgattcatttttgaaaactttgactgaagatgtaaacgattctagctttatttgcttttaggtagaagtttaatatttcagaggctacagattagagaaaatcaagttttaaacgatccaaaagtgttaaacttgatcaagtgctctgaaaagacagcataacacatgaacttcattgaaaggttgtgaacctattaccatcttcaatttgaatgttagtttggtgtttgatagtgtgaaaaaacaaatgtccagtgacttaagctcagaacagcactgctgtgtcaccaaaactctatcccagaggggagggagctttgaaaacaatgtacacatacattaaaaacagatttatttttttaaaagcagccaatgtggtgaaaatattttttttctttcacaatgtatatagttttaaactctatttacccatatacttattacatccattagagtttaatgtggagaaacaagctgagcagaaatgtgagctcacgttaaagggcctggaagtgttacagaaaaacattttcagaagggatttcctttctatgtcattaagaacagaaaggctggaccacttcagtgtataaagagttaaattgtgtgtgggggaggggtgtgtgtgtacacacaggagaaggaggtacaggttaggagaaatggtaatgccaattcctcaaaaacattttcacttttgctataagattcgctatttgaatatgcttgtttaactactcctaagagaaatcttgttcctaaccaagaaaggtaatgtcatatcaacataaatattcagccatacatagaatttgctgatctggtaatcagggacaaggatactggttagatataacagtatctgttactgttactatttctgttactgtcttcctaagacatatcaagataattgctttttgtgcttcagtaagattctatgcatactatttcacttgctgcattattttataactacatatttttgtatgtatctctctgcttaaggacagggaatcttatttgtgtttccattcccggcccgtacctcagtgcttggctaaagattagcacacaaacaatgtggactcaaaaatgggtatgcttactggcaggtcaggctcctctatgactcttcaagttgtaagattctttctttaaaaacatttaaaatagaatttgcatattaaaggacaggaattaattattaattatttgcctaagaaacagcatttggatggcatgaatctaatggaatcagtaatatccatgcatctgttgaaaaccaatcaacccgtttaagatttcaaattacgatctgaaatgtgaaaatgattggtagattatcaaactcactgggctggacagagcaatatgtcagcacctttgcccacgtccacagcctgaaagcttttgaaggtaagcagcgccgtcatcattttggcattctattttagtctaagcctacatcagaagcctgccagggctcagtgctgataacaaagcactatcgcttttcaaagtgacagagcacagtgacatatcaacactaagacttaaacgaaaagccccttctcatttaactgggaatctgctgaagctgtattcagcccagcactcgttttcaattaaaactttcttgtcgcaagagaaaagtttggcatatccttttcaacgacagttatggaagtgagtggaaagggtagtgtagtgtagagtatagatggtccaggaacagctaagtacgtatcagcctttttcatctactaattgcagtacctatggttcaacaaaagttttacctaatgactcatgttgctgaaagtccttcctctcaataccactgcttttccaggaatgctactcacacacagcatataaggcagtaaaggggacatgatgcatcaataactgagtacctgctatgtgccagctactatgagtaagaaggtggagggttcttacctgtgctatttcatgaaattcctaccaaggtgtatgatataaataagattcttttcattttttttatttttatagaaaaaaacgaagttttaacgaacttctgtacagtcatacatcttttaagtagtggagttggaatatgaatgtgcatccatgtcgttagtccagttgctataattttaaagtggagaattatgggtaacatcaacacagtgacatcatcatacttttctttttaaatgttatggcacattcaacagcacattttcttatcgtggagttcctgaaaaagacttagtccatagtctaattttgctcttaaaaccagttcaggacaattcagcaaaacaaatttcaaatacaaatctatcacacatcttagaatctgtttttgagaactttatttgggtgcctgttcttagactaaggcatagttcaatagaattcccagtgaatttactgtaaagatatggctaagggtgttgtttagatatcacctaatagctttatgaagccctaagacagatgtttctcacaaacctcactgttaaaaataattctgcagcttaaaagtaactgatattaaaaactttgtatctcacagataccacccattatataactaagcttttaccctttgtgttcagtcactaataatctcagggccaaattcatttacattttaatgagcttattaatttttttcatatttaaatttatacttagattggttttaatatttttctttctctgtacctttgtatccttatcctcattcgttctgtgttactatgcatatttttacaatctcccctactacttttgggagtgggataaactattagtaacaaactaaacagaatctggactggagtcagacaaagggtgtaggccagacttcttggtacactttctataccactagatcaaatcagagcatctttcaaagtatttcctcatatttcgcagtggtgtttcaaatcactaaactgaaacattgtgtttttctttagattgctagcagtgaaagaatagactttcttacttcaggggataaaaaccctcactactgttgataaaaaataattttagtcacacacacaagcacagcaccagttaaaattttcaaaggagtatttccctttagggataaaaacaagtttctggcaatttgtctccgagacaaccattaagcataaaaagtgttttacatatatatgtatatatttagtagagcttatgttcctcccttagaacacatttttcttcaaaaagtattttagtggattggctctacatcaaatctctgtcgtctttaaaatggcatgagtcagtctgccatcctttgattgatcaaaacttggaccaaagaagggcagccatatggcacccaactcagtaatgctatgctgcatactgcagaatctggaatcagcaaatgccaagaagcagaatgcatagtgatgtatgaattaatgcaggcagacaggaataaaaatattgatgcatttttaaatcgatattgatacatatacgtcaatgaatagttaccaaattatttttacttcccaacaaatgctctaatgaaagactatgaaaaaggctttggttcaaaaaaggagtcaagtagaactgaacctacattcaaattcatacttttgttttggtttaattttttcttttggaatataataacactggcataagagatatcatatggatatgtaattcaatcatttagtaaattattttctgagtacttcctagtgccagacacttttctaggctctgatgatagagcagtaagtaagacagccatgttcctgttatggagcttaggttcaagtatgccagacaaaaattaaaaaagagagttctgcacaagataatttcacataagtactatgaagaaaacagtacagggtgatgtaataaaataatagcaatgggtaaagaaggagttacttaaaacagggtgctcactggggacatattttttgagacctaaatgaaaaggagtcaattataagatatgcagatgggatgcacactgaagaatcagtggcaggtacctaggcccttaagtgggaataaacttagaatgttgaatcagtaggaaagcttctgtcacttgagcatagggaatgaaagggggtaggtgggagttgaaaaaaggaaagacatcgtgataatatgggaggcttctgttgaaaatgacttttgtctcttggacaagcaagacttaacttacctggaccttacatttctcataagtcatgagctgatctttgggggtccaactctaaaatattctgataaaataattcttcttagagtcctagttaggctttgattattccttcacattaactatgtgtggcctttagaaacacgctgtctttaactaaaagtgttcatccagttaactgtattagcaatgtactgcattttaaaagtgatggataaaatatacaagtaaaataagttctcccaaagtgctcactgccattaactgggagtgttgtccatttgtggaaactgcattaaactcttttaggatgttagaatgctactcactaaattgctgctttggttcagcatataggaaaagcatttccagttagctaaactctaagcacataaaggtgaatatataaaagcaataaacatttaggaatccattttttaaatcaatggttttcagcccttttccaaatgtgataccattctcacatccatttccattagtaatattccttaatgggggaatagaaattaccctacacggatatttgaataattttatcccattttgagatgaaattcttcctagggaagtatactccccctttcactcttcccctagagttattcttttaaagttattaattatacaaagaaatccactaagttactaaatgccttcttacctactactgcatatgtagctttgcattcataactttggcatcttagtactccatcacttggctaatatctgccacccagggctttgcaatatgctggtgtgacaggatcagatgagatatgttactcacacagtcattcatttaacacattttactacgtaaacactgagtatagggtactattctttgtgctagggatagaactgaggtaaagagacatgatttctacctcctggagatcatggtgtagtatgtgtgtgtatgccagatataaggtgagatggttacagacagcagccatctttacagacagattacagtgatgtacaatgtacagtaatgaagtctatgatggagaaagcactgagtgaaataggagtaccaaaaatgctacctagcacaggttgaaacagccagagactatccagaacaagggacatttagacagaagttgagaaaagaagtggcaataacacatataaagtgggacttgaaagaggagacttccagatggattattttttaaaatcctgtggtaaaaaatatgttttattagtttattaatattaggttatattactgcatttgtcgatttggtgacaggaagttgagataaaatctcctcttttggtttctacttcctctgtgccaccagtaaatgaaatcatctacttaaagggaaaagttatgggccctgaagtattaagtataggtgagaaagtatgaaatataagtagtgacattggttccacttaccgctgggatgcaaaacgttgccataaatttttgttcctatcctaatactaagaacaatagataagctaaaagactgtagatttcttttttatttttaacttatcagatagctgaagatattaaaaaaacaactaaaaaggactaaatagaaaacaaatacctcgttctaggagcaactatatctgtagttactttcataccttgctgagtgacaggaagaggagaaatacacggtagacctcaagaaataacgaaaaaattactatggtggctcactatgaaccaactttcctaggctaggaagttccttgaactttggtccaggcaaagttagaagtgttatataagtggagccttgaaaagcacttttaaattagggcttatctttttggaacactccctacaggacttcagttgccatgatataaggaaattgaggttatactactagactgagaggtcatatggaggcgctctggaagatgaaacaccatgtgaatatagcagtcacatggagaagaatatgaaggccccagaaataggagagacgccatcttggaacttccagcccaacccagctacaaccatgtgagaaacctcaacaaatatcatgtagagcagaaatgcctgaacaaccagaatctgaggaatgcaaatgtttaagccactggtttcatagatatctgatctggtatatcagtttaacctttaacaacgttttaattatacatatgacatgcatgatgaattagaatcacaaggaggcttagctatagaacaagcatgaatccagccacaaacatttccccaaaggcatttaccaagtgcataaagtggtatgctgatggctaggacagaatagaagagctaagaatgtttccactgaggcacgcagagaatatttccagagtaagtcagtggtctggctgaagagtggcagcagggcaggaatggtgaggtaataactatggtgtattttggactttcactgagtaactattgaatgttgggtggggaagagaggtatctaaaagaagaaaagtctaagataatgactcaagattctagagaaagaagttagcagaataagagtaaagtaaacccagaataaggcaatattcaagataagaggagaggtcaacaaaatagaaaagagacaacacagtagagaaaactaaagtgaaaaattggttctttgaaaagatcaagaaaaatgacaaaccctgagttactctaatcaagaaaaaggagatacttacagaaaaaaacgaaaaaagagaagaacacaatctactgctatcagggaagaaagattatcgcaacaaaccctggagacagtataagaacaattagagaatatcttgagcaactttatgccaataaattgggtaatttaggtgacaaacaggtatcttaaaaaataaacattgattcctgtctcacttaatgccaaaaaagatcatggacctgtacgaaaaattaagaatatataggagaatatcttcaagctttgaaggagtccaatatttcttatacaggacacaaaagctcttacctttaaataaaaaacactaacaataaaaaagttatattgaatttcatcaaaattaacaatgccaaatcatcaaaagatatcattaaaaagatgaataagcaagtcaagctacagactggaaaaaaatatcagcagtatttatatctaacataggtcttatatacaaaatatataaagaacttgacaaatcaataatataaacacaaatgacccaattaaatctgagagaaaaagaataggcacatcctaaaagagatatatgaatggtcaccaatcaagtgaaaacggtactcaacatcattagtcattacagagatgcaaattaaaccacaatgagatgacatttcagtttactaaaatgcttaaaatcaacaatacaattcctagtgttaacaaccatgaggagcaactggaactcttacaaaattctaagggttttgtgctgcaggagcatgaaatttaataattattttagagaactgcttgccacttcgttataaagctaaacataaccctactcagcgttttctagcaattccagtaattctctaacagatatttacctgagatacatgaaaacgtatgtccacaaaaatcttgtgtgagaataatcataccaattgaaaacaatgcaagtgctcatatacatggaaataaacaaattgtggtatattcatacaacgaaataccgcttagccataaaaaggaatgggactactaataaaacaacattaatgagactcaaaaacattttgttgagcaaaataaaacatacatgaaagaatgcatattttaagattccatttacatgaattttaagaatagacataacaaattatggggatgctattcagaaaatgttgccactggtggatgttagagttgtagaattgattagaaatttgcacaaggctactttccagagggatgcaaatgttctataatttgcttcatttgtaattccaaaggtataaggtataaacaattgctaaattctctgggcttcacattatatcaatatcatgtatcacttaatataattgtttttattttatgtaaattatatcataataaagattaggtaaatttcaaaattttaattgacttaagatttactaagttttccaaggtagggtagatttaatgatagattttttggtgatggataatgcaggtacaaataacttgctgagaattatgcaaatctcagagcccattttatgtcacagataagcctaggatcaaggccatcaaccttgattgttactgaaaacaaacaacaaaaacaaaaacaaatcaaagaacaaatgaattttcgttctaggctacttctttataatctagtctatactatagtgttgcacacttgatttttctaaaaggttattaaaacatgaaaataactgcttttgggaaatcaaaacaatacgtgcttaactattgttaaaacaatttgtgtttattaaacgtatattagaagctaccattttccagaacttttaatacaaattttgctttgagtccaaattttatcaggtaactgtcagattagaatccctccaccttcaattttgtaagctattccaaatttcataaaacctgacttaatctcttctcttgtagaaaatgcatctaagctattgcccatatctctgtgatacacttcaaaataaccttggtttgaattaaacttaaggataaatggtgagcattaggaagcctgtttaataccaaactattttctataaaacagtacttttatttatatccgtggattttaccatttctccctaaaaattgtactataagaaccaaatgtgaaaagcaagtattaaccatttgtaatattaatttctgcgacattttaattaattgaattaaaagcttatttttaggtttccttatcagaaaatatcatttaatcaatgaaggttcccaaaataattactttgtataaatattttaagtccgacttcattttgattttttaggtacatatgacacacatttcttaacctttttaaggtttagatttaattaagatatatttatttcaaaataatctcacttgagggcctatatacttaatgcaatgatgctaaaagcagtttgagaacatctctcgactgtgtcttcaaatgtattctgaaccacaaagaacatcagtcacctgaccttataaaaacattttaaccaaaaatattttaatatctacatgcactttttgctttcatacaaattaaagtcatacagccatttttctaggctcacaaaattttccttggatcataaaaagatagatattttgagaaaacactaataggtctaagctttatgtattttattataataattttattttatacttttgttttagatttggtattctgctttagaattttattatagttcaactataatagtgaattaaaaagtaggaaatctgagcaaattctagccgatagcccacatttctagttgggatgggtttctgactatacctgaatatgtgtggaggtttaagctaatctaaatctcatcttgttgttcttgattatttttattttttagaggagttttacattcacagcaaaattgagaggaaagtatagagatttcaaatatacttcttgtcccacatatggataaggttgcccccattaccaacatcccccaccaaaatagtacacttgttaaaattgctgaacctatgttaacatcattaacacccagattcctttgtttaccttagggttcactctatgcatgagttcaaactcattctatgggtttagacaaatgtataacgacacacacttgccactgtagcatcatacaacatagttccactgtgctaaaaatcctctgtgctgtgcctattcatccctccctttctctaacccctgacaactactgatatttttaatgtctccacagtttcgtcttttctagaatgtcatatagtttgaatcatacaatatgtagccttttcagattggctcttttcacatagtaatatgcatttaagattcctccatgtttttaaaattctattgtttagatgtgccacactttatccattcacctattaaagaacatcttaatttctttcaaatgtgaacaattatgaataaagctattttaaatatctgtgtacagagtttttgcatggaccaaaatttttaactcttttaggtaactactcttggtctattcctgatttctttattctgttacactgatctgtacatctgttctttcatcagtatcacactgtcttgattactgtaggtgtattgtatatcttgaagttcgctgatgtcagtcctccaactttgttcattattggctattctgggtcttttactgttcatataaactttagaattagtttattgatatctacaaaataacttgctgagattttgactgagattgcattgagtctatagacgaattttagaaaaaacaacttgaatatattgagtcttcctatttataagtatggaatatcttcccactttttaattttttttattctatcagggtttttcagtttctcacatagatcttgtccatattttgttagacttacacctaagtacttcattcttttggtagccaatatacatggtattgtgtttttaatctcaatttccacttgtttatttctggtatatagaaatatatagcagtttttttcactaaatatatagtttcagtgaaattttgttttgttttgagttttgtgcattaatcttagatcctgaagctctgctataatccattattagttccaaaagttgttgtggaatttttggaatttttacatagaagatcatgtcatctgagaaaaaaaaatagtgtgttgctttcttctcaatctatataccttttatttccttttcttgtcttattgcataagctagaacttatgcaatttttatagcaaaattaaataccagatgtttcttttctgcacattctcatgtatttctattttatcttctttattcatgttcagtttttctaattaatgccattatttgccctccttaggtgattttgcatagaatctttgttcttttctatgtatttatcttaattttcagttttgtttacctctctagtagtgaccatattccaccgacaattactactacctttatgctatataaattatcccttttatatgtaaaattctggcagtaatgcacaaatttaaaagtgttcctcttataccagtagattctgtgtttatagtaataataattactaacttattgaatgtttataatatgttccactaagtactaaatattgtgctgtgctttatatgcattatgttatttaatctataatgaaaaattttaaatcttgagagtcatataatttatgatcttaatatagtggagtaattaccaaacagtgttcctcactaaaagagcattaaaaccaccaggtaaataatggaaccctattacatgggtagtgagttaaagacttgtgttaaagttctccaaatcaaaatggagtcactaatgttaaaaaaaaaaataaaaataaaaagacaaaaaataaaaaataaaacctaatagagcaggggaagactatgaagagagggttctcatgcttgtatgcttggtaacaacagctatcacaaagactctacaaaaaccataaaattgcacaaatgccataccaaacttacacaaaaatacttctacaaggaaaccctgtctaaattggactgatgtcactcttgctatcgattttgtagccaataacaattatttcagaaaaagtacgcagtcatcctcatcattccttacaaacctttgtgttcctttacctccctgaatgtgcagagcttactacagtgtgcatattccatttgaaatgctctacttccaaataaacatctttttcttttggaaatcctctctccctttttatttaggttgccattcaaaatatagattcagtgaaatttttgtttggttctcagagccaggacttaattaggaatcaagctgcctagcctgttgaaatctcagaatgctcacttgtaaaacatcgataataatagggtctactttcaactgtttgaggactaaatgcatgtagagtgtgtgattcagtgactgacactcatagtaaaggctgaataggtcatagttgctttagtcttgtgatgacatgccataggatatctgtatgacaaggatattttgtacatcaggatatttagcccttctgacaatccaaaagaaaaagtatttgaaggctattttccaaacttttccaattgttttcccaatttgataagagctataaaaccaaaaatctaagaaagctcaaataaacacaaattcacacacacacacacacacacacacacatcaggaaaaagtccaaggcatataataagcaaattgctaaaaatgaaacataatgagaaaaatgtgaaagaagctcaagaaaaaaaggcttattatatcaaagagaacaatgataggaattttttctgacttttctcacaaaaaatgcaagacaaaggacaatgaaacaaaatctttcaagagttgaaagtgtaaagaaaaacactgctgtccaatattttttatccagctaaaatgaagttgaaataaagatatttgctgagcaatgtaatacaatttgtcatcagcagatatgcacttcaaagaatgataaagaaaattcttcaagttaaatgaaaatgatactagatagaaaattcattccaagtgaaggaagaagaaagctggaaatgatcaataataaaagtgactaatagaagataaatagcaagaatacagacctaaacccaaatttattcacaattgcattaaagaaaagagactaaaaatgtaagctaatcattcaattaaagggcaaagattgccagagtgtatgacagagcttgattcaattacttgctacgtatatgtgactttttttcttttttttttttttttttttaagacggagtctcgctttgtcatccaggctggagggcagtgacatgatcttggttcactgtaacctccgcttcctgggttcaagtgattctcctgcttcagcctcctgggctacaggcgtctgccaccatgcctggctaatttttgtatttttagtagagatggggtttcaccatgctggccaggctggtctcaaagagatacacttttaaagtaaagacacaaaagagttaaaagcaaaagtatgataaaaaacgatgtattataagcactgatcataagaaagatggagtgccgtattagacaaagttgactttaagataacgaatattaccagagataaaagagcatattttataatgatgaaatggtcaattcggcaagtagacatagcaatactaaatgtatatcccttaaaagaaaacttcaaaaataaatgaagcaaagattgacaatacgaaaggaagaaatagaacatttttaccattatattcagttatttttcactcttgctctcagtaattgacaggaaaatcaatttagttataaaagatttgaccaaccttctcaaacaatgtaactgatacttttaggacactatatcaaacaacttcagaatatatctcttttcaagaggaaagcataggcaactatctttgcaatcttgaagtaggcaatattttttagataagaaatagaaagcacaaacttataaaagaaaaaaagcttaaaactcgggcttaatcattttttaaaattcaccttatcaaaagacattgtaaaaaataagcagccacaggttaggagaaaattatacatatatatgtgtataatgtatatattacacacacagacacacacgacaaaggacttgtttccagaatatataaagaactcttataactaatcaaaagacaatccaatttttaaatgggtgaaatatctgaaaagacattttaaaatgaaaccatccaaatagccaataaactcatagaaaagtgttcaacagcattagttatcaggaagatgcaaactgaaaccatcataagatgccgccacatctctaccaaaatagatagtcaacaagactgatctcattaactgctggtgaagatgtattaaacttaaacagtcgctatggtccagcaattccatgcctcgttatttacctaagaaaagtaaaaacatgtcataaaaacacttatacaaaattgtctcatacacatgcttcactgatttttgacaaggagataaaagcaattcaatggaaaaatgattcaacaaatgatggtggaacaattgaacatacatagaccaaacaatgagcctcaacttaaacctcataccttacataaaaactctcaaaatgaagaatagtcttaaatacaaaacacaaaatacaaaacttttaggaatgtatacaaaacacacagaatatcttgggatctagggctatgcaaagatttcttagacatgacatcaaaagaatgatggataaaagtaaaaataaataaattgggctttctgcccaatagataattggactaatttttagtgccaaattggttagactgtagtgaccagttgtttggtcaaaccccaaattaaatgttgctgtgaatatatttttaaaatgtgattaacatttaaatgataccttgaataaagcagattaccccccataacatgaatggaattcatcttatcagttgaaggccttaagagaaaagacttaggtttaccaaagaagaaattctgcctctactgtagcatagaaattctgcctaagtttcagactttaggctgcaatatcaactcttacctgaatctccatcctgccagctttccctacagatttcagacttgccagctcctgcaatcacataaaccaatttcttataatctctctccctctctctatggaaagaagtatatatatttctcatatacatatagttctctctctatatatatgaaatgtataattttatatataaaattatatattaatgtatattatgtatagtattatacgtagtatattatgcactatatactatatatatggtatgatatgtaggacaatatattatgtatagtattatgtatagtatagcatatatatattatataatgttaatatatatcccaatttatcctattggttctgttgctctggaaagccataatacaaagttcataaaaacaagaacttttgctctgtaaaaccccgcatgaaaagaatgtaaagataagttacttcctgggataaactagttgcaaatcacttatctggcaaagggctagtataaaaaataaagaactctcaaaattcaacaataaaaaaatagcaaaggagcaaaagacatgaacagacattttactaaagaggatatagagagtatataagtacatgaaaatatgttcaatatcattagccatcaatgtaaattaaaatcacaagaacatatcactacacattaactaaaaatggctaaaataaaaattaatgatatcaccaaatgttggcaagtagagaaactgtatcactcatgaattgctagtaggaatataagttcctagagttatctgaaaaatggtctgaaaatttatcatgcaaatttaatcatgtaaatactacatgaccccatagttacactcaatttataatttaatgtatattcttgaaaaataagaacttatgttcaccctaaacctgcatatgaatgtttcaaggagctggggtagtatggaggggctcatttatagtgataatcaacctggcgctaaataaactgcataaattttacctgagaaggatcagtaaatgcttaactgaaaaatcttataaagctgacaaacggaggtcaaaaccttacaagctttagaaattcagtatttaaattaagggtctctaattattccctaaaggtgaataattccagttatctattcgaatattctagctttccagtggtagtactaggcaacattgattatatttaattttacatcaatacaagtcttttattctatacataacacattagtgaaatggtaatagaatatatatatatgaaaattcactctgtatctacctactggagttctgacacaggttcgcataaagctggatttgatcttccagagtacaggctgaagatattacattaatgtttggctcctatatggttctcagtacatcctttgttcttctttcatcaagccttctttaattccattggactttccattttaatggtgaattagtacatgccagtcctactgcatatagcctgggataaaaagctgatcttagaaccccacaaactaagccccaccagattgtaccagagtaagggacactgccccaaaccaacttatgtatctgctagtggactgtaatttaggatactgtaagttgctccccaaaaggaaaatgtggaacaatgggatcatctctcagtgagtttgaattaaagacatgcagaaagaaatcagagttggctgacatagaagtgagaaaaaaaaaatgaggaagtaaactgaagccatgaggcaaaagaagcaatccataagcaaaagtataaagacacataagcccaactctttatcaccatcacctgaagggctttctaggtgtcagactctcctctcactttcataatagtcaatattcatttactcctcagttaagacaggtattagtatctcacttttaccaataaagaaacaaaggctcagagaggtaaattgatttacccagtctgattcaaaaatccatgccatttccattattccacgccatctcttaacaaaacagaaggaaagcagtacataaagagtattgaagaaggaagtgattttaatttcaagtcagtcattgtttttgcttttgttggataatttcgcagtcaattgccattttctatatttagtcatattttgagacattagtaaaactttcaaacctctaaaattttgttactccaaacgatgagcttttcaatcaaatcttgaaaagtattgactattaaataattttaacttcctaaatgtagttctttataacttacttcagcttatgaaatgaattgtgccaatttttagtgggacttcttttatatgcaaatacttgcttctctgtagtaagcctatagcaaacttcttctgtctaatgacctaagaatgctctgagatttatctagtgttttgcagacattgcttcttgggttcaaggttagtgctcaagaagactagattcctcggttcaaggttagtgactgggaagactttagagatttctgcatttttgtggagcaaaatcacattgtgacatggctgcttttcaaagatgaatgcttcattcagcactttgcttcatttcctaatacaattgaaaagtcatttgctgacagtaaaccagtggcaggtgtgctttcgtgttgacagctgctattctgacatggatcacagacaagctctactgacagtgctagaacatctggagcatttggtcagatttcaaaagctaatttaagtggactgtcttcttccatttcaaaaaatgaaagcaattatggacactgggaccatatttacattgtgatagtataataatttattcaatttcttttttattaaatatggaggcaaaggcagcaaagcatgccaatacatctaatgtctgggaagatagtttgtaatgtagcttactgcagtcgcctgctcctattaagatttcctttgatattgtgaaagcaattgattgacagaaaatgaactaaaatttcatccctataaatatgtttctgagaaattgttatacggatttatacaaagaaaacatttaatatttattgaatgaatgaattcagtttatttttttctaatttcttattaataatattcattgccaacacttactaagcagcatttctgccaacattgtacaaacctaatcacttaatctccagaaatacccttcaaggtaataacaaatgacataattcccatttaacagatgaggatactgaaactcaaataattaagacaactgcccaaactctataagtagaaggtagaaaaactcggattttttttttccacattggtattccaaagatcatgctctttctacagtgttttggtgtttctaaatgacagtatggataccccttacttactgaattaataaggttagtaaagaaagcatacaatttttctttactgaaaagtaaatacaaatatgcttgactatattgttgacaataagggacttcctagcaagctattcaggtaggaagaaaatattaagttttatacttggaaattgttagacaaatgaagcaaaggaatttaatgtgtttcaaagttcaataattacatttagactaagaaaataatgcttacacattctcacgtatcagttacttaattgctgattattgggccctactggagtgaaggaggaaagttgacagctgcaggcatataccctctgacaacaaagcttacatatgtgagcattgcttgctacagattctgggtattttaaaagcaatgagttggacaatgatgggaacatgacatctgagaattgatgccatttatgaacattttattatggatgggctagaaaagttagattgaaacttcaccttttacgctttcatatgacagtatttcatgggatatgtgggcaagaatccaaaaatattaattgcaaactcaaccactggttcatgtgggtgtatgaaatatggaaaacactatcaagtaatttatcttcaatgttgtgccaataaggatgtggcctctcacacactgcacaccagagaatgtccattcaaatgagatttgagcattttatgggtgaatgtctgactaatggatagagactaatatattcttctgcctcaatattataaagactgcagtatttacttactagtgcacactgtgacaaatggtcctgttttatttttttttttctttgatcctactcttgtttttaggttacactgggagctatttagaaaaaatgttgacatggttcgggggagtgggggtccatgtcaagcaaatactgtagggttaaatatcttgaaagaaatatattctggcaccatccaagagaaaatgaacaatcacactcctctggcacctgaagatattggtcgttgtttggcacctgaagaaattacccatgaaatgaacacttgaggcttgactcattagaattcaactccagtgtcttcaaatgaataagaatctctacacggatactgagaaatagagataaaaagaattgcagaggaaacgtcaacacttcttaactacgcaggaaacttagacttaatggaatttgccccataatgtacataatgtcaaggtataatcataggtcaataaagtgattacattccaagccaggaaaaactgcatattcaattattcaatgaaataaagtctatctgcaaaatgtggattttaatttgcttgcttatacgtctacatattctatattatacaagctattttatatctatgattttgtctaatgggttagaatttttatcatttgtgcaaagaggaaaataattctatattagaaaatttagactcagttctaaaagtggtttgtttaaaggcataagtgcataatgtgaaacatttcagagttttgagcatggactttagaagactgtgtttgtaatactgccaacatgtatgtattatgaatatgttcatttttttacataatatttgacgtatgatattatttcttatgcttctagaagactttctaatataataaaatatcttattagggcagatatatggccacagtcttttcattgtttacctatataaacctgaatgttccccccataattattgaccagtcacctgttgagcaacatcacacattattgactgagttcaccagaaaaagggagaaagctggtgtttatagagttagacaagtataaataaccctgtagagtgattccctaaacctgtctttatttatcgtattatagtttcatcaactctggaaacacacacacataaacatatacacatgcacataattacatgacacttcatatattgtgccactaaaattcagcattattgtaggatggaaagcatcttaactgatttctttcctgtttgctttctattttagaaataggctaagttcaatatgttgtaaatctagtacaagaagaaaccacgtttggcatttaagtaggtcacaaaatatgtcctgatttcttatgtttctgaatatacagataaaactacaaaaaacattagctataagtacctttcccattatattatatgagaaaattatatctaaatgccttataagagattaaattttttaatgcaaatattaacatttaataaatgcaaaactaacgaatacacctgaaagttcaaaagattgtcctcctctagaaattatgcatattaaaactaaaatagaacctttgcttccttttaaatttattttttgtgtcttaaattactccttttatggccttagattgtacagttgacccttgaacaatgtgggggaccccacaggtagccaaaaatctttgtgtaacttttgattccccatgaacttaactatgaataacctattattgaccagaaaccttactgataacatagtcaattaatacatattttgtatgttatatgtattatatattgtattattaaaataaagtaagccagagaaaagaaaatgtaattaagaaaatcattagaaagcgaaaatatatttactgttaagtgaaagtggatcatcataaaggtcttcatcctcattgtcttcacactgagtaagttgaagaaaggaggaagaggaggggttggtcttgctgtctcaggaaagcagaggaaaaagaggtggaggaggtagaaggggaaggaggcacgtttggtgtaacatttattgaaaaaatttacatataagtggacctgccagtccaaatctttattgttcaagggttcaactctatttattattcataacagtcataaatagattgtaaattcctagaagtctatcaattgtgtttcacactttgaatctaacttgcccccaattttcttgcctggtgccttcccacattgtagatcctcagttaataattttcagtaagttattgttgctagggccccatctaagataaatgaattgtttaaagtatataactttgtctttgtatctctgagagctaacacaacccaaatccttcaaatttagatggtcagatgatcaagttacatccaaacttcaaaatataattcctggcaagaaattgagagctctgtggttcaaaatcttgatgatgatggagtgaagcctcaaagatttctcagtgccttgcagggtcctttcgttatcagaaaagaacaaaggattagaaacctgtattctaatctcagacagtatcttcaattctactgtagaaaagagtaaagatttcaactgagatggacatggtggttctgtttgttactctatcactttagggaacttatccccctgagactcagtgctttatccacagaatgctgattcattattttgagtgtgagagataacgtccatcaatggaagaaaagtagtatcctttcagcaaattgtctgggtttcattgccattgtaaaccaaaaacaaaattatagctcccgcaattgacttgtatgtaccctcctctcagccaaggcattccaaattaaacttgaaaaactagttcaggccatgatggaaggggggaagggtgtccagacatacctaaatgtagcctcctacctttggaattcaggcacaattgatcagcattaacattaaaacagagatcttaagaatgacaaagcagactctttgtaccaataagataccgaactccaacctaactctaacatagcattgcatagcagatagcaagccctggaagaaattgaagtattttatcccaaaataaaattttttgacatattttgaaatgcactgcaaagctctctctcgggagaaaaaaatctacatgctatagagaaaccccttccctttccagagcttttcctaatccaacagatattaattaagaaactggtacctttttagatctgaaaagagactaataccatccattctttctgaagactgctacctagagacttcatctgcataagaaccttggtctccacacccccttatcttaaccaaaacattcctttctattgattccagattttttgataattgccagttagaaaagctttgaatccacctatgatctggaagcccccttcaagttgtcccatgtgtcaggtcctggagtcctggtccagcccatgctgaagtctgaggggagtgggtggatgggcagaaagaacactcaggggctataggcaggtgaatatggttttattcagcggcagctctcttacacagcttacttaaactagctttctcattagcagcttactttcacactgtccaccctatcttggctgcttgagccagcagcctgcatgcacagcacacagccagcttttacttgccttcagggtcagcagcttaactctttctttctctgagcacgagtaagctgagctgtgacctggctccctcctgtccatctgcaagatggacagctttggctctctctgtctttctctgggtgccagcgcgcccaccatgtcaagccatgttgagccgagctgaacctcaagagccaagcaagcctgtacagtgttagcagggcagttgtaccttttacagacaatagtggcacagagccaagtaatggcctttccatgttatggctacatggttgtgataacaagtggagttatacatctgtgctctaaactcactgagtcatgcagaatgtaaacatcctaacttggcctatccttgactaaggcacagccatattccttacactccacccctttggccgagggagacatagggcttggacacacaggtttgatacacaggttttgtcacacaggcctgccatacaaactttgggtacacacacctgatacatagacaggcttgacccataagcctgacatacaactgggaatgcaggtccgatacatacacaagcaactgagcacgcaggcctgttacatacataagcgttgataaactgcccatctattggcacagattaccacagatgtcacctccttggtgattaccattcacactgccctgagtttagcttattagctactccgtttacacctggttttaaaccatatgttatcagtactaggctggactgagacaaaagtccaggcagaaggagcaccccaggtagacctatctgtatataatgccctattacgaattcggggacacccttcctaacagtgaaggttcaggatctaggggtgtctcaggccccatgaccttaggccccaaggccttatgttgcattaggactacaggtcctaagcctttttgtaactctgctactaagggacttgtactcagtgtacttcaatgctctaagtaggcgccccacatcactaaagtggatgtccgcacgttccagtccgggggggtagctatccatgagtgcacccatcccgttattgggtaagtcatctgaatgatgactgtagcctgtcctgccacactcttatgagcctagagggcagcatatgcagttactaactgcttcccagtctggggcgtggttacccatcaacacacccatcccgctatagggtaagttgtctacaggatgactgtagactgtcctaccacactctgagcatgaagggcagcatatgcagttactaactgcttcccagtctgggagttggttacccatgaacacacccatcccgctattactaactgcttctctattaatgaacactggcacttagctccctcccgcagctgggactaaaagcctactggcacttccaactgctccagcattgtttaggccctagccaaaactatctgtggtcacatgcacattcagttttaataggcacccctggttaactacatgtagggcttgtgcctactgaataggctgcttggctgtctcagcctcatcatccaatcccaggtaagaggggcattgctgtttctaactctgcaagagaatgagaggttagcataacatcatcaataagactatgacatatagtggagctatgcacatagccctccagcaacactgcgaaagtccactgttgccctcccatgaaggtaaactgttcctggctctctggacaagaagttccagttctgttgtcaagtggtccagcaagtctgtgacagaccgtacagctgccaacccatgaaaaacatccaccctcagaatatcctcaggcatgggagagacataagcggtgcataagtggagagccaagctgccaatgccaaggtgcagacagaggtttcacttccactgaccagcttccacagctgccaataaatgcagttctgcctggaaacttatctgggttcagagaccagtggattgccaagtccacatgtggctccggttgtccggtgccccctcaagtcgggcttctcggccagttctcttaccaaacagaaaaaaactacacttccaccaaccacagcaggtactctttgaactggaatgctagggcaggactgggttgcacagcaatgttcttctctcagacgtcttgcactaagtctgtacatgactgtggaccttacttacttaactcccacaactcagccaggacacaggcactagaggaagtacactccaccacagtaggtggtctctgggaccacccctggacctaatagcttctcatgctctattttctggtggaatacagggcgagcctgcaagaacatatggtggtagattctagaaatgttgcatcttgcagggactaggcatgtatttcccgcagcacagttacaaatgcctatccgactttgctggcaaagatatgttcctccttggtgttgtgcacctcaggtgcttcagcgcctcctccacactcacagggaatctgtccactgcctcccatgtttccattgaggctcatccaagcagcaccactgccaccgggtaccacagcccatgctgcagccacatggctgaccgggcaagcctcaggggctgaagacccactcacttcatcccacccttattgccagttgtcaggtcctagggtccggttccagcccatgctgaagtccaaggggagtgggtggatgggcagaaagtacactctggggccgtgggcaggtgaatatggctttattcagcagcagctctcttacacagcttaaagtagctttctcattagcagcttactttcacactgtccgccctgtcttggctgcttgagccagctgcccccatgcacagctgtgcagcaggttctcccttgccttcatggtcagtagcttaactctttctctttctgggcacgagcaagccgagctgtgtcctggctccctcctgtctatctgcaagacaggtagccttcactctctctctttctctgggtgccatgtgcctgccatgtcaagccatgttgagccgagctgagccccaagagccaagcaagcctgtacagcattagcagggcagttatacgtttcacagacaatagtgttgtagagccaatgatggccttcctatgttatggctacatggttgtgataacaagcggagttatacgcctgcgctctaaactcactgagtcactcaggatgtaaacatcataccttggcctacccctgactaaagcacagccatgttccttacaccacgtttccagatcaaacccatggataccttgcatgtattgattgatgtctgcctgtgacttctgtccccctaaaatgtataaaaaatcaagctgtaacctaaacagtgtgggcacatgttctcaggacttcttgcaactgtgcctcacgtattggtcacgcatatttgacgcagaataaatccattcaaatattttacataatttgactctttttcatcaacactactaagtaaatggccactgatttatcatcaaaccatttggggtaaaattagattttcacaaagaacaagcaaatggacaagtataaaaagaatagcctctctctattttcagaactacagttagaaatgtgcagggaaaaaggcatttaggtttaagccttaactgaaaaaaacactcttactttccaaacaaaagaagggtactaatttataaaacatccgtgttggtaaaaatctgtttctcttcagaggtgatgagatcttttctcttagattgaaagacatcacatacttttctttctctttctatctactggttgtaccttctctcatttgttggttccttctccttccaagctcttattgttggaatggcccatggctcagacttagacattttctctctatgtatacatgctgctttaaggatttttctctcattttatggctttaaatgtcatctctgtgccaccaacattcacttttttaatcttctggactgacatttcttccaaaatgaagcctcatatatccatatgactacttgatacccaacttcggagtctaaaagacatctgaaattcaacatgtccaaaattgatctgattttctgtgtcccccatatctgttttcctcacactcatattctttattttttcttatttttattttttggtaaaaggcagctccacagttaagttcttagctctcaaatccccaagccatccttgattcctctttctcttatgtccctcaggcaattggttggaaattctgccaacaaatccttcaaaatttacctagaaaatttatctaaattcttttcattgcctcctctgccactattctggatgaagcccctattatttcttatctgcattacggtagcctttaaaaatggcttctggctttaagaccataccctatttgccattgtcaacagagataattaccttagtatcatccttctgcttaaaatccttcaatggcttctcactgctcttagtgttaaagccaaagctctacctgacctgccttcaaccccacctctgttactattctgacctcaggtcctagaactctgccttcctctgctcctattgcactgtcctctttgctatttttcaagcctcctttcagcctttgcctttacaattagacccctctccttcatggtatctatatggctaacacctttagttcctgagcaaatttgcccaaatctgttgttttggataattcaactctaagcatcctatttacaattatatttctacccaccccacatctccttatccccaaatctcctatttcctttcaacctgttctactttttgttattttctgtaaaatacataacctttaaatatgctagattattctatcaccatctctccacactggaatccaagctccatgtgggcagacatctttgccgcttgtatttacggtgtaactcaagcagaaagacaatggtctagaacacagtagctgctcaccaaatatttattgctagatgaatgactattagaacatttttaataaatcacctttttcaactgaatataaaattttagctaattgtatggttataattgtacccactttattataagaaatatataatgtgtttcagtctgacccttctctttggtaggagcagaaagagattaaaaataaaaggggcaaggggtggtcaagatatagtaataaaagttgtaaggagcaagtctatcccgataagtttgaaatgtgagaagaatccatggcttaggtgcgctgtgcaaatttgctgggttacttcatttgggaactaccttatggatagactattataaggtgggatcagaatgctttgacaatatgataactccagtatctttttaattaccttattgtcatgatcatcaaagtagctttggttatttttcttctatctgtacccaaaccatggatcactctctccttattttattctgcatggacaagaaagaaatatggtggtagattctggaaatactgtgattgctgaagaatagaccaattccagaactcagggacagcctacagagctggagcatagtaagaaaaataaggaaaccacattcagaggatcaggacagctgttgatgcttttatccttggcttttatgccaaggattaaacattatgttatatgaaaatcattctgcaaccatataaacaaaaccataaagcttccattaagtaatatcccatgcatccaatatatgatgtttgaaagagatcattaatacattggtatgcccaagtaatactcttatcttgcattctcatactatagaactagaattgactcatattgacaaccaacatgctttacctgagcatttaaatcttgacttcagttaaccttatccattgatatcctggctttcttctccacatgacttagcccaatggctctcaaaccaaatgggcatatgagtcacttaaagaggaagtaaaagacatgttggcctaggttcaactgagtaggtgagagcttgggttgttttatatttaccaagttttccagctcattctaatagctaccagtgcttgtggatcattagaatagcatgctcatctggcctcccaagagtgtatttaatgagtatgtcagccaaagaggctattagaaacaccagctgagctttttaaagtttaagtacctgtgtattaactttgtagatccttattcatttaacctgaggaggagctcacagatgtgcaaaagaaaatctccatgagtgattctgatgagctttccaaatgaaggagctatgcccaagttcttgaagtactctttctccaaattttcatcagttgtgaggaatgcttctcctgttaccctttagaaacaagttaactcagaatctccctggcataacagagttggcatgaggaatgcagggggccttgtcaatttaaatttatattttaaaaatttctgactccacattagatcaactaaattcgaatttcttaggctgaggttcgtgaattcacacttttatcagatttactagatgattctcttgcacaccaaattgtgagaacctttgggttggagctttctttttttaaacaattttcaaacttactgaaccaaaatcttcgaatcctggggtacatatgtcttaaaagctttccaagaagatttttaaaggtcattatatttaggaactcctgtattaatatgtaactcaagaaaacccatctctgaattgtttttcctaactctagttcagtgactgtctttggatttattagcacttagaaaaaatatatcacacttagattttacttctgaagatatttcttgttctgcctccagaaatgtaagctgaacaaaagagagacttgaatcttctgtttttttttttttttttttttttttttttgcagtgcacctaaggctaacctgttatgggctatgtactatttgcttcataaagatttaaatgaatgacatgcagttttcaaatttacctagtttcaaaattatctcaaggtctccaatgtcctgataactaacttaatcttacataatcccataaaaagaagcttaataaagtgaaaagttatattcaaatattttattaaaacttactaatatgtgtaaaaggttttgtaaagtggaaaggattatctgaatgagtaattgtaaactaacaatatattttattaatttacctcactttttgcaactctaaacaaacctttttaagctcactaaactcttgcttcatctgttttgattaggaattttctgatctgaaaaaatatgcggtttttaaaattaacatttatagactatgtagaaatggagatacacttctgatgagtgaaatgtttattaaatttaaaattgcaaaaaattgcatgtattgaatgatgtaatctaaatgcaaatctaaataaggattggaaaggaaggtataaaaatcctttttattttgatacctcacaatctgaatgcagaatgatgatggatttctgaagaataatttttcctttctttttgttatttatattgcaagactttattaatgtataaaaatgcttttaatatttttaacatataagaaatataaagaaaatgctacaaatagccacacgttcagaaataaactacaggtacctttattttttaaatcatttttacatttttttgtaccttaacatattcccagaaactgttacattattattcattttttgtgcatttaggaaaccagacaaatgtccttgtaaaaaaggaaacagaacattaaactttggccccgtttcctaggattttgaagaatttatatgttagagctgtcaaggatggaatacagagaaatgagataaatgaaaatgaccaagtaaccctacttaaacccctttgttgatggtgtcttctatagtagggaatctataatttcatttttttactctctaacaggccagaagtgtcagatggatttataaatatgctatgaaggacacaagatgaatcatttattggctgcctcctcatttgtgacaacttgaattctatgctgttagggcttgcttttttattcctgcacattttttcttctccagcaatttcatcttggtgtatatatatttttttcttttccagtacttattaaaattctcactaattacatttatacgtggacaacacaaatcaaactattgtcatattttgaagactgttattatctacttatatggatctttgaactcgataagataaaaataatttgcacatgttgatctgtcaaaaactgtgatatatatgaaggtaaattataatacacaactataagaattttatttgtttaatgtacaatgagcttaaattaattactcaagagcacagcaataagcaatggtgttgtggtcaaaaatttaaactcagattatttctctctgtacgtgcttttcgattaaacttgtgcgagagcttataatggtttgcctaggatatcaggaaaaacaatgtaattcttgctggagaatcagttttacacaataatacctaaacattcttatatgctaaataaaacctggatgttttattacatagactatgtatttaacataatttaaaaaggctaaacactataaaatataaaattagcacaatttacaaagattaaacaccagcttttaagaaaagcttacactcgtagtggggtcataactaattatatttcatagatcatcctttgtcagtaaagttttggggcagtaaaacctttggacatttgtggaaaatattgaaaagcgtttcttcggcctatcttactttcttctcatggaaaaatgaaagaaatgctccgaacattcgctctgcttatgtacactgacactaacactattttgttgcccaggcacatactctagcaaacacagagtaaaccttaccttatgacagtgattacagagtcaaatactaaggcagcaagggcaccaattttaccctcaaagtgtggaaagtccattgccgagagaggtcaagtagatataaaaaatataaaataatcagtctaatggaaatatgttgaaggtcaatgggaaaatgaaagcgcacataggtcacctgaagattcatgaaatactgcataaggagtgtggcatttgagctgaaatttgaaggaatgaaggaatagcagtaccttttctgtcagtcaaaggtgtgtgagtgggtcttggtcaaaggaaaaatgcagagatgattgattgtgggtgggaggttctgctaggggtgggattgttgtgttattgagagaacaggatgggtgaaggcaccagattgagagcaaagaacataggtatgccggtctcatggatggtaacagagcagcaaaactgagggagaaaccccattctgtacatttttatacagaaattattctcttgaagatgaaaagtcactaaagaattttgagaagagatgtggatgtaaacaataacaattgcctacttcctaagcaatcacctgtttaatttgatgtgattatccctggggacttcattctaaagtaaactcacattttatctattattgcctcagggaaaataaaagtattaattcaagaaggatgtagtacaccaacaaagcataataactataacagataccactggttgcctagcaaagaaccatttctccttttctgcttcttaagggaacttgaattttttatccccctccatgcttctctatgcagccttgagcttccatggaagcagaacacatttttaaatgcagagggtaaacacaactggtctaagccaatagtaaatgatccttataggctggggcatatgacacatttgatagaagagatgtgaaaaggtatttgctggcaataggcagaagagtggggattgtcataaaatcttaatcttttatggcataaaaagaaggcaaaatcccctttttttttctactgggtatctcgtgcctagatatgtaacctataattacggcagacatctttcaatattgagggattctggccaaggacaaacctaagataggacattgggcacaaagatgaaaagaacataggtccctgattatgtcattgagtcatccatgaaattctacaacttcttaacttcttatttgtataataagaagcctttcttaaagcctaagcaagttagtttcctgttatttgtggctcaaagcatatcaactgacataattagaataattaaatttaaagcttgaaaggattcaaaattcatagtgcacatccttcttgttttgtagtagaacacatggaagacttgagaaaataaatgactgaggtgggaggtcaaacgattaattataagcagaatcaggcttcctaagttccacaaatattctgccttctcatctttaatacatttcagatttcttagaagatcattatacaaataaaaccatccagaagagtatgtgacatgtaataaatactgaataatacctgactgaaaatatggactcttatttccagctttgcccaactagtgaacagttttgatattaaccatccaattatgacagtgagaaaatatatgctacttacaactcactgagtcatacatgtatggatttataggttttcctacatgctttcctctatgacgtttacacatttttttaaacgataatcagatgctatgtcccttcatctactaattataacttaatgggaggtagctcttaattttccactgatgggtaactaaagttttgatggggtgataaggatatacacatagtatagaggacttcacagatgaagacctttttgtagctggaggatgactgtagaccctacaagctctccaggactataaatttcctatgggtccctgttagctgactgtttcccaatactagcccaatgcttagtacatacagatgcttagtgggttttgttgaataaaataatgggtatctacaataaggagttgtgaataaaagagagaaaaaggcaaagacactggggaaagtcagttgagaaaatgcactatgcccactttctcattttgctaggtaatggccattatacagagtttaaagtcaattcattttcttaattcttactctgtcattgtcatcatctgcagcgagtaataatagtaataatcctctaactatctgcacatgtatcaacacagatgatacgctagtcatttgcgaatgttataagtgtaatgaaattaaaaccattgattaaatggcacaataatttctacagagcagaggggaaaaaaaaaaggtatttaaagggaagaactgagccacaaagtaaagcttactttaaaatatacatttgagtttcaagtttaaaaagtcagtcaccaaagatttgtatcatgtgataacagtggcagtttattaataatctgtcatgtaaagctgacatattagaagctgaattctgctcagctttacaataaaatcccatccattttattgctaccagaattaaatatatgccattgaaaggctttagtaagcttaaatatgttctaaagctctttttttttccctaacacttcgttatcaacaagtcaaatcgacaaaagtctaatctcgattttcccagatatccatagtatatcaaagagggagcaagataacatacacatttttatagaggttgataaagtttgcctttagacaaataggaaagtcttagaaactaaattacttgttcctgacatgtcgggaacgggggaaggctagatatagtgtgtaaatcatatagagtaagtattaaaagttaagcctaggggattcacagatggataatttatttaatcagaattatgtgtgagctagccagataggaataatctgtccaaaggtgtgaagaggtgataatccatatgtattcagactaaaggatttaggtgaggcattttgtaacaagtaaatatcactgaactagtttttcagaaatatcagttgaaagtgctcatcagaactagaactccatttttcccatatattttttagggaaaaaaaataaccccacagaactgcactttaacaattctgtgtaatcaattcattattgaataggaagcaaaaatttccagaaagtatttgtgcatgcagtgatctcaaattcaaacttcatttatgttaccaaaactttttacccacgtctttctaactgtattatcatcattattattattatttggacttcaaacggtgtttgtgacttcagattagacttctattgcataattcagtatttaaattttgggtccaaataatgcacagtaattcttcagtttccactattttccttcatgcaggatgttacttgtatgtcgtttaacttcatttttccccaagccctgtcaccactgtgaaaataaactaagctaatttaactggcatcaattacctctatatgtggtttgtgtttcttaactggatttttccctttaactatcacttacattcagggacacatgaaataaatcctgaaatatttatttctataacttatgctctatttctcagataagctcattatttatctttttggaatggctggtggaggataagaagtattagtgctacttaaagtcttagaaccaatcttcaagacagctatttgtgttttacctttgttctccctgctttcattatgacacagagatcgataatttagaaaaagtgaaaaacatctaattagctcttgattattgcgctcaatatttcatcatgtttggctacctaaaacaggcaagaaagcagaaagaaaaaaacaggcaaccaaaatcttctgaaacaaatcccaagctcttcaaatatccaagtatatggattaataaaattccatctttagtttcaaggattttaatttataaaccccaacatttctttattacattgtttcaatattatgaagaactgaaacacgttagctaactactaaaataagatactatctactttgctgttctacttccattgtgttacattatgagttactcttaaatcatgacatggcttagactaaggacccagagatgaaaaacaaacattctaagaacgtatttaaatgaagattgttacttcatgaggaaaaacacatgcaattctaaaaaggtgtatactgcaacctgtggcaaacacatgtatgtttgcataactgatacaaaatttttaaaaataaacaatcctgatttttataccatcctttctatcagacacaaaataagttgtgtttttggtgaaaattttaaaacaaacaaaaaaagatatgtatgtctctctctctcttctctctctatatatatctcacaagacaagtattaaataaaatcttaatgaagcgcatataacagtattctgtagttaatacttaaggctgtatttatattatggctgttatatgcttatataacttattagacataatattttagaagcaataaatatattttaacaatgattacatttaaatgcttaaaggttagcctaatattctgatattttaatgatgctgtagaacattcatattgcatacttttggttcccttaataatatcatatggaaataaattatcataattcatttaggcttaaagtaaaataattttgttatagtgctgaattttcatttcaaaattgtggccacataactaattgttgcatgaaacttataatgggcaattcataaatatatatatattgatttaacaaaatactacatattgcttattttaatagatacattaaattattaaataactacatatcaatgtattaatatttatgtatgaattttataataaaacattaaaacatatacagagcaattacaattctaatgcaaatctatttatcttaaatgcacaaggtaataaacatagaacaatgtaacacctggagtccattaactgtaaaagtttaaacgatattatggtttagagaaaccataatatcttagtaacaacagataaggcaaaaatatcttaaataggacataaaaaactttgatcatagaaggaaaatgaaaaaaccctaataaacagaaataaatcaaaattaagaacttctgttcatcaaaatatatcatccagagagtaatgagaaaatccaccaaagagttgaatataaagtgcaaatattcagtggtgctctggtaaatatttcacaactagctctccagaaggaaaaataaagccattatttttggtgtttctcaaactatgttgtgaaaatacttctatcatgactgattttcaaacccataattgacacttccataattggctatggttagttttgagaaagtatttaagaatgtaagaatgttagtcgaagaatatatttgaatcaggattattacttcatgaggaaaaacacatgcaattcaaaaaccatacataaaaggacaatgtaatctgtggcaagtacacatttgcagaattgattctgaattttaagaaagaaataatgctgatttattaattggtagttttaaatcctctattggatatatacaatggcatatatatatgtatatatatatatatatatgtgtatatatatgtatatgtgtatatatatatcatacatatatgtatatatatgtatttatgtataaacataacccgatatgtatattatgtatgtataaacatatgtatgtataaacataacctaataataaaggacaaataatctagtaagaaaaaaaaggcaaaagttttaggacatttcaacgaatagtgtaaccacatgagaaataagagcaaaaacaaatgtttgatagcattaatattcaatatattccaattataatacccctattcacatacccaaactgctgaagttaggatgaaaaaccccggtgtcagtgactatagggagcaactgaactcttatatcctgctcctaaaactgataaacacttggtgaattgtcaatatgtactgaagcagaacatgagcatatcctatgtacacaacaaaatacatacatgtgttctccaaaaacacatgttcctgatatccaaatcaacactattgataaagccaaagtctggaagctacttaagttactatcaatattagaaagggttaataatttggtctattcacagagttgaatactacacagcaatgaaaatgagcaatttaccactgcacacaattttacaaacataatgttgagcaaaagaaacaaagcaatacctactgtatgatttcatttatagaatacagaaaaaggagcctcctttttctatattctagaagcaaagatacttcttatgttctgtatacttctagaactgaagatattgcttatgctctataggtttagtgactagaaagagtataacaggactcaaagtactctaatgttctttttttaaaaaaaaaaaacttatgtcagtattggttatatgggtgtaattcattttgtaacaattcactaaaactgcgcacttaagatataagtaattttctctatgtatataagataattaaaacactggagataatagtaatttttagaatacttttgtttcttattataaattgaaataatttatttaaaaagttcattcaggtatatttgtgaaatataatttaaaacttaaaaataagtacttggggataaaattattactcaaagtgtatctaaataatttctccaaatttctcccattatcagcaaagtcctcctggtagagcagaggaatttcactttcctcctatatgacacttgttttaaacaatcctatgttatgttgagtgtttctttaaaaagtaatgaaaaagtataccttatagttcttagagatggctgttatctacgatcattttaaaacatctttttcaagatacattgcaataatgctatatgcccaaataggagttttaatcaactgcctttgtgcttccaaggatgtcatttcccccaagtatagaatgtatgatacaaatgcccacattatctggattttatatatttattataaagtaaatctttattatgtttactaataagcaacagataaactctgaaagttggcttagtgaaaattaatttcatcagtttcaaaacacaaataaactcatatttatgtatattctgtagtcaattattaatataatccagattcacatttttgacaaaccttattgaatacatataaccacagaagttaatgaataattaaagccttaaaaattgccttagaagtcacttgttatttattaccatcttatttccatagttacatactttactctcaacttcctggagctctaacatcatgcttcatggggagacccaattttgatacatcttgacaggtgataaaataagttttactttcaataactcattgccatcaaatagacttcattatgaaaaatttaatggataaaattgttattcatgttcaaagaacagttttcagtggtatcaatctttacctttgcgggacatgccttaaaatttacatagaaatctatcaaagactatatcaaataactgtattactataatctatccaagaacataaacattttgatagaaaatatcacataatttcttcaacatttatggttaaatatcaaatgacttatttgaatttcctttacttaaaaaaaactggacatgatcaaaaagcggtaatgaaaataactctaaaattaggtaaattaattataatcttaccgtaagctcacaggttaggaattcgaagaaaaagttcaccaccctgagacctagaaaagtataacacaaaacattctttattagtactagtgttcaatttaaattaaagaaccttaagaggttagtaattcaatatgagaaatgttattatatgagtaattagtgtacatatcacttgacaaacatttttgactacagtatttgtctgaaatagcattaccagttactcatcttacatcaaagtattgtgatttgggctctttaatgcagtgatgacaaacaagcaggcaattattgtccacttgcttcttgtaagactatagctgatggataacatttgcaagcttaatgtattttgctagataaccttctctgttacattaatttaacaatgtcagatataacatacatcccgatatatacatgtgcaaacatgtacacacacagctgtggctatcataccataatcgtactttttatcttagctttatccattttaatcactaataaataactatccgtgatatattctataaagtatgtaataattttaaaggctgtacagtactccatcgttcactgtacatcctaaattatttaagatatttgatttaataattatgctagttattattattgtctttaaattgtctttaaaatacgccagttagttaccattgtgtgtgactttatataatagttactgaggccaggtgcggtggctcatgcctgtaatcccagcactttgggaggccgaggtgggtagatcacaaggtcaggagttcaagacaagcctggccaatatggtgaaaccctgtctctactaaaaaatagaaatattagccacctgtggtggtgcatgcctgtagtcccagctactcaggaggctgaggcaggagaatcactggaacccgggaggtggaggttgcagtgagccaagatcatgccactgcactccagcctgggtgacagagcaagactgtctcaaaaaaaaaaaaaaaaaaaaaaaaaaaaagaaagaaagaaaaagaaaaaaagaaaaagaaagaaaaagaaaaaaaaaaatagttactgagccctttgtaaaagttttctcattttggtgcagtggtaactttatcaacacacattactcgccatcaagtttgtttaatgcttgatagatactattttatatgaacaagaaaagaaaactaaatatttaacctctgccctcaaagaagaaattagtagtacttgcaaactctttagaaaattcataaatgactggtaggtctacaagtaggtgctctactgtgtaacctctagctaattgctatataatttaaaatagaaaagttataatagattgagtcttttatgtcaattctttaattgttggtactgttttgggagactgtgtttttctcagtttatgcattaaactgtttcaactagtttctaccataattgaagaaaatagtttatataacttcatttatttcatgaaggaataatacttcattcttaggaaggatgatcatatgtgaaagtgaatctgacagtaaaatgaaccacttgagaggtgatataaaatgtttctctttttgatgaaatgttagaggaaaacaaaatatcactatcacggaggtgtaaaggagtacattacaattcttccagtagacctcccgggctcatttgtacagtatcactttctgctttcattaaccctccaggagcaaggatagagatgatttcaggagatctattccttattgacatttgtgaaaggagaatcctctcaaaaaaatctagtgtgatttgagatgctcgtactttaaaaagtcaatcaatgaattagagtgaccttctttcttgccctccctttttatctagaggtgcagcaaattaaattttggttaaatgttaaaaggttgagtattagaattaacatttggctgaagctaaatattaccattgtagaataaacttcttggatacacaaattagaagttttaattgttattactattttattactaaaagtttaaagtcaagctttaaggttttaacattatagcgcagaaacaataatttattttagcacgatcagatgctagattactcctgcaggcactgtgttgcatatttgcaatatcaaattgacacttttaaaagaatgatggaatttcaacataaaaatcacataaagagatttatgtccttttgttctatctagaatgtttatctatatttgaaactgaatattttgatattaacaataaatccaaaagacatccttgtttgtattactgacgttgttacactgatcagatatgttgggtatgtagattgtaagtcatggctcatacttaagttcagggattccagaaatgatattcaaagtatttgactagttggtcttccaaggacaaatccaaatcagataggtaattttaggcatacaagaaggtcaaagcagaaatacagtttattccaactttaatttaccattttcaatgatttgtggagcttgactcaggcaaatatacatttaaaaaggaaagcattggctgggcatggtggctaatgtctgtaacctcagcactttgggaggctgaggcaagcagattgcttgagcctaagagtttgagaccagcctcggcaacatggagaaatcccatctctacaaaaaaatacaaaaattagccaggggtggtggtgtgtgcttgtactcccagccacttgggggcttagaaagaaggatcgcttgaaccctggaaattgaggctgcagtgagccgagattgtgccactgcatccagcctgggggacaaagtaagaccttgtctcaaaaaataaataaataaaaataaataaaaaggagtttattttaacacgatgtgcataaataactattttcagaggagagatttatgatgaatgaccagttattaaactgtcagagactttgacactaggttagagttttatccttgataaattttaagaaattttatttcacataaaattctagccaaataaattggatcagtccgggcacggtggctcacgcctgtaatcccagcactttggaaggctgaggcgggtggatcacctgaggttgggagttcaagaccagcctgtccaacatggtgaaaccccttctcttctaaacatacaaaaattagctgggtatggtagtgcacacctgtagtcccaggtacttgggagactgaggccagagaatagcttgaacccaggaggcagaggttgcagtgagccgagattgtactactgcactccagccttggtgacagagtaagactctgtctcaaaaaaaaaaaaaaaaaaaaaaaaaagaggatcagatatacttctctcatttgtactacttatttgaggaacaaccattcagaaagcactgatgttaagccaagcaggcaaaccacaaaagaaattattgataattttataattctggtatcctaaacttaccatgctgaataagacattcttcagagttgtgtttgaatgattttcaaattactacagaaatcttgaaaagttatacattcaagtttaattttttagtattattttagtatttctgtagataaatgcctttaatgaatggatttattggatctatgatgtagtgtttggagaaattcatgaaattggcatcttagatggtgatttcttcctcattaaaaagaattagagtgcattacttcctcttgacttaattttgcaaggagtccaaaaatttgggggagggagaggaaattgaataaaaattatttggaaacctaaaaattggaaaatcattttcaataataattttaaataattataaatacttcaaaatgattgggaataattttaaagacagtttgttgggtttaggaaaataatatttaatcagcaataaatagtactgtaataggatttctacattgtatctcatgtatcctcagttgatgctcagaaaagtttcatatattagagattattttccacattttcacagaagagactgaaagccaacaattgcctgaataaactacaaaaaaatcttactatcaatatgttgtaaagttaaaattgaacctgaagttaactaaattcagaatcccagttaagtcacataccaggataggataatattagtagacaccatttaccaaacatataatgtatgtaagatcctggtctcagtatttttatgtattaattcatttaattctgataattatatttttactttatagataaaactgagctataagtatattgttctttatcatacacatttttaatccaaggagtcttgcttcagagcctatgctcttagtcattacatctctatatgatagttaatcattgtacggcattcttacaagtgctatttcaatgcacatatattcatttattcttttcagttttaggagtcaagtaattatatatttattatgagtctaatatcatcttagtgggctggtcctcattaataactacagttaacatttactgaacacatactaagtgccaagaagtgtgtcaaagtctttaagttcatctcatttaatctccatagcaatcctatcaggtattatgagcatctatgttgtataagtaagaacactgactagagaggtaaacaaatatatccaaggacagagagctagtaagtaatatagttgagtttttaaaataattattttaatttttaagatctggggtacacatacaggatgtgtaggcttgttacataggtaaacgtgtgccatggtggtttactgcacctatcaaatcatcacctaggtattaagcccagcatgcatgatcttttttccctaatcctcccctgccacctccacacctcctctaacaggccctagtaagtgttgttcccctccctgtatgttcagctacagttgagttttaagcacaaactctcctacccttcagttagatgtagcttagagatacagattgtttgtgtaaatttgaggggtataagtataatttggttatatgcatatatcacatagtggtgaagtcagggcttttagtatgtcctttaccagaataatatccattgtacccattaagtaatttgtcatcattcatctccctcccactcccttaccctctgagtttccattgtcaatcaacccaagctctaagtccatatgaacatattatttagctcccacttataagagagaatatgcagtatttttccttctgtgtctgggttgtttcacttaagatgatgacctccagttccatccatattgctgcaaagacatgtttcatcttttttatggccgaatagtgttccatactattgtgtgtgtatgtctgcgtgtattacattttctttattcaatcatttgttgatagacaggttatttcataactttgctattgtgaatagaactgcaataaacatatgagtacaggtatctttttggtacaatgatttcttttccttcgggtatatatcaagtagtgggattgctggatcaaagggtggttctattcttagttctttgagaaatctccatactgttttccatagaggttgtactaatttacattcccaccaacagtgtataagtcttcccttttctttgtgttcttgccaacacttttttgtctttttgttaatagccattctgattgatgtaagatgatatgacattgtaattttaactttaatcattttctgatgattagtaatgatgagcatttttgatgcgcttgttggccatttgtatgttttcttttgaatggtgtctattcatgtccttagcttactttattttctttttttttttttttttttgagacagagtcttgctctgtcacccagacagaagtgcagtggtgtgatctctgctcactgcaacctctgcctccatgattcaagcaattctcctgcctcagcctcctgaatagctgggattacaggagcctaccaccatgcctgcctaatttttgtatttttagtagagatgggctttcagcacgttggccagggtggtctcaaactcctgacctcttgtgatccacccacctcagcctcccaaagtgctgggattacaggcatgagccaccgtgcccagcccttagcctactttttaatgggatttgttttgttgttgttgttaagttgtttgagttcattgtaaattctggataaacagtccctgtcagttgtgttgttgtcaaatattatcttccattctgtgggttgtgtgttccctgtgttgatcagattcttttaaaggggaggacatgtgaaagaaatagggggcttgcattttagtcaatttagaaagaaacccaaaattgtatcttcataaagcagatacataactatattctcagttttttatagatctgtaagaatagtaaatagattagaaagcttctagtcttacaactctaataaattataattaattttagatagtgacagccccacagtacctagctcattaaatgctaaattgaacttatgcattatttatcagacatgtcaaattctagagttttctgccaataaattttagaatacataatattgttacaaaatatgtaaattgtaggtaatataagaatgattttggcataggttatcagaaacactttcttgcaaaaccagataaccttctatccatttagaaaaatgcaaataaatgctttaaaaaataacaactttgaactcttatctttcaagactgtgaagcttatcatctcagaaacacaattcctattataattgtaggcaacatatttgggaaaaaatgtagactgtttcagtaaaaccttgcacattataaactctcgataaataatcaatgaccatctaagtgatgcaataaagaaataataactggatagacccttgggaaaaaaaataccccgtgtttaggtgttagagtttaccttatcaaaatcttctcaacgtcttaatcaatgcctaacttatttcttacaaaaaagatcttaaatcttgggaaagttggaatgactggcaagtggtgagactagcaaactatcctatgaataatgtatgtaaatctattgaatacaatggtatataatgcttgttaagtaatttatacatttattccacaaatatttactaaacaattatttaccagccactactatactataatgtgaggttaaagtcacaaataagacaaaaaccataatagatttgatattctggttactaatgtttaataactgtatattttattgccacttcaaaagctactagacattgtacaattgcattctataatctcttccgggatttttcttttggtattccaaaatctagcttgagaagttttatataagtttgagtgggtttaacactatggcagaaacttctagttatccctcaacatccatcttactttacttattttttgctaggttcatgaccacttggaataagacaaccatccttagtctcaatgccataagattaagttctggcaaaaggacacatgtagacgttgggtaagcaaagtctaaacagtgtcagtgaatgttaagaggcatgttcctctttgtccctccgtccctaagtaaaatttctggttagaatgcagaattaatgcctggagctccagcagtcatatatcataagaggccaccccaacctctttgtttatcagactcccaagtagagcaattaaaataggaggaatccagatcaaatgacagtgtggcatgttatctcagacttggatgaattatttcttgaatctgagagataaataaattatatggaaaaagaaagcagattaaagtttatcagagaataaaacgtgggaggaatggggaataactgctaatgggtaaagaattacttttgcgatgatgaaattatatctcaataaagctgttatttttaaaagttccttacattactctattagtttatctcttaaataatttaaatgcattttatattttacaaagatatttgtgtggtatattcttctggaggctcaaatttgtctgaatttctgaacctgctataatgtattaacgtgttagtatatattaggatgaataaaataagaaaaaactataatctttgtcttccattgtctaaaacctactggaaagaagataaagtctattcatgaattaacaccaagaaaaaccattaacctcccagagcatttgttggaatttcattatacaattgaaagtcatttgaaagtttacttgttaccacataacaaaatatgtgattaaaaatatctacagaaaatgttgccaataaatagtataggctggaatttgtattttagcctgttggttgtagtgcctttgatatcttcctcactgaatgaatatctgttcctaaattattctcacaaaatccaaaatgtcaaaatctctaaataaactttcatactccttcaaaaagtatacaatgaaagtgattacaaatattttgggtatcaatgatatataaaataacatcaaacaactcatttagcaagtgggaatttatgtctcttaactgaaaatttatacatccttatgtttaatattttgactcttaggcattactactcagaaaaatgccgctctaaattattcaaaacactaaaatcttattaaaatgtttgatgctgtattgaaaagattgacaacaataacctcaatctataaatgggtgcattccaaaaacgtcctctgaaccctttttcatgaatgacattgtcataattttccttagttgacaatgagccaaactaattggtaaaacctaaagaaataataatgctcatcataaagttgccttgttatagataactacgcatttaagaagaaattaaaattataaattgtaactcccagcataatatactgatcctttcatttctggagatagtaatattgaaaaatctgtaagtccatgtgaaagttcacaagattggtatagcctttatgtaaattcatggtaactatggcaacattcattttcattttacttcagctgctgcactaaagctcagataagcttggagactcagtcttatagttgccattatgactagcgggtccttatcactccctattctgaaaatatacagcagcatttgggtgccacttgtccctttctatcttactcgccatggttggctactttaatcaagccgtgaaactatcctgtattctcttcttccttcatccttaccatacttttttgccaattggcaattcagaggcagaagctaagtatacagtggtaactctcaaactcaaatgcacataaaaatcacctggatttttgttgaaatacagattctgatagttctgccttgttagaaatacagaatctcagaccccatcccaaaaacatgcatcagaagcttcattttagtaatactagcaagctatgtaaagcttcctaagccacggtttgtttatctcagaaatagtttatatatatgaagtgccctgcaacctctgtctccccttaatctcccctcactcaaatctacccaatctcatttagatgatgcttcataaaccctaccaaccttttaatttttggaaaagaaagctactacattaaaacattttatttcatcaccattattattattattattatttgctatgctaccacaaaagacctctatgttgctcatgtttcaccatcactattctttctctacagttacctaaccattatattcctaatgctgtagccactaaagtaaaatatctccaactccctcccattttgtacctgcttctctctcctgctatgacatgacttgttcacatattaagtgtatgaacgttatccatgagaacaacttcaacttcgttattctacactttaaaaatccatgtgcatcttcatccattcctcttctattactttatttccaagaaaggatctctctcctcctcgcagttttgctttcatccccccttttcagtcctgaattaccatgcaccctttatgctttttctaatgacaacaaatttctcattctcccctttatctttattttcaacctgtaatgtcaaggcttatctctctggagaactttgcccttgaccatcctgagtcttcaagctttattttcttcttgtgtggatgctttacacgtcttatgatttgcaacattttttttcacccaaaaaattctaatgatgccctttattgcacaaccacaaggatgccaagacatcaaataccatgttccttttaaagtcatcatcaccctggaaaatttacagcacacagaagttaaccacttcttctttcataaaattctctttttccaggaattacaagctgccttctagttttggattattatcatttttgtttcattatgtttttatgttctcatgattacatcttattgtttttgcctttattttctcttcttcccagtactttgaatgtaaaacttcccagttttacagcatgtttatctcagtagcagacataatgcctaggggcaaagctgtgctcagggatgtttgagtgaatgcaacaatcaaggtatgaatatattttcggatcctgtcctttttctacttattcctatgtgaacttgtacttagacacttggttgaaatcttcatctttacaagtttcatcttcaattcacatcttaactttccaaattagtatttctagacctgaatgtatttctggcctaggtgctactttccaaacttcttggtagatatttctaactatatattgcacaattactttgaattgaaaatgtccaaacaaaatttatcctcttcctgctaaaacccactttgctccttggatttttctttctattagtgacacttctaacttgtcattcacacaaacctaaaaggctagtcattactgattcttccctttcttttcagcccttcatccaatcatttttcaagcccaacaattctacctctgttgtcttcatgaaaatgaagaaagaccatccagatgtgaatacgtaggtactatttatttgcagttggctatagcaagggattcagccatgcatcatttgcatttgccagagactcaaaggtaggtaggggagcaggaaaatctaacaatgaataaaaagggaaggcttgaggtgtgttctgattggagataaattaacatggagaaactggaagcaggctaaccagaagtagagcaacctatgtgtttgctttgggagatatatttggcttcctctggttagttccgagttggaagcagtggataaaaattaaggaagttggtagtcagtgacctgaaaatgtccccaacatcctggccattctgaaccaattgcagaggttgtggtttggtttcctgggctagttgcggtggaggtggtaggtcagagttttgtcacatatgttctggctgttaaccatttgtatattcagtctctcatctctcatatttctttttccccttccaattacagggccatccctcaacacagccagtagttttgctgtagacctcattatttggttcttgagatcagattgtctcatccttctacaaccaaagaagagtataatgtttgacagtatattggtttaatgaatacttactaatacaaacaaatctagtataattggcataatggaaatgattatgtagtcataagtacgcagtaagattataattcttgagttgagttttatgtaccaggcattttttagtaataaaaatattctcattgaacattattgcttcttctgtcagttgttcaatatgaaacctatacaaactatattcaggttaatttagttaatctcaaggcacaacattatttcctacaattctatgaggtgaaacatctttagttgaataaattaaataccatttttaaaatagaaaaacccataaatactcacttttcgctaccatttatgctaaataggttggacattgataaatggaaagagatatagtcagagaacatctaaatttttagtcctgtgtacagacctaggccactctgaggtatgactgttaaaaacagaggggaaaaaagagatatatcactttgacatgatttctacaatctctgattttattagtatatcacatttattccattttatcagtgtttgaagaagtaattggtaatgatcttattcttcttcatcaattagcaagcatttattgaacatctatgttcctaagtgtcatttcagatactggagagcataagtcatcactctctcctgtgatgttgaattaaggaagccagtctatcatagcaatgttgaaaaatatgagaggaggaaatgtatgtgtatataggtaacaaaatgtgttatgtgaatataattgttgtaaagaggggagacaaaaaaattattttagaggaaaataaagctggaatcaacttcaggcttctactattttagttgtattacatccagcaagttacttaacttaaggaggcctaaataataattataattgttaatactaatatataagagataatagtaatgatataagcaaacacatgtgcacattacatgtgttttagggtttttaatacactaatctatgaaatcctcctaacaactctaagtggtaggcgcttctattatatttattttatagacaaattaacttaggcacagaacaatgaaactacttgcccatgggcatagatctagataggagaggggcttgctaatgacacagatttatatgctgttagaactattaataggtaatttaattgaagtgcccactatggtaactgattcccaatggcagcccaaaaaagaccagtttgcttccttctaagtatgagatactacagtgcttctcaaacttcagagtacatcataaaggctgggggtctcactaattccctcactggggaatgggatccaaaattagcatttctaaaccaagttcccaggtgatgttgatgctgctgttctggggatctggatggagctggaggtcattaagttgaaataatctagtcacagaaagacaaatactgcatgttcttactcatatgtgggagctaaacaaattgatctcatagagaatagaatggtaaatagtagggactgggatgggttggtggttggaattggaggataaagagaggttgattaataggtataaacacatagttagaagaaataagttttaatgttggttagccgactaaagtgactatatctagcaacagtattttgtatacttcaaagtaatagaaaagaggacttgaaattataccaacacatagaaataatacacaagatcatggatatctcaaatatcctgacttgatcataacacattccaaacatgtaacaaacattcatctgtacccctaaatatataaactatcatgtattaataacagaaaaaaatagacccagtgaagctatgggacctgcaaggattttaaccataggcagcgataaggactaaccttagtccttatcgctcagcagaattggaagacagaagggagaaaaaataaagcgtcttcataaatgacctgctgatttcagttcattcagttcctttattcatggcaatgtttgcttctactgagttacattttctattttgacagtatgcacatttagattggtcattcaaactgctcagaggaaaaattgaagacatgtctctgggagaacagccaatcaacttaggcaagggggtaatgaaagtcatagccacttcatgtgccaatccaaattttatactttgggaggggattttctataatatggtagtttttgattactcagactttgatgatcaagtttatcttattagtgaaagatagaaaacccaggaatatatttcttaaagttgcacagaaataattaggaataactctgaaactaatattttttaatatccatgtttatgaaggttggcaattatattacttccactaccagtccttgaattgttaattagagaaaaaagtgaaaagacaaatgaaatgttacgggaactgcatcaatatgttttctaaatattttactcatcaatgtcatcattttagctgagtataatgaggaattattaagagccagagcttttctatgcattttgaaagcattttatgagttattcttatagttgggttcaaactctttgtatctccatttggagaaactgtgacttagaacattttaatattagaacttgtaatattatattcaaatacagcatttttagttttgtggcaaaatttttgttcaattttaatttttatgtatttatttacaagcaagttgaccacttccgtatgcttattaataatttgaagcaattcatgccatttcaactttcttagttctaggcaactaactggagaaatatttgtttctaaatgtatgaaattgtgaaaactgtgtattagtgaaaaccaatacaacagtagtttatttggtgtgtatttttaaatatttgatagtaaaacatagcacatagtagcatacagcagacaaaatcagtaaaatcctcttaaggattttatacatttcctacatagaaaatttagatgttcttggttgcagctattttttttttcatttatttaataaaatgtctttcccttttaaaaggttcttgttaactcttgtggcatgttctctctttctcttacatatttctttaaaatatagaacaagtaatactgatttgtagcaattaagacaggttgctggtgtttctgattcctcagtaagaccatggaaaataggatttttcttaggaagttaatcagcaatctatggcaacaatcagtacactgtgttccagtgatatttcaaaatgtttaacagcattagataacttttgcagtaattacaattaatattcacaaatatagcaataggatttatgtgttactggatttttaaaaatctaaaatgccatggattataagacaacccattatttcatagagctttacaaaagaaaaaaaagttaaattattccattgggtatgcatcctaatttcagagatgttgaaatttgaacaacaacatgtggtaaacacacatagtagtgattgttgtcattagtagatgtttggagtagtgtttatgagcaagggaaataagcacacgtacacggggcttgtgggagaagatgctgggtcattatttctacaggtcatctcggcaatatctatccaaagcgctcaaactattcatacattgtgattctcattatgattcctcttattcaaaagagtaagcaactcttactcttttgtataagaatgtaacttcttttacttaaaagaaagagtacaaacatttataataaaacatataatgtcaataaaaatacaagccagttggctaaacacattatgcccatcacttactgtatggtgactgtttctattttttaaacacatttacatattaggatcatacagcaaatactgttctatgatctatttttttttccacagggcaatatatcacaagaatttttttctgtattatgacagaatgtgagctcctcacaggcagcaatctttgctccctttactaatatatccaaagtgcttaaaagagagcttaacacatagtgggtacttaataaatgtttataaaactctgtacctatgacagtgttcaaccttgaaaatgaaggttagaaacactgcttacactatgatccccaattttaagtgtttttgtatgaacattataaaaagactacttcttcttattatctgtattcttatttctaatgtattttatgtcttattttctataatgaacatcaattccttaacaattcagaaatattaaacatgtaatttttaaaatagaaatggcttcatatatttattttttattttataagacattcaagataacacttgtctttttcataataaaatgataatcatttacataaaaagagcatgagcttgaaccattcttacccaaaatctgaatcttaggcatattacattctcaaataaatctagaaatgaaaagtttctcccttgcctccatttgaaatactgtttatctttgtttgcttaatgaaagtcccttagaggttaatgatattaactctttctcacgtatgtggcacatggattttcacagaaagtcatttgctttgggtattatcgtgttttggaggaacagaagatgcaaagctttatgtaatgaaacacaaaatgggctccattttggtatcttaattagaatgccttctgtggtaagcagcacgaccccctaaaggtgtccgtgccttaatccctggaacctgtgttaccttccattgcaaaagggactttgcagaagcaatgaagactatggaccttaaaataggaggattgtctgggtaggcccattctaatcacacgaatccttaaaacgaagagaattctctggctgtggttagatggatgtggcggaagtcagagagattgaaagcgtgagagggaggaacctgccattcctgcggtgggaggacatatggaaggcatgaaagggaatgcaggcagcctcggggaccaaagaccataccagatgacagccagcaaggaaatgaagaaaatggatctgtgtcctacctccaaaaggaagtgattaaggccagcaaactgtgtgagcttagaagcggattcattcttacagcctccagggaggaacacaacactgccaacatcttgatgttggccttgtgagaatttaagcagaggacccagttgagctgcactgcatctggaatcctaacctacagaactatgacatagtaaacgagtgttgtttcaaagcactaggtctgtcacaaagtataatggcggcaacttaagaaaacacaaataagccttcaataaattcagtgaatacatatttagctatgtatttttctggcacttcttaatatgtgttctttcagttttaattgacacataagtgtgtatatttgtgtggtacagtgggatgtttccatatgagttacattatgtaatgatcaaatcagggtcattagcatattcatcacctcaaatacttatcatttctttgtggtgagggcattccaaattttattttatagccattttgaaatatacaatacattgtcaactataggcactctactgtgtagtggaacaccagaacttattcctgctatctaattgtaattttgtacccaatcaccggtctctctccattctccccacacagcctctggcaacctccattctactctctacttctaggagatcaacttgttttgattttttatgtctgataactttaaatatttgaagtttagtttttttcttaaggcttttttcaatatggacttaaaaatatttgttctcaaaattatttagccattgtcataacacttgctatgaaataactggagaatcattttcttcactaatttaaaatacaccaataaagcatataaaatcttaggtaaatttatggccttttgcctaaattatatcttgttccatttccatgctgtagatgagtttgtgtgaatgaggcctagataaaatctattgcgaaacaaattcaaacaaaacaaaaataatgcaaaacaaaatcaaacaaaacaaaatatagaacacactgtcgttgtgtttcttcctccatgtatgcttatatgttcatatacaatatgaaaaataattgaagagcaaactcccagtctgtccagtgtgggtggaggttgacattgaggaaaacattatttaacagtaggagaaggtaataaaaacaggaaattatttaatttgggagaggatttgagcatcgagcaaatcaatctgaaatttctcctctagccaactctgttaagttgatactcctttcgtcattccctactcctacaaggaagtgccaatttcctggtatctacagtggattttttccccatagcctacaagcaaacagatgaacaattcatgtaggtgaagattgctaaaaccaatgtaatatcaatagcaacaggattatatggctgtagggcatggtggctcacacctgtaatcccagcactttgggaggttgaggtgggtggataacctgaggtcaggagttcgagatcagtctggccgacatggtgaaaccttgtctctactaaaaatacaaaaattagccagatgtggtggtacacacctgtagtcccagctacctgggaggctgagacatgagaatcacttgaacctgggaggtggaggctgcagtgagccaagattgtgccactgcattccagcctgggtgagagagcaagactctgtcaaaaagagaaagagaaagagagaaagaaaaaaagaaagagagagaggaagaaagacagagagagagaaaggaaggaaggaaaggaaaggaaaggaaagggaaagaaaagaaaagaaaaaagaaaaatgaatttattgagtttttaccagttttgttttttttttgtttttgtttttcccccccctcaaagaaaagggggatttcttgtactgtggataggtaggattgtccacactattttttatggaaacttaactttttttttttttgcttgcttttctttattgcagaaggagtaagaaatacaaatatttgtatgtacatgtgtatgtatatgctatatttatatctccaaggcttgagtattgagcaatttaaatgttttaaagaaaagtaaacatggttttgttgttgttgctcggattttatagcctatagaagacatatttgagagaatatggattttgaggcatgagaaaactcctgataaaaaatgttaatatggagggagtcaccccagattactaaaaagttggagaacaaatgtcaagtgaaggaatgtggaggcagccccacagagcaccatgagagcttagtgaatttgcccaagaaaaaagagaaccctctgtcctaaaagttagaactaggggagaaccaaagtaaaggtcactgaggaacacaatgaaggtcactgaggaaatgcagtcatttttcacctgattattagccacaattggagtaagaatttccattcacttgtaatctgaagaaatcatcccttcttcaacacagcaccccaccaactaattgtgcagaaggagtgacacccctcatgacttacttcagtaacttttgttagccaaagaagatactctaatttcagaagatctcagatatctgtaacctgagaaaaggggattggagccctggctatctattggtatgacaatataggatagtacagtggtacttgtatgtggacaatggacgatagttaatgaggcagtgattaaaattctatagtattcctgttgcattgaaaatatcagttcagtatgaatcattttagaatatgaaagaagatcacttactaatctagaagttatttaaaaaataagcattataagataactgagctacacatttcccaggacacacatgtgagagagtatatctttcctaagatacacatgccaattctatagatgggctatataatggagttaatttaaaatattcctattactatttatctttgttcttatggcatttgcttttgggttcttggtcatgaaatccttgcctaagccaacgcttagaagggtttttccaatgttagcttgtagaatttttatagttttaggtcttagatttaagtccttgatgaatcttgagttgatttttgcataaggtgagagatgaggatccagtttcattctcctacatgtggcttgccaattatcccagcaccatttgttgaatagggtgtcctttcccaatttatgtttttgtttgctttgtcaaagatcagttggctgtaagtatttgggtttatttctgggttctgtattctgtcccattggtctgtgtgcctattttaacagtaccatgctgttttggtgactatggccttatagtatagtttgaaatcaggtaatgtgatgcctctagatttattctttttgcttagtctagctttggctatgtcggctttttgcacagcaaaaggaatagtcagcagagtaaacagacaacccacagagtgggagaaaatcttcacaatctgtacatctgacaaaggactaaaatacagaatctacaaagaactcaaacaaatcagcaagaaaaaacaaacaaacaatcccttcaaaaagtgggctaaggacatgaatagacaattctcaaaagaagatctacaaatggtcaacaaacatatggaaaaatgctcaacatcactaatgattaggggaatgcaaatcaaaaccacaatgcaatactaccttactccagcaagaatggtcatcattaacaattcaaaaaataatagatgttggcgtagatgcggtgaacagggaacgcttctacgctgctgatgggaatgtaaaccagtgcaaccgctatggaaaacagtgtggagattccttaaataactaaaagtagaactaccatttgatccagcaatcccactactggggtatctacccagagggaaataagtctttatatgaaaaggattatatatatattatatatatatatatatatatattatatatattttatatatataatatatattgtatattcatcatatatatgatggataaactgtgatatatatattccaccatatacatatatacatatatatacaaatgtacacatatacacacgtgtacacatgcatacacatgtacgcatatgtacacatgcatacacatgtatgcatatgtacacatgtacacatatgcatacatatatacacacgtatgcatatgtatgtgtgtttgtgtgtgtgtgtgtgtgtgtgtgtgtatatacatatatatatgatggaatacaattcagccattaaaaggaatgaattaatggcctttgccgcaacctcaatgagattgcaggctactattctaagtgaagtaacacaggaatggaaaaccaaacatcgcatgttctcactcataagtggaagctaagctatgatgatgcaaagacataagaatgatacaatggactttgaggactcagggggaaagggtgggaagggggagaaggataaaagactacaagctgggtgtagtgtatactgctcaatgataggtacaccaaaatttcacaaatcaactgctaaagaacttgctcatgtaatcaaacaccacttcttcccgaataacctatggaaataaaaaaaaaataaaaaataaattaaatattcctattagtatccatcacaagggattttgctctttgaagtttgtgtgatctcatggttacatatgtccttatgcaagagtttgtgtttaatcaaaatatattcacttagatataaccatagtacccatatgtgtgcaaaggaatacccatggatacactatttatcattatgcttaagttaaacaaataatttatacattgtatttagtcccatgtgtcaaaatgccaaacttaaataggttatattaaagacatctttaatgaatattttgtgatatatatcagataaaatagcatatcaatagaatattcctgaagaatagtaattctttatgtgtattaaacatgttacacatatattatatagaaatacctttacatattcggtaaaatatccagaggtaccctttacatttccttaagagtcttatagggacgatattatactgaattattttctactgttcactttgtagaaaatcttgcctttttatttacaaaggttgttattgctaatacacagaaatatttttaatccatcactatcatctgatatatcatttgtgattttagcaatgtttttctaagactagcaaaatctacaagaaatgatttattgctagtctcctttcaaatgatacagtgacaaataaaaagctgaattcatatagtctagggtatggttcagtattaaagacttgattgtgtaaatcagtccatatccttctggttggtatctaaagtacctaataggcttgtgtatatgaaggaggcaatgaattgaaataatgttagcttaagttaattctaaacatttgcaaatatagaaatataaaacacaatctgccctcaacttaaaataacttttagaattacaaattaaaatatatgatatcattcacagatcacacaaatcagtatacaaaatttattgttggtgaaactgaaatctattgtttagaaaggattattctgccccaaagaaactgaagggatcagagaaagagaatgcctccagactgacaagtaagtaattggcatgagtggagatgaatagacttatgccaaaaaagctgcaggtaagaagttcccagtagtcattgaaaaacgaatgaaagtaatcagtgagacagaataggccttaaacatcttcctgctctccaacactgtggaagcaggctgagggtggggggaataaaaatcatccttaaaacagaaagtggataaagagaaaaggccaacagatataacctcccccaccgcaggatatcatcccatcaaagtgggaaagggaaaaagacatacatttaaacaaagttaacaatgttcatagctatattgatgttggcacaaaattacactgaatggaagacaacttatacttttaaatgactagcaagtcatgggaactggcttaaattccatcgaggaataaaggaccggttccacagataagtcattaagctaaaggaaaaataaaaacataatgaagttacttttagaaaatatcccttgaaaactgattgttcaacatgattattataaagaatgtctgttataggaatattcaagaggaaaagtaccgtagaactgcaaaaacgaaagcaggagagaattttacaaagctgggggaagtcaacagtatcacatatagtagagaaagaagtcaagaaatgggacattaaaaaggtcactgatttgtggaaaaaagatatgtaattgatggagaaaaagtggagaaaatagtttcagctcagtagtgcgaagagacaggtgaacaagaaataaaggtaacagatacatgtatatattggaatatacatattcatttgagaaatttggcagcaaagtagaaaaataataagatgttaaataaaatggagtatgcgaaatcctaaataagcagtgttgataaaagaataaaatctttccctaattttctgtgatatccaaactaatgtttttgtttattatattttttcatcatcactacattaagattaaatgcaaaaaccatgtatcctgattaaagacctttttcctgcaaactgtcctgccacttgtacaggacttaagttgctgtctggcttgggcaaactgcacacagttagtacatttgtactactactatccccaacactccttcaaaaccaagagactcacgactagaggcctcaattccaccatggcacagaggtacaagaataagagtaaaggggttgccaatgagaaaatagccctccttcctcaaggtggacacagtcccacatcagggctgagttatgcctttcttcacccccttggacaagatgccttaactactgtatatggtagaagaaacaaaatagaaaatggggatgtcgagtaggagagggcagagagaagaaaaaggagaggaaatcctgcctttactattctctctatcctgagctcattattcttggaaaccattgccctacttcagaatcccaactccactttgttaaaaaaacagttacttttaataaaataatttaaaaataataaaaaatgttcatggtagaaaattatgaagttatacagaatacagtttttgaagaagcaactactatagacctactatagaccttttgattaactattttatagaccttttaaaacttctatttaaagaagtcttacaatttttttgttataagttatttacaaaatttatatcctattttttcacagtattaaatgtttatttctgtcccattattggtaagcataacttttaatgcctttccctcacttgtcccatatttaattaatcaatctctatcacagtggcttataagaaagtgatttgtaagaggtggacttgagtttgaattctggctttactaattctcagctgtgccattttggccaaagatttccttctgaagcttcagaattttatgatccagagtgccccctgtctgacattttagctcatcatcacagttcttggttcctaagcccctcatattgtactctttcgaactaatacatgagaataatatttttacactgctagaaaaatggatgatacaatggatgataaatgtttttgcccagagattatctaaccacatcataataagatcttagaatattatttagtacccatgactctatacagtaaatgaatataattattactacatttctagaatccaataaaaggtgacattatatgagtgctttacatgctaggcacaatgctaaagtaatacccttctattatctgagtcccatgataatgtcataaattagtaactcttccgatgctcgttaggaatatagggagactcagccttagaaaggacacacaatttacagatgcccactggctcttttagtaaatgtctgagttgggattttatctgataccaaggcaaccactaaatccatgcccttaaccaggaagcctcaagcactcaagcccttacccgatgttcaccataacagtgttgggcttcctgggctgggtgtggatacagcccttcctccaatatctacagtctcagcttctggaactttttaccttggctggtgttactcattctattcttcaggtatcttaatttctttgttttcatatatttatctttatctttatgtgtttcattctgagtaatttccacaaatttatcttctactataccattttttctctttggttttatccatgtcttaattcatatttctaaaattctaattgctataatcagtatttctagaattcctgtaatttaaaaacactggcacatctctattagcaaacacaagcttaaaaataaaatagaacataggctgccattaacaatataaacaaatgctattaaatatctagttattagtcaaataaagaatatttaaagactttatgaagcaaattgtaaaactcaatttaaggatattaaagatcaataggtgaagaaatatgtcaactgacagaattatttaatattgttaccatctcaattgtccccagagtattccccttgctctatgggcttgtttctataataggtaaaatgcattctaaatccaagcagatgagttacaataaatttttgaaacattgcagttgttatctgaggactgatcttatgttgtttatgtgtgcggtatacaccgactaataatttgggggaaaatgacacgatagaggtacaagaaagcatagaaacaagaaagactttctagcaaggtctttgtgacacaaattatttgccaggataatagtgaactttgcagttggaacttaataatggcaggagaggaagtacaattaacaggtttaagtaaaaaatgtacacaccagtatgtttcttttttgcacaagctcacaatgaaaagatacaactgtaataaattattttcctctgaggatactactcatggatcattatgcattcattcatttcttcattcattcattgtattagcccccgttttaaggtttaggtacatcatcgagaatcaacattctagtctggcacactggcatgtgaagacagccatttattttggtttaaaaagtgtcttacgaggtgtgtggtgttcaagaggaaggaggcataaacatagtttgggtatctgtctgtcagccctatctgacaaccaagaggccctcccctacatggagctggcatcaactgttttgtgagttccctttaactgttctttcttctctgattattctatgaatctcacaagctatgggtagtattgaataacaattataacagaaccgtccatccttccgattttattcactggatgctaactttacacatatatttaaaatccttttgtactaaaatgttactggtctggcttctaaatagttgctgtgataaggatgtgtcaactaataacacaaactatattttttctacttgtatatttcatgatatgtttggtttttaaggtggctttcttgtttttggtttgtgatgtatctaaaaccacctggccattggtaatgagacctggatattttatttgagaaatggctcaaaaatatgacaggaagaacacaatgctgacaaactaattgacgaaacaaagaaaactcattggtatcacacaggataaatacactgggaaaagagattaatatatgtgtgtgtgtgtgtgtgtgtgtgtgtgtgtgtgtgtgtatgggggggggagagtggggagagagagagaaagaaagagatttggaattcagtaattaacttgctataatatttgagttataattacttttgataaaaattttctttttgcatggtcaaagatgaagctttgtgagattttaaacttgcagttcaagctgaaaattgacactgatagttgctaattttccaggaacagtgaccttcacatctgtactctgtagctaaatcagggaactgttacagggaaaattacaaatgtttagaaggaattgatggttattgtttcaccatatataaacatataaacaatacatgattagagccagatcatagatagagtcactgctgcatcctaaaatgataaaaccatgaacaatctattatttttggaagaatggagttagagatatttagatcagcaattcaatgctcaaatttacattctcagttttttgctcaaaattaacactcttattcttaatacaagatatatgcagtcatcataaatatgatccttgattcagtaaataataagggactactgtgtataagaactgttctagatgtgcttttgaatagaaaaggttaagatcattgttctggtggaaactacattacagcaggtggagcagaccataaacactaaatataatacaaaagtaaattatgtagtacactagatggtgagaagtctatgaaaaacaaatagggctaaagaggatttaaagtctttggggtgagcatgtagagaataaatcattatagactcttgggtcaccatatatctgtgaattctatattttctaccactacatacataaaagtagttttaattgaagattggcagatttgtgtgtatgcatatgtgaatatttttgtaggcagatgatctactggtttcatcagactcttgatggaatcatgttctaaaattaaaatgattgaaaattccaatattttttcataaaagcagacaacattgttcacttcattcctattacctttgcttttcaataattgtgaaaaccagactttttgaagaaaactatgttatcattaaacatgttaatatttactttcagtctgaaaaaatatacatgataaaatgcattatacaaatgatttaggcattttaggccttttcaatttgaaatgaaaatgaacttggaaatatttaatataataacaactacagatccctctaatatatttaatttatatttttaaagcaatggtcatttaaaacaacattttctacaatgtgttaagtacgtggtgaaacaataaccatcaattccttctaaacatttgtaattttattccatataagattatataacttcagttatttatatctaaaagaataagagtaattcctgtctcaaaagattgttacaggagttaaatgaggtagtacctgagtaccctcatcgctcattatattcctttttatttttaaataatacgtacctatctttttttcattattacaaaaaatagatatacaagcattcttttgttgtgatggagtcatatttcacatgttgtttctctagtgttactctatcttattcccgtctggataaaagatcttgaaatgttctttcatggagatgaaactgctttcctcctggtcttcttctttataatgaggcctacgatgccagtcataactggtttattatctattccctcaagctatgtctatgtgaatgattcagcaaccacatattataaaattctaaataatttgaataagaaacaacttatgatcctggataaaattatttttttaagataagcaaattggctgctatattttgaaagattaggttgtgttacaaaatacactagtaaaagagtaagaaaaaaaaagactagttcccttaaaaagaattcttgattgaaattaatctgtgaacgtaatgattaggataaaatgctgctaatatatggctagaaggaaataagaatgggcaatgcataagtgagataaattgcatagatagggttcttctgaaagggtaaacattaagactgaacatatgtggtcagttgctgtcggaatagctttatgttgtccatactagacaggaatggggcaatagtatgagctcctacaccccttgcataggcatgagtcagacacatggtcaaaaaaagtataacagactaaacaaattcaatagctgtgagatgtttaagtaccagctttgagaatcagctatggtaccctaatttcaatgtaattagaaatagcaaataaaggttatataagccatattaggctataaaccagaggtccccaaccctaaggacacagacttgaaccagtccttggcctgtcaggaaccaggcggcatacccggaagtgagcagcaggcaagcaagcattaccacctgagctccacctcctgtgccatcagcagtgacattaaagtctgtataggagctcaaaccctattgtgaacagtgcatgtgtgagggatctgagtttggagctccttatgagaatctaatgcctgatgatttgaggtggaatagtttcatccagaaactatccccaccatgtgtggaaaagttgccttccatgaatcaagtccctggtggccaaaagtttggggatcactgctataaagtatatagaaatcctagaacttttagtaagagtaaaaatctgtgaaatacatttttttttttaacttttattttagtttcaggggtacaggtgcaggttttttacagaggtcaactgtgtgtcacttttggtgtacagataatttctttaacataaatttcaactgacacaaagcaagaaatacaactcattaaaattttttttaaattttatttttgctgtgaaatatactacttttaactaaaaattttgtggcattagtttgattaatataattttgcttttattactaaaatttcttttttttctgggaaaaataacagctaagttttggagagttgatccctagtttttcagatattagaacataagccactgattaaactgtctaaatgcatctgggcaattcaatactatttcattgaaaacacatcctgtagaaatgcagaattaatctgttcacacatttaaatgtatttcttttaattcattaaaatatgacaggcacaaccttgaaaataaaattttatttatcaaagtcaattaatattcaacttaagcaagggtataagcatattttgtgagggaaatatttggcctttgtaatctaaataatttatacataaaataagagagatcagtggaattttagttctgattataacaaattatttgtatgttttagaatgtatgctttctgttaaataaaggtgttctaacttttagtgtaagaaatcatataaactctttttggaaaactttaaatattcattttgttctacaaagtgttctttgaacttgaaattttgctgtggtccagtccaaaactaccattactactacattttattttgtcaaaaatattgagttttacatagctcgttatgattacatttttaaaccatatctatatgtatgggtggcaaatttaaaagggtatttgtttgacaaagtcaaacatcatccatttctatggctaaaagtttacatttttgtttttaaatcacatgttttgccattcttcagtgtactaccataggaacatagcctagaatatcaaaaaaagaaaactattattaaagaacaaaaaaaaaagagaggtatattatgaccactttcttaaaaactttacaatattattttaacaggaggtggtccctgatattatttgtgtaaaatctaatgggccagagcttattctcaactgtgaaatatatgctcataaactcagattgttgcctttttatttctttttaatctatttgaatggaacttacaaagcatctattttcatctagcaaaacatttcccttcccatttacccagtagattcacataacgtatacactggaacattaccattattccctgggtctacatggcaattctgcattagacaatattcaataatacaatacttttcacagtgaaataaagtaaaatttagaaaacgattcagtgtacctaatatgtataaagcactctgctatgattgaaacatgtttagtatatgtggtccacttttaaaatttcctcagatatgtgcagtccctgacctatagtgtctatgtcattggaagctatgaactccttaaatgaagaaataagtagggaaaagtcatgcaaagaagtggaacacctgcttctacgtatattgtcactatatctttaataaatttttggtttctttatatgtttgcatgtgttataaaaaacatggttccccacaacaaaagttttctagactatatggtttgctaatgatttagactttaacttgtaggcaatgaggagccactgtagatgtatcattatgcaaattatataacaaaatttgtgttttaggtcatcaatatagaggatgaactagaagttgagactggagtcagggagaacaattaggaagtgaggccaataatacaagggcaacaactagatttgaaactcctttaaaattttcagttgttacaaatgcttgttattattattgagattaatgcttctggtaattaaactttcttggattagttgtaagaatgatttgcattacacgaatttccaacgataacggaacttgtcataatgaggctcttttatgttataagtaaaggccaaagtgcaaaactaagctgctgcttgactattttgcactacaatggttcggctgtcatttaaataactcatgctaaaaaggaatctgttattatattaacatctcttgatactacacaaaatgcttcaaaactgttccacagtttcttttaagagtggccttgaagactagaatgaattttcctagatgtaacctaatttaaatggcatataaatctccaatttgctatttgcttgtagataaccataagcactttaataagaaaatgtaggtgtcattacactcggtcaaacttactattaaatgcctaatagacttagacaattttacatcctttatcgatggagatgtcattaacaacagaccctggagctatttcctgaatttcactctaaaatcaaagcatattatcattttctggttctatctcattataattagcttggtcttaaaacaacagcaatttctttaaaacatagtgtgtgttagaataaaatctggtgtttttttgttaactataattagctttcaggtatttactctctttatccccgtccatctctatactctttccattattaaattgtgtcacatggcttgtatggcgatctcccaatatttgggaagttatattacaatatctggcaatcttggcagaaagctgtgctctatatgttaaattaaggagtctttaatcatataaattctgtggaaaagcagccttaatattcctgaattttagcctgtagaaaggacagaccctttattatgtatttatactaccaaccaccagggggtaatagaatactctaaaaacaaggtcgactaacttcaagaaaacaacagaagttcttactaaatgggtagatagaggtggacaaatacatttcttagcacctaagacaataaatgatcatcaagcacacacagattgtgtctgactatcctccaagcacagcctgcaagctatactttcgagaataggttcgcctaacaattaaggcagacagggctatctggaaagctaattttggtgcagtatctgattactcagcactgctaaaaaaaaaaaaaaaaaaaaaaaaaaaaaaaaaaaaaaaagtgtttctgccatgtcaccgaccagcataattcagaggaattcacccttaaatggaaactccccaacacaaagcacgtggcctgtaacactctttatatttaggtttacacagactgaatgcaatgagttatttatttatgcacatcaaagccctctgagggtgaggattagaagagtagcaacataattttgatgacttagagcataagttgaaagaatcacaagtagtaacccaatcacactggagtctatggggattactggccatttctgtttttactaatgggtcttttatccaaataataaacgctttttagagaaaaatcataacagtttaaatgttttagttcatactatgcactggacactatatgctccacgaatctaacaaattaattctcacaacaagctgaagaaagagaaattattaatacctgtgttctacaaataaggaaactagctgaaaaccaaatagctatggtgaggtgggatttgattatttgagtctaaccactttctttaagaaaccaaaagatgcaaagtttatatgtcttctttatccatcctcagtctatccagaaatatcaggaacaatgtgaatttgaaacgcctgagaggagaaggtttaacctcagagcatcctgcaaacccttatcattcctgacattgtgctttcaagagtcagttaccactattgttattgctgatgttattataatacaaagaatagactgttagtaaaaaaaaaaaaaaaaattcattggcagacgttttgagggatgtatctcctgatagattccgaaggcttgccccaaaagagcttcaagggtaaccaagaaaaagctgtcaggtgggtagtgactgacaaaaaaaaaatttagaaaacgcacttgagctgtcctcagtcaaatacacccagcagatcctgcattcggataaagggcagcttggcagtgaggaaacagtctggatttgggagagcaatcgatgggttaaattctgattagaatcagactccactgcttactaggcaaaacatctaatcatgaaactcaaagaggttaagatcactggctccaaaatcagttcagctgctttgttttctatatttgaaaaatagaggtaatagtagtagctacctcattgattgacataagaattaagtgaatcacctcatatgaggtacacaatataattcctgacatggtgctttcaagagtcagttactactactgttattgctgttattattataattgcattacattagtatcatttttgatgtactaaagtaatatatacaattttaaagcctctggtgcatggttatttaaccttattgatacatcgtctttgttaaaccttttaatactgtactaaaagtttttaaatctaggctgtccagtaagggaaaatttctattcttaaaaagctgagtgactcctcaggtaaaacattatttctctaaatacttttctcccgcataaagtaaccaatggtcctttatgccaggggcatattttccagaagactaattggccccacctctaaccaactatttagtgaatagaaggtagacatgtagaagaacaaaatgtcatccttgaggttgtggagatgatcaaacactgcttcattctggcatagaatccttacaatttatgttttttgtctctgcacctactcagaatttctacccagtcctcaagtgacagctgtggcacacaagctaaaggcacttaacttgcttcatgatttcttgaccagctctttattaagagttagatttagcagggtttgcttgattccttggtcgattattctgtacattacttctaagaattaccttctttcctgactcattgcctttcatatgcagtctccaacacttcatttattgtttattctttattcggagggaaaaatactacttccctttgttctgattctttatttttcctgtctacttgcaaactgctagagtattgtgattatacccaatttctcaaattcaaaatgtattatgtattgaattttctttaaaaaatgaaatatagatctgtgagtctatattgcttaagaagtgaagaaattggacttacaatttgtgcacatatacttaatttttctatattctcgtagtgattatccctgacatttatgaatctacattgatttattaagtgaaaattttaaaagcccaatatttaaaaactcagcatgtacttaaaatgatgaacctaaaatagaatcatctgattgatcatcaataaacccgacaacaattcagtctgaggttgtttctatatacatacctagaaatttggaatctttctttaaacatttcccatgctaccttaaaaaaacaaaaacaaaacaaaaaaacagaagcacagacaaaagaaactttgggaagaagagatgtatatcaagtaacaatgtgaaggtgttttttgttgtcgttgtttgtttttgggacagagtctcgctctgtagcccagggtagagtgcagtggtgcaatcttggttcactgcaacctctgcctcccaggttcaagcaattctcgtgcctcagcctcccgagtagctgggattacagatgtacgccaccacacctggctaatttttgtatttttagtagagatggggtttccccatgttggccaggctggtctggatctcccaaccttaagtgatccacccgccttgtcctcccaaagcgctgggatcacaggtgtgagacaccgcacctggcacaatgtgaactttcataagcttgaactctccctgtgggaaaaccaaatcctgttaggctggtgggttgtgttttgtcaattcagcgtgtaaaaaacactgtgaaaatgtacatttaaaaagtagataactaatttataaaaaaataagaacatttaggctaatactcctgattggcaaaattatgtgaagatgaatatcggcggccccttctactcatggcatatatttaccaaatgcctggtgggtcccttctttccagccttctcctctcatttatgttagtagtctggattccgtagacattttggcttgggggactactgacatagaaataaagatgtgccaagctctgacaatcagctataaaccagtagaaatacgttaggaatctttcgaaaggcttttataatgtagcgtatttcaacgtaataagagccacgatgaaaatgaggataattacccactcagtccttgaacaactacaacattatgcagccattaaacatattttcaaaaaaatgccgtatgaaaatataaacaagatttagttaaataacaaaattagatcacacagttgtaggtaaattagtattgagttatattataaagagaattaagactacatttgcactagcaaagcaataatatcaacggattgataatcacttagaaatgtgctaaatcatgctagggtaaccaattctaggagcaaggattcatatttacacattaattgcaattaattatattttcattgaatttttttaggacaaattagtgagaccagtatgctaccttggaatagatgggggaaagtgaaatattattttacaaatattgtctaaactttaaggtctacaggggatgtttgaaaacttgagaaggatgaaagatgacaattatctgagatttatgaagacagtattggttaagcagcattttaactagtataattattgttctgattacctttttttaatcataaaagtaattcattctcattgtaggtgattggaggatagacaaaggtaaaaataagaaaacaaaaatcatctgtaattttatcaacaatatttattagtaaaagttttgaactttcgtttccagttttatttctgctaaaacaacccacatgaagaccaggggctaccatttcactgaccagtatgtccaagcacctagaacagtgattggcaaaaacaagcaattaggcactcaacacattgattgaatatgtaatttcaaaattagtcttctattgtacccttaattttgtgtgtaattctctcttttaacatcatattgtaaacatcgtcctctatcatttaatgtacaaatacaataccttttaatatggctacatgatgtaccataattccttctgttgaatatttaggttgtcttcaaattatcactgtcatcaaaatgcttcagtgaacatctctgcacataaagccagtagcatctgattatttaatgatgacatataaataacagaattggaaaatctagatcaaaatacgcaaatgatttaatatgtttttgctatatgccatacacatatctccaccagcagtgaatgaagagcattgatgctgaccattataaattttttttcaaattttgcaagaaaaataaatagtatataattgttttgattcgtaattatttaattactgatagtgctgaatatttttgtatatgtcaataacatcatctttaattggaaatactgttattctaaaaatttaacatagaatctgatgtataaaacatttggatgtatctaatctgtatatgactataaacatagtcatatatattttcatgctaaataatgttattcatattatattggtcatccatagtttcagaacacacacacacacccacgtgtgtatccattgtacaatcattgacatatgtatgtatatatatttatatatagtctgatgacacatgtatatttattgactgatgtagaagtatttaacagtaaaaatattagtgttgatatggttaaagtatggaatattaattcctggtttatgttacacataaaaatgtaattatgtttcaaataataaagctatgctcattctctctctcatacgcactttgaactggcatgaacaaaatctcctgtagtaatttcatatacataagacttgacagacactttatatactttcacaagaatttaaatatatcagatattttttagtgtaaaattagaaaaaataatttaacatgactatcaatatattttaaattttcagctttgagagacataatttatctgctattttgataaattttatctatatataatgaaaatatatgtaaatgaatatagaaaattgtgtaataaaattgagtacatatttacattaagttccttttttctttttttatttgtggaaagatgtttcattatacctatctgtagggggaataaaaaaaacagtactgaagcttctgaaatgaagttagaaaggtggtcttgactgagttctcagatgcgaatagtacagcttgtgagtatgcttactgttcacagaagccctctgccctgccaccccacgacacaaatctggttgctgctgggcatatttcaaattcagaatcatgtaactagcagcagatgtgtctgtctgcaactgtgataggctccatctgcagtttgcacctgttgttttgctgaggccagagtgcaggtgtgcatataaaaactcaaagggcaagtagacagcaaaattaaggaagtggtttttcctctctcatgatctgcgttcctgttttctttctttccttccacttcaaaaattgagatgctgatggaatcataacctgtggtcagcatcagccaattatcctaagatagtaattattgtaatttttcactacaatctttgaaaaaaaaggaatataagaaaaacaaatttgagagccaaaagaaaaaaaaaggagatacataattcttcaagagcagcctctgcttggactattttgattcatgttgatataagaaacactttgctgtcaagggaaatattgctagtgtgtgattacatattcagaacttcatctatttttaagaacatattttgtttaaatatagttttgaaaaacaatactgagatattttctagggtatttacatggccagttctagttttaaaatcacacttctgtagaccggtggttctcaaactttattgtacatatgaagccactgctgatattgttaaaatatagatttagggtagggctggggcctaagcttcgccttctgaacaaagtctcatgatgctgatgctgctggttcagggaccatacatataatagctaggctgcagtatacatacatacatatatatatatatatatatatatatatatatatatatgattgcatcatatgaagcatgtggaataattttgaaaactgtgaaatcatttaacaaatataaacaatttaaatattaaaacttttcgattacattgataatgaacataattaatgataaatctaaaaaacgtcattcaatcagttattaaattatcacattagtgttttaagcattcagctatcttgagaaagacattggcttgagttctaatgataattgccttcacgatcattgtccctgggtgtgatagatagataagcattctgttctttttgccatctacttttgatacattcttgcccttgttgtgagtttcttcatgatgtttacagaaggatctcccaaattctcccttcttcttttagagccaagaagttacaaagcatatccttcattgatctctttagtttttctattaagttgaacagctgaaatcttaagtttatttggatctcactaatatatcggtcttttccaatcacatttttctcttactcatttctacagtaagtatggttcatggactagtagcatgggcaccaagtgacagcttgttagaatctcaggcccaccccctagtctactaggagcctgtattttatagagatcctcgggtgacttgtgggcacgtgaaaatttgagaagcagtgctctggataacacttctaataataaaatataaatctctactttaacctagatttagaaacatgcctaaaatcaatgggagttttggagacagacagataactcttcaaatcccagctgttcagcttttgaaatgatgctctgttacagtctcctcacggtcctcatcaataataccttcttcacatgttgtcataatagaagtgtgatgaaaatacaatgtactcagtacagtgtctggcatataataaataatcaattgttgctaaaaacatgtatatacgtatgtgtgtataaatatataatatacatatatttataattatagataaagaaattagaggaaggaaagtttatgattgccagagattacaaagtggttaattttagatctttgtggatcaatgctgacctgattaccagtgtgatacattcaaataccatgtcactttgctataataaagcaattctcagcagttcaactaacttcatatttgcaaagattcttactttttccctggcatcatgatcagcatagtaatttttcttttattattttctctgagaaacatttttttaaatgaggaaaaaataagccctctcacaatatatcaatgcaatgtaaaagactgtttaaaatatatttctttgcaaaacatattaaatggatcattatttacatgagatcttcagaagttatcatggtctattgtgcaaattttaaactgacaccagaaaggtaaattatgtttaggcagctttcaaaaactggagttttgattcaatagaccgtagcatctctttgatgtgctattttgtaattcttcaaattattttgcagtatatgcatagctatcatgatgctgatagatattcatatttaaattatgaactaaagtaaccttatacctatatatgccaatttttcatatcaaaaaacacagaactgaaaaagctgtagagcagaacacagtatttgaacacatttttgtggtggggtgatttctagattatctctgcattcgttaggcatatctgctgtgtcacttaccaatttattgcctcagctcccaatgcacccttcaatataataatcaacagaatttgtttaagcatttctccttaaagtgaaggtgatgttaagctttctcagtagaaggcactggggagaaattgcaggaggaaggggcttcctgcaatttccagcccaggccagaagggtcagcaacgtgggtgtaagaatatctaatagataatgtcccagcagccactggctcaatacttgtccttttgtgaccttgttgccttgacctggcaatatttccacagacaccttggactccctgggcaagccctgcctagctggcctgcactcaaccacctgcgtcccagaggctcacaacaccaagtagttgctcctcctgccaggtgcaggctctgaaaaccttccacctccaccagcacctggactaccttgcacttcacaccggccaccaggcgctgatctgttgctcctcacctgctggcactgcactataaagggtggcgtgtttgtgaagcagcaccagacagctccagcccggccaaaccagtaaacatctctgctctccattaccaaaccatgtcttctccaagggaagtcttccctatttgtccttccttggatcaagggttgtctgcttaggttgccatataaaatttccttctatcttatagctacatttaccatagtttgtttgtttgtttgttcattaaagtactccctctttaacctactgtatggtttctatctcctagttggatccagactgctagattggctttctataattagaagtgaaaattgttctggagatcattttgctatcataagggctactacttagtgtgaattacctttgtgccaggctctttacaaacattatctaatttaatcctgacaaaaaatcttataaagtgagtattataatccacattttacagatgaagtaactaagccttaaacttagaaaatgtactcagagccaagtgatagagttgggcttcaaaacaagtcctctctcaataggatggctgtgtgtataactactctctattttgtaaccatcccaaaacttaactgtccaagaaaactccattttatttctataatgactaatgaacgtaatatttttaaaggtttattatccaaatagaaatcaaaacgtttctagaatgcattagcctgtagtgcttatataggacatggtctttaccttctgagctttcctggttctgccaaattgatacggtaatatacaggctcataagaaagaaagacacgcttcagaagagtatattgtccgataacatacagaggtctcgttacatttaaatttcaaatgaaatgatgattttcttttttataagtatatcccaagtaatacagtgacaccccccaaaattattttttgtttacctaaaattcgaatttaactccatgccctgtgtttttatttgctaaatctggcaagcctacaagagaagtttctcctttgcctgttactgttcctgtaagtttctgtgaatcttatcgcaacaaaagtaagctcaaaataagacaatgcatctaggatacgaccccactttccaaatacataaagttgttcaagttcaaatacataaggtttattctaagttttctcatagacacgaaataaattttaagattgaaataaattcctagtagacctagttttattattatatcatgacttctgatcttattcgtgagggctgctaagagttttaagagaccccaaaactcgttggggctaaaacacggctatatgaaaaagttcatgatcacataagaaaacagatagaaactggaccttttctagaaaactcacgaattatccaccccttgtttagcatatgatcaggaaataaccataaaagtagccaaccaacagctctcagggctgctctgcctatggagtagccactataatttttttaaaatttcataataaacctgagttctaatttgattgcactatggtctgagagactgtttgttatgatttccattcttttgcatttgctgaggagtgttttacttccaattatggtcaattttaaaataaacttgttttccctttactctgtgggctaactcttaaaattccttcctgtataaagccaagaactcaagtgacctcccagaatgaaccccaatttggagtttcaccctgtgaaaagagccactgttaatattgttattcttgttatgtgatgctgagcttaattgtaaagaatagaatgcttattctgggagttttatatttttatttttccaacttattaatagaagggaaatcttagaaatatatatctacagagaaagaggaaccagaatggataaactgctgagtggaaaggagaattagactcctcgtagccagtctaattaaaaactaattcaggtcctctgcattaattaaaagcatgttattggaggtagagttatgaaaagataatgtaccaacagaagagctgattgtactactgggtaggatataatataatatagacaattagagtaaagtatataaagtgtcatgaatgaactatgcacaatcttttacggaaataagtaggataatcctggacacagattgaataatggaagtgtatggaaaggttgacaaatgtgtgtgagtcctgatggctgagcaggtatttcgttgaatgaaaaaagagagttctaggtaaactgagaagcttctgcaaaggtaaatgtgcatgaaaaaagaagtctctttgggaatacactaaggatttctataaaaccagagcatagtatttgaagggtggggtgaagtagggccagtgtaagagattaggatggtgagggtgtcctctaagccttggaaggatgtttagatgtttttatcttgactttttttaagaaatatgattttgggcccggcgcggtggctcatgtctgtaatcccagcactttgggaggcagaggcgggcagatcacgaggtcaggagatcgagaccattctggctaacatggtgaaaccctgtctctactaaaaatacaaaaaattagccgggcatggtggcgggcgcctgcggtccctgctactcgggagcctgaggcaggagaatggcgtgaacccgggaggcggagcttgcagtgagcccagatcgcgccactgcactccagcctgggcgacagagcgagactccatctcaaaaaaaaaaaaaaaaaaaaaaaaaaaaaaaaagattttgtcttctggttggagaatagattggaaaaaggcaagattggaggtggggtattccttaatacataaaaggaaaagctaatgtcacatatctaatctgtgttagacaccatccttagattttaatatgtattctcactcttcatcattatactaacccttccgggaagacagtagtattatcacaattttaagttgagatttagcaaaattagaggattactcaagtcattagagactacactttaacctcttttttcctccatacctatggattaagaaaaaaaaaacaataatatagtgctttatttttagctacatcagcaattggctttgccaaataccctagatgagaagagttgagaacatgagctatggcagtgacactgcagaggagaggacagatggaagtgatattaggaaggtgagtaactgatcttgatgtggaaagggtgggaagaaagaaggatcttaatctttggaaactgtactgttaaagagaggaaacagaaggaaaaaaagtgaaagtagtaagataatacattatctttgggatgtgtttaatgtaagataggtatcagatattcaaatacaaatatcaagtaggtattaaatatatacttctgaatttcaggaaagaattttaagtgggagatacagatttggaagtcataatattcaaggtgatacttgaagtcttgaatttaaataggatcacccaaggataatgtatagaaagaaaggcaggaggttagggaaggccctggaaaatactgccacttaagtcgcaaacaaaggaaaaaaaacctctgaaggtagttgagaataaatgtcccaagacataggaaaaagcagaagagagtagagtcctggaagcaaagcaagaagaatgtttctgaaacgagatgccacagagaaaacaagaaaaagaataaaaaaatatgtgcttttgctttagcaatgtagagatcattgactagaatagtggactggtggtacaaatttcatattatactaaggcaaacgcatgagttgtgaggaggtatgcacttagagaaaacaactctttcaagacacttgactatgaaaagaaaggtgacagctatagtcaaggagggttttatggttgtttaagattatagacttgcagatgttgaaatgaagttgcagtatcattttgagactagacgattaagatacaggagaaaggaaataaatgacaaaactctcaagaagggagaaagtatgaagaggaggcttcaaatatcacagaaggtggctaaactttgacactgatccaacctaaattatgaaaaacaatttaatatatatctatataagcatgtctatgtgtgggtatatattcacatattctatataatctatatatattatattatataaatataatatataaatgactatatttatatagaaattccatatattatctaatatgtctagattaatatatcatatatgttagagagataatatacaaatatctatatataataatctatatgttaatatttatattgtatagaaatattttaatatttctataatatatattcaaatatttctatatagaaatatatgtatttatatataatcgtgtatttaattttctatagatgtaatatttatatataatctatataagtatatacaaatatctatctatatagaaatacatttatataaatatatttaatctttatatatgttagctttttatttctatatagaaacatctatatataatatagatgtttttatatacagatatttcagtatagaagtatatatgtaatatagatagatatttctacatatagatagaaatatctccacatatatatggagaaagagagagagaaagagagaaagagagagaggtggagagagtttgttttcagtatgtagaatgggcattgttaaccttgtatggttttccttggcattgaagtccttctgatgaattttccaattgcctgggattcataaacccatgttttggaatttctaatttcctacttaatgttctccaggtcctccacataacagaagatgatgaatattcagaagagcacagccctaatgttgaaattgcagagaaagaaaagtgcacacatttcagagcataaaaggataccgatacctacatttatctagactgtaagtcccatgaaggtaagaactatgccaaattgttctttaatctattaattaacctacttttcaatgctaggccggtaaataagatagtctgataaccatatttatcctcagctggtatcttgggaggattgtattccataacattctttatgtaagagctgtatcatctgaactgattccttccaatattaaaccataccaaataaaatattaagccctttcttacaacagagtatttcaagtttcactgtatttctcatcaatttttacattatttcttttatttcaattagctcctttctacctcctgtagttttcaagtttgacctttcaacatcaatttgaaggttatgacctaggcccacattgagataactctttttcactattttgacacaattaaaacaggttctggcttcagaaaaaaaaatcaacataatatatgttagctcttcatttccttagagtttttgagattcaagtgatgacatagaactttatcgtcagctacatcagcagttagctttgccaagtgaggttgctagctcttctaaatgcaaattgaaagagaggagaaaaaaaaaaaaaagagcaaagcattagtaggcaaggaaatgatatggtacttggccaacgaggtaatagcctttattgcaagccagtcagtgctccacagatggagaattatcataccaatagtgtttgatgtaagacccaattccccttgtgttggtgtctctgggcaggggttagtctgcagtgggaggtaaataaacccctcactaaaccagtattcttaattaattcctgtggaagtactcactgaccaggctgtaagaataccaaggaggatgtgcataatatttctcctaactgtgaatacttggcaacaagaaagaatctgcagtgccctcttcattcacaaaggacaatatgcctatatattatctaacagtggatattagaacatctcatctatttttagagttttatttcatgttcataaaaacattcccatttttctcttcctgaagggtgctgcttgaactgaaactgccaatgactttccacatccctcatcctattttattatagaaacgctcataaagacacaattttctcctatcaataaatatgtttgatgttccatagaagttctgtgtaatacatgcagaacaatggagtcagactctggaataaattattaccaaaacaactttaagcgatgaggctgcctttggatgctctcctgtggatgtgatgtggatgctcagtgtgaaagcaggatgaacaataaagcccatgagtcataatcataaatcccaaataggcattacccttccttaagacatttttaaaccctttgaaaaagaagactataaggtgcaatctggttttaggggcattctattctttaatacatttagttaaagtgtgaagtggagcacgcctgggctggggtgatttttagatgcagcagcatgctcagccggcagctctgtgtggatagtgatggtgtgatggaaacacggagtgtgctgcctgtggtgttctggacagggccttatttactttatttaggtttgttttatttttacaacatattcctcttgaaggcttctaaaatcccctgcctataaagtaaggcaaataagcttaggcatccagtcacccatactgaacggaggcgaggagacctggtcatctctacaaagtaagaagaggtttacaagtattattatttggatatatgttgcctttcacaatttactaactttctcaaaacacagactctacatagaaagtattagggaacaagaataatttgatgtgattgtttatcagataggcaataaaaaggcactaatgttcttcaaattagaccattagacctgctatgttcaactctgattctacctgtttaacactcattaaacacaaaattcagggtgctgactgtcaagataaatagggttattttctgcttttcctattttctcacaggaagacacatataccacgcaatcaagtagtaatttcagaactagacacattatgtggaaaatgtcatgctgaatatatctccactagtacagcctagctaagcccttgattaatatacaggagatgaaagtttctttttcttattatttttatcatttacgtattgtacaaataaaatgttattgcatctcagaagaaaaaagatttactaaaatgtttgtccacaaaatctcatactaacttatcactgaatttctgatacgctgcatttcccatgaagcttagtacaagttcagtgagaattactgaagcccaccatcatgtaagttctgatcattgctgggatcaccgaaaaaaagttcataaagtcaactcaaagtattggtaaaatatatttataatgttaaaataacatagatatattaaggcaaggagcatttttaaagatcacccaacaatggcatacattttgcatacttggtaaagggataaacactgctcaggaatctcacaacaggggtctttattacatctagcagctctaccagttatttgccattgcagctttaagggaaaagattctaaaatctcaggtagaatgccatgagtatacagcctcaagttctagagatttcacatcattgagataggttacctatgcctccttcaatgagcaatcagatagagatatacagtttgctaccttgtgtggtaatagaaaatgttagcttaggcattcaatcaaccataccaaattgggctggggagacatagctaaatctataaagaagagatttataaatcctttattacttgcatatatgttgcctttcacaatttaccaacttactttcacgtaactcatttcatataataattatattgagacaagatattgtttttgtatttttcttactagcatctcctttgtatgaatcaagaaacagagacttaaaagaaactgggtggttctttcagttttgcacaatgaggatgttttagcagtaggagttcatcacttctttaactcctatcaattatcactttactaacatctacatattatctcaaaatgatgttttcacttttaaaaacccctcattagatgccgtgctattcagaagcatgcagtataacaatgtgtctttttccagtataggcaatattctccagtacttgacaggcactcactgacggctgaaccattgaatcactggatgaatgaatgagtacctcatattaccccctttctagtaacacctttgattattgattcatttcttactaaagacccagcacagtgtcacaccgtgggaaataaatgatacaacaatcaattacatggttactcctgtgtggtacaatggccagcctgctgccatctggatgcttgctacaaatccaaattcctgggttccatcccagatttgctgaattagaatctcatatatactaaagcttgaaaagcattccacaatacattgacagtcaacttgtgaaaacaagtcagtggatttaaaaatatcactttcaagaaacagtgcttcttacaactattctacaatatttttcccgtgcaatctctcttagattgcccaaaactaaaattttgaggaagtggcaaaataaagacatgtcagtgaaagttcaaaactgaggaaaagagcgagctagttttgtgggtctggaaactcaaaaacaaaagcatttctgggaatatgagctcataaaaagcactaatgattagagcaaatcagacacagatcaaccaatgacatgatcgtcataatcaaatgtccttatgtaactatggttatgtggaaaatgaaaatacttattccgagtagtggataaagcaagtcttaattgccatcatcttacattgtattattttttttaattgcactattaactctgctactttcctgtcttctgctggttgactatttctattactttgtatttcagtagctagttttttttttgtttgtttgtttgtttgtttttgacagagtctcactctgtcacccaggctggagtacagtggcatgatctcagctcactgcaacctcagcctcttgggttcaagtgattctcctgcctcagcctcctgagttgctgggattacaggcatatgccaccatgtctggctaattttttttttgtatttttagtagagacaggtttttgccatgttggccaggctggtctcaaacccccaacctcaggtgatctgcctgccttggcctcccaaggtgctaggattacaggtatgagccactgtacctggccgtattttggtagctgttgttttaaccaccataactattttgtaactgtcaaagcccagcttactgaaacccaccacaaagttaaaaagcccagtttgcttactttctcaaacatctcagtgggatcgatttaatattatcaaacagatgcagatctggggagtttccagcagtctcagttctcagagttctggccatgtttctttaggttaagttgttacaaataaactgaatagatgcattgaaaaaaaaaaaaagtgggggttttagagtcaaatgtagctgcgattaatctgttggttaccagcagtgtggccttgggttacttattaagtgtgcttttctttaacatttggtcaacacaatattaaagaattattgcaaggaagaaaaataaatacttgccttgtgcctactgatttacagggccaaaaataaccactgttgttaaatgactcttaaatccatagtgatgacttgaaagcctagacagggaaatcaaattattcgaagtcaccaagccattaaagtccacagtagttcttggacctgcctttattcagtccttatccaggattgtttccattctatgacatctccttctaaagttggaggtatgtcacagtggggatatggacagtacacacaaggccagaagagtgtggacatgggcaagggagcagaagcacatgctggagtgcacagatcccaggtaaaacaagaaagcctattggctggtgtctgatgtgctgctcaagtgtgaatacctgtaagctgcttataacctggcgcatgctgttagagtggctaggagtacgtcttcgcactgtattaatagcaccagcgtctgggagcttctgtcagttcttaaccataggcagctccagcatcctgattggaccgtaccaccccaacagcttctctgaattactgtgaggtgatttcctgaccaaatattgttcctctattttttttttttttgttttgagtgaggggaggatgggactcaaaataaaaaccaaaccaaatggaaaaacataagggctcaaagtctgagatagtcaccattttgtataactacgggaaatctcttaggttattgcagatggtatgggtcgcagcaagggaattatgaggccattatgggaagtttcttcacatgcaacaagtagggacattttatccgaacggccagcaaagcaaagaacagttaattgtagaaagaatggaggcaattataacatgtctctgtcttgtttagggaaccagctctctggtagacattggtagaggtttttctctagagcaggagtcagcagactttatctgtaaaaggctagatgataaatgtttttgtccttgtgggccataaacttttgctgcaactactgagttctgcctttgtagcacaaaaaaacagcaatcaacaataggtaagcgaaagagcatggttgagttacaactggactttacttgcaaaaacaggcaaagaactgaattaggtctacgagccacagtttatcaacgtgtggtctagaattaaaaagttcaaaatgagaaaatatccaggaagttttcttgcttccagccccactctccactagacagagcagatgcctgatttttatttcctttcacgtaactcagaatatatctgccggtggtagtgcagtgctttagtgtgagtagggtgctagtaatgactacttttataatgacgcttgcaaagtggactaaaagctaaggctctgtctgattttataccctgctgttcttcagcagccagcatagtgcctaacaagtcacaggatttaataaatttgtagtaaagaaaggccattcatgtacatgcaaattcttacctcagaactactgggggaaaatcgatctcaaatggcttcaaatattgaaacctgtgttggcacttttagttgaatgatttgattaaaaatggaaaaagaagaggaaggaaggaagggacggagaaaaggagggagaaagaaaggtgatttttcttaaaagtttcacagagtcaggtatgttttaattcattgatgagaactgagtatttatgacacaagtactgtacatataatatttaatctgaaactgaagcaaatctctctgaggtagggttagggttacccattgtagagataagaatacattttcagaggtaaaatgaaatggctcgccccaaattaacaatccatacaaacacaaatttagacattcttcctccaaatctgtttttctcaccaacataacagacctatatgaatgttaagtgaaaggagatgaaggaaaaatgggagaagcaagttgaaggatacaaactgtcaacatgaagtattaatttaatatgaatttcaagataatttaggaatagtataagacagacagggagctttccagatttcaaggaaaattaaattctcgtttgcaggctgggtgtggtggctcgtgcctgtaattcccacactttgggaggccaaggctgtcagatcacttgaggtcaggagttcgagaccagcctggccaacatggtgaaaccccatctctaccaaaaaatacaaaaattagccaggtgtacatctgtagtcccagctacttgggaggctgaagcaggagaatcgcttgaatctgagaagcagaggttgcactgagccgagattgggccacttcactacaacatgggcgacagagtgagactctgtctcaaaaaaattctattttgcagaagcaataacaaagtccactgtagatgcttagtcaattctcctgcttaatttgtgtgtattcgtttgtcatctatgttaataatttgttactttgctctgatgagagagctagagatcaatgaatcaatttgaactacttgatgggatttttctctaaaaagtaactacatttctatagcagtagaacttcacagtgttttctcttcttctctgtaaggtggggctggagggtgaggtaacgataaagtgtaacacaaactgtattttaacaaataacacttaaattgctttgcacaattgttgaatagctgaattcttcctattttttctaataaagactaataggagacagtggtagagagagagagctttccaagaaaggttagaatggtttcaatatgtgaagccatttgagatcagttcttccccaatagttctgaagtatgaatttgcatgtatgtgactgactttcctttattacaaattcattaaattctatgacttgttaggtactatgctaggtgctgagaaacagcagggtataacagaggttagagaagttagagaaaaagtgtatgttagagagaggggagtaaccaaaacctatattttacaacatatgttttttttaagtggcacatcaatgtattcaagaaagttggatactcttcaacaactgcttcaaaaatataagaaactaatatttgtatatttgcatttaacatgggatttcctttggttagttttcccacttatattgtttctcacagatttgccttctaaaattttaatcattagtcaactctcattatgatactgtataaatgtaggctttagctgacactatttcttaatttttctccttcctgtggccccagtttggtctctccagtcacttcacccataacacatgtgtgataactcctgcgtccatggcccactctgaggaatctttcatgctctagttttgctcttacaggggcttattccatatcctaccagcagctcaaaatcagcatatccaaaaacacaatcaattgccaggttcccttttttgttccccctttctgctggcatctttgatatctccccatacatctttcagaatccattctgatgatttctcaattgctacatctctttcacttcttagcttgccattggtatccaggatctgcacacagctgctacacagagttcctagaacagctcaaatcctttcactccccttggcaaaagctttattattccaaagatatttcagattaaaaaactcttaatgacagaaagtaactaaaaaatactattttctttagaaatattgaaagaaacagacattcccaattccaacctccttcttagtaatcttaagaggcaagtgctaatgactatttattaactatcttctcaggtttttccatgattatgtaatctcaatactctatgaaatttctatacatttttataggaataaaatcattatatatactgatttgatgtacatcaaatatatcataatacatatttatatataatgattttatttctataaaatatacatagtggccaggtgcagtggcccacacctgtaatcccagcactttgggaggccgaggcgggcagatcatgaggtcatgagtttgagaccagcctgaccaacatggtgaaaccccatctctaccaaaaatacaaaaaaattagccaggcatggtggtgtgcacctgtaatcccagctactcaggaggctgaggcaggagaatcacttgaacccgggaggcggaggttgcagtgagccaagatcacgccattgcactccagcctgggtgacagagcgagactctgtgaaaaaataaataaataaataaaaattaaaaaatgaaaattctggggagatatatatgtgtgtgtgtgtatatatatatatatatatgaacactttatgtatgtatgtatatatgtgtatatatatattatattttaggtatttatttagttacttaactttaattatatatcactatgataaaccacctaaaatgccacttcctttatttcaggactgttttcttcattcttttaatagcaagtgtgtcttcttccataggccagaaaactgtctttgaatctttattactgcatatgtaacaggatgctgattgtaatttggggatatttttagacttgtggctaagacctatagctgagaaattaaatgcacaaaatacttcactttaaaattccaagacccaccagccctgagggacagcctattctgcaccagaattactgaggagtgacagatcagataacttgatctaacagataccaacaacaaactacctgttgctgtctctatccctatgcccgtggatggaagagggtaaggagagaggaaaatgtcttttggggaaaggaataggctctttcccttctgaattcaaaccgctagagacaggtgattaaaaagaattacccaaaactacactgacagcttacaagaaggaaaaaccagcactgtatctcaccagtggatgtctgcttaagcagtgatcttggcttgttatgtagcaagagagtaggggaaatgagagtaggtgagattagacaaagtgaaaaacttccaggaaggaaaaggttaagacagcagcctcccttttttttccagcttttggaaagtaaggaagattggtgccctgtgtatccctggatctgagagttactctaggaggaggacacaggttttctgggaccaccacaagaaaaaggattatatggaaacacatgcattaggggagatgtgccagcacaagttcagccagaagtactggccaggtcttttacaggacttacaaatgctgaagcttgctgagtgaagataagctcttcttaatggggataggttggaggttgccaccattttcatttaggtcatagacaacataccaggtgttggttttatatagcaaagaaaaagaattgatcttttccagttacctaagaagagacctgctcttttcctgatttcccctctcattaacctaaaggagaaggcagggagaggatggtttctaagatccaaccaatgtcccacttttcctacaccttctacttcgagtccctgaaggtacagcactagcctgaagtgacggaaggggaggaaaggagataacaattgaccttgaaattgtaaactgaactagaattaggcttaaatacttgaataagaaatgtttattaaccaaaattggtgacaatttatgaaatttgagtaaaatgccatttaaaagagctgatgaaaaagaggagagtcagtatgcaaaatccgggaggaaaatagtgactggaagataaatgtattcccctcttatattccaaatagtggacacttttcaataaattgattttataatattcacatattaaattttattacatttatttacataaatgtctggtgccacaaataagattgtaaacttctttgggtcaggaattagatagtaagcaatatttcccaggacgtagaatgtacttatatgtaaaagatgttcaataaatatttgtcaattaaaacataaggaattaaattgtagtacattagaaaacaaaaaggataaaatacaggaataatggatgcgaagtatataaatccctttcattttcaatgcctttaatgaaaggggcagtcaactataaagaggtaggcatgactctgtcatttaaaaacaataaagactgtataaaatatgaagagcagagcatttgtaatcacatagacaaggatttaatcctcagttctgctactccttagctgtgtggtccttagacaagcagctgtggtactccttagacaagtatctcattcataaataaataaataaataaataaataaataaaaagaaaaagaaaaaaaaaaaagaaagagtgagctctgggtggagtatagactctaatgttactcctaggtataaaattctacaaattgtgaaaatatgcagcaagatacagctgaaggaacgattacatcatagtccttataatctacatcaatagtttcttttggcatgcacattcagccacaagttattctttcaaatgttaaatttgactcatttgggtaaaagcaagctgcaagttttcttggttcactgagtttttgaagcagcactctttattcaaagtatagggcctttttttcttgttttctaaacatagtctgtaagattcagcaggtttcagagttgtattacaagagaaaatacaagtcaagtaggttcagcctaatccctcacccagcgcagacacaagcaatgtcaggtaacatagggaaaggagcaagttgccctctctatattctaagtgcatcttctcctgtcagtgttgatgatattggacacagcaaagcataaaaacaaccacctaaaattagtagggagcgttatcctacgatggaaaaataatcagagcctcatttacaccacaagaacaaataacccaattcagccacttgccgggcagttattttaattattagaaaatataagtaattggaaaagataaatcattacatgtcaataaagaattagtgctgatactaattctctctaagaagctcaccaggtgatataaaaagtaaggtttataatggaaaaagggtttaacaataaagtgaatttctcaaatcatggcaaatcattccaatgcaaaagatactaggaacaaaatagcatgacagaaaagagttaatatgtccacatgaaaacttgtatgtgtacattcatagcagcgttattcacaatagccacaaagtggaaacaatccaagtgtccatgaactgctgaatggataaactgttgactatctgtatgatggactattacacaaccatcaaaagtgataaagtatgaatacagtccatgttacaacatggataaaccttgaaaacattacactaaggaaacaaaatcagacaataggctgtatataaatgattcatgtaaatgtttccatttacatgaaatgtccagaataggcaaatctttaaagtagaaagaagactattgatagccagagttggggaggagagaatggaaagtgacttttgatggttgtttttgtagggaaggagtattaaaaatgtttccaagttaggtagtggtgatgattgtacaatcttgtaaatatattaaaaacaactatattgttcacttgcaaatggtgcacttggtatgtgaattttttctaaacaaatcatactttttaaagtaaaacaaaagagagaaagttaaaaaaaaaaaggagagatagttcaaatgttggtttgcttcatttttctgcttctacacaccttttatgtagaacataaaccctgacctcaagaattttaccaggtggttcaacaggatgcctgacaaactataaaataaatgggacagttacataggtataaatatagataaagataaaaatgtggcactatgggaactaagaatggtttggaagacttcccagaggatgtgattttgagcaagtgttaatgaacaaggaagaattgttaggtttgaatgaagagagagatttcatggagaaggaatagtaagatctaagaaacagagtgcccttgggaaacattatagccaaatgggaaggtatgagacaaaaagatgaaattagaaagagtagctggctaggcatggtggttcacgcctataatcccagcactttgggaggtggaggcaggtggatcacttgaggtcaggagttcgagaccatcctggccaacatggtgaaatcctgtctctactaaaaatacaaaaattaaacatgtgtgagggtgggcgcctgtaattccagctactcaggaggctgaagcaagagaatcacttgaacctgggaggcggaggttgaagtaagcctagatcacaccactgcattccacactccagcctgggagagagagtgagactccatctcagggaaaaaaaaaaagaaagaaaagttatggtcagtgggtagggaaattcaagataacacttgctgaggaatttgaagtgtattttatagattgtagggagtcaccaaatatcaaagaattcaaacgacttccaaaatctaggcatgttttcaaaataacacatatattaattccttgcattgccactgcatatagaatttagatgtaaggttaaaagtgattataagcagatattatttctttatagctatcataagcaaggagtctgattctctctcagtgagagatatttctagctcactccctcagctcagtctggttaatcttattattcatgttcgaaggaaagtaataattaaaaatattttctaaaggttgtaggttatcccatatatttatagttatagggtaaggctcaatgaaggtagaacaggaggaaagctacactaatcgcaaacatattttttaaggtaaaatcatctgcttaaaatttagaaagtttttgaagactatttcaaaataatgtgttgtcttttccagtgcaaatcattaacataaatagattgtatattcatgcagtatatcttgcccaaaaaaccacctgtatgtaaatcaccaagttcaaattagaagtctatgtgattaacttttcccctttatgatactgctgtcaagggtgggagaaaaacatgttatctgaatataaatctttatgatatagacagcacatatcagatcttaattctttttattttttacttaaaaatggtatataataccagagagtaatatgttcatcttgacaaaagcagcttcaattgtgtggtcaaaaattctacatcatcataaagggatgatgctccttaccaaattaacatatgccaaaactctgttcaaatatgggtgtatcaaaaacgttggtggatatactgaaattactataaacattaaagtacctaaaaacacctaatgtggagtctggtaaataatagctcatcaataaatgttaattttatttgttttcctgatttctcacaagaaatgatatggggaagaagtggtcattgttaatattaattgcaatgctagaaatatcagtgcaactagaagactgaagcaataaatgagagcaatggcaaatataatttatacaatccatgagactgtgtgtttgtttctgctattggtaattcaacaataaatttgctgattatttaaaattcacataattgtttctaccataagaggaaggaaataaatgcttgatcatatctttaccaggtaaaattcttgttctctaatacaaccaccaaaatatgaacacaaaataaaatatctttctcagcaggttctatcttgtcaaaagataaatccaagaagcagtcaattcttaaagctcaaaaatcatgatatcttatttgagtagatttctgtgcatactacgtatatattttaatttgaatgtgtatagagttaagtgtataatataacatcccactgtgttaatgggaactctaagtaccaattcccacagagcagggattacaagttacttttatgttgagtacttgtgctattttgaatgttagctacattgtagaataaccagccagagaggtaagtcatatgtgtaaagctgtaggaggcaaagaaaagatttaagataaaataaggatatgtgaaacacaaatgaaaggatggattagatgttcaacaatatattgagtgaatggtatttaaagtttgagcaataggacatatccttactattttttaatggattagaccattagagatacagtgtccatctatggctaagaaggacatctgtagccacacaaactggaataagcctataaagcttctttttctttcctttttaagatataagatcatcaacagaaaataaagaaacccccttatgtctgagggatgtatgctttcaaagtacattgagagcatactgtgtgttactttttggccttccagcaatttgctagtggaagagtctgctaaatgattaaatcccgtatgtccaacttagaagctttttggttcagggtaggtagcatattcctctcgcaccaagtggctcccgaactttattgtaaggtctagtgcttcctatagaaacagcttctggctggacactcaatgatttcacatggaccaagagtgattggtcactcagtttcattcaattctggggactgtgatgagctgtgtgggttatgcttttacagctgaagaaagccattgctcagattttggaaccattgacagatttaaggaactcaaatgcagtactcctgtaacctgtcagccttgttgtcattcttttcagatactctgttacttcttattgtagagtctcaacatggttcatttccctggactaccagttacttcagcgagcctgaaacccagaagtcattgtcaacaccacctacttccttgcttcctaaaacactcatgcaaaccatctcaaatcttgtcaagttttccttctaaataaatgtcatatcaatctacttctctacattttcactaccaacacctaagtcaaagtatcaccatccttcacctggaaaaattattctctcccagtgttcattttaagtcccattcacagcagaaaaaaatgatattgcaatgactctccattgttcttaggaaaaagatacaaaactcttcactgatatatgtaaggctttctccagcttcatctaaatgcaaagacccatctttgcactctcagtcaaagccccaccacactttttcaggttcttcatttgctcaattttctccagcttacaggatatttttcacgtgttcttctcctgacctgaaacacttttttgcccactcctcactcattcaaaccctacttattaactttcatttctccttaagcctcctcaggaaagtctttcccgacactgtatttccatggtacagacttttaaacaatgtctaggactttttgcatagtttgcatttgtaattttacatttgtttctttgatttattgagtaatgactgtagtagacattttggttgattttcaacatccacataatattagataattactttagatcaaacataggaattccttcacctttctccaatgacagattcaaacatatagatatagatgtagatacagttatatagatattgatatagatatacacatacacagagcctcaacttggtcaatgagatataagaagaaatctgatgagggaattctgagaatcttatcaccacatctatgatagacactaaaggagaaacagtcttctttttcctctggatattttgtgtttgggtatagtctctgaaagtatagaagacagattgtcaccagcttgtggatgacccaacaacaaaagtggcagaatagagagaaagatttcaatatatttagttatgtcactgagccatttaattatttaacattgtgtcagtctctttatcctgctataacagaatatcaaatatgaggtaaattataaacataaatttgtttctcatagtcttggaggctgggaagcctaagatcaatgtgccaacaatttcagcatctggtaaggggggcgagtctctgcttccaaggtgcaccttgaagcttgtatcctccagagttggggaatggtgtgtcctcacatggtagaagcagaagtgaaaaaataatcgaactccctacattaaaccctttttaatggaattcattcattcacaaagataacactctcatgatgtaaatatctcccaaagggccccacctcccaaaactattacagtatggattaagtttccaacacatgaattgtgggggacattgagatcatagcactccaccccagaacccccaaatttatgtcattttcacacacaaaataccttcatttcaccctgatagcccccaaagtcttaattcactctagcataaactcaatagtctgaagtccagagtttcatttaaatatcaaatatgggtgagattcgtatcggggcaacttgctctccagctgtgaggctgtgaaatcaaacaagttatgtacttccaaaatatgatggtaaaacaagcatagaatatacattccaattccaaaagggagcaatagaaaagaaggaaggagtaatgggtcacatgtaattccaaaactcagcagcataaatagcattcttcaaacttgaacttaatcttcctttactcatttacacaccttcctggtacactggggtggatgtggttcccctaatgccttgggcagctccccgcatatggcttttctgggtgcagaccatgctttagctctcatacattgaaatgcatgcctgaggcctttccaggctgctactgcatgctggtggctctatagttctggggtctttggaatggccctgctcccatggctccttaggcattgccctattgagaactctctgtggtagcccagatcccacagttctgctcggcattgccctagtggggcactgtgtggcagttccacccctgcagtaggtctcgacctggcactgagactctctgaggcatcttctaaaatctagtggaaggaagccatgccttcacagatctatactctgtgagcctacagacttagcatcatgtgaacatcaccaaggttacagctcatgccttaggtccctggccctcaccccaaaggccctggcattctgggcctgtataggagggaatacctcaaagttcttcaaaatgtctttggggtcattatcccattgtcttgataaataatatcaggctgccttctatccatactaatatccatatcaaacctgtgattttttcctctcaaaatactgctttattctttacttggccaggctgaaaatttcccaaatcttcatattttgcttctcttttaattatgaattgcatcttgaaatcatttctctcttttcacattttactacaagcagtccaaagaagccacacagcattctgaacgctgctgctagagacttcttctgccaaatatcctggttcatcactcttaagttctgccttccacaaagtcctagggcatggatataattcatcaaagttctttgccactttataactagaatgaccatttatccagttttaaatatccttgttcctcgtttctgtgtaaaacctcatcagaaaagtcttcactgacatgatcaattaagtaatgtctaagaagactgagggttttcctataccccttcttttcttctgagccctcacctgaatcaccctaatgctccattcatagcaaagtagacttcttccagtattcatatcaaaactcttccagcctctatccattacctagtgccgaaaccacttctatatatttaggtatttgttaaggcaacaggccacttctctggtatcaacttctgtcttagtgtgtttgtgctactataacagattaccgcaaactaacttataaccaatagacagtcctcacagttctagaggctggcagatttggtgtctggtgagggtctggtcctggcttccgagatgttgctatgaatgctgcatcctccaaaggggagtaatgctatgtcttcacagagcagaaggtgaaggagtagaaagaacaaaactctctccttcaaactctttcataatggcacaaacccatgccactctgccctcatcaccaaaacacctcccaaaaggccccacctcccaatactgttgcattcggaattaaatttccaacacatacattttggaggactaattcaaaccatagcaaatctcgaatcctttccaacatctgtatttacagttttatgagttaataattattaaatcactttgatttggggtctgcaagcaacagcagcctaacttattgtgttaatattatttatctcagtcttagatcctaagctccatgaaagtagactctaggattgtttctactcatcattttagtgctagcatctagtttagtgcctacattttatagtttgtgtttattaaatatttactgagtgaacggacagatgaataccaaacattttctgaaaaactccttgggatattcattgtttcccttttagctttggattattcttattatccatgtggccagttgcttctgtttctcaaaaggcatagtttcactctggccattttcctattagcaggctatgtttatctcaatacctccaaaatacgacatttagtactaggcaaaattgttcagctattctcttgccaggtagataacagttatattgtttctctcattctataaagatcaatgattttataaataaaattgtatatgagacttattctgaagctttttaaaaacataaatacctttgaggtcctccaaaattatgggtgatagatctggtatcgttgatacacaggcatatttacattttggtgccctatcaggtaattctcatgtgttttcaagtattatatccattgttccatatactaaatctctgttgactttgcttaggtttgtattaactctttggtgatcttattatctctaagctaaatttattatagcttagagaaagaacattatttcttcaaaatgaagagattataggaaaagaaaatacaggctttgttctgtagagtatgaggaattaattattacttgatgatagaaacacctaagaaggtaaactttgttagactgtaaggacaaagatattccaataatttgtttcctctttccttggtaactgaaccttgatttcatcttagagacccataccgaaactttcagcccatgtgggatgagtagaccttgatcaaaccttgattcaagagcagatatgtggtgttgggcaaaataaatcagagtaccccattcttctcaccagaagtgatgatctcagtggcatgcatgtgatctaaatatggccaatgaggtgcaatgtgatttttgcttggaatgcttaaacagtgactggcactctttccgaggaacagtttttgaagctgagccaatgtaagatcctaagtctggtgtagtcattttatgcatttagggagagaccctgtgtgaaagcaatgaagcagaactgagagaggaacaagggcctgttgacattgttttcttatctctatattctgccctgccagaagcctctgcacttttcatttagttgaggcaataaatcactatttcattcaagacaggttagatcaggttttctgtcacgtggaacagaatcataactgataaaatgtggaagaacttttaaatatatgttcacatagaaggtaagcctgtaagtatgaagattctaatcattagaagaatttttatggaggagttagacaattacttgaaataaatatttaaaatggaccaatcatcagaatagtgattggtcttgatcacatttatgaggctgggaagtagaggggtgaccccaggaagcaataaatcaaaaagaagggagaagagaatcttaagagggtatcctttggccctaggccatctatccaatcctgttattgctaagaggtcattgtaaataacggatacttaaagcaagtacattatatgccaagcactgcagacactaagtgatttaaattgaatgatctggtcagagtcaacgtaagatcaaatccaactggcttactgccaaaatagttctatgtgcctaacaggtagtgatacctcatattggcaatgctggatcagcagaaattactaatgattttggcagccaacaagctccatgaggtaataatgaaagctatagctttaaatagctcaatggaaaaattcaatggggcagaagggaattgcaatgggctttctgaactgttctgttgatgctgcttagcaaatgtagctccttgagttgttttcatttcatcaaaatcatgatactcttgagtgttggcaaggaaatatcaggtaatgataaagtggtgaacatgcctttcatcagctgaaaatctttaattgtaaatgcagcatgtaatggtgtaattagttgtctaagtgacaggataggctcaaatctttgctagtattttgcaaaaagaccattaggtttccacatccctttcttcaaataagatgatgagcaggcaaagataagtaagggattcatttttaaccccatgaactgagcacactccccgctagaaatgataagaggctataggaaagtaccatagtgtgtcaggccagatctcactgacacagacctccataacaactgtttctgtactgactgagtggttaagttaaatattaaaagccagtgcccttatacaaaagctgggatgtaagaaaagcccaccaacagttttgcctaggccttttctggaccttaaagcatgacaaaaataacaaaggaatttttaacaggatccatttaggattaaacaagtctaactgtgggtctgaagaaactccccaggcctccacaaacgtgtttgccagcggggctgaaggaactccccaaaccaccgtgatttagcaggagacaagatgagggtaatcaccctagcacctggacccatttagattaagtaagtttactgagactccagaggaaggcctcaggactcagaccttagctatagattaaaataagttaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaatcatcattctcagtaaactatcgcaagaacaaaaaaccaaacaccgtatattctcactcataggtgggaattgaacaatgagatcacatggacacatgaaggggaataccacactctggggactgtggtggggtggggggaggggggagggatagcattgggagatatacctaaggctagatgacgagttagtgggtgcagcgcaccagcatggcacatgtatacatatgtaactaacctgcacaatgtgcacatgtaccctaaaacttaaagtataataaaaaaaataagttaatcacttatgtctttagatgaatgcatactttcacctagacatatagcttagaaggtatataagctctggaaaactttgtaattttgagttggtctggtgataatttccaggccttctctctgtaactgtttgcagatatgaaagctctctccctccccaattcatcttgattttgttattgggccacgagaaatagcagccggacccacactttggtccagaaacaataggttagtactgctactcagatatgtgttggttctaaagaaaacacacacagaggtaaatagtaaggatcatattttaagcaactcaaggaactataaatatatttgctccctaaatcttagacacaatcttgcaaaacaggtattattatttccatttttcatacaagacaattggggctcatagaaattgagaacatatttagggtcccacagctagtatgttgcaaaaacagagctgtgatttgtacctagtgcaaaatctaagtgtcaaacttcaaagttctttaaacagaataccttcaactgtctttaaacttttagaaagctggttctaaaatttctctacatacaagaattatagaaaagcttgctaaaatatgagtttccatgagcacatacatgtgtatgacagagagggagagagagatttgagttggtagattatgaatgcagctaagaaatttgcaatttaactacttcctcagggaatcttgaggcaggtattcctcagaccacacagtttagaatgtcctttgcaaaatcctgtatgacagaagtctggagatttttatacagggacatcatacaatgaggcttctaatagaatcttgatgacaaactgcaacatgtaaaaagacagacttatacttaatcagaaccagttgcatagaaagccctaggctttttaaagttacattaaaaaaagaacatagggcctcaatcactaaactcaaattggatttgtaactccaggactgttagaaaaacagctttttcatctgcacctgttatggtggagatgattctagaatgagcagagtgaatccaagaaagtatttttcttcatgaaggaaacaaatagtgctctaggcaactgtggttgatggatgtgatagcagatcctttcttagcatcctcaccttataaaattaatagatcctcacttttaaacatattatagaaaatggaaaagagaatcaaacgaacaaaatctatttttctaaattaaaaagcttgaaaaagccctgcttcctttgtctgtcataatgatatcgctggatcactgccaaatcagaagctatatgaatgattgttcttagataatagttccttctgcaaaatataaagctacttttcccaaaactcataccatgagtttccaaacataataaatcctagttttctaaaaatatcttttattttggaactgattttgccttaattttaaccactgcccgctaaagaattatgtcagttatactcataggcatttcaatgttgtacaactattaccattgtacaaattctactgtctgcttagtaatgctgccaacatcattaattttaacagaaagatttatacattgcaaagatatgctttttaaaatgctggtccctcaaagttttttttctgtacaactataagtattgtattttattcaagacaatcaaaagtgtttttggtaattacatttattcataaaaatgtttatatagatttctttgtgacagtagcagcaagtatgcattgtcgtagccttatccaaccctcttgacattttgcttttcccttgtgcaggaaatggggaggtttcaagtggtgagggcaggctggaactgggaggggaagaggaaggaatcagaacagcaaggcttttgtggttttctgggcttctcagttgatttaatgcagcagaaatcagataaccagtatcatcaatcatgacaatcatatgaactgtctccatgcttagattgctttattctcagaatcattattttcaaattatttggtctgaataaagatttccatgccagttaaaaaatgatcctctatatctcccatttcagctatgaagcaatgaaaataacaaatacagctttctttgagaaaacctgaatttgaatcttgacattgatacaaataggaagcagacaaatgctgggtagaagagggaggttccccagcaaaggccctggccttaaggctggaaactatggcccctaaatgagaacagttatccccattttccagccaaaatgttgctttttccaaaaccacactggcccaccaatccccacatcctgtacccataaaaaccacaaaccccactggcagaggagcagagtggcttggcagagaaggagagaagagaagaagcatctcaacgtcaagaggagaagattcttttcccacttcaccccctttccagcttcccatcccactgagtgccacctccatcattcaataaaatctctgcatctttcaagtctgtgtaacctgattcttcctggatgccacacaagaacctggttaccaagagggcagggtgtaaaaggctgtcaccttgactctccattgagatggttaacacttagccatctgcagacagcaactgctaaaagagcattaattgtaaaacacccctaaacactgccatggggccagagcccaaaagcgctctccctggctcctgcacctgctcacctgcgtgcttgccctccaggaaagggcttgagccacatccccattgcaagttcccagagcgggtcaagggagccttgtgggcccttgggtgagttacttaagtcactgagtttcagttttgtcacctgtaaaatggagacaataatgcctatttctcagagttgctctagagacaaaatgatacagtattttgaggagagctcattcatattaaactcccaatttttttgtttgtttgggaagactaatataagtgttgatttgctttgtttttttcattataattatcaggtttccctacatatatgtatatatatatatatatatatattttctatttgcttctatttgaaatatcaagtgaacaaaacattttttaataacttctcagcattctagcttgagattttaagctgtaatctatcccagaatttctgatgtcttcaatggctgctacaaaacaaaaacataaactttaaatgcaactcatttggattttttcccctttcttgctttcctctgattgatattttctttcatttttcttatttcacttcttcccactgtttccttgaaaattatactcctgtataaccttttagctttaatatccaccattttaacattcatatctttatctttctcctgaataatttaaagatattacagtgagtatattttaatgctaaatacttttcatcaaatgtacaagcaaatttcctaaagcatttcaaaattgttttaaatttattattaattgttgtggatacatactagttgtacatattttgggggtacatatgatattttaatgcacaacattttcttctatactgtttcctgctccataaatgagacagtgttgttgatgctgttttgtgttgctttagaatacaattcatgtttatttgtatttaatacacatttacaattatttttacttagcaagatgctttccatctaagacagtccatttgtgatagtattccctctgcctaaattacatatttagaagtttgttttttgagggtctgttggtggtaaacttaatatttgtttgtctgtagatttgttatcttgcctctgctcttgatggaaagttttcttggatgttgttagtctatagaattgtagggtgaccattttgggaggggtgtgtgtgtgtgtgggtgtgtgtgtgtgtgtgtgtgtgtgggtgtgtgtgtgtgtgtgtatttgcccagcacaggtatgttattctgctgttttctaattccattgttgaaaaaccatttagcagagtaagtaccagtcctttgaaggaaatctgcctgtttcctctgtctactattaagttttctgtttatttttctgctggctcgctatgatgtatcagaatgtaggtattattatctgtttatactgagaatcaatgtgtttttcaacaattttcaaaggtatcagccagctatcatctagttgaatatgccttcttcctcctctttatactatcctataaaaaatagtagtccctctcttatccacagggcgtacattctaagaccctcagtggatgcctgaaactgcagatagtactgaaccctacgtacactgtgttttttcctatacatgcatatctataataaagtttaaaattagtttataaattaggcacaggaaaagatgaacaacaataactaagaatagaacaattataaaagtatattgtagtacaataatgtggtctttctctctctcagaacaccttgttgtactataccacaggttggctgaaactatggaaagcaaaactgtggataagctggggaggtgcagggggctcatatagagtatatactgttgtggacatttatacactggcctacattttttaccctctcataatttccatctctttgcccatctgtgcttaattctaaataacttcttcaggtctgaataaatttttcgggtctgttgttgatgtctaggctaatctactatctgattcaccattgaggttttaaatctaattattgcatctttcccccccctctttctagtcattccattcatttccttctcaaatgtgccagttgtttttgtagcctcttatttattgcttatattctcaaactttaaaaaattaaagacaatttatttgatgactgctaattgcaaaatctaaataattttgtatctgattctgtttccttgtttctactggctttctcccaggataatttgtttttttatgccttgtattcttctggaacttttggttacgggtgaataatactcttcagaatgttatctttaggtgttattttaagcctgggttaaatatgcatttctcccaagaatatgtgtgcttacttttgccagtcttatatatgtattacctataagagaccaccttacatttatcttttccctacagtatactatgaatgtgggccaaaaatcaaattttgtttatggtcataaattctcaggggaagcctgttttccctttgactcagtgccaaggtcaagacatgcaagacattgcaaactctctgagcaatgttctaatttcttgttcagccttattgtgacagcagacctttttgtcttggctttatgtagggcacttcctattagtcttcacaccttgggtatgcccaaaattttaaatcctgtctctcccactccctgagagaaatttaaaatagaagttcaaattaaaagttctcaaaaccctaagatcaaaatgttgctctgagaaacacttaagtccccagatctcatactttaattgtgtgtggcttctgcatactctttcttttgttgaagcacaaaatctactttacaataattttttaaaaactattccttaaacatagtgatcttttatgtctttgccatttttctgctaactcccctgcacctaccaagttacgacaattggacttctcccctcatcactatattctgaaagaataatttttgtcatatatttattttaatgcatattacaaatatgtacttatactcagaaatcattttattttcacttatttgaatctatgtataaatcttatatagcctattaaaaaaaaaacactaaagtgtatatttagagccaaaaaaacatttagagagcacctagacctaacctttggaaggtgcagggactttcctaatattacaaggtgtcaggtgggaccagaatccaactctagggtaatctgatacagtgttcttcctaccaaaacaaggtttatttttaaagtatggtcataacgttctgtcttctaaacaaaattcattttatctaatgaggaagtgagcttaaaataaagatttgatgtttctgacctgatggtaattttcacaaatctcagacattgatgctggagaggagaaatttcaattagatatttgatgatcactacagacaaagctgaataatcataatctcatgtgggtggtgatatatttagcaaacagtaaacatgagagactacactaaggagttgtagcacaaaaccatattttgtctatatttattgaaaactaattagccatgaattgcagggaaattgcttgaatttattagtgaggtgcaagtctaagatataaacgtaatgttcttatattgtattgtgtacttttctaaatttgtaaacttttcattccaaaagtttaatggcccacactctcaaataagctgtagatgggaaacagaaaaatgaaatccctcagggaagtattagctaagataatgatcaagtaagcaaagtatagataacaacagtgaaggccagcagcagaaaaaccggctcaccaaggaagaaaatatcataggagtgtctgcatttctgggaaaccaagcagaggggcctttgtgttgaggcctcagtttcccaagtctcaaggatgagccaggggaattgggcgagagtttgggaggtagtaaacaaaccaagacgcagtgttattcagggtctgtgactaatgagatagcgaccatatatcatgtagccatatatcagtaattttctaggaggctcctcatttcatacattctgaccctgtgtacatattagcagaataaactgaaaattccaagatggtgtattcccactgtattgccaaaactgcctctagaactcaacaaaggcacagaaatcccttctcatactacatattacattttagagtcaaataatgtgtacactctatctgtaaaatggcaaaatcagagaaaaatttgaatggcagcagtgattataaactgcttaagtttaatggcattcatttaatcataaatatatggaaagaaacactgggaaattaactgcatgatcttaaaatgagaaagagtcttctaaacagaaaaacaaaaatgatagattagtctatattataaaaagaaataaaaggcaaaatgtatatctaccctactttgagtgagactaaatatcactgccttagagcactaaaatatttctcacatcaacgatcatatctgaaattctcataactagagtcactcattttgcactcattaatgtggttccaccttggagtgggataatgtatttcatttaacatgttaacatacaattacagatatatttacctgattattctctcagtgctactgtcattttaaatttaagacaaaacttaagctttaacatttaataaaatattttgaattttattttataatttatgcatcttttcatttttcctcatttctcagaaagtgaaataaatatatttggagcaatcaagttttagaaatgtgatagtatactgtgctagcgatagaaaaaatgaaacggagggagaattgaaaatgaaagcatgccaggggtagaatgatatggtttggttctgtgtccccaccaaaatctcatctcaaattgtaattcccatgtgtcaagggaggaacctggtgggaggtgactggatcatggggcagtttcccccatgctgttctcacaacaatgagatctgaaggtttaaaagggtttaaaagtgtgcagtggttttcccccaaccactctcctgtcaccatgtaagatgtgccttgcttccccattgccttctgccataattataagcttcctgaggcctccccagccatgcagaaccgtgagacaattaaacttattttctttataaattacccagtctcaggtagttctttatagcattgtgaaaatggactaatgcagtgatgaatcacatttactgatttgcttatgttgaaccaaccttgtttccctacttgattatggtggataagcttttagatgtggtactaaatttggtttgctgatactttgtagaggatttttgcatcaatgttcaacaaggataatgccctgaaattttctttttttgttgtatctttggcaggttttggtatcaggatgatgctggcctcattatatgaacatatggacacctagaggggaacaacatatactagggcctctcagagaatgaagggtgagaggagagatagtatcaggaaaaataactaacgagtactaggcttaatacctgggtgattaaataatctgtacaacaaatccccatgacacaagtttatctatgtaacaaagctgcacatgtacctctgaacttgaaagtgaaaaaaaaatcttcagtatgtcatatttcaaaatacagtaatataaatttgtacacctatttatcagactaaatttatggaatatatataaataattagctaaaatataaataaatgttacatttataaattaagtatattatctacaaatagcaattctagagtgtataaaacatatatttatgaggacatttatattaaattatacaaataatttatcttcgcaaaaagactattaattaggattacccttattgtataataaggaaacttgtactaagaaaggataaataatatacccatggttactcttctaataactgggatatctcagtcttatgcttttccatcaccaaatcattggttcttgtgtaaaatacattttatcatttctatgaataaacctagaaaattattttggctgtgtgcatttaaccttatttataacaccaataacatcttttttttaaacttttaagttcaaggatacaagtgcagatttgttacataggcaaacttgtatcattgagggtttgttttatagattatttcactacccagttattaagtctagtgaccattagttatttttcctgaacctcttcctcctcccaccttccaacttccaaaaaaccttagggagtgttgttcccctctatgtgtccatttgttctcatcatttggctcccacttgcaagcgagaacatgtggtatttggttttctgttcctgtgttagtttgctaaggataatgacctccagctccatccatgtcctgcaaaggacatgattgtgttctttattatggctgcatagtattccatggtatatatgtaccacattttctttatacagtctatcattcatgggcatttagcttgattccatgtctttgctattgtgaatggtgctgcaatgaacatatgtgtacttgtgtctttataatagaatgatttatattcattgggtatatatccattaatgggattgctgggtcaaatgatattagggaataccacactgcctttgtatttattcaaggtttgttttttttttttttttttttttttttttaatggagtctcgctctgtcacccaggctggagtgcagtggagcgatcttggctcactgcaagttccgtctcctgggttcacaccattctcccacctcagcctcccaagtagctgggaccacaggcgcctgccaccaggcctggctaatttttgtttttttgtatttttagtagagacagggtttcaccatgttagccaggatgggctcaatctactgacctcgtgatccgcctgccttggcctcccaaagcgctgggatttacaggcatgagccaccatgcctggcctattcaagctttaattgtactttctcaaagtcatgcctcaaagcctttctgctctattaccagtgtatccttgtcttactatctgctggcttggctgatgccttttgttctctctctctacacttcaggttcctgggttcttctaccttgcccattctcacatgaatttcccaggcaataatctgagacaaagtttctgaaacttatcattggcattaatatatgtaattatgtgtccttttagtttttataaccttatctcctacataatgaaacgtaggaacttgtagttggggaaggtatttagagttcttgatatcaccaacatggttgcagttgactactataatttcaataggctccctataatacctttattgcctatctgaaagggtcagattgtgaaatccttcaggacaaattcaaggtcttttacttgtctttttatctctctaaattataaaataatataccacttttttttttttttgagatgtagtttcactctttttgcccaggctggagtgcaatggcacgatctcggctcactgcaatctccacctcccaggttcaagcaattctcctacctcagcctcccaagtagctgggattacaggtatgtaccaccattccctgctaattttttgtatctagtagtgatggggcttcaccatattagacaggctgctctcaaactcctgacctcaggtgatccacctgcctcagcctttgaaagtgctgggattataggcatgtgccactatgcccagccaataatataccacttttaaagtgctaaatattttcttgcttagtttcattcctagtcacaatttattctttatgggaaatgttcaatatggacttaatcaaagcccctatttttccttcaaataatgccctttaaaaagtgcctcatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaagtgcctcattctcattttacgcctaaagaaaatataatggttagcaaatataggtcctttggtaaacttaaaaatgaatatatttttttcaaaatgcaaaagaaaaaactgcacctaaacttgtccagaagcatcagttaaacaaaagcagtcaacagcctccagcttccattgtaaatgaactttgtaataggctgcttacctgtttttgtggttagaaacattactgaacagcatgaggtcctgtattataatgtggttgaagaaaaaagcattccaatataagctttgaaattgtttgcttatagaaatccagaccaatggtaaaaattagtgttttggatattgccaacattttactccttgatacacttataaagctccttcctctaaagggatttggctttgatggactattaactaaggacacatggtatctgaagtgataaagacaaattagatttattttcttgctcccttatgaaagtcttgaaatctattattattttcaatggaaggcttatttaaatgatgtttctggtggtttttattatatataaacttttttatttttgctttgatgtagctaagatattacagacttcacttagaatatgatgaaaggaaggttagggttacaaaattgaaacctcacaagaccactgtcttagatcaaagacttcagctgaaaataatgggctgggttctgataattcattcttacaaaggagtacacttttatccaacccaggctacattataatgtttctttgccgtataatgtaactaggcaggtaatagcactgaaagactttttaataaccttattgtctcctaatcttaatatctttagtaagagtgagaagctataaaaatagtaaaatatgtgatgtataattttaagagggatagtaacatactcttcttataaaaagtttaatgcttaagataagtaatgatttcaatatgagcattatgtaaattatatttatacacatgtctaagtatgtttgcaaatatatcatacatatatacatatatatgtgtgtgtgtgcacatgtatacacacacattacccagagcacacaaccattcataataatgccacatttaactggcaatcacttaggtgttataaagactactgagaatgtggaaataaacaaaacagcacctgaacattacaaatcaattacgtaaaacactttcatttaagattgtgaatattatttgtaggaacattctacattcccatgtttggttatctaatttttctgtcctcaggttaaaatattctgattctgagtttagctagaaggagtaacagtgtcaaaagcaagacattgtcaattgatatctgcatacatgcaaatatgtagcacatttatacacacatcaggtttgtttattaagtgtataacaaatgactttctctctttaactgatactgaaggcatccctatattaaaagcccaagataaaattggtcatagcaatgatatatgaaatccttcaatgattttatacaattagcttttgaaagtaaaatatgtgtatgctatactgaagaataacacatttacacaaatattttttaaactgaagcatatatatatatagatatagatatatagatatagatatagtctacctatctgaaatgtttactttaggccttgagaaagagaatatatttattctaaacctatttttttaataattaaattggtatcataacacacaccttgttataaaaactatatgattaagagaataagacaagccacagggtggaagaaacatttgcacaagatatagctgataaaaaactgttatccaaaatatgcaaagaactcttcaaactcaacaataagaaaacaatctgattaaaaaatgctcaaggctgggtgccatggctcatgcctgtaatcccaacacttcgggaggtcaaggtgggcagatcacctgaggtcaggagttcaagactattctgaccaatatggtgaaaccccgtctgtactaaaatacaaaaattagctgggcgtggtggcatgtgtttgtggtcccagctacacaggaggctaagacaggagaattgcttgaacccaggaggcagaggttgcagtgagccgaaattgcatcactgcactccagcctgggtgataaaatgagactccatctcaaagggaaaaccaaaccaaaccaaaccaaaccaaaccaaaccaaaccaagccaaaccaaaccaaaccaaaccggaaaaacaccttaaaagatctgaacacacatctcaccataaaataaatgaaaagagctgggtgcggtggctcacaactgtaatccccgcactttgggaggcagaggcgggcagatcacctgaggtcaggagtttgagaccaacctggccagtatggtgaaaccccatgtctactaaaaatgcaaaaattagctgggcgtggtgggaggtgcctgtaatccgagatactcaggagactgaggtaggagaattgcttaaacccaggagacggaggttgcagtgaaccgagattgcaccatcgctctccagcgggggcaacacagtgagactccatctcaaaaaaataaaatgaataaataatggaagataagcatatgaaaagttgctcaacatcatatgacattaagaaagtgaaaattaaaacaatgcggtaccactacgatctattcccatggggaaaatccaaaacactgacaacattaaattatggtaaggatgtggaacaacagaaattatcatttatttccagtgggaatccaaaatgatacagccattttggaagatagtttgacagtttcttataaaattaaacatacacctaccatacgttcacattctttagtatttaccaaaatgcgttgaaaacttatgtccacataaaatcctacacagatgcttaggggagctttattgacaattgtcaaaacttggaaactccaagatgtccttcagtaggtaaatgtacaaatacactgatacatccagacaatagaatattattcagtgctaaaaagaaatgatctcctaagccatgaaagaaatgtaggaaaattaaatacatatcactaagagaaagaagctgatcttaaagggctacatactgcatgattccaattacatgaaattctaaaaaataataaataaataaaggcaatactattgatatatttaaaagatccatgattgccaggttagggagcagtgcagaggaataggtagaacatggaggatttttagggtgatgaaacagtctgtatgatactataatggtggatacatcattaaaatttgctcaaacctatagaagatgcagcaagagtgaatcctaatgtgaactatgaactctgagtgataataatgtgttgacataggttcatcaattgtaacaaatgtacttctctggtgggggatgttgatagtgggaaaggttgtaggtgaataggaaaagatatatatatatatatacataggaacactgtaatttcctcttgatttctctgtgaacctacaactgctctaaaaatgtaaagtctacatatttacaaaaaaactaaatgagaagacaaaagtatgcaagagtttagcatcatgtttgatgtgtagtatgcactcaataaataacaaccacttgaatagttaataatgttaaatcccaaacacctagcagagagtctcacacacaatatgtacttggaaaatatttttactaagtgaatgaataaaacattggatcctccacctgtgtcatgtcaaaagaaacataataaaatgaaataaagtttataaattttatagtaaaaaattgagacaaattatctatggtttcaagatacaccgtgaaatactatgcagccataaaaaaaaaggtcatgtcctttgcagggacatggatgaaactggaaaccaccattctcagcaaagttacacaagaagaaaaaaacaaacaccacatattctcactcataagtgggagttgaacagtgagaacgcatggacacagggaggagaacatcacacaccgggggcctgtcgagggttgggaggtggggtgggatagcattaggagaaatacctaatgtaaatgacgagttgatgagtgcagcaaaccaacatggcacaggtatacctatgtaacaaacatgcacgttgtgcatatgtaccccagaacttgaaatataataatagtgaaaaataaataagtaaaaaagaaaaagaaaataatcatggctaaatgttgtttatgaccgaatctttgtttttattattggcagaatttttttaaaagaatacaagattgaagaaatataaagcattctttgacataggacccacaaggcttgccacatgggggcaaaccaattgtacatcgtccttcctttgatggtggtctatgccatatgctttagagtaacacaaatggacaaaacctccataagtacctagttgaggagtgcaatataaaacagtgagattttccccccgacctaaagagaggatgggtcccaatggcccttacatatttaattcagccaagtggaactcatttgacttttatgcttaattttgagttttatgtttagtttctttttgtgaatttcgctaaaatatttgcctccatatgtcttccagcggtatcttttgcaaagtcacaatgattcttctatgtattacaggtgctgttttattttttttatttaatgagagtaatgtcagcattatctaaatggagaattgagtatgatggttttcatcattgatataatcaaaagtcagatgtaccaggaaactaaaactctgatggtaaaatcattcattatccaattgctctggaagaacaaagaggatatactaggttgtttttggtgaaaatttaaacatcatttcgccttatatcctacccatttatctcccgaactgggttggctgtttctttaccctaaaaggacttcacatttagtacttataatgtattaaaattgactcttcattttctctcaaacttgactagaaatttcctaaaaggaaagatttccttctttactgtttttccgaacatctagtacaatgaatgacatgtagtaggagtttgataactgtttgtaaagctagagttcatacttgggaagcagcctcgatctctccaagaagatcacttgtgagatcccttcattgttcagacagatctggttcttttattggcagagaaggttatatgctatgaaaattctggtcacttctttctgaaaaatgccaccattcaagagtcattaagtagcttaagatattttatcctggtcattatcactagtactcttaatacggccggcactgctgggaaatctttattgagatcttattccgtgttaggtactgtgctttataagcattatcttatttaattgtcacaacaattcttggtgcttgttattattgcttatattgaacattgaagcccaggcttactgaggtaataagagttagagcctagatttaaatctggcagtttgattcaagagttagaaagcaatcacatttcaaagaagtagaacacaaactatcaaaacattctactatgtgaatgtgattataattattttttatctaaaagccaggcaggactttggaaagatgagaatgaaagaaaagaggtgaagatataattacaggatacataaaaacagttgcttttttattaaattgatcactaaactatatattagtattcaacttgcaattcattagttacaagtgaggtggaatatcacttcatgcttcctatgtttttatttaatatgtttcaaattttccctaaaaattttacatatgtgtagcttaaagattcaaatcattgtacaagaattatttccacaggcagttgttttatatggcctccaattctttatctgaatatttgagagagaaaaaatttcaacaaataaatgtttcaatgttttcaaagtaaaattatgttgccaggtgaaattataatatagtggctattaacctttgttgcttattatactgggggcttttggaaaccttaacgccagggctatacatcaaatcaattaagtcagaatctctggacataggactcaggtgttagtattttttttaaacccctgggcattccaaagttgagaattactgttacagaaccatttggaatagttaatgatatacaaaataccctgaaaaaaagcttttccctagcagtaacagctagagcttcagctgtcaatgaaaaaataaatagtacaataaaaagtcactaaaagggaaaattattactaccagtcattgctatttgcattcctaaaaggtgattcaatctcatcacaagcaaacaaatattttgtagttgtactcacaaccattgaaaattgggacgttcccaataaactaaaagcagaagataaacagaacaggaataacctattctactttggagatgaggatacctaaaataagttttcaaggtgaggaagcaactttatagtccttttcataaatatacagtgctcatgattacatatattactctcttctgggctgtaaatgaatttcccttgtataatacatagtcacaaataccacttaaaacacaatatatttatttttaacatactttatttaaattaacatagactggtatatgccttttttgtttgtaaagctattggcctaatttttatatgctaacagtatttttgcacttcaaaaatttcatgtaattcccccgtggtcaaaagataaatgagagcagataaagaaacacctgggcatataagattttggatattattttaggtgacatcggaagcctttggaggttgagagtggaggactgacatggcttgatttacacattaacagaacatctcctctgtgaagaatagactatagggaggtaagggggcaagcaagaggacaggttaaagagttatttcagctaccttattttagctacagccaagtatgagatgttggtggccctgggtcagtgagtagtagagatgctttgagtgatgggatcttgaatatagtttaatagataatatttttcaagacatagatgtgggttatacttgggatataggatgtagaaaagaggagtcaaagtaaatatgtaactctatcacaagttatttgtgttcagaaactgagagttgccctaatatgattattaagtaggcatttttgaaattttaatttcttgatttgtctcaccaatgatgatcactttctcaggattttgaagaaactcacagttcttgtagttcagatatgcatatataacataaacaaagtgatttctagtgatttcctttgcctttattccaacatatacacagattatgcatagaaaattaatcttgcaacaactcaaataacctcataagttatttagctccttctcattattataaactcagagcctgaatcactggaaagctacgctgccaccaatgccaggattcatgactttgtcattgtgtcacgtttcagcagtgactttcaataaccagaagttgtgaagatgttaggcagcttcatatggaaataacgctttattcaggtaatgatctaaatgtccattttttgttactaataaaccaccacgtaactttccataaagaaatgaaacttcctacttcagaaaaacactattctattaatttttctctatgtgggggtctaaattaaatatgaaacctgtgccatatatttccaatgagaggctatgcaaattttctataaatattcaaggtggacctgtcccttcctcatttctctacattccattttctaattaagactcgattttcaataaataaaaactaattatatgaaaatactggccactaccccaaaagtaatatcttaacaatcagtgcttcagatgaattaaactaactgtatatttttttaaattgctaaactagattcagttcatctctttcttaaatgttttcaaatcatatcttttgaatgtttcaacctagaagcatcttcatgttgctgccatttaacattatattaaactatggtatcgttggacaataattgctaccatttaacaattatgctaaactatggtatcattagacaatatagaatacttatgacttactctacctatacagaattttcatatatgctgtttatatttgtctttccatcactgcaagcttcataaaaacaaacaaacaaaaaagtatgtctaatttgtttgccactattcaactagggtcttgcaaatagcactaggtttgacatacaacatgattcgaagaagatggtgatgtaagatgtttacattttagtcatctaagaaaataaaggaagaaagagaaggaaaaagggagataacttgaagaggaggagggctggaagagaaaaagaccttgtgtaaataaggagatttgagtgcttgtttcagcccagatattaaacagttaagttattttgaagcaagtgctactctggtggaacagtgaatttaatcatctgaactctgaagttctttccagattttatacttcttaaccttaatttgcaatataggtacatatgcaccaaacacatgtatgatatatatgattcctgatacaatttaaagtatatcaatgccaagttttataaaagtattcaaatactatatgagaaattacaagatagcattcttctcattgagagtaaagaactgtgtaattcttaacactccatacagttacaaaatatcttgagagcttggaaggcagtctcagttccagtatttacctacagtattacagaacctgctactataaagtatcataacaaaaccattacctaattgttctgggagtgacattcaactctatatgtagtagaaaaagaaaattgttcaaatgtataccttaggtagttaacttggaaaactgcacttgcatttcctgaaggaatgtaatcatgatcatttcatttgtgccacataactgctataacagcaagacgctttttcttaagagaacacatttgtgccataaataagcaataatgtatagagaaaaccatcagcaaggatatgaaagctgagttttgctatggcattccttattattttatgacatttgaagcaatagagttttttccttctgttaagaaatctgaatagtatcaacatgaaaaggctaagaaaacattttctattaatacttcgatagattctatatgtaggggaaatgtgctcagtacaaagtaagattcctaaaagacaaagtaatatttctaaaaataactagacaacacatatctactgaaggcttgtccgtttttagaattacataaattaatccagaaatgggattgctataaggcattaaaaccacatgtatcttagtgtctttcacatgatgctcatgttattctgccttgttttattgctgtgtactagtttgattccctgatagattgtacagtatttgagaataaagtttgttttcactgcagttcttaacaatttatgaatctgatacagtttaatggaggcatcagttgggctcactatttttctttatgcataagtttatttaaataatattttgaacataaactgacattatgattcctatctaattttgagatacataaatagcaaaatttcatttgatgtgaaaaaatcacaagctgttatgtgtgtgtttatatgcatgtagatattatagttagcaattttttgataatcaaaaactcagaattaaaattaaatgtcagaataggtttatctcataggtcttttaatctccacattactcagtagtcatggaaagaaaatacaacttatttttaaataggattatataattgtactgattaatatatagaagtaaaaaataaccattgtaaatatctatatttatatgaaatcactagttatatcaataaacttaatttcaaagaaatactaaagaaatatataattcaatataatttttaaaaagtgactacagtatcttcataagatggttttaacacagaattcaacccagattggtagaaaaaaattatccacttcacttttttgtctgtcttctcattggtagctcaatcataagctaagcagaattccatccctaacaaattccatccctatcaaactcccataatagtgaacaatgtcaccatctaacttgttgctcaatttaaaaacttgagcgtcatcactgacaactctctctccttccgcttcatatccaaatgatcactaacacctgaatttgatctttatttaaactttcacttatttattggcaaaattacatagaacttcacacagctgtattaagtgatatatacctaaatatatgtatataatatatggcatgttattctgatagttttaacagctgtaacagttgattaattttacactttggaatgtcaaaagcaaagttgtatgtgaaaaattaatcttattactagtgtactagtgtggtagctggatttgaatagtttttaagataaagttttagaaactctttcacatagaaattcatcctatataacatattacaatgaaggagaacttatgttttaagttactttggattatgttcactgatacattaggttttaaatagactgtatcaatatctacatatacaaacatttacactcctgtgtaaaaaaaaaaaaaaaaaaagaagttatgactctagggagaagaagagctatgagttacacgtaaagagtcccttacacagcctggctttaaaattaaaattaaaaaaataaataaaaaccaggtatgggttctgactatttatatagtgattattgatagtgataaccatctatgaacttaataactgctattagtgaataacttgataaaatatatttaaaaagaagaaagcttttctaacgcatagggcaaaaaagatcaacttctaatactgcttcagcctttgttaagaatcacttctcttctcatacattaactacatttatgaactatgctagaattcaatggtcgtaagaaaccagatctgacatatctgcccggacatgcaattagatcagctctttttccattttaatcctaatacaagagtttctaatttaagcattcaaactaaatggaaacctctaaggtctgtcagtttcatccacaaagctcttttgttagacagttccatcaaaagttagacaattcattttactaggaaaagaactgatcagtagaagaataaattgtatccttaatgcatggacagatcactggattactgttaaagtattattacttaagcagaatctccttttgaaggagtcttgcagtccatgtcataaactgattaaaaatcagtgaatgagtactttctacctttgttgtatgttaatgagaaagcctctatcccagaaagcttttctggaagctggtaacctttagcttcctgaaactagagcatattagagctatgcaagcacaaaagttctaatcaccagttcctagaacagaaacttgtattttaaaatataatttatttcattgaatgaaaactttttatatttgattaccagccttcatactcatattattatatgtcaacaaataatgaaatcatgtcactcttcatatgtgtatatttgtttgtattaaggagaatgatacataagaaagagtattttatgtgtgcatctatgtgtgtatgtggggagagagagaggggtgaggaataattactcagaaagtactagctatagaaaatagtcttctgactcagaacggcaaagagccaactttcttgtaacgaataaaaccttagaatggtccatttaaaaaccacaaataattgatgtaaatagaaacacggcataaatacaaagcatttattagtattttcatttaatctcgtttgagctgtatacacttagaaaagtggcttaaaaagattgcatcagagtatttttaaaggacaaaatagatgttttttatttaatatcaaaacttataaatgctcactgtgatagaatatagaagaaagaaaactaaaatttattagatacttaactatgttctggctttctgaccttctgacatatgtgagatcctaattattcagttaagaaaactgaggttctatctagtaaatatcttactcagagtcccccagttacagaatgggacgaggattcaaatttaggtctgtggaatttcgaggttcattctctctcagctgtgtctccaccttccacatgtaagatactcagaatagttctatttgaatttatttatatccttttttcctagcccacattaatgatattaatgtaaaagtgaagtcttcaaaatgagattgatgttttaacgtaacactcccttcacagtactgaggtaaactaagaaatttgtttggcaaaattccagggagcacatttctgagaatttaattggtaatttgattgaagtgacataccatatttcaaatgtttattttttactggtttgaataaccaaagaatgtatataaagtccagaaagaggaaaggaataaattataaagatatgaaagtcctttatctttccagtttgaaataagtgttctgcatacaaaaataaaatgttgtcatcaataagttgatgtaagttttctggagttattcggtaactatccacatatcaagttgtatacccataaacccccaaaattctacctaggccttaatacagatgaagtatatatgtattaaagcaactgaaactttatttatagcactaaaacaggaaatgattaatgcctattggtgagggattggttaattaaaacattaaacatttatacactggtatcctgtacagtaattcaaaaggatgagtaggactatattttattgacatgtaaagatgtctatgatatattgtttattttaaaaagtagtatcaaaaataaacagtaaaaaaattatgatcttatttgtataacttgcaaaatttgtctatctttcgtagaggagaatgttcaacttctaagatctcacctctctctggtgggagtttgtgtggcttttactttctcctttgtgtttaaaagttacacacagctcaattttaccaaaacaatgacaaaacttacaaacaataataaaacaataatcatcatcatggcatgtgtctttgaagtcattgacctcatatttaataagttggcaaattgtatcgattcaatctctatgtcttatttttggcttctactgttctacctaaggtctttactttcaactgtcttgtggcagtagttcctttattgttgcatctagtttctcattccccttcaatgagttccacacattctaaaactgaaatctaaaaccaaaaatgtgtttaatgtcataataatctatcaactctaaggataattttagggtaaatatcacatttttcttctactccttttttcccttaatgctttacctcgctttttatggatacattgttgtatttaatgcaaaagccttgagtttgggttataggaactactgatgagtgttttttgtaacattattaaaaatagactaaagtcatcgtttctctttaaatatattacttggttaccctcaaagtgcaaacataaaaggatacaaatttgttagccagtctttaaggtggcttcacaatctgattcctgtatagctttatatcttctttactctcttttctaccacgtgctttgtttattactgattactcatggctgtgacccccaacccaaccaactttcatcctgttttcttaggctgatacttcttacagcagtgcaatcatttccacctctatcaaagctccaaatattaccataccttgctcaaattctattatttccccaagccttatgagatcttcccattcatcatttacccctctcatcctcactttccaactagatgttttaattttcttatagtgctcaactactgaataggcctatgcgtattgtgatcacagccagcaaaactgtctctccatcagtcactggtttgcccgaaagtcataaaatagtttatgttcattcattttacaaattatacagcagtaaaaacggtaaggaagtattatttaaattatgtgtagtagcattttctaccccttagaagctggctctaaccctaaaagtgaattcatttaagcacacagggatttctagaggtgatctgagtgctgacagtgatggccaactcatctagaaactagacaatcatccagtttggattagctgcaacatactgctgaatgtttagagaactggtcaccaagcattagcgtacctctgaatcatttgtggtgcttggcagaaggcaggttttcagattgatgtccagaaacatttattcagaggtctgtagggtaggacagggaagcagtaatctgcattttgtcaagcatccttggtgaccttgccacaaatggtctggggtggagagctcccactttgtaaaacattctcttagcaatggaacaattacagatatttctaaataaagacttatgagctgcaaagattattggaacaacctgcagtaaaataaaattcttgtgaaaatggacagattatcatccattttcaaattcaaaatcagagctaaaatcatagattgccctcatcccacccaaactcaactgatggtttgttaaagttaaaacaaaatgatctccacgtatcatctgaataagaagccaccaggtctcactcatgaaaagtggaagaaactcttataacaataactgattataagcacaaccgataaaacgaaatcattctactgtcaattttcccccttatgcaacactattgaataaccatctggacccgacaatttatttcctgaatggtcttcagcaagtcttcgcatttcctctccagaaataaaaaatttcaaaggattttgcttatttggggaaatttttgctaactgcagtcttcaaagtctaaattaggcctgatttggttaccctgagacatacaacattagaatatattgtattaatccttaaatgccttaattactactgcctttttagtacattgttgattttttcttctaaacagatccaattaagttttgattggccattttttttcccactgaaattataaactaactcttaacttctttgctcataatagatttgttcattcagcataaagagaaattcagttgtattaatcacttaagccataaacttgcccctggcatttgttaacattctaaagctacttttacctatttatttttattattactttgcgtactcttaattagttcagctaactgattttcgtttcatctttaattgatatcattttaaaaattcaggacactggtgttcataatcattcttataaaactgtcttaattttctcctgcatctcacaccacagtattttgggaaaaactgcactccgtgaggcagagtggtctcctattgaccaatcctgaactttagtgttgaatgaaattttgattcatatgtttctttaactcagctcttgattagctactgtagtgggaaaaaaaagtgaaacagtaaattaatagcagattgtttctacaatggcaacaaagggtaattttttttggcttaaataatctctttattctaaaaaagattttctagttctactttttttattattatcattatactttaagttttagggtacatgtgcatcccattactgggtatatacccaaaggattataaatcatgctgctataaagacacatgcacaactatgtttattgcagcactattcacaagagcaaagacttggaacaaagggtaattttaacctctacagttggcgagatacacaaggaacacaacagatagagattctattagtatgactgatagtagcatcttgttcctgattggtatggaattagttctggaccaaacgtaggtaatctaatttctatcactaggaaattgatattattgaaagaaggagaccaaaagatcaaagtggtgcatcaagtagagttctaaaaacaatttgtgagtgctttagaaggaataaagaccatttttaaagtaccacattaaacacattttgaaaattgatacttcttatgtgtgagtgtttgaagtattgaaaaatgatgtttttaaacttgttaaaaatatcagatttattgtactattccaaataaattataacagttaaaaatctatatatttgtctttaatgaatacatttatgagtcagaaactaaattttcatataatctggccagtttgaataacttcattgttcttcaacatcatttttataattcaaaagtccccatataaaaatgtttaaatataaacctttatgagaatattgaggatcatgtatatacatattaaaattatcagcaaatttagatagtgactatacaaatgtcaatgattatagccatgtgtccataaagatatgcttagcacccaatgacatcaacgactgtaaagttattaattcatttaccatatccctttacaaatgttctaattgcccctcaatatcttttagcttccttttttagcattttatcagatacaatgagaaagagggagagatcttaaaactttaatcagctaacagtaaattggagtaatatttggcagataattagtaatttgtaaaatttgtaaaattagcaattagtaattagtaatttgtaatttctgttgaacaaagagtaaatataagacaccataaaaattgtgtttaatgtagaagcaacaagaccagggaagctgaggggaatgatatggtttggctgtgtccccacccaaatctcatctttgaacttgagagagatgatttatggtatctggcagaagtaatttccaagcagcaaagcattcaagaggtgacttgggtgccattaaaggcttttagttttgtaaggggagcagagcataaaagttaagaaaatttccagcctggcaaagtgatagaaaagaaacacccattttctgaggagaaattcaagctggcttcagaaattcacacaagtaacaaggaaccaaatgttaatccccaagacaataagggaaaacggaaaatgtctctagggaatattagaggtcttcatggcagcccctcccatcacaggcctagatgcttaggagaaaatggttctgtgggcctggcccagtgtcctggtgctgtgtgcagcttagagacttggtgccctgcgtcccagctgtgcctgccatggctgaaagtggccaacatagagctcaggctgtggcttcagaggttgcaggcctcaagccttgacagcttccacatggtgttgagcctgcgggtgcacagaagtcaagaactggggtttgggaacatccacctagatttcagaagatatatggaaatgcctggatgcccaggcagaagtttgttgcaggggcagtgcactcatggagaactctgttagggctgtgaggaaaggaaatgtggggttggagatccccacagagtctctactcgtagtggagtagtaagaagagtaagaagagtctctattccctagtggagctgtaagaagagggccaccatactccagatccaccaacagcttgcaccattcacctggaaaaaccacagacactcaatgccagctcatgaaagcagctgggagggaaactgtaccctacaaagccacaggagtggagctgcccaagaccatgggaagccacctcttgcatacagtgacctggatgtaagaccaggagtcaaaggagatcattttggagctttaaaatttgactgctctgctggatttcagacttgcatgggccctgtaacccctttgttttggccaatgtctcccacttggaatggctatagttacccaatacctgtattcccattgtatctgggaagtaactagcttgctttggattttacaggctcataggcagaagggatttgtcttgtctcaaatgagactacggactgtggacttttaggttaatgctgaaatgagttaagtctttgggggactgttggggaggcataattggttttgaaatgtgaggactgagatttggaggggccaggggcagaatgacatggtttggctgtgtcccccacaaaatctcttcttgaattgtactcctataatttccacatcttgtgggagggacccagtgggagataatttgaatcgtgagggcagtttcccccatactgttctcatggtagtgaataaatctcacaagatctgatggtttcataaggggtttgcacttttgcatcttcctcattttctgttgccaccaccgccatgtcagaagtgcctttcacctcccgccatgattctaaggcctcccagccatgtagaactgtaagtctaattaaaactctttttcttcccagtctcaggtatgtctttatcagcagcatgaaaatggactaatacaggggaagacttacatttgccacaaacattcctgtataaacatccaaaccaaagaagactatcattagggggttgttatgagatgtgatgagaagaataaaaattgctactgtacattaaaacatcacaacttgtcagggatgcatttgagagaatgaggcaacctttatagtcactgtatctgctgtgagaaatgaatcacattgaactaatcactatagtaggggcaatgcatttattaaggagtctgcagcataaagcaagaagaatattattttttcactatgtaaagaaaacaggtataattctatatgattccatattaaaaccacaatataattttctgaaaacagtaaatttttagcaaattctatcatctaaagactatttttaataaattggaaaatattgatgtatggtttatgatgggcaaaaaataaaaataaattacctatatagcagaatggctataatgatattattatctacatttaggtattggttattatgtgcctgctgctgttttgagtatcttatttgatatcaactaatgtaataatcaaaacaatcctataaaaatacatgattacttattttacctatgaagcacagaagcccagcaaagttagtagcttgccaaatatcacagagctaatacatggtagagatggaattcccaaccaatttaaccttaaagctcatgatctgaacatttgtacttagctacttcacatagagaatgagatttgaagtaaatttttgagctctatctactgatccatctatttatcatcaatttattctctacagaaatcctgacagggagttattatccacccagtttcactactgagaaaacaaaagctacaaaaaaaaattagtgatgtatgactgtatagctagtaaaagtaatctagacatacgacctaaatctgcatatttctaatgcctgaaaatggaaataaaaacagtataaaagtgctaaagaagtatatgtagatggtaaaatgcatgcattaatgcatttgtattcatttcctgacattggtatttgactctagcgtaaatctgttataaaatccctgttaactaagagacagacacatagaccttgattataacgtatacaaattaaaatataaaaatacagacaaattaccaatgctgcagaagtctgttaatagtgattcaagggacacttcactaggctgacaaacaggtacaaattttgaagttaattctagggaattgtgcaatattaccctttttatcacacattttcaaaatcctgttaataatctttaagaatttttaaaactcctaatagcccaattgtttatgtgttgatttctttccctattaattttcattattccaccattgaactatcagctacaggaagaaaaagaccatgtctgtttcattcaccatgatatacttgtagcctatactgttaactcagagaaactactcaaatatatttgttaatgaataattatgctcaaattattagatagaactctggaaaaaaaggataaacttcccatagtaagaaatgtaactcttgaaataaaaatttcaatgaatggttagattaatcccactgtagacacagtaaaagaaagaaaaatagcaaactgggaaatatttctgaagaaattacccaaaaagaaaagatgaacactacaaattgagtttaagcattaaggactcttgatatattgagaatagatgaatgaaaaataatatttgataagataactaaaaatatttctgtatcaatgaaaattaaaaatctatagatacaggaatcaaaacctatattgagaagacaatttagaaaaaaaaaagcatacctggatacactgtaataaaacttcaatggtagaaatacagaaaccccaaaaagatcaggaaagacagattacatataaggaaaaatgagtgggctgacagcataccaaaagatgtaacaattaaaccccaaagacaataatatatcatacttaaagtactcgatagaagtaactcccaatatagaacactatactttccaaaactatctttcaagaaaaatgatgaaataatgacatttacagataagcaaacagtgggaaagtttagtctcccagatcttgttggagtaacagctacaggaggaagagagaaaataatacaagaaagatagtctgaactacaaataagcaaaattcataaatatgtagataaatactgtctgtgtaaaatagtatatttgatttggggagttaaaaatgaacaaaagtaaaaactaaaatataaacaaaagtagtaaataaatggtaatggagctgataggcattgttcaggtattttaggtattgatactgtttacaaggatggcttataatattaactttaaactttgcaatgtatatttccacaagtacatacaaccaccatcaaagaatcaaagtaggttacaggactattaccttctccgtgataaagtgcaacaatgaaagatgggaacaacaacattaaattgaaagaaaaaaagaaaaaatggaagagaaaaaacatatagaatatttgaaaaattaaaatgtagtcatatattaataatcccaacatatgttaataaaccagctgaaagacaagaagtgtttagttgatttttaaaaattaaatatgctatgtaagacacgttcatatactataagaaaagagaaagattaaaactacaggacagcaaaaaataaacaagccaaatacataccttgaaatgctaactaagcgaattatattaatcttaggcaaaatcagcattttgataaaaagatcgttagggtaataaaatgtcactacattatgataaaatatttgatttactgggaagatgtacaattctcaacatatatttcaaataaaaagattttgatacatataaagtaaaagcattctttatgtcactggtagctggtgttgagcaaggaagaggattgtgaagttaatcacaatagtgagaaatatgaacatgactccctcaaatggtgaacaaaaagacaaaaaaaagtagtttaagtatagaaggttagaaataacaagcctgattattggacagataggatacatagaattctagataacaactaaagaatgaattcttctcatgtcaagatcatattcaaaatttataaaacctctagcacatggaacaagtctaacatatttaagagatttttgacaaacacaatctgatggcaattacattcaaagtcaattatgaaagagaaacaaacaatctgtatacgtttaaatactccaaagtatctcatgtgtccttagagaaaccattttaaaaacattttgaacttaatgatttaaagtttttgtttgtatcaaaatctgtagatgcagtaaaaggactttcagagtaatatatattcttaaatgctcataataaaaatatgaagaatgcctaaaaattaatcaactaatatctcatccaggaatttggagaataaacattagaacaattctaaagaaataaatagaaaacaataatacagagaagatcaacaaaattaaaagcaaattgtttaaaaatatgataaatacaagaaattataaaaaataaaaaggtcagattttaaaagagactacaaatacttagtactgcatttttataggacagtcatatacattcaaagtagattaaaataacattttaaagcaatataaaaatttaatccaataatttgaaaacagatgaaaaaataaagtaataaaattctatgaaattagcaccagaggaaacagaaaaatctgaaatgcactgtaaagaaaataggtccaccaaaatgcttgtattggtgagttctatcacaatacaaagattcttctgggtattttaaaagcgtcccaattcattcagtaaaatcaatctaactttaatataaaaacatcgacctaatcttaatataaaaacaggcaaaaatagtatgagaggaaaaagttatacccaatctctgtcagcatcattgatgtaaaaattccaatcaaaatattaaccaactatacccaacaatgtttcaaaaatgctaagactgagtttgatttaccacatattgcaagggttctgtagcactaaaaaaatacaaatatcatttatcacatgaacagattaagtaataaaatgtacataattatctcaaaatatattctaaaagaattttgtgtaatccagtttttgtaagtttttttaatgttggttttttattatactttaagttttagggtacatgtgcacaacgtgcaggttagttacgtatgtatacatgtgccatgttggtgtgccgcacccagtaactcgtcatttaacgttaggtgtatctcctaatgctatccctccaccctccccccaccccacaacaggccccagtgtgtgatgttccccttcctgtgtccatgtgttctcattgttcaattcccacctatgagggagaacatgcggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctaccattgatggacatttggcttggttccaagtctttgttattgtgaatagtgctgcaataaacatacatgtgcatgtgtctttatagcatcatgatttataatcctttgggtatatacccagtaatgggatggctggatcaaatggtatttctagttctagatccctgaggaatcgccacactgacttccacaatggttgaactagtttacagtcccaccaacgtgtaaaagtgttcctatttctccacatcctctccagcacctgttgtttcctgactttttaatgatcgccattttaactggtgtgagatggtatctcattgtggttttgatttgcatttctctgatggccagtgatgatgagcattttttcatgtgttttttggctgcatgaatgtcttcttttgagaagtgtctgttcatatccttcgcccacttgttgatggggttgtttgttttttttcttgtaaatttgtttgagttccttgtagattctggatattagccctttgtcagaagagtaggttgcaaaaattttctcccattttgtaggttgcctgttcactctgatggtagtttcttttgatgtgcagaagctctttagtttaattagatcccatttgtcaattttggcttttgttgccattgctttttggtgttttagacatgaagtccttgcccatgcctatgtcctgaatggtattgcctaggttgtcttccagggtttttatggttttaggtctaacatttaagtctttaatccatcttgagttaatttttgtataaggtgtaaggaagggatccagtttcagctttctacatatggctagccagttttcccagcaccatgatcaagtgggcttcatccctgggatgcaaggctggttcaacatatacaaatcaataaacgttttccagcatataaacagaaccaatgacaaaagccttatgattatctcaatagatgcagaaaaggcctttgacaaaattcaacaacacttcatgctaaaaactctcaataaattaggtattgatgggacgtatctcaaaataataagagctatctatgacaaacccacagccagtatcatactgaatggacaaaaactggaagcattccctttgaaaactggcacaagacagggatgccctctctcaccactcctattcaacatagtgttggaagttctggccagggctatcaggcaggagaaggaaataaagggcattcaattaggaaaagaggaagtcaaatcgtccctgtttgcagatgacatgattgtatatctagaaaaccctatcatctcagcccaaaatctccttaagttgataggcaagttcagcaaagtctcaggatacaaaatcaatgtgcaaaaatcacaagcgttcttacacaccaataacagacaaacagagagccaaatcatgagggaactcccattcacaattgcttcaaagagaataaaatacctaggaattcaacttacaagggatgtgaaggacctcttcaaggagaactacaaatcactgctcaaaaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaacaactactttaaagttcatatggaaccaaaaaagagtccacattgccaagacaatcttaagccaaaagaagaaagctggaggcatcatgctacctgacttcaaactatactacaaggctacagtaaccaaaacaacatggtactggtaccaaaacagagatatagaccaatggaacagaacaaagccctcagaaataatgccgcatatctacaaccatctgatctttgacaaacctgacaaaaacaagaaatggggaaacgattcccagtttatgtaatttttaagagctcctagaaaacttacacaataaaaaatccttcgtatttttattagatacctcaaagatatttaataaaaattatagtgaacatcattattaatagtgaactattacaagcatcatttggcaactttggtgactattcagggttctgtctcgccatgctccaaaagtaaaaagaccttatagaacaattagaagaaaaaaacaaaactctaaaaaaaaatagctctcagcataacaaggagtcagtctaaactttaagacaactgtatgtataaaaagaagaaaaactaccacattccagtgaatgatctctcacattcctgtcataaattttgtgatgatcaagggtagtcagagaaacactacaggcaaagggaagacaggatcaaagtggcagttcaaaaatcactctaaaactcatgccagaaaatgaagtccaccttgtgggaaaatattttaaaaaattaaatttagaaaatgaattttggtacatcagagtaataatgctagaaaagagggttaaatgcatacaatatatagaaattgtctttaaagcttattagggagtcaaaatttcaaaagaggagagagataccctttggtaattaggttgaaaaagggggaaaaaaaaaaaaacctagaagaaaatgaattcctaaaagacaaacaaccagaacaatctaaagatagcacaaacgtgccttatcttcttttactcttcctctctctctctctttctctctccctccttcccccactcccttcacacacaagcgctttgctacacacaaaagatggcaccattgatctagaaatgtcttaaactacaaataaattaatacatatgagatcagtaacattgttgaatatatagtcaatcaatccataaatataaagtaattacctatagaagaaacaaactgtcaaaaacctgaactttaaaaataaattagagaccatgtggcacctgatagaatgacggatccccctgtgaattaatcttgctgaaaaatcataattaaatggatcagtcctctgtgtttaaataataatttaccgaggaatgctttaaacagcatcacagaatgacaactgcaaatatcaactgtgggaacttttatgaagtagtcattaaacaaatatagaccaggtcaaagtagctgggtgccctagattctccaacttgttagcgattaacagagtcaaattttaaaaactaaaagatgtaagaaaggaaaataaccaaaatcatgaaggcctgatttgccaatgcaattgcatttcagtgactcaaagatgttttgattaaaaacaaattgaaggtgtagaaaatctgccaatcttcctagaaatctggagtctgtcaataattttcagaataaataacagcacattggagtaaaatagtgtgcttatacaaatagcaaaattaaaataagatatgcaaaactgccataagtgtatttgaatacttctcttgcttttgaatataatttgtttattcctgtagagaacaatattttaaaaataatatttctctttgaaattttctcaagataaatatggtatcagggaaacaatgaatactgctaagtttcacttactcttgacagttatatgtctcctaatagcttctcaaccttacagagatactttatttccagcaatcctgtcaaggtaatttttcatcacaactatttctccacttaaaatgataaaaaagcctttatctttggtaatctacaagaagataagtacattttctgatttgcaagaagaggatgtttcaaagctgggactccagtgaatctaattcatatttaaatatattgctttggaaaattagaaaataaaaagaaaagcttatttcggcatcatttgtggatcaagcccagaaattataagaaaacattttcaaaaattgctagaattctttctggtacttctaggtttaaaagttcataacacaaattcttttatcataatttgatgagccactattaatgagaaatagttttatattgtcccaaaagtgatatacttaacagaggtttatcacaaaattgttgaaacttaaagaaaggctaaggtaatatgaattggaaagaactattgagaatagctaactggacaccacctactactaaaatatagcttggaggtgtgattgcctaagtaccttgactccctcccaccatctcctcctaggattgagaggaggaagggatgcaacttcataactatttggggagtaactaacagaggaagaggagaaaagaaaaaaaaaattgctgcttgagctgattaactgcctgccagctatgcagaccatcctccctcctcttgtgggtgagctgaaggagcacatatcttttcttactgttatgagcattaatattgtggtaccctctcttgtttcttgctgccttaaaggcccacaagaatcaatcttcacgaatatatcactatatttttctcatttagttctttaatatgggacttggtaaaatttttcacacagagcagcagttggaaattgttattttattgcacttttcaaatttgtaatagagatttcaaaataagcatatgttagagtcaaataaatatttctaaaaaatggaaatactcaaagccaatttccattcacttgaatctgggataccttcttataaataatgtaatgaaaacatttatattttcaaagtatcttacactgaaacataatgttcttcctgaagtgtaagtgtagggtgcggagccctgtttccttggtggacagattgtttgtctcatcaactctgtgataaaatatggactcaactattatcttgaagtttaagacattaaaaatatctgaatggatatcattctcccttatttttcctctttcattatctcctctactattgagtctcctaacactctgagtaaatattggccccaagcaatatttgagtagcatcaaaacaaatgttatataaagatatgatcttgacacataagccctactgaaagtaatcccgtctaaacccagtatgaccccacctatcaggccccatcccctccccatgtgaccttttctcactttgatatctcttttaatcaggccatcttaaaagaagcaaacaccagattgcgtcccttctccttacatcttttatctccttgagagaaattaatctgttccatgttatccctgtgcagcaaacaggtcattttaataacagaaaattgaatgttgagactagcagttactttaattaaaaggtggtcactagagaattgatttcctagctggttgttgacttacaaacagaaaataattggcacataaacccagcagagggactctactcagaacatagaatctgttgacaagaagaaagtaataatgcaggaaaatcatttacatttatatagaagatgttatatttatgtctatttccagttattagcattctagagattaggaaagacatcaccttgaactttctcatcattacccactctctttctctgacaattgatgagcctgacaatctcgttaaactgccaactacataatttgcagaggctctaacttgccagcccctggaaaacagcaaagtgattgtttaacacaaacctggcactaatcttaatgaaaattttattttataagccagattgctagcatatccccctcctcgaagtctgcactagcttgaagcaacactgcaaagaagacagggacaggaataggtgatcttttaaggtttttcttacctggttttctctagtcctatagttatattggatcctctttcccattctaccaaagatacactatattttttattttctaatgactattcccatttttgccatctcctactgagaatgctcacattttctgtcaaagtcaggaggtgattctggctctgggtttcagagactttcaaggtttatttccaaagaacaagaagaaaatttgttgttgccattgttttatttatggtagggtagatcaatgcaagtgatagggtagatcaatgcaagtgtgggtccttatggaggaatgttggggaaagaaaagaaggtagggaagggagttaccagcttgggagctaagccttggaagtgcttagggagacagactgtccagtctctgtccaggtgttggtagagtacaccaggacatgctcagcagataaggaaattgtctggaggccaactattcttctttccagcaagaactttcctctccagcatgcaaaatcctttaagaaagtctgctaccagcacatagccacgtgactgttcagtccaaatactgcctatcagtactacagcatttttctcagttccacaaatactccaggacctcatatttacagggaaaaagagagttttctgggtctctaataaggtggtgatggggaatgccactggaaagagctttaactgatgaacaagatatgtacagtcattagtgatagcctctttaccttttgtaatataagctagatagacatattgggggttatagtataaaatcacagatattttgaaagataggggacttaaatataatgcttatggcaaggtcattaggctaaggttctagattctcttttgatgactattctttttcaacaaattggtggaaccatttggacgaataagttaggcagtccctgaaattatgacagttatattcaatgagttaagtgacctgttgttaattaagaagctgaacatgaagtattagtggttcccaattaaaggagggtgtgggaatattaccaggcactcaggggtaaattgattttctttggaagcctacatagggagtctactggcatcacagaactttgtcagctgaacagtatggtttgtggcacaagggtgagatttggagacagataccagcacctggtaaaacagactagtgaggagatataataatccaggaaaaataaacatcaaaaatcaaaagcaaagcaataaaatatgtacttttttccttcctataaaaacaattcaagaagcgacaatgcatataaagcataacatccctagtttgcttttggaaaggaaaaaggggactaataagaatttcaaagaaaaacacagaatgtcaactctgaagtaataagatttattggcatgctgcattttagtattagattttaataatcacattataataggaatccacaatgaaaactgaaaaagcacataaaaaggtaagaattcacctagtgttattaaaatagcattgtgagatataattatgtaatgtataattttatacataaaaaatcattttaacgaattgatatttataatcagagtggcatcttttttaagactttaagttagttcgggttctaacataccaactattctaattttatagtaattatatgactccagcaacccaagctggtagaagtaaatatgatcaacattcatgtccttgactgccaaaacacgctctgaaaatgacagtgagggcttctttgtagcctaaagaggattatgtagacctctagggaactgttttcacaattttaaaagcagtgaaggccagatactcgaatcattttgaagtggccacttacaccttgttcaacaaaaaggcagcctgaacacataagatcatattagacatgcttggttaaaaaaaaagaccttttaacattttatgtcactcaaggaatcatgttttatttcaaatagccaagaataatttaaaactaagcctttaagtaatctaaccttattcaacatacctttctggactagtcaccatgacactctaatatgtgagatgttattcttttctagcatccagatcctatcaatgttgggtgcattttcattaatattttactgaggcattttgaacaacagatgttaattttccagattagttcgactctaaaaacatctaacaccttacattctctatggcctcatttagatggtctttgtcaactcaatgcaattcaaagaaagactctacctaagatagttgcttattattttagctggtaattgagtaataatattaatacttgggaggagactgagtgggtaggcaggaacttccttcttaaatattcactaaatacataaaaggccttttttgttagcaatagacaaatttgttacaaattatttttataagcattgaaatacagcatttgtgtgtgtgtgtgtgtatgtgtgtgtgtgtggttttcttactctttttcttagatgggattattcgctctaattcaggcattccagaagtttgcggtctttagagcagtgcaaatgaatgattacagtcaaggaatttaaagtcacactacttagattccaatattttatctgtcatttattattgatccacagcatgttacttaagctctgtgttgtattaattttttcctatctaaaataagaatagattatacatcacagttgtgttaagaatcttatttcggttgatagcctgaagcccatgtccttagaacacagtcagcacttaagaattattatctatttttcagcataaaactttaaacttttacaggtgaatttttgaagaaaatatgaaagtataaatttaggtgtgtaatttcatccacatttttatttttaagaaagttgattaccatcccttcaacttagaagataaaatgtgaaaaataaaagtttctggctcatgagtacatacaatcattaaatgtgtggttatttttgtatagcatatatattatatatgcttattatatatatatatgtatccatagtttatagattttacgtaagaatgcaaatggaatccacatatatgcacatatacacttaaacatgtacttattaaaaacaagagtaggctcccaaatgcaagttcagtaaaagtttattacattttcaattgagagtaaaaatattttatttggaataaactattacttttacatttcatgatttaaatgctttcaagtgtctaacttttgtgttcctttagatatatatttgaacttaattttttctggcaatattttaaaacataaagaaaaataaatcttaacaaccaaatcaaaatattcagacaccctcattgaattaaagaaacaaggaaaagtatgttgcttgtctactagtagttagctaagctacagattagaattggctgctcttaagtaataagtcaccattacccagaaaaaaaaaaactttgaaaagtaaaccagaatattttagcagtaaaattttataggcagtttcaggatgacatttaatactatttgccaaatattctatttcttttttagtacttaaagctctacaactcttcattattatataccagtaactttgattcattcttctttctcaaaaaggaattactatagtttatattgtcttagctgaaatgataaaaatattatctcttaattttaaataaatatccaattttttggaagtattggtaactgaaaaaatcttcctgacaatctggaattcttagaagacattttggtgttttcaggagagcataagaaaatttaaggcagaaatatatattaagttatattttgggaagtttatttggagaactagatgctctatatctgttggatttttgttgttgctgttgttgaaataattttttttaattttcaaatgttacgtatataattttgtccttcttaaattttcattcattcagatgttgtaatactgtattctaccaattttactcctaccttgaaaattaatcctctcatatttgagatgtatgtatgaattattttttctaaaaattctatatttaaactcatttttttactgtgtattctgtatatcatttcaattacgcacttcaacaaatatttgctgatctgatatatattttccaagtcattcttattctatagacagacctacagtgattatctagaatagataatacattatataatattaataatttatagatcattattctatgtagatattatctattcacagataataatctatgctgacagaagtccaaacagtggtcacctttgtggtggctaataggaaggcagcaggagagagactttttacatttctacataaattttatctagaaattggtgttgatttggtaacaatttatcaaattctacccttaacatttgtgtactttatgtaatacatcaatgaatatttacaagttatatgcatataacatatacttacatataacaggtaatacattgtgtacatatatacagtgactatgcataaatataactataagcaaagagagatactcttagaagttatcatacttaactacattgagaccaaaatttgaactttgagagcaatgattcttagtcaacagacatatgctaacttcttccaatatgtctggcctgttgcttggtgctacaggaaacaaaaatgtataagacattgtccctgccttgccaaagacttctaccttattattacgttgtgagctcatttaatacaagttgtgcattattaatttctctatcccagcacctaacagtgtagtgttcaaaaaaggtattcagtaagtatataataaattaactcagtagaaggtgaggagagtgagccaaatgcataaacaaaacatatagatctacacagcacatcattaaccataaaggcacactcgtgagttcctaggaaacagggagaagctatgtttaaaaccttgagacatttgtctacccaatgttagaaaaatacagaccttgctaaaatgaagaaacaggatctactaaaataaaccttacacaggtgggagaaatatcttgcttagatgacaagataagtggagctccctttgtggaagccttcataagggaggttttatcctcttgagctgtttctcagggtttcctgatgggtaaacagccttggactgcctatgggaaactgattcccaaatgtcagacaccagttatgttttctctagtcctcaggaaactgaaaaatatagggagagcatagggcaatttcatattgttaaatgtacttacctaaaataactttttacatatgttactaacctgcacattgtgcacatgtaccctaaaacttaaagtataataataaaaaaagaaaaaaaaaagattatgcaatctttaacatgatattaaaatgccttctctatgccttctctgaaatcatgaaatcaagattctattttcattttattggtctcaattggtcaaaaacaaaatgttgataacaataagtagacctccttcaggtctacttatgagataattatatacatgtatgcacacacagatacattattatgggtgtgtgtgatattgtttggctctatgtccccacccaactcttatctcgaattgtaatcccaataagttaagggaagaacctggtgggaggtgattggatcatgggggcagtttcactcacgctgttttcataatagtgagggaattctcatgggatctgatgatttcaaacgtggcagtttcccctgcactctctttcctttctttctcctgctgccttgtgaagaagttgcctgcttctccctcaacttctgccacgactgtaagtttcctgaggcttcctcaaccatgtggaattgtgagtcaattaaacctcttttctttataaattccactcttgggcagtatctttatagcagtgtataaacggactaataacaatatatataagctggccttttaaaaccaaaatcctagaaatatttacaaaaactaatccaactaaataaggcacttcaatttaagaaaccatacaaaacgtgaactgagctctagcttttcatttatttgtttgtttggtgtttatgccaatgtacctaggaagacaagaatagaatttcctttggaccttgcaggattaggccccaatatgtatttggttccttcccctcaatgttttgttgttgctgctgttttgtctgggtaaatgagcctatgattaagatcaaaggctaactatggggtaacaggtatacaacagtcataaatagtagaaccctgcatacagataaagaaaatatgagtacgacaaagtttgcgtgagtgatgaggaaatgaagacaatgaatgcatatgaactgctggtcaacaggccagtgaggccactagtccattatcttgtatactctaatctcttaatattctatttcttctggagtggtgatatttctctaatttccttagatagactactctaccagtaatacaccttcttctgcaggtttttcacacattttaaatcttccaagttccagagatattttacccaggcatttaaaaaaaacaaagctaagggggtacttgtttttttttaaatgactgatgatatatcctgaatactaatagatggatatgtgaatggctagctaggtaaacagtagatatagatacatagatgtatacatacatacatataaacagactccagcatacaaaaacaacaaaattgcaattaatgttaaattaaatgtacacaaacttatcaatgagtaaagtgaaactcaactaaattcttatataatttaaagaatgtgagtgtttttatccttttctgtttgagtttcttatcaattgtataacgataaaaattatggttttagattccaatttcacgaccagagactacttatttagcttttctgctttactttcctcatttgtaaaatcagtaaaataattccacataaggtctctgtagactgagtgaaatatggtaacatcttcaaaagttctgtgttatgttaatcattccagaaataacagtctagaataaaatatggaattaatgtcaattaaatatatatgcattttactttttattgatatataagagatgcacatgtttcagggtttatgtaacttttgatgcatttatataacatgtaatatatctatgatcttaaatatttatcttttatttatgttgtgaatatgtgacttattctctactattttgaaatgtactatagattattgttattttgactatagtcactccactgatttatcgatactaggacttattttttctaagtgtattttttgttttactattaaggaacctctgtttatccactcctcccctctactcttcatggcctctgctaaccagcaatatactctctagcttcttgagattcactttataagttcccatatatgaggaagagtacaatatttgtctttttgtgtttggcttatttcactgaacataatgacctccagttccgtagacgttgctgcaaatgacaggatttcattttttaatggctgaataccatttcattatgtatgtacacattttcgttatccattcatccattactaggcacttaattaggttgcttctatatttaactactgtgaatagtgctgcaataaacatgggagtgcagatctctctcttatgtattgatttcctttcttttggatgtatatccagttatcggctccatatactgggttatatagcagttctatttgtagatatttgaggaccctccatactattttccctagtagctgtactaatttatactccttcccacattgtatgggggttctcctttctctacattctctccagcattcgttattgcctgtctttggatataagccattttaagtggagtgaaatatctgactgtagttttgatttgtatttctctgatgatcaatgatgttgatcacctttttatatacctgttggccatttgtgtgtcttcttctgagaactgtctattcagatcttttgcccatttttaaaacagatgttttccttcctatcgagttgtctgaagtccttatattctgattattagttccttgtcagatggacagattgaagatattttcacccatcctgtgggtcatctcttcactttgttgattgttacctttactgtgcagaagatgtttagcttgatataatcccatttgtttttgttgtctgtgcttttgaggtcttatcccctcaaatcattgcccagagcaatatcctatagcatttccccaaagttagcttctagtaatttcatagttttaagtcttagatttaagccttattccattttgatttgttttatatgttgagagataggggtctaggatttttccatataggttattcagttttcccagcacatttgattgaagagcctgttattttgccaatgtacactttcaacacctttgttgaaaatgagttggctgtaaatgtgtggacttatttctggtctctattctgtttcattggtgtatgtgtcttcttttatgctagtgccatgctgttttggttactatggctttgtagtatattttgaagttaagtcatgtgatgactttagtttgttcttgttgctcaggattgctttagcaattcagggtgttttatggtttcatatacattttaggatatttttctatatatttaaagagtgtcattctttttaatttttgtgggtacataataggtgtatatacttatggtgtacacgagatattttggtacaggcatgcaatgcataataataacatcatggaaaaatgggtataaatccattcaagcattatcctttgtgttttaaacaatttttactctttcagtgattgttaaatatacaattagattattattaacaatagtccccgttttgtgaaaaaataccagatcttatttgttctattttgtatgcactagccatccctacctccctcccacactcccactacccttcctagccttttgaaaccatccttatattctgtttccatgagttcaattgttttattttttaaactcataaataaatgagaacatgcaatgtttgtttttctgtgcctggcttatttcacttaacatgatgacctccagttctatccatgttgttgcaaatgacagaatctcattctttttatggctgaatagtactccattgtgtggaagtgctatgtgttctttattcatctgttgatggaaacttaagttgcttttacattttggctactgtgaacagtgctgcaacaaacatgacagtgcagattcaatatactgatttcctttcttttgggtttatactcagctttggggttgttggattgtatgacagctatatttttagttttttgaggaacctacaaactgttctccatagtagttgtactaatttacattcccaccaatagtatacaaggcttcccttttctccacattctcgccagcgtttgttattgcctgtctttggacaaaacccattttagctgaggtgaatggatatctcattgtagttttgatttgcatttctctgatgatcaatgatgttaaacattttttatatacctgtttgccatttgtatgccttcttctgggaactgtctattgaaatattttgcccatttttcaatcagattatgagatcttttcctttgggattgtttgaactccatatatactctggttattaatctcctgtcaagtgagtagtttggaaatattttctcccattctgtgtgttgtctcttcgctttattgattgtttcctttgatgtgaagaagattttaaacttgatgtgattccatttgtccatttttgctttggttgcctatgcttgtgggatattcatgaagaaacatttgcccagaacaatgtgctggagagtttcctcaatctattcttgtagtagtatcatagtttgaggtcttagatttatgtctgtaatccactttttaatttgattggtgtataaagcaagaggtagggataaagtttcattcttctgcatatggatatccagtattcccagcaccatttattgaagagactgtcttttccctagcatacgttcttggcacctttgtcaaaaatgagcccactgtaggtgtgtggatttgtttctgggttgtctattctattccattagtttatgtgtctgtttttatgccagtactatgctgttttggttgctataactctgtagtacaatttgaaagcaagtaatgtgatttcttcagttttgttctttttgctcagcatagcttggctagtctggatattttgtgattctatataaattttaagttttttttttttctatttctgtgaagactgtcattggtattgtgataagaattgcattgaatctgcagattgctttctgtagtacagacaattcaacaatactgattcttccaatccatgaacatgaaaattgtttccattttttttagtggcctcttaaatttctttcatcagtgttttatagttttcactgtagagatgttttacctctttggttaattcctaggtatttaattttatttgtggctattgtaaatgagattaatttttatttctttttcatattgttcactgttggcatatagaaatgatactgattactgtatgttgattttgtaacctgagagtttgctgaatttatcagttctaatatgtttttggtagagtctttaggattctcaaaatataagatcatataatctacaaacaatgataatatgacttcttcctttccaatttggatgccctttatttctttctcttgtctgtttggtctagctaagacttcagtaatatgttgaataacagtagtaaaagtgggcatccttgtcttgttccagatctggtatggtttagctttgtgttcgcactaaatctcatcttgaattgtaatcccctgtgtttagggaggaatctggtgagaagtgactgggttaggggaatggtttcccgcataatgttctcatgtttgtgagtggattatcatgagatctgatggttttatagtttttcctgtactctcacagacactctctcacctgctgccatgtaagacatgccagcttcttcttccaccataattgtaagtttcctccccccgccatgtgcaactatgagtcatttaaatgtcttttctttatgacttactcagtcatggtctgttctttatagccgtgtgaaaatggactaatacaagatctaagaggtagtcttatttaggttaagtatgcttgctgttctataatcttcttgtacatgaatgttaatatatttctctaggtttgggaagttttctgctattatcccttcgaataaactttctacttctatgtctttctctacctcctctttaattaaggccactcttagacttacccttttgaggatattttctagatcttgtagatgtgcttcattttttaatattctctttgcttttgtctcctctgactgtattttcaaataaactgccttcaggctcactccttttttatcaattgcttgatcaattctgctattaagagactctgttgcattcttcatcatgtcaattgcatattttcactctataatttctgcttgattctttttaaatatctcaatctctgttaaatttatccgacagaattgtgaattccttctctgcataatcttgaatttctttgagtttcctcaaaacagcaattttgaatattttgcctcaaaggttatatagctctgtttctcctggattggaccttggtgccttattcagttcatctggtgaggtcatgttttcctggcgtgttgatttttacagatgtttgtttgtgcctgggcattgaagagttaggtatttattgtattcttcaccatctgggcttgtttctgcctgtccttcttgggaaggttttccaggtatgcaaagggtcttgaaccccaagcataatcctgtggttcttgcagacttgtagtggtactctcttggtggtcttggataagatctggatgaattctctacattgctaggcagagacttttgttcttttcccttacattttcccaaacatatggagtctctctctctgtagtgagccacctggaatgggcaggtgtgttgatgcaagctcctttgtggccaccaccaccaggactgtgctgggtcagatctgaagccagcagagtactgggccttgtcaaaggctctacccttcaggattgcgagttccaggaatgtccagagatgctgtccggaagccagggattaaagtaaaaaaaccttagcaactgatgttgctgacctgatgttccattctactgtggctaaactggcactcaaactaccacaccaagtccttcccactcttcccttcacttaccaaaggaagaggagcctctccctgtggctgccaccaccactggttcatctgccatgccaccaccaatgttcgcttaaagacaaagcactcttctattggcttgtggtgaacgctaccaggcctaggactcactcttcaggccctggggtgccctttgaccttggtcaggtccagaaatgccgtccaagagcctaagcctggactcggactcccaagagcctgcttgttgctctaccctactgtggccaagctggtacctagtgtgcaagacaaagtctcctttacttttccctctgctttactcaaacagaaggaatcattcactgtagccaccgtagctgagagtatgctgggtctcctccacattcaacacatttcagagcccaaagcccatggcatactctctgggtatcgctggtggttattcagggctcaagggctctttagtcagaagtcgatgaatcttgccaggactgggtccttccctccaaggcactgggttccattttggcccagagtgtgtcaagaaatgttgtctgggagctatgtcctcacaactctgcccagtgccctatcctactgtgactgagctggtatccatgacataagacaaagttctcttcactctcctctttttaagcagaaggagagaatcactctcattgctatgagctgggttgcctgaagttgggggaaggattgtgcaaaccctctcttagctgtgcccatggtgtctccctaggtcatatgtgaccttagttcactggctctaagctcagcctagcactaggaattgaataggaattgcagtccttgtgtcctaatcatatatggcatttattatttcgaggtatgttccttttatacccagtttattgagagtttttattacaagttggtgttaatttttatctaatgcttttcagcatctatgaaatgatcaaatgtgtttgttctcggttttgttaatgtgatgcatcatgttcactgttttgcatatgtttaaccattcttgtatccctggattgaatcctatatgatcatggtgatagatcattttaatgtgttgttgaattaggtttgctaatattttgttgaggatgtttacatctgtgtttatcaggaatattgacctgtagttttcttttatatagcatccttgtctgggtttggtatcagggtaatgcagttcttataaaataattttggaagtatttcctccttttcaatttttttttagtttgaatacaattggtgttagttcgtaaatattgggagaattcagcagtgaagtcattaggtcctgggctcttttttgatgggagactttttattacagcttcgaccttgttagtttttattggtttgctccagttttctatttcttcaagattcatcctttagtaagttatatgtgcccatgaatatattccattatggtcataaaaggtacttgatctaattttgactttttgaatttgttaagaataattttgtagcctaactatagtctattcttgagaatgtttcatacgtttataagaaaaatgtgtattctgcagcaattggatgaaatgttctacaaatattagttaggcccatttggtctagtgtttaatttatctctgatgtttcttcattgaccttctgcctggataacctgttcattactgcgagagaggtgttgaagtcccatgctattattgtattgcagtctagctctccttttagatctattaatgtttgctttttataattgggtgctcctgttttgtgtgcatagatatttgtaattgttatatcctttcatgggactcatccttttatcattatgtagtgtcctcctttgcctatttttgtagtatttgacttaaaagtctatgttatctgatttaaatatagctactcttgcttttttgtttccatttgcataaactatcttattccctttcttcaacttatagtctatgtgtgtctttataggtgaaatgggtttcttgtaggcagcatatagttgtgccttgtttctttattcgttcagacactctttgccatttaatggaataatttagtctatttaaacacaatgttattattgataggtaaagatttactattgcaattttgttacttgctttctggttgttttacaaattctctctcactttcttcctttgtggttaagtgattttctctgattgtatattttggtttgttgcttttcatatttagtgtattcattacatgtgtttcttctgtgaggcttacaaaaacatataaaaattttattttaaatagacaacttatctgatcacaaagaaaaaattagaaacaaaggaatagttaaaacaaattgtacactttaacttcatatccatttagatttttcttgcctcaatttacatatttttatagtgcctgtctcttaagttgttgtagctatttttttgatagattgctttttagtcttcacactagagttataagtggattgcaaatcacaattacagtgttagaatattgtgagtttgtctgtgtccttacttttacaagtgaacttaataacttcaaatgttttctctttgcatattagtgttattttttctttcagattgaaaaactccctacagaatttcttgtaagatgggtctgatggttataagttccccatcttttgtttctctgggaaagactatttctccttcatgtttgaagaatagctttgttgggtacataatttttgtttcagagttttcatttttttaaatttcaacatttttgcatgttttcccacttctactggcctatatattttctaataagaagtctgttgccaaaaaaattggaagtctctcatatgttttttgcttcttttctcttgttgcttttagaattctccttttgtgtttgacctttgagagtttaattattatatgccttggggtagttttatctgggtgaaatctgtttggtaatctctgacctgcatatttatatagtgtttttgaaagctgtcatttcttttaataaactttctaccccttggtcttgctcaacttcctcgaacacaaataattcttagatttcctcttttgagataattttacatatcttgtaggaattctttattcattatttttcctctttgtgtattttgcaaatagcctgtctttgagctcactgattctttcctctacttgatccattctgctattgagagactttaatgactttttcagttcagcaaacatatttctcagctccaggaattctgtttcaatttttaattatttctctgttaaatttccctgataaatttttgacttttattctgtgttattttggaaattaatgagtttccttcagattactattttggatttttatcagagagctcttctatcaccatcttattagggtctttcactggctccttactttgtacacttcggaaggtcatagttccctctttactgttttttcttgtggaggtacacctccgtcttcccatcaaaggactagtcttttatttcagtcttctctttctgggttggtgtttttactggatatgtttccttagaggtttctttgcaatatagttactgagtatcttttctgctaagttactttctcctttttagcactaaagagtgccttaagcccgggtttgtcttggctttagtgaaattcagtgtgttgcctgtcccagataggggagatcccaaagggcaaatgccaacagtatgagaagactgggtaggggtttattcccaggaaacccatgggacatgccaacaacagtatggtcctgctggatggctactctaatttggcatctcctttggctgggatagaacaaagttttctggtctggtaatggtagtcctgccaccctccccactccagtctctggctgtcttcagggatatttctgccttcacgccctcccaatgcttcctatgggttgaggcaggaacaggtctcctgccagtgcacccaagaggttgaaaagctggctgttcaatttgatctcactcttgtaatggagtatccataagtctcggagaaattttccacctacttggtgcctggaagatttgagaaagggcatcacagatataaaagtctgattagcctaacaacatagcctaactcctagcatggagtttttacttctctgtagcctcagatgctgtctcatcctcacatataaatggtgatatattgctagaagttcggtaattcactgttccttgtgtctaactttttaataaaacgattgtctttggcatgactttctctctgctactataaaatgttttaatatatccttcttctactcatgtttattgactgtgaaaatggctgtatttcttcaattaagaataatccaattttctaaaaaaagaactgataattggctattttcgttgtggttatcatggtaacaataacatagttctggtacttacatttcagtcaagctgtttctctgaaatacatttttcttctacatgcataccttatactgagttatgtgagacctaggtgttttttcaagcacaatggcaataatcaagatctaaataatttccttttcatattatgtcaaaattactaaccaccattatcttttaataaaatatttttaaaacttgtggatttatacttaagctaaaattcctttttgttcttttttgtcccccttaggaatgaaatgcctgaattgtaatattagggtctttggtgccacattctcagagcacaggggtgtatgtgtctgatagtttaaataacagttaaatcaaattagaactctaaaatgaatcttatctattagaacagtttttacccccccaatacagctacttaaaatatcccatttcggaaaatgctcacttagaagaatatgtgttttcttttgaccaactaagtgccttggtcacaacagcagggcttctatttgctaacagagctgtttcttgcacttattgaaagaagagggaccgttaaagttttagtagttgaaaattatccactaattagaactggaagcaagaagccatgaagtacaggtgataactataaatcagaacaattagtctgtctagaaaagcaacatgatcaaatcagagtcagcataccagctgctcatttaatctagggttgcaatgtttttccctttttgtgagataaccctgtacagcaggagcttggatttgacaagtatgcattcctcagaattatttatgaattcaagaaagtgttggtacgctgatgttacttttacagaaatgcttggatttgaataagaaaataaatgacattcagaatgtgaaattccttaaatatgatgttgcattttcacctagcataaatatttacatcggcaaaggtactgaactatatatttttctttctgattgctattgcttgagaaatatatattatgtgaatatcatcattttgttgtagtactgcccttcggaaatacattaaacttctacataaaagtggaattattttataataaatgaaattttaatattcctctaaatcattacttgaaatctgtttttattttcttagacattctggcagtattagagaaataagtattttgagtgcacacacaatgaacaacagcaatatacaagacaatatttatatactaatgctgtttccttctgtaatatggtaattttattacacagtatttctagagttgagatgtgtaaggcactctacatggttttggaaccatactattctaaaatctgacttgtttttaaaacattatatgtttgtagagaaatgagataattagacaaacaacaaaaacaaaagctgaaagtggtaacaattgttacagaaatgataaagcaaatgaaagatcagaaatttcaataattcaatgtatgatgatgaattacagtcatatacaataattcctcattgtgtatacaatataatatgtaattccttattgcttatataaccattatcattattataaaatggtcttgttttctgaccctaactaagtttaagacttatctcctattttcatctccataaaaatttctagtagatttcaggcagatcctaagattttggaatataaagacaaatgaaaaaatgtggcttctgccatcaaataactgacaatctaacagaaagttacagatgtaaacaaaccattacaatactaggtgttaacagcaaagtagaaatgtgtgcaaagagttgtaggaactcagagaaacgagtacttcattcccctagaagtcagaaaagctttctaaacacttcatcctgagattaaaaaaaaaaaaaaaattgaataggtattccccctgttggaatatgttgggaagatattaaagaatggagagcagctcatacacaggcattgagagatgtgtataacccattcttggatgagcttaggaatttggcatagtgttgcctaaatatacaaggaagccattttgggaggtaacactgaaaacttagagcaaataactaagaatgttttaaacatgatggtagttatatctcatatacaataaggagccatttaaaaacttcaaactaattaaggacaaaagcaggtttgcattataaaaaaaagttatgctaataattacatggtgtgaactggaagcagagaaactggagacaggggtccagatagaaacataggggaacaacctagagattgtaggtaactcccagttgtactaaagagttagtactcaaaggttttaaatttcacagtcaaattagcaacaaaccataatacttgttgtattttgtatttgggaaggcattgatgaccattttgcatttagcaagccacaaagtcttctgaatggtagaggtggggatggcaaatgggagatacatatgaaagaccttgcagaggaaaatagacagtacttagaaattcattagatgtgaaatagaatattaaagttgaattcaaccaaaaaattccttttcaaatgagaaggatgaatatgctattaatacaatttgggagtctacacgagagtttcagagggaagaaatgaagctttctatataaactgataagctatttgaaaactaaagtattggccaggtgtggtggctcactcctgtaatcccagcattttgggaggccgaggcgggtggaccacctgaggtcaggagttcaagacaagcctggccaacatggtgaaactccgtctctactaaaaatacaaaaattagccaggcatggtggtgcatgcctgtattccccactactaggggtagctgaggcagggggattgcttgaacatgggaggcagaggttgcagtgagccgagattgtgccactgcactccagcctgggcaacagagcaagactccgtctcaaaagaaagagagagagagagagaaagaaagagaggaaactaaagtatcatgatgacgagaaagaaaagggctaagaacatttatgggagtcatatgaacgaagacatagttgaagtcacttagggagagggtgcataaaacagtgtaatctaaagagaactttggttgtgtttacaattagagaattggtaacaagagaggaattaatgcagagaatggggcaatagtgtgagatcacaacagtataatatcatggaacccaaagaagcatagtttcacagtgggctttttctgggtcagatgttctaaagatgacaaatagactcagaaaatccttgcgtttgatggctggaggtaccagtgatcttccaagagagtaattgtgttattatatatgctgaagtggttattgggaaatagatttcaggtggatagttaatgaagcacagacaagagaaaaacagtactttcaagccactttttgagaaaactggtagtgaggagaaaacagaaaagatatttcagaaaaacgtgtttcttgaagtagactgcttatggaggaaaagtggagaaagtagctgacatagaaatggtagtaactaattatgtgtttatagaagtggaaatgcataaaaagagcagtaaagataatggttatcaattaatacacttaatggctagcttatggtaagatctaaaacaagaaagtgaatgtgatcaggagagtaaagaataacaagatcttaacatttctgactctatttgtatagggtgaaaaatccgtaaagccaatccatacatggatctatatatgagtctagatccagaaagccaatctaatactattctctttttaaacagaatgtactactgatatgcttggctctgtgtccccacccaaatctcatctcgaattgtaatcctcataatcctcaggtgttgagggaagaactgataagaggtgattggatggtgggggcagttcccctatgctgttctcgcgatggtgacttctcatgaaatctgatggttttatacatttaacagtccctccctcacacactcttgctctctcttgccgtcttgtgcctgcttccctttcaccttctgccatgattttaagtttccagaggccttcctagccatgctgaactgtgagtcaattaaactctttccattataaattacccaatctcaggtatttctttatagcagtgtgaaaatggactaatacaattatcaaaactcaaacttttatgatactctaaatttatctgatattcttttaacattaaacctccagtaatcaaagtggggtttacatggcagaaacattacattcaccaggaagcttgttaccaaacgcagaaacttaggtttcaccccagacttatggaatcgtcatctgaattttgaaaagattggcaggtgattaatgtacacattacattttgagaaacattgatgcatagcatattaatttaaataatattattatatacatttatgtggctagtaattttgctatctgttgatttgttctgtacagtttacctccctgagagaaaatctatttgttaataagtgattttatttttttgccaagaatacaaatttaatttgctcttagaaatcagggagattaataaaataaccctaaagagttgaagttagttagaataaaaatgtatacagtattttaaaaccatgttgagaacatatagaatgcaataaactttatccagtagaaaaaataattacttgattaattttactttctttgagatagggtctcactctgttactcaggctggagtgcagtggcataaccaccactcactgcagccctgatctcccaggctcaaacaatttccacctcagcctcccaagtagctgggactactggcatgagccactgcacctggcctaattttagtttttattttaaaaatgaaatttctgtaagaccctgaaaccagataatagcctttttaaaatttatatgttaattttctgaatctcataatgcaaagtggctttccgtgggtctccttcaaactcaagtacagcacatctacatacattttaacgaactattgtctgtgatattgccatcaaatcgcattcttcttttttctttttttttgtcaccagcattctactttattgcagctcactaaaaaaaaaattgtagccctttacgtctgtttaatcatagttagtaaaattatatccactcgacatattattttgaatcattaatatgctcagcatctctagctaaggcaaatcagaagagaaaaagagaacgttgggtgagaatctggtttgtcattccccatgtatggtggttgaaagatagccacaagttctttgataactccccaattcaaagattgggtccaattccccttaccttgtatttggactagccttaaagacttatgtgaacaacaacaacaaaaatgcagccaaagtaacgttctggaacttccaagaatatttcacaataattattacagcttttgcccaggactcttagaatattttctttgggatccctgatccatcaggaaaaaaatctgactacctgagaccactgtgataaagtgtgcacatgaagtgctcttgttgacagtccctgctgtgcctaggctactagccatacccaccaaagtgacagacataagtgaaaccatcttatagattccaaacgagtcattttccagttgaaaaccatcaagagatatctgttgatgccacatgaaacaaaataatcactcaactgaggcctgtccaaaattcttgaccccaaaatttataagaaaaagtaaaatgactgttttaagccactaaattttggggtagtttgttaattagcaacagattaatgaagttacatgttttttatatgccatcccctccttttcttttcttttgtttaatggaagcaatgtgagcattttctagcactacacagagcacttcacgtgaagctagaaattcatcctacatacttggctgaatctttgctcaaatacaattcagtatatattcatagaattgcatatgacagataatatttcataatggttcccttattctcatgccagtggttttgtggtgctgaattactataaatgaattaggattttagcagcattttgaaatgtagaattatacatttttccattatgattatcttaattagatggagaattaagccaaggaagaatgcaaaggctgaaacctaatattttgaaatatgattatgttgaaatcaaaaattcaattttccctttttatattaaaacactctgaagtggccttaatataacacacaaagggcttttctattttattttacatttaccaagaatgagatcacttctactatctaaaatagaaactgtactctcaagcacttgaggtctttgctctccatgatcttagaagcatataataaagatagtaatagtgtatgagtaattctcaacatttctcagctaatgaaaatattttatcttaaaatatattttaaaataaatatacctacttctaagtatcaaaagttaatttaactaccttaaccagttttgtcatactaatgtacaaaaaaatcaaaaaagttttttatctgtgcagaatgatttttaaattaaatatctttatcaacttataccattcttgaagtctaattgtaatctatgacattaatatttactcaatcactttgaaatttattgtgttttctggcagtgacctcaaagagaggtagtatggcttagtggaaagtatgtattaggcatcaaagtgcaatagacgatggtctacatagctcctgggccaattaatggctttgggcaatgtttccctcatctttaaaatggacatgataatatcttcttgcaaattaatcatgaggatgaagttaaataatctaagtaacacgcataacagttcctggcacaatactgaataaataacagctattattatgaataatagtacttctcttaaaactaattaccacagtttgttttgaattactccctaatctagggaaatatacagttgttacaaaagaaaaccccaatctgttttagatttcatattttatcaagtattatgtattttacattaaaaaattctcctaaacaattattctaaaatattttacatatatgatcaagtttcatacgtacattgatttatttctcatgaagtttccttccaatgtattatcagacaccaaaataagagtactattgtactattgttatttacaatatgtcattgcacatcaccgtacttttgctaactcttttttttttttgagatggagtttcactctggtctcacaggctggagtgcaatgacacaatcttggctcactgcaacctccacctcctgggttcaagcaattctcctgcttcagcctcccgagtagatgggactacagttgtgtgccaccacacccagctattttttgtatttttagtagagacagggtttcattatgttggccaacctggtctcgaattcttgacctcaggtgatccgtctgcctcagcctcccaaagtgctagcattgcaggcatgagccaccatgcctggcctactaactcttaaaaaactccattgagtatccaaataatttgtccaccggaaacatatatataagatgcaaaagaacaaaagcctgtttggggtgggaatggggcgaggtaggtagtgctgctggaggacatgtattaaataaaatgaaacaaaaaggcaaaaagcaattgaaaagtctgaaaaatcttgcatccaaaggaccatttggccccactaaaataatttgttatcagcaaagataaaatagaataagttaaaagtatagaagtgaaaaataccactcaagaaaatattatctgagattacagataagaaaatgaacagatgtcctttttattaaaattccaagttgctaacaatggcatatgtacgtctgactgacatgtttgaaatgccataaagggattcttttgtatatcggtaatatttttccaatgcctttaaaaatggtatttatgtacatgtaaggtatattctgaaaattataattatgggtattgttaattaaaaccagtgtgctgttaaaacaaaataagaatatttttgggcagcctatctattttggggccttagagatcacagttgtgaataaatcccttcaagtcactattcgatttacacaagatacaaattattatgtcagagatgagatatatttcatttgtaatccctctctaatagaacttataacaaagtagaggacgttgcttgttttgattgaaaatggcatttgatgtacaatagaaccggtacaaataattcattcctaaacaatgctggcatactcactggaataacagcgtgattattgtttaattttacattatctaggataccatctctaaaataatgcaatagcctacatttttctgaagttattagcaaaaaatagttttgcctatgaattatccaataaattaagctttttcctttaaaatacaacttttttctaaaatgtataaaatacttaaaccctttcttatagtcacatcatgtacgtttatcttatttttgatgatagagttagcagtgccactattctattggcctgcattctgctatataaaggactattgaaacctgtagttatttgtccacacaatcaatgactccacctgctatgttttgaaattccttagtcctgttagagtactcattattttctctctttcattgtaactttttacttctcatagacatatacctagcagtaagaaatctgatcaccctttaatgtacttctttcatttagaaatacgagataaaaacataggatcaagcttataaagacttgctgtaagccaagaacaaagagactttcaatgacaaagagatgtctccgtaagaactggcaccaataatggtacagattactacgttgatttagttctatagttctgcctacgttagtcaaattgacaaaacatatttctagaaataatatgtttacagaaagttctgcagttgctgggcccaatttcattaattttaggacattccatcagtgatgcattcagctatgtgtttactctttctctctacctggagtttctcttcagaatggcaattctcttccctcatacttttgctggagagatcatccagggtgaaagataagagaagaaacccaaatgagacagactatatttcatttattcttactaaaatatatttaaatttcagccatgtctccttgggaggacttctgactggattcacattacatagtcaattatttgcattattactgccattattgtttttgaattgtcattattcctatactagtgagctaatcactgtcattgagtgtgaattttactaacataactctcagaggacaacccgatttcaaagtcctcaagagtatttcacggttttcctagtgtagagacaacaaaactgttttacttttacagacattaaaaaaactatattaaattttaaaaagagagataagtctatacccgtcagataactcttgattgatgaaaattcacttaaaattggtagaaacttgcataatacctggagtttcaaaaatataattcagaatgccattgcaagaaaaacgtggtgtgttttctatatttttgtttagttacacctcattgtaaatttaaaaaacacaatttttaaaattataattctgcaaactagaatattttcccttccattttgttaatcacagaagatctttcttagagactctccagattacattatatagcatcaattataccatgagcttcttgaggacaataattatatcttttcaagtctgcagtcttaatttcatgagtgaatgaatgtcaatagtttaagatcttataaaacattttcttactctgaataaattggcatataagttataaggtaagaacttgtggttttgcaagattcaaataccaaaacaaactgaatatttttaaaatatgcttagtcatgaatgcttagtattttcttacaactttctatacccctatatttttatttctcttttggattgtgtattttgaagtattgttattataaaatgcccaaaattaattttaataaatgttaagatatcatcaactaatatgactttctataactttctcaataatctcttaaaactgaaatggcaagataccacatgtgcactcttttgctgtggtaaagacatacatgttatcaaattttacaggtaggccaacactcaggtagtaaactatagacctgaacaataaaaaactaaaaataaaactgataaattagtataaaacaagaaacaaataatgagctactttgatttatggtattcatttccatttcacataagcaatctatcttaatacatactacaaaccttgcatctgctttattaagtagtacatttcacattcagccattctaaaagagaaagatagtatttgggtgatggagcagatcatttctgtttatcagaaggaaaaatttaagcaaatcttaaaggggcaaatttttatagtactatttgctctgtattattgacctaagtactgtaatcaccattgatatagtagacgtcattaaatcatattttgtaaatttagagatattccattacagattgatttctctatgtatacgtatgtatgaatatgcttcctgaggaaacctgtttaattaaatcccattaatagaatatcctttttctgcattgtacacgcatttatgtaaatatatacaaaattatcttctagtctgaaggcgctatagttcagtgaatagcatcatgctgattacatccaatgagctttttaaaagcagattttgtttctttaaaaaaaaaaatagaataggtctctgccattcttaccatgaatgccattttgctaagcaaaaagattatcagagcaatctgaatttatctgtgtagcaaatacattttagtacttagtatcatttgttacaaaattataatgaaggtaagagagggaatttactccattttcctttttttctttatagaaactaaagctcaaataagactaggttatttggctaatttacatagctaatccatagcaaaaagaaggcaaagcccagaactctaaaatttagtcttaacttctttccacatatcaagaggtacttgtacttacaatgggaaaggtgattaagaaacttacttaatcacctttcccattataagatttaggcctgcagtaacaaaattcaattcatggtaaatatgtaaaaacagaaattttaatggttttatttcaaatacttgattctcacttatgaattggaaagcaactcatggtggatttgaaggattgcttcttaattcaggtcattctgactccatgcaaagatttaatatcatctattctgttttttttttaatttaggagattcataagataattagaaaattttacttcctaaaaaattaactaaattccattttcatcttcaaatttcctctttaaggtatgaagtactatactaataatttctgagttgatccagaaagttgtctatccacattaacattattgacaccaacctgttggacacacacacacacacagcagtttctagaataatgttatttcattcaataccgtttgctaaaaatattgatgagaagaagacatgatttccagccagggccgtgatttgtatggaatttgcatgttctctccaggtgaactggcacatctaaatggtcctagtctgagagcgagcgagcgagagagagcgtgtgtgtgtgtgtgtgtgtatgcacacgacaacgtgtgaatgtgccctacgatggaatggcatcctgtccagagttggttcccaccttgtgccgagctacctggataggatcaggccatgcgagaccctaaactgtaataagcaggtaaattattgtttttactaatcattctaaaacatatgtatagctcatatttattttaatgtttaatattagaagtgatttaagtgcttgaatctttaaaaaatgcagtgatgtgtttgtgagcagaaatatgccataggaactgtattcttgtttatatcaattaacctttggtaaaattggtttcctaatatgttgtttcacttaagacggcagtttccaagaatctaccaacgatgataaatgaggtattactgtacttcgttggtaatatatgcactttgttcctatttactttgtatctattattagaaaaacatataactctggcaacaataacaaaaacaggctaaaataaaattatatgcctaataataataattataattagactacttaatatcttgttttaatgataaattctcagagatgggacatatactgagagtatactatttctattggagctatgtccactttattccagtggttctcaacaaagggtaaacttactctccaaatggtgacattctcaaggtcaacagacacttttgatgatcagaactggctagttactactacatgtagcggggagaaactagagacactgctaagcgttctgtaatatatatagcatgaccttaaatgtcaatagtgcagagaccgaaaaactctgcctttcaaacagctctcttattttgagctggattcacacagcctcaataattagacatgcctgattcagagtcatggcatgatttcctagctaaaccactacatctaactatatgaagggttgttcactgggaaaataagccaacagcatctccctgggcacaaatactgtcattctgatgcatgaatgtacataatttttcctttagcattcaattcagcattagcattgtgagatctcgcaccgacttagcaaaactcaaaaatttaaacaagtttttcgttgattttaacctgcggaatttaattttgagtttctatggcatttgaaaccaaatataaaattataacaataagagtatccattaaattttttttgtctcttacttctgatttactttatcaatgaacattaaaaagtagccatctggactgagaaagaaaataataacatttctcatttttaaaagaattcggtaataaccataagcacaaagaaataaaattcatcagatttttttctcctattgcttcagcctagggacacagtgataggctgacaaatctgaataggaacataaactttgattgtaatttaattaaaaaaaattattttactttttactccagttcattaatatttttaattcatgcacttgccaaaagcatgatgctctctttcagtcaaaaacacattgaacccgcagggaagaaatactaccccacgagtaaaggttccttcctcagcttgtcaagaaagtcattccaaactcaaacaatggcagacggcagatcttgctatataacacatctattctatgatacactgccattcttgaacgtacatgtatccttcagaaactacaatggattataatacaaattaggctgacaaaagttctcttagtttatccattggtctcagaataatgcagattttcttgcttcatctgagcacttaaaactcaataatatgccagacctacctaagaaatgccttaaaagtagtttattatctagcatagctttcaaaaagagaaaaaactattttatggtatttgtttttaataggttatgttattgctatagtgacagaaagaactgaaaagacctactgtatgtatccttgtataagaaatacacaaaacattaatgaaaaaactcatttgctaaatcagtcgctaatcttgtccagtttaactttctgtaatccctgacaaacaatcctaatattcatcactcatcaagtcatgcacaaacttttaaataaaataattgtatatgggcaagattattctacttggcaaatggcctattgcactgatatccacctttggttttttagaaatgaaataatcacagtcttgcagcttatttctgccagaaaacttcagacagaaaatgtgtattaatacaatactctatgtctgcctaagaataagcttaaagacacaaattctccttctatattgttgaaataaaacagaatcatagaccaagaaaattagaatggggaaagggaatatttctaatgagttaggaatgattaagtaagatgcatcaaaaatgtcactcgtcctcttagatatctagactctatgctatgcattatggaggacagcaagaaatgtgagccataattttgtccttgattacaattaatggagaagaaaggaattataaatatttagaaaaatattataacaacagattatgccaagtgcaaactatagggttcaaagcataaatgaatattatccaagactatgagagatttttgacattttgagacattatgcaagaagcaaaattgagctggtccttgaaaggatgggtcgatttagaaaaataaatgcagagcttcataaatcaccgtttcaagagatgaggacattatataaactattccattcatgcttttattacagggacagtgggaggaaagagaacagaatattggtagaactaatcttcagcatgatgttggcagatctcaataaaattatggccacttgtctccaatgttacaattcagggctttggagagtcttattttataggcttcctcattaatcatgggatgtctttctccaaacttatgtttctacagtgtaagtgtgagatgctctcaaaagaacttccaggaaggtaggttaccctccttacttgtagacaccagcaagctggtttttatctccaaagtagaatgtcttggacccagtgtagcttatgcagatatataaatggcacaatgaccccagtacatcttttacaagatgttgttcacttgcgcaaaaaaaaaaaaaaaaaaaaatttgaatacaagggacactgatttccttcactaaagcttcctgtatttaaagctgaaatgaagttgcactttttactcttaattgatttatatgctacttttaccatggggctatagcacatgttgtcttgtaactgtttttcagagaagggtcattaggttgatatatttttgtacagcaacaggaatgactgctctgctaaatcactaaaaattaagacaaagacaaactgaaatctgcaaggattgacttggcttctgtccatagccatatcattcttggcaaatgtgaaaccattttaaaagtttttattattggcatggaacatattttggcatacacatatacaaaatgaacattataatgacaataagaataccaccttgttagtttaaatcagtaagaatattgattactcagtaatgtaattcagactattagctaggttttgccaaaagtaaagtaaccctgtatttctttagcatatcttgcagaaaattcagattcatctaaaggaaacaaataaataaaaaacattctaacaatgaaaagagaaaatacagtgagtactgaagagtggtggagctgatcatactgatagctgtgagttctctgctgatggtgggaggtgggtggcagagcccatggaggtgaaagatctaaaagttcaaggcagcaatgttccttctgagtttgagaaatatcatttagcagggtagatgctcaatattcctttccttcctttatcctgatatgaaaaatggagatgttgtggtaaataggggggtaaattgggcatggaggaagaattaaaatatttagtatattatgttttttattgttggcttatgttcatgactattgtgtttcttttttcagcttttaggggaagaagaaagtaccagcaataattcatttcttacagaatttagctgtggtttcgtagagaagaaattagaagacctgggtttatgctggatcctcgtccaaataactttgtgactttgggcaaattactttatgtcactggacttcacattttctgtatgtaaagcaagatgttttgattacattcttccactggtatgcgtacaattatggtactgcaatttatgactttctgttcctactatattgcgggcaatttgaaggaagacaatacatttttcaactctaaattctcaaggcttgacactggttggcatacagttaatgctctgtaaatgtttgttgaattgacttatgttgattatcttacttccaagtccttgcagaaatgacgtgttataaataacctctctatcatttcataacattagtgatagaaagccgtattagtgccttggtgggagccaagaaataaaaaaataaaaaatatattttctacaacaaaaaaaattaagatggacagttttacttgatttctgaaatcagagaacaaacacctgttccagtaaaactgaaaagacaaaatatacattaactaaatctgtggaaaccctcaacttcaaatagaatctagatagagatacttcatctggatggagaaaataatacatcgcagtattaagagaatgtatttgttcctaacaatgagctctttcacttcaatattaaaatcctatttcaaagagaggttaatcaaagctgaagactattgtgtattgcgattttcacagaatatataattctaacacggacccctttaataatcaaactgttgctaagaagcttcttttgttattattattattattatactttaagttttagggtacatgtgcacaatgtgcaggttagttacgtatgtatacatgtgccatgctggtgcgctgcacccattaactcatcatctagcattaggtatatgtcctaaagctatccctcccctctccccccaccccacaacagtccccagagtgtgatgtcccccttcctgtgtccatgtgatctcattgttcagttcccacctatgagtgagaatatgcggtgtttggttttttgttcttgcgatagtttactgagaatgattatttccaatttcctccaagtccctacaaaggacatgaactcatcattttttatggctgcatagtattccatggtgtatatgtgccacatttttttaattcagtctatcattgttggacatttgggttggtttcaagtctttgctattgtgaatagtgctgtaataaacatacgtgtgcatgtgtctttatagcagcatgatttatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccgttctaactggtgtgagattgtatctcattgtggttttgatttgcatttctctgatggccagtgatggtgagcattttttcatgtgttttttggctgcataaatgtcttctttagagaagtgtctgttcatgtcctttgcccactttttgatggggttgtttttttcttgtaaatttgtttgagttccttgtagattctggatattagccctttgtcagatgagtaggttgcaaaaattttctcccattttgtaggttgcctgttcactttgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggatgtcttctaggatttttatggttttagatctaatgttgaagtctttaatccatcttgaattgatttttgtataaggtgtaaggaagggaaccagtttcagctttctccatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttgcttactatagccttgtagtatagtttgaagtcaggtagcgtgatgcctccagctttgttcttttcacttaggattgacttggtaatgcgggctcttttttggttccatatgaactttaaagtagttttttccaattctgtgaagaaagtcattggtagcttgatggggatggtattgaatctataaattaccttgggcagtatggccattttcatgatattgagctaagaagctttttaatgaagtcatctttcaatgtaagcatatataaaactcactcattttgtttacattacttttgtggtcatttcaaccagtgtttaacaagttagttttgaaaacagcagacatggaaggaatgattcaaaacaaagatgtcttatgatttcaggggaatattttattacaaatatggaacacttaacccatgaacttagctccacaagtctttgacaatttagggaataatgggaataccaagccagatttctgtgcagtggatggaaggaattaatcttagcaaggtaaacccttgtttttgatttctcagaccctccatttataaaaataatatgggaacatacaaaccacttgatacttttatctgtaaaacacttagggcaaaaaatatatattattataggaatcaaaaaattaaaaataaaattagcattggaaagacttgaaataaaaaaatccattttgtctttgtaaatctaagtataaattcaaatcatcctcagctttccaaaaaataccctcacaaaatttccttacctactggggtgaaataggcattgctgttaaacgatgctaactaaacgaattctgctcttttcagaaaatagtatatattttacaaatatccttctttagtttatcaagaaatagacacaaatacaacaaatacttgagttatacattggctttctttaaagaaagtacatgaaaatattttcttttataagaggagatggcattgaaaacatgagtatgaaaatagcaacattaaagaaaaattctatcatgctagcaggagtttcatgttcatctctatatgaaattgtatgcattgaagtaaaaaataaacactgacggctgcagaagcccatctagagtggccgctgtgaggatgccagctgcagcaggggaggtgcagctggggctgtgtgctccatggaactgatgggggaggggaacaggtgatcccagtgggagccctgcgcccaactaaatagtgaggtgggagctcctgctcccaggcacagctgcagctgcccagccacggctccagacccaggcatccctgtgctctcagagacccaggaagcccccttcccctgcaggctcagaagtgcctctgcacccactccctggcctctccctgctccaagcacctgctctgtggtggagcaaagttgtggacatgtcccaatagctaagcccaggtgctgttgtgacctggtcaggtgtgcctgtacttgggggcagcactgacatgctggtcccctgctgtcttggccccctctggaaactgcttctgaggctaaaactttgggtgccaacaagcacaggagggaggctgggtgtctgagattggcttggcacgtgcctggtgttgaccctcggcaaagacagcctggacaccatggagggcacattaatggcagccggaggcagacaggttcctaagtgggaagctgtgggtccctggtgaaacccaccttcaagccagggatgacctgaagcctgggggccaggatgccagttttgggtggagtcagtgacctggagtcagaacttccttgatgtcttatggccagttgaatggtgctttttccaggcctgtccatggccactcactgacaaaacagcatgcacttctgccattctgagcccataacatctccagactcagccagatccagagacttgtgaggatgacctgcctgcagataggagctacccacttcaggtaacctctctgctgagagctgtgctgtcacttaataaagctcctctccaccatgttcaacctccagttgtccacataacctcattcttcttggacatgggacaagaactcaagatccaccaaacagtgggagtgaaaaaagccataatatatttctggccagcttgctaagtcatgggcagtgacatgctcctggaccacaggattgaagagtggtgaaccttctgggggctcagacctctggattccccaagccagagctgctttaacgtcatagccctcctgccctctgctggtaccaggcagcttccccaaacaggaagcagcagcgaggcaagccagcccaggatttgcaggccagaacaaggtggcaggactgaaagagttgtaacacaaacggtctgaaacacacctgctctgcaacatccccctcacagctcgctatgctgcggcggtgaggggagaagggctgtaaaccttctgggatccccgacctcagggctccccatgtcagggctgtgtcattcggtaacaccctctttggggttctgcggtttctggcatctctacgctttcaggcgcactgcattcccctcatccggacattggtcctacagtagaagcctcttgcagtacacctggtccagtctcagtctctcatggtgctgccacctgtgctagtgcgtggagctgccagcgctgctcaagtagccaacatgactaactgtgtgcactggcaggaccccacgcttgattgtttacacacccttgccactccacacctggctcacccttggcaggcatgggatctgtgttggtagcacgagccaatcaaagactgcaaggctgagtgggtgaaactagcccagcaggcatgagcaaaactcaagcagaggtgctgttgaccccagatgtttccagctggcaaagtgacatcctgcatcaacatcttataatcgtttactaggtataaaaaaggggtagcagtgagcattttcatccaaagtagatcttcataattggaaataatttacacttatactctcactttatagatgagaaatctcagatacagagattgcaaattgtcaacagtcacagaagaagtcagtattaaaagagccctacaactgaatctcaaggaacataaagagtttactggagaaaaatatcatttccatagctatatatgttccaaccaagaatatgtcactaggcgttttacattcttatttacttaaggacatgaagccgaaagtcagaagttaggacagacttagaaaatactggcagggtagtaaacatatatagaatgactgtgtgttgctttgagttagaagtgatgggaataacctgccacctccatacgtgaatctaaatcccatgcaggtgactactactgagaaaatctggcttcatttgctgcattgagacagtgcaaaaaataagagtgttcataaacatacatacacaggagtttaaattgcagtactattcacaatagcaaagatatggaatcaacctaaatgcccatcaatgacaggttggataaataaaatgcgatatatatacaccatggaatactatgcaaccaaaaaaaagaatgatatcatgtcttttgttggaacatggatggagtggaggatgttatccttagcaaactaatgcacggacatataccccatgttctcacttcaaagtgggaggtaaatgttaagaactcatggaagcaaagaggggaacaacacactggagactatttgagggtgtagggtgggaggagcaagaagggtacaaaaaaaaataactgttgggtacgaggcttagtacctaggtgataaaataatctgtacaacaaacctctgtgacatgagtttatctatataacaaacctgcatatgtacccctgaaactaaagtaaaaattaaataaaatactaaagtgtggataaacatcttttaaaaagagtatagaaagttgcaatagaggatcatggaatatcttcaagacatctcagattttatcattaaatttaaaaattataaaatgtatgttcattcccaccaaatatattgcaaaataataaaatagatcccctaaacttttctcttctaaatttgacaaggggacaaaagagtataaggactatactatttttaatgagagagagaaaatagtcttgctcctttgtagaaataatttataagaatatgccacaataaagcctgaagtatgtgcctctattctatagggggcacaggttcaaaacaagatatttgacctattttccactatgagaacaggattttttactttaattccttagacatgacaagttgataggaaaagcccgcattttgctaagatacagtcatgatgctacgggagttaaatgaacaactttactaaagtcttggtcaatctgactttagtattctggatttatgatgtcatgtgtttaaactctccctgataaaattattaaagagatagaccctgaggtcacataaattcttacccatatctcacttgtttgtcattcaggtcatttctatgtttgttggaaggtgaattaatcacattagtaataaaaattaacagcactgaatcattttagtgcattgaaatgtggaatgaacagtaataatcaaagagtaggaaaacaataaaatctgagttcttacataagaatttgagttgtgaataccaggcaaggcttttgtacatatgattttttaaatattttggtttatgcctagattaaggtatgtgtgagtgttagagagtcttatctccttaagttttaatatatcatatttatcccagtttcttttttttctccctttttaaggaatcactttattaagatatattttacacaccataaaactctcccttttaaagtatacaattcagcagtttttttgttaactcacaaagttgtgtaaccatcacaactacttaattttagaacattttttaaatccccaaaagaaatcctatacttatcagcagacagcctcttcttcttcctcagctcttggcaaccaaatctatggatttccctattctggataattcaggtaaacataataataaaatatgtggtctattgtaactggcttctttcaaatagaataatgttttccagattcattcatattacagcacgtaacagtacttcatttcttttacttttggaaaaatagcattgtaaaatctataccatatttaaaaaatttattcatcaattgatggacattgtgattgtttctattttttagctgttatgaataatgttcctcggaatttgggggcaagtttttatatagacatatattttcatttttcttgtgtacatacctaagagtagaatttccaagtcacgtagtaatgctgtgtttaatcatttgaagaactgctaaactacatctgaagtgtctgcatcattttgcattcccaccagcaattgataacaattccaattcctccacatccttgacaacacttaatatctgactttttgattctaggcatcctagtgggtgagaagcagtaccttgtggttttgatttgcctttctttgttaactagtgattttcatatgcttttgaccatttctatacctttggagagatttctatgcaagtcatttgcattttttaaattgggttgtctttttatgtttgagttgagctctttatatattttagatgctaatgtcttattggatatatgatttcacaacactttctcccattctttgaattatgttttcacatttttgatggcattatttaaagcacagaagactttaagttcaatgaaattcaatttatctatttttctttgatgttgtagttaagaaccactgtgtaacacaaggtcacaaagatttactcctatgttttcttctaagaattttatagttttgccttttatatttaggcctgtgatctattttgagttatatgtggtttgagatagggatctgacttcattcttttacataagactatccagttgtctcagcaccatttgctgggaataaaatattactttctccattgggttatcttggcacctttgtcaaagatcagttagccataaacttatggctttatttctggacattcaattctattccattgatttattcgttaggccaattttgtctatgcttgtaacaatgccatacttcattgattctcatggttttatagtaaattttgaaatcagaaactatgagtcctcctactttgttcttttttaaagatttggctattctgggtccttgacaatgccatgtgaattttagaatcagcttgttagtttctacaaagaagtgagctgggattccgattgagattacattgaggttgcagatcaatttggggaatactgccatcttaacaatgttaagtcttccaatccatgaatatattttttccattcatgtagatctttggttttccccattaattgaagttttctgaatatcagttttacacctcttttgttaagtttattcttaagtattttacttgatactgttttgaatagaagtgttttcctattttcatatttgggctgttcattacgaatgtatagaaatatcattggtttgtaaagtattaatcttgtatcctgaaaccttgctgaactcattagttctgatatatatttaagtagattccttaggattttctacatatacaattatgtaatctagagatagagattctttccaatgtggatcctttttatttctttttctttctcaattgccctggctagaacctccagtacaacgttgaatagaagtggccaccacttatcactcctggccaaaattatttatgtcttcttttaataaaaacattaagatgttttttgttattgttgtagctaaattcatgtgattgacttctagtttcagtacagtctttagaaaatgtgaattgtacatttttggggatcacctttaaagttgtctctgtttcaatgtacctgttcttttttaaaggttgcatccaaagtttgagatatatcttttatcttaggtcaatatttgaaatagtcattcaaggaaacatcacagttacagattaaatgcttttgagggtgtttatcatctctcaaagctcaactcaataaacatagtgttcaagttgtgtgcttaataggcctttgccagagttacgtcacttgtactttctttcccagaatggaaataacctgatgtacatatgaatatatattgaggtagtaaggcttggatagccttactcccataattaaatcctgtatagagcagccaactatattcaactgtgaggtctttactcaatattaacagatccttaagtggatgaaagaaggtcacagaatgcttggaaagtatttctgatccagttgaagaaagcattagatcaaaatgtgaaggatgaaggtgataaaaatgatagacaacacttcttgcctgatattgttgtaagcactacaaaagttgcatgtaatatctttacaactgctctttaaggtatccccatttacagtggaggaaatggaggtacacagacattaaataactcacccaagttcatgcaggtaacaagtgatatagctgggatttgagcctaggcaaactaacttccaaactgtcctctgattactaagctacagtacaatgaagatcaatggcagaggagtggtcagaacactacctggctttgggagactcgcagagtttatttggtgtcccttcctgcattccctactttgtcacccacattatcaagagggaaacaggaagatttcagactgcataagtggggagagctggtaaaatatctggggtaggttagtcagagtgtccttaacacatcctcttttgcttcaaaggtgatatggtttggttctgtgtccccaatcaaatctcatcttgtagctcctaaaattccctcgtgttctgggaaggatctggtaagagataactgaatcatgggggcaagtctttcccatgctgttcccatgatagtgaataagtctcatgagatctgacggtattaaaaatgggagtttccctgcacaagctttttttttttttgcctgctgccatccatgtaaaagacataactcactcctccttgccttccaccattattgtaaggcctccccagctacgtggaaccataagtccattaaacgtctttttcttcctattctcagcttatgtcgttatcaagagtgtgaaaatggactaagaaaggctaagagaaaaggcactgaagctctaaccacataagcactttatctgagcacttcctctgtctacattcagggcttgcttaataagttggttctccttatctccattccatttttgtctcatattctggtttcttgaatttcatttccagattgacattatttgtaattattcaactacatgtttgtagaaagaaacaaatgtgtatgtttatttttcttcaagaagaataaacatttgagaagttttctgtggtgacaaatatttttgtgaaaattagtgacaaattattatactttggggaactgtaggacattttttctttacaagagaattcttctttcaagatagccctcacaacaaaacttggctatgtctctaatcgttggatgtttcattctctctctgtctttcccagcagtacgcattgtttagggaagcagatgacttcaggacagtcatgtaaaagacaagacaaatcccaaccaagccagcgttaggggtaatacagtaactacatggctatgaatgtttgaaacagtattaatttgatttgttagaatttaagtagaaaaataagaaatttctcattgttttttaaggacaacttgtacatctattaaacagaacattgacattgctataataccaagaaaatgttatcccataattaatcttctattaggatctgtctcagaacctcctcggttaactccattccatcctacaccaaaaaaacttcactatcggatatccgcataacactgacattggcatgcacacattccaagcatttaactgtcttccacatgtccaaatcatacaccttcccaggctgtaaggggtatctcagaagtaagaaatgaagataaagtgggattcccattcagaggtaggtggccataagcaggacagtgtaaaattatttgtctatactccatattagcataacctcattcccttaaagcctgcctaacagccctaccacttaccattgttcagtgctttaggaagatgctatgttattctttaagcatgattttttaaaccattttagtttaaatgttaaacagttaaacttattgtgtaatatttcatttcaggaatctcaatcatcttccactatttctcatttgcaaaaatggtaagccaattcagcatcaactagaaaatagaaataatatgtgaaaagacattttcatatgtctcaacatgtttgtggataacttttcaaggcttacatctttctttgacattagagtttgtatagcaagaatgatacacaggctcaggcaaagtggaaatattctcttattacaaataagggaggagaatgaaaaatggataggagtgtcagctgaaaattgtagaatgttctgtatcaagaacacataatacttgttaaataataagtacagtgttctgagtacccaaggttttgttaaaaagtatgtacaataacaaacagagaataataagcagagagcttttgaaattagggaagaactataggatagtatttatattttggtgaacacctggagaagagctgcttgatttaggacaggaggcaagaaatcatacagcaaatgtgtgcttaattaaccacaaaacgttctttcaatgtattagcaatatgatagataatgtcagacttattagaatcactatataaattattcttggccgggcgtggtggctcacacctataattctggcattctgggtggctgaggcaggtgaattgtccaggaattcaagaccagcttgggcaacatactgaaaccccatttctactaaaaatacaaaaagttagccaggcgtgatggcacaagcctataatcccagctactcagaagttgaggcaggaggatcacctgagcctaggatgtcaagggtgcaatgagccaagatcgcaccactgcactctagcctggataaccagagtgagaccctgtctgaaaattaaattaaatgaaaatatcttcataaaagcattcataaatattttatgtcagatgagaggctaaaataaaaaagtagatagtttaacttcccactaagtgatcactcttccatgtagtccaattattaacactcttagtgtcaattccttggagtgttaacaaatgcataagtcctatgctaccctgaggggcaattatgaatataatgtaatttttgcttaatgccaaagaaacatgtttaaacactggtagtccttctgaaatgaaacttgccgtcttgtgaatgtttaatgaatgctatcctgatggtgaaattaggtgaaaagcaagctgatactcagtgaatgaaagctatcgtaggtatgtaacctctcaagttgggttgaactccacatgtaggaattctgattcttacacattgaataaactttatagaggtagattttaatgtcctgatatgatttggctgtgttctcagtcaaatcccatcttgaattgtagctcccataattcccatgtgttgtgagagggacccatggggaggcaattgaatcatgggggcagtttcccccatacagttcttgtggtagtgaataagtctcatgcgatctgacggctttataaggggtttcctctttttgcttggctcccattatctcttgcctaccaccatgtaagatgtgcctttcaccttctgccatgattgtgagactcccccagccacctggaactgtgagcccattaaacctctttttcgttataaattacccagtctctggtatgtctttatctgcagagtgaaaacaaactaatacatgtcccatgaatattttagaggctattagtgattgacacaaaatactttatgagtcataatttgttgtgcctccttccttagtgataaattgaaatccttttaattccaggtaattgtatacaattatttttgatctctagtcctatgtgtgaagaaaagaagtttaactaattagctgttgtagaaatgaatgatgctagttggcatgttggtggcatttaaattactatggatcctaaaaagtaaaaatgaaatagcagagggagacttccactctaaaaggtaaaaagagccaaagacataggaagcaggtggtgattcaggtcattccagaaactaaggcaagagttgaacatagtaaactttgggcaccacatcaaaataaaattatctaagatacagtggctcctttaatttagaaattgttgttagatggtctttaatatggattgttgcttaatgacagttaagattaaagaacttcaactattattaaaagaatgctgtccattttcctattagaaagtagaccattttgagtgtagatatgtatcttgtagattttttcctatttcatgtttttttagtttatctagtgacatttgttaagtgattcatagttgatttttattaaaatttgtagtactatttatcccaagtcttctattttggaggcctaagttgcctgctttaccacacaagtaaatggtactgcaggttatttggtaaaagtcaggagagaattatttcaaagtctaaaataaaattgtcaaaatatgtctttggaaacgtggctctagatttcagaaatacccaaacataatagctcccatttccgtttgagtagtttgggcgggctttatgctgctgtaacaaacaaaacaaaaataaaatgcaactcagttgcttaagaaaacagaattcatctgttgttcagataagttagctgtgaaactgggagtatcttcactgcagctgtcctccatcaggtgactcagggattaggaagattcagtcttgtggctctactgtctcaaatgcatgcctcctctacaatctcctttgcagaggaagagaaagactgaaaatgcacatagaggatttttatctcctctgcacagaagtgatatactttacttccattttcccttggccaaaagtaatcctatgaccacacctaactgcaaggtggaaggaaaatatgattttctatatggtcaataaagaaagaaacccagatattaatgcacaccaatagtatcactctcaccatccttatgatttctaataacctgctatcccagcaagctaaagggaataaaaggcttaaagcaaatgctcataattttaaataacttttttaaaaatgataaataaaagcacctaattatacaggaaacataaaattaaggtccttgaagttggggtcatgtcatatcctttttatattacccaatccctatcaaatggtttgcaacaaaaaaaaaaattgtgagagaacgaacatattagtaaattcatgagagtatgattccttcctttggtcagggaacacatgatttatgttcatatcatgacataaatttacatcaggatagcatactagcagtaataacaactttaataactgtgtataatgttaaaatgtgcaaagcattatcatatactatatgcttaaaaagtcaaaactgtgagattggtatatatgtttggtttgttctctacaatttaaatacataacataacaaccttgaaaacagtaacatcattttaacacaaaacatttaatttttgaggggagagtatcttgtagataaaacatcagaatatttttggtacatataaaagaaatacactttttaaactctctagatggaaatagcattcaattcttggaaaatacaatactacatttgaattaatttgtattatttgaaagatattgtatgactaatgctaagcacatgaatttaatttgcaagttacctataatactgttaaaaaaaattcaggacggccaaacttgcataaaatttgcattagaaaactgagaacactaatgaggaaatgaaacagccattaatcatcattgcgtgactgcagaagggttaagtgggtttctatagattttgcttcacttattaatgacatggttttacaggtataaaagatatgtatacacagatccaaaattggggcgtaggctgtggcaatttatttccccttggatttaaagtaactatctctgaatttttctcaataactatataagtacaaaagataaaatcttgttttaactatctatgtataaactttcctaagagctccagatcagggttactactcaaatatatgtagaattgggttttattaaaaacttactaggataatagtatctcagtatatatagtctttagagtccaaaggatagactgaaatctcagcatcttgattcattaagtatgagactgtagatgaactaattaagctctctgaccattagtctcatctctaaagtgatattaaaatgccctttacaaagtgagactggaagcatgaaatgagaatacacagataaagcacctagcattgcacctgacaaacggtgaaagcttgaaaattcaaattctctttgagtgtacatcattgtgcatatgttattattttgacctcttaaaaggtccaaaatccaggtgcagaaaataaaatacatgaattggaacaaattgccagaactacacacacagatacaaaattcagtgattcgtaaacattaaacacattaccttatttaagtgaaaaaatgctgcaataagattttctgtaaatattttacctgctatgtaggaagtgtcagttctttactttgaagtaaatttttactgctggtatttagttccagagtaaatattttttttacttgagaattatatcataatttaatggagtatttttaatgtatttaatttggaatctaagtttgcatattatcatttgtatttcaatagtactctggttttaattttacatttattttcatttctctcaaatggcactcagttttgtagagtgtatcatgataattcagaatgtttttcaaatactattaaccatccttcacattcacagcattgttttctttcaaaatgataactagaagcaagcaattctagaaatggaaatttaaggtttttttttaattatactttaagttctagggtacatgtgcacaatgtgcaggtttgttatggatgtatacatgtgccatgttggtatgctgcacccattaactcgtcatttacattaggtatatctcctaatgctatccttcccccctccctacaccccacaatgcagccataaaaaaggatgagttcatgtcctttgtagggacatggatgaagctggaaaacatctcagcaaactatcacaaggacaaaaaaccgaacaccgcatgttctcactcatgggtgggaattgaacaatgagaacacttggacacagtaaggttattttttaagtaaaggtgaaatcctaaataagttagttaattgaaaatattgaggaactactaaacatagagcaatgtgttaggtatgctgcagtaaagagaacaagatgacattgtttcctcatttagcaaacttgcagaattgctgagtagaaaacatgcacacaacacaagaaccttagaacatatgacagtgtaaggtaaagtgctatgctttgtcatcttaaaaacaaagagttcaaggacagggggaatcaaactacaatattgaaaacaatgaagacttccaggagaaagtgggacttgaatttggccttgaggaatgaataggaaatggggatacgagcagacacactgatcatgctggtcacagaagcagaaatagtgatggtggggcttgtaaagggagaaaactgaacaaccttattagctttgagatttctggtatgtactgaagaaagattgcttttggataactgtggcaatacttaattgtataacttgtatatcaaactagggaaaaaaaactcatacattttcccacactggtcacattaaaaaacaaacaaacaaacaagcaggagaataagtgttttagaatccatcacctggtagtatattaagaatggatttgaaataagatatattagaagatagaagaccacccaaaagatcattttggccatccagaattggaaattcatactgacaatttaaatgaaaaatgatggaatttaggcaaaaggacaattacaggaggagggtccagatccaacttttgcaactaaggacagctttaggatggaaaaagtatagaggacctctaggatttgttatgatggaaatggggaggcaaaatttgtgctacctaaaataccccagttcctcaagaaatgcttaagcaaagctttccatttgcagaaagtgctgagggagatggaaggctaaccctcattctcattttgcggctaaatattgactaatactttgatgaatacttttaaaaatcattaaggcagccagggaccgtggtgtggctctgtcgtctcagcgattctggaggctgaggtaggaggatttcttgaacccaggaggccagcatgggcaacacagtgaaaccttgtttccaaaaaaaaaaattactaagaaaaaatataatttcaagttccttttgttcatatttatggttaaatatgtaggactgaattcatcattgtgaataggtatttgtttggtagaaatttctatttaccactctccaaaggtaatgcaaaattctactcaggcctagtaaaagcctgcacaatgaaaggctaaactagtctcgcaataaacagaagcttgccttcactgtgggctggttaaagttatgacagaacattttaatgtcaacttattcttcacgtatcttgcaggactcaaatataaggaataagacagagagaaatatgtcaaagtgtattcttctgggagggatgcagaccccagtggttcatggtgcactgatgatggagagagacaaagcatacatctctatgggaaaggcatcattcagtggctttcttagtgatgagatctgatatacaactttaagttttctgtttgtgtgcaataattctgtttaacctcaagtcttcagtaacgtttgttcaacatgacagtttactatcaaatgtggtactgtttggtgggaagtgtgaacttgaaggatgaaacccacatggaaatgaaatgattataacatattgagaaatcctgaaagcatttggttttaggaagataatgaacaacagcaaggagatactggaccttcactgctctcccactcccatccagcaatacccagttattactaaataatggagtacaagattgtatttctgcagtccatcaagttagaatctcattcttggttcagtattatggaaagggtcactgcgtcagatgagttgggacatccagtctacacacgtatctaagctagagatttcttcatagtattaaatgagataaaatgtttgataatcttgtatacactcagaacatagtaggatcccaatgtatgaatgtgatagtgagcaatatttcaataatatttgaagaaaaaagactgggtggattcaaacatgaatacaaagctgctgtttggaaaaatacacaacttcacagaaaacctcctatctcaaccagtacagctttatcatccctgtaatgcatgtcccaggaaaatgttgcaaggattttaagagtttccatgtggaaaagatcagtgtgttcagtgtgtttctagctttacaacatgtaaattatactctcagcattgtactactgaaaaacttttaaacacccaatttttgtgtcagctcatctttggtttttatcttgcttctgcatttgatctatttttaaagaaaaattttccacattttaccgcataatcctctgtcctatcacgaactctttcagtggggatttaatttccttaagaaacaaatgctccctctgtttggaatgttcttctaacccatgaagttgaatctccaagaagtatctggacttatcatattgtctaatattggttaagatgtaactggacttatgagattcaaactcagaagatggaaatgaggggagatttttttttaaggattaagcctgacacagaaataaaaacatactccaaggaatagtgacaaacaaaataaaaatatcagaagactgagagtcccaaagaaaaaaatatctcaccagatttttgaagttaccagaagatcaaggagtccaagcctgataaaaagcaaaacagaggaaagacagaaaataagagtttttgtttcagaaaaaatagacaataaaatgctataattctacaatattattctatttacaagtactgctggctgaataaacactttaagacataatttctgtagatgaaaatgtgtctttaacttaaactgaagtgtttaacttacattgtgccattaaaacaaaggaaaaaaggaaatgttctagctctagaaaatattttttccaattatttaggtgacgataattatttggttaattctttaagttctcaaagaagggagattattattaaatgcacttgaaattctctaataattagtacataaatttaatgtttttatgggagaagcagaccaaagtttcattttaaaagacttttcccatttttcaggtttttgctggctatgacaataattagttctggctttgatttatttttgaaaagtaaaaccatgaaagatattataatgacaaagataaaaggcttttaatttttaaatgatactaaaatgcagcctctattttttaaaggtgtttgaagttcaaatgaaaggcaatatctgaacagcacaaattcccaagaggagacccagcacctgccatgggatgcaaaggttttataaatgttgtcttgtgtaaagaaaatggcaaacattgtgaggccttttgcaaatatgcctgcctgcttctgtgtttgagcagaaatattgaacttctaaccattattattataaaataaaggagattattctttaaacatttgatggtagccttttccttttgtcttgggaatcgagtttgaaactacacatttgaaaaacacatgtctttctttgaaagagaatggagaacacggtaagtgtgaaaggagttgacactattgtgtaaggttttatatgtgcatatgaatatgtgtctgcatcttactgtcagaaaatttaaattaggttatttctgttgggccagaataatctccataatgctggaccactaattggtaacaaatcatcccgaaggaagctattaatattccttctctagtgtctaaaatcatttgagaagatcaatgcttcacttttgaagagtaagtaatggatcttgtcatattattagagaccttactgaattctctagcctggcttcaaagatgtaaaacggatgatctatctcttagaaacctttgtccatggatcttagttctattaacgacctaagaaaataatctgatacattcttttattgtcatattttaagttatttctttgcggtgcgttataaaccacaaaagatttgcaaaaatagaaatgtatacagctcaataaattatcacaaagtcaatgctcatgtaattattacacagataaacaccttgaagttaaccagtacatagaagcctgtggcttgttctgtcacactgggtaagtgtatatgtatatacaaagatacatgtgcagagatttgtaatcatgctgcattaatgtctcatgttcatcacaatatttcaagtcatttgactgtgtgttaccagggagggacaacaccttgaacatatcataggatgtcattgaatatattgtacactgtaatctcagtaaactattaattatctgtatttgtcaaagtatctggattttttgtccagcctatggttctaacttaagttttaaactttatctacttggaatcatgtactacatctctctctctgtgtacttcctttcctttaaaatcttatttatgagattcattcatcttgttgctcataactgcagttagttttcattactcctatagtattccattggataaatattccacaatttacatattcaatccactattggcagatatgtggattgtttccactttggggttattaagaattaccctaccataagcatcctttgttaagagtgacattactgggtcagaaaatatgcctatgttctactttagcaaataatttaaatagtgttacgagaattgccattgttgcacttttccagaaaatatttcttttctgcttaattttagctatcagtttactatttagtggaatatttctgtacttttcatttacattatcttcataacaaattttagtgcattttcatatgtttattagtcatacacatgtgtattcatctgagaaggtttttttaagttatttttatgcattttatatgggtagtctttccttatcgattcacagaagtgctttatgtattctagatgcgagtcctttgttggttatatattgtgaaaatctgttccctactccatggcttccttttttactcacttactgtttcttacgttgaacacctattgttaattttaatgcagtcctattgaatcatctttacttatgtgtcctgtttattacataaaataatcatatatacacatctgtatttgcttctaaaaatctttttatgttatgattactttgcctttcacgtctaatccaaaaatctacctgaaatttacattttgagttggggtaaaatttcattatttttccaaattggtccagcaaaatttattgaaaatatgacattttcaaactgctctacaatattagtcatgaattcagtacccatgggtgcttggctctgtttctagacatttgtgtgttccactgaacaatttgtctatattgtactgtcttacacaatatgcctaataatatgctttgatagctggtagagatttttctaccctttctttcaatatgagtgtgttgactttttactatattgatataatttacataatgtttactatttaaaattctacaattgttttttcagtatgttcagtttgtgcaaagataactactaattccagaatgtttctaacaccttaaaagaaaaccctatatagtacctattagcagccaatatctgattctcttgtatcttcttcccctgataactcctaatctattgtctctctggatttgcctattctgtacacttcatataaatggaatcacacaacatgtgaccttttgtgtctgccttaatttaaaatatttttaaagtccatttatactgttgcaatataatagtactttattccttatgttgctaaaaaatatttcatcgaatggatataccacatattgtttattcactagccgaaggacatttaggttttcatttttttgctattatgaataacaatgctatgaacattcctatatgtgttttcttgtgtgaacatttgtttacagtcctcctgggtatatacttaggaatttcagggtcatctggtaattctatgtgtttgatgaactgccaaactgtcttccacagcaactgcatcatttcacatttccactagcaaggcataaggtttacaatttctccatatccttgccaacacttattttctattttattaaaaaaatcaaacaccgcatgttctcactcatagttgggaattgaacaacgagaacacgtggacacaggaaggggaacatcacacaccggggcctgttgtgaggtggggggatgggggagggatagcattaggagatatacctaatgttaaatgacgagttaacgggtgaggcacaccaacgtggcacatgtatacatatgtaacaaacctgcacgttgtgcacatgtaccctaaaacttaaagtatgataaaaacaaaaattcaaacaacaacaacaaaaaatcatagctatatggtggaatgtgatggatctcactgtagttttaatgtttgtctccctaatgactaataatgttgaacatttttttcatatggttattgcccattttttaatcttctttggagaaatatgtattaaaattcttcactcactcacttttttttttttttttttttttgagatggagtcttgctctgtcacccaggttagagaccatcagtgcgatcttggctcactacaacctctgcctcctgggttcaagtgattctcctgacccagcctccttctgtgattacaggcacgtgccaccatcacgcctgactaatttttgtatttttagtagagatggggtttcaccatgttggccaggctggtctcgaactcctgacctcaagtgatctgcctgcctcggcctcccaaagtgctgggattacaggcgtgaaccaccacacctgacctctttgctcactttttaattgggttgtctttttattgttgagttctaagtgatctcaatattttattagatatgtgatttgcaaatatttcctcccattttgtgttgtctttcactctatggtattattttatcccaataatgtagaattttctacatatagctttacatctttcagtagatgcattctgatttgatatttttatgttaccagacatggtatttttatattacttgtatatagaaatgcatttgatttcttagtgaggaacctcaataaaaaatcatatattaaaattaataatctggtacattcctttcaatttactatccacacttacacaataatagttttatctagtctattcaaatcctttaactttactaaaaaggcatgcatgtgtgtatgcatgaattcacgtgtatatgcacgtatacattttgcattcacgcatttaccaagaccacaaatacaacactgaatacaagtggtgatactgggcatccttgtctttatctcaaaaggaaccactgctactaagtgtgatattagttgtaagcgtttgctagatatttttatatcataataagaaagcacacttctataagaatgtttataataaagggtttttttgttgtccattacttaaatagttacataattacttagagtgtctttttcttgcgcttctcatctttgctaagttgtatttttctagaaattttattcaaaattctatgtttttagaaaagtaatttctaacatcctctcaacatccttttagtatcatcagggtttatagtgatttaactgacattagctttccttgaatcctctattttttttacttggcaagttgcatcactgtcactttcatcagtttatttaaaaaaaaaagccagttgtggttttgttgatcccctctgttgtatgcagtacaatatatgatataatattttccattatattaccttctgatatttattatttctcttcttttgtatttgagatatatgtgctgggtccttcctaacttgttgagatagatacttatattatttttctgcctttttctctacatatatatatatatgtgtgtaaattacaggtttcacttgtaatactggctttcattttcaaacagcattttaatttgtattcatttctaaatattttcaagttgtgttttaagaaattccaaaaatataaatatctatgttttaaatgtcctaatatctgaagattttctacctcatattaatttgtacacaaagcacttactctatgtaatctcaatcctctgaatgtattgaaacttgccttatgattcagcatctggtcattttttatgaatgctctatatgtacttaaaattatattgtaaaattatatacataaattaccttaaatgtgttgatcttgtggtttattcaaatattagaagatgcatgttgtcatatcccaccatgatttgggattcatctttctttccctataagctacatcatttttccttgttatgcatattagccattaatatataaacatttgaaatattcatagtcttttgttcaacagatactattatgaagttgttccattttatctctaaaactactatttttttttttttggagatggagtctcgctctgtcgcccaggctggagtgcagtggcgtaatctgggctcactgcaagctccgcctcccgggttcacgccattctcctgctttagcctcccgagtagctgggactataggcgcccgccaccacgcccggctaattttttttgtgtatttttagtagagacggggtttcaccgtgttagccaggatggtctggatctcctgccctcgtgatctgtctgccttggctccctttcaaagtgctgggattacaggcctgagccaccgcacctggcctctaagaccacttttctttctaagtaggttttgtttgaaattaatagaaccataccagtattttcattgttttttctcaatacaataacaaataattttagtggaaagtattacatgttaaagtaaattctcgggctgtaaactcactagtggaagctaccagctcttccaaggaaagtcaacgaatgctttgactggagtgaatacatattctaaacagagaaaataccatattcaacaacatagatggtagtatattctatgtggctgaagtctgaggttcattgtggaaatagatataacccaacattggaaactagaatttcagacgcgatttgagagacttgataatggaaagacttcggtaactggcaatttgaagataaggcaaagaagattttgggcaaccgggtgatgatatccttcactaaaacaaaccaatatgaggaagtagtagaggaatataaagtaaaatgtaaatgtattgagtttgaaaacgctatagctttttctgggtacatagttctgaaatctgtacatgtaaatctgtggctcaggagaattttacaaattagaggtacacatttggaatttattagtactttagtgatagaagaaacatgggagaaaagaaggacacagaattaataaccaataatagatacacaggcaatcaatgaaatttcaaaaatagaattttttttacaaggagtagtatgtttaacttttatttttatgaactttacaagttaacaacaacaaaaatccagaaacgtttgagttggcttttttttttaaattatgattatacttataagttctgggatacatgtgcagaactggcaggtttgttacataggtatacatgtgccatggtggtttgctgcacccatcaacccatcatctacattaggtatttctcctaatgctatccctcccatagtcccccaaaccctgacaggccccagtgtgtgatgttcgcctccctgcgttggtgtattctcattgttcagttcccacctatgagtgagaatatgcagtgtttggttttcttttcctgtgttagtttgctgagaatgatgatttccagcttcatccatgtccctgcaaatgacatgaactcattcttttttatggctgcatagtattccatggtgtatatgtaccacattttctttatccagtctatcattgatgggcatttgggttggttccaagtctttgctatcgtgaacagtgctgcaataaacatacatgagcatgtgtctttatagtagaatgatttataatcctttgggtatatacctagtaatgcaattgttgggtcaaatggtatttccggttctagatctttgaggaatagccacactgtcttcaacaatggttgaactaatttagactcccaccaacagtgtttttaatattcgccattctaactagtgtgaaatggtatctcattgtggttttgatttgcatttctctaatgaccagtgatgatgagctttttccatacatttgttggctgcataaatgtcttcttttgagaagtgtctgttcaaattaaattagtaaaattggctgagaaacttaaggaagagacgtgcaaggaaggagcatgtatgatggggaccaagaacaagattgtcagcaagatggaatgttcttcagcgcattccaagagcatgtaaaaagaaatgtgaccttcactttcacctttcgtagagaaatgtatgcagaatactcaaattagaagcatcatgtattcagtaataaatggtaatttatagaaatataattgtaattgaatgtatgattttcttttttgtaattttgataaagaaaggaagaaaagggtactattcataccttttgagaatgaggatatgggttaaggaaaggtagctcttgtttaggaacatgttatgctaaaactttgaggtcatcagagagcctgagccatattctttatcaaccttaaaaaaaaacctggcagatttacaaaaaacatggtatgttccttccttcatctcaaatatgtaacacaagacttttatacctagaccttagtgtttccacttagacacacctgttataaatatcaactctttccttcctctactagcttcttttgaccaagatatgtaattcaaatgacatatctgtgggattaaattcaactactattgctaaaatctcaaggttttgcttttttattgttgttatgcatactcattatactggcatagagagacctaaaatcaattatactgttactatccttctttagtgtcttcctttctaataattaataggcataactgtacttctatgtcataccaattactccaaatgatgtgtatttttacattcttatttatataatttatcttgtcctttcagttatgctttttgggatactctgttcccacatagccttaccttctctctacatccccctgcaatggctcatgagccataggctctcagacagtgtttataaaatatgtatgaatgataaaaatgcattcataaataaaacaattttatataaatgtaaagtcacatgccaaatgcatatttcagatcctttggagggaggtagccatgttatgagtccaagagggctggaaccaaaatgtcaagagtctgtgttctgactttactgctttttagatgtattcatttggataatttgcctaaccttcagttttcttatatataaacagaagatcttaatgcctagatctaattacctagctcaggaatgttataaggattaaataagttgttcctatgaaggcacctaggtcagcgcttgtactcaagtgagggcttaatattagataatcctggacttcatgggccatctgacctccctaagggcccatttctctggtaccataaatcatgacctagttcttgacactacctgttcacaatccacaccctcttccttttccaaaggcatgacctttaactgtcatgttaagacagaagaagaaatgaaaacactcctttggcaccccatagtccaaatcttacttcttcatagcaaaaactcagtctatacacacacacacacacacacacacacacacacacacacaatttatactgactgtataaatttccctccaaaaaattaaaggtgggttcgatgatttctatttgactctctataaggtcttgaatttttatccaagaagaaaatatgcaggctaattgatccgataaatctatacattgtagcctctctactccttatagaaacagtgacattaaataacctacacctcctatatcctaacttgtatatgttctacataatgcatctgagtgggcagcatcttgatgacgtcattctatttgtaagacttttacatatacttcttcaacttaacagcgtttctttaagcctaggaattttcttgcatgaatacttattaccaccattttcgataggaattttaactcacttgaggagatttaattcaaccttccaaatgatcacacttcccaaacaagtcataatcaacgatatatcgtcaaggagattcgtgcaattatctacaagtcttctaattggaaatacacattttacctttcctttggagggaaatgagtcgttttagagtagagtggctgcaattgaggcaaacaatttaagtaaaaacaaatgggttttataaaccttgcatgtagatgttgaggactgcatatattgttaccaattttgttagttattttactctgcaagactgagtttgagaatttaatgaccagtgatacattttccacagtgagcttacagaacttacctcaatttagttcaaatatctctaatttatatttgcataaggtttctatttcaatacccataacctttgctattgtagcaatgtcttctctaatgacataagtgaacactacctaaattctgcttggaagaaaaatgctactgtcacaaatactttgtgaaatatacatatacataaatatatcttcaagtatatgtatgttgaataaaagagtaaaagagtaaacaaattaatgaagaacagaaaaagaatataaatctcctagcctggtatgcttgataattagtaagtgctagataaatactattaatataatccacatcataatctaattcatcacacagcttttatgtgagccctccagcaattttaataataccaacaattttacaactaaaaatatgtgcttgagtatatcatttgcatgtagttctaatgctgccctggaatattatctacacatcagaaatcaatagaaagcattttcttgaatctcatttccataatcaacaagctaattcaaatccatgtagagcaaataagtgatttcgattgaaacatttttaatgtcttcaaaaaagtggactgataaaatactttaaacatgaaaagtaacttaattattaaaaattataattataaaaatagttaaccagaagaaaaaactcaaaattcagatatttttaaagcactatagtttatcatgtctctactttttcttgtgcaatttttataacatgaaatagattgtgtggctgttgtttcaatgcaatggggaaacaaaatagccttaaatgctgtggactatgctaaatatgaacttattttcaaggaaaaattcagtaattctgactactttttttgttaagctgcttcctagaagtgaaatgaaggcttcggtcccaccagagaggcaagtagcacaaagaagttttcctttctctttcttccagcaaaatgactcagactatgaaattaaaatttggaaaacatcaccctattaaatttccctctctttatcaccatcgtggcagggcaaatgaatgttcccttcagctgtgttcccatgatttttatccatttacatattgcaattcctcaaaaaaaaatttaactatttcattcccttgtacaaactttctgaagattctgaactcaagagcagaaagtgccttattgctcatgatccttgtcacagtctagataatcttgtagactctagccctttgcctacctttctggcctcaattttgttttcctcactgtactctagctacacaggacatatttcagtttctaaagtgtgttccctgaccccatcacagtgcttttcatatagtatatagtaaggtagctaaatgctagaatagctctcccagttgttgtctctagaacaagagaacaactgaaatcacagtataataggctttaataataaacacattaaataaaatggtagcccttcttatttaaaacaatgtcatcttcattgcttgggatggggaaaaaaagaactcaattaactttgcaaatgaaataagattttatatgagtactctagtatgagaaaccaagtttcctcaggaaacccaagagaaaatctgcaatgcttaaaaaagtttacttcagtttgcccaagagaatgaaattatgaaagaacaaataaagacagcttgatctagaagaagaaaaagattattcttaagaggtatgttgtgatcttaaagggtaagctaagcacatataaaataaaagagacgacatgctcaggtcaaactttttagaagggtttcagaaaaaaagagaagaggttttaatcattactagattggaaagttacttgtgcccaataaatataaccaaagaaaggagacagtctcagagactcaactcttttggagaaaacatatctaaaaatctatcaggggaacaaatctgcagatagagtaattagcacaatgaggaaccacctcttcagtacttagataatcagaccacatggcatctgaacttctgtaattgagaggaaaattgccaaaaagatcaatatagaattcttaaaattgtttcacgtaaatattgtgagtcgatattcactaaattggcataatttataacaaattgggatatgagtgttgcttagccattagggattctgagaagttggatgagaagtgaaataaggcatagaaaagatgaaacacagtaaacaagaacccagcaggcaataatatactgaatccagagctagctcacacgctctgtaggaatgtccatcttgggtcacagttttttacttcagggtgtgaagatagacaagatgtgcttgaaaagttttttttttttttttttggcagatgcagtactcatttattttttaactgtcataagacaaaatatagacaagtatatgaattcctggactgcaaagcaaagttgaataaaaaggaaacagtacattctgaatctgcaaacagtagtagccctgtaggtgttaggaaacgtttaacatgttaaacagttaaaaattcacctgagcctcctagaaatgtggaaggaaacaatagcaggaaatagaatactggggtcatgctccactgctggagagaaatgtattgtagaaataaagaagtttctgatgtccctaaaagaatacaagtttttcaaagcctggaaaagagggaagaagcactctgagcaggagccactgacagaggtattgggcttagcagaccacctggggatgcacatttcaggactatcaacagcttctgttcaggctcatgatttccgatatgaaataaatatggggctaaaagaggaaccctcccaagaaaacatgttgcacaggtttcagcatctccatttctagagttcatggcagcaactcgtgcagcacagaactttatatatctgctcacaatagagtgtgtgagccatgctacaagacagaatccacattcgttacaaaactggggctgaaaattaaattgctttgaatatactatttggggaaaaatggtgcctcagattatacctggtgactgaatcttttttgttttttttttttttttttctccctgagatggagtttcactcttttcgcccaggctggagttcaatggcaccatctcagctcactgcaaccttcgtctcgcaggttcacacaattctcctgcctcagcctcctgagtagctgggattacaggtacccaccaccacacctggctaatttttttgtgtgtatttttagtagagacagggtttcaccattttggccgggctggtctcaaactactgacctcaggtgatctacctgcctcggcctcccaaagtgctgggattagagacgtgagccactgcacctggcctgagtctaccatttttacaaatttctaaacttagcagtatggccggaatgtttcaaaaacactctttgagaaaggaatgtataaacaggtggatttcctctgagtcactgtccatgcaatgttgtgattaagcttatgacagaagaattagatcacgtggagatcacagctcttggaatccagaaaaatggcatgaactgaatggcatctcagcaagggtggtccaagcaagattttcctgggatatattctttccatcattcatcagtgaatcactggttcactgctgtaaaatagtgggttgctgtgttttctgaacttggtgcatataaagatagtatggtaataatcttctatgtcttattacttttatttactttttattacttctatgtcctctgtactttttaaacagtgggatcctacactaaaatctttgcatatttgcatgaatgttcacaccagaattgttcttaataacaaaaataagaagggacaatgatccatagaagtgtttaataaattgtgccatattctatcaatgagctattgctacgtgcattaacatggacagttcagaaaccaagatcaaaataaagacgaaaaaagatctgtcaattgtgattcaacttattttgaaaacagaaaaataaacaacacatcgtaagggatacatacttaaataattataacgacagaaaagcaggatggtgtttacctcaatgaggaggagtactgctgaggtactgaaggaactacaaccaatttcaatgactgatagctgctgaagtcacccacactacttgggaatcagagcagttagctgtctggctgagcaaataaaaaaattatttcaggctttcgtttctttggcctttaacttacgaattttggcctttgatttgactggatttttacacagcaaagtgatttcatttggagatttatgtcaacctctggaaatgtaataatggaagagttatagtgtccacatttggttctttcagtatcagtgacattatattattgtctgcatactgatattcatttattgtgtactactgtaatctacatttgacaacatggctggtgataatttgaggtgggaaaaatcaatagtgtggcaaaacccaataggctaacagaaccaatacctgcaggatgtggagtataatctcccttcttcttctttcctctggtttttgtgagtgtctccattagaacaatccacctgatcttctctttactcctctgattctaaagtttggcagaagaccctgagcacatccacttcagccccctcttgactcctgcctctctccatgcctctcagtttcaaatctcagtcaatttctatgctgtcatgtgatgatcagggagggccaactctgccctgtttgggaggcatttggttgttcagctgcaccaattatcaggttggtaagttggcttaactcagtggtagggtattaagcctttttgcccatgcctttataaccacgttttccaatcatctctataataaaactatttgacctccatttgtctgtctcctgagtcttaattctgaattgattccaggctcaggaggggaagaacagggaattatttattgatcccctaaaccctaagagcagtgattataataaaacactggatgacattatcagatatttattattatcagatcaatcattgtttaacagtcttaattcctttcatgactccataacaagacaatattctatagacaatccacagaatgtacacaccacagggtcagtaaaagaggaatgcctttttaataataaatcattttttgtgtgttccaatattttcaaggaaggaaggcctcaggaagagatttatattaagagtctgacagttcatttggaaacctcataaggcaaaagttaggagtatagttattagaacaactctcaggttagtcacgcttcctgtctctttcctcccctcatccattaaaaagaggaggaagaaagaaaataagtttcataagttgaagttggatttagctaaggtcacttgaaataaccagcagtattttttcactgcctatataaaataatagaagatgctcatatgttgactgatgtgtgtggaactacttgcacagccttcataacaaagagctctggggttttgaagatgggtattttaattgaaaacaactacgaaaaataaacttttatatgattaatgtaaagcagttttacttaacattacacaattactaatacaaattgtaaaagttttgccaatatgctaaatcctttattcctctctctagcgcatatcctaaatgcaatcaaaggtgatgattagatgttttaaatttattctagcaattatatactttatgtaactattattgaaatgctcaaaaataaaataatgtgaatggcaatcacagattttaaaaactgtctttgctttagttatcaagccatccaaaaaaaaagagctggaaatagagattaaacatctaatctatagcaccattacagagaaattatagactccctcagcttatatacaaaccatgatgcctctaccccacattctctttgatgagaaaacatgatccaaaacttctcctccctttgtttaacccagttctgcaccaagacttctacttacctcaccataaccaatctcagtaagagttctttaaagcaaagggtgagcccaacagattcacattaaattgtaatgtgaaactctaacttcctacagaggtttgcactaggggtgtgggtatgtgtgtgtgtgcatagtttcttctgcagcttaccctttaacaaaacataagaaatcttaaataagtgaaacattttcaatcactaacaagatatcttgaggaaggacaactatgaactccagggactcagggcttaatgggaacttttctatttaatctctaaattttatttcccctcccctaattcctgaagtctatatgcttcctccaaaggcccaaggttctgccctattccatttctgtgtaggacatgaaatggaggtgctcagggcagaacaagattaatgagcagccagttggcttcacatgtcgcaatcattaaagtgcattaaatcatcactggagaaagaaatcaaatacagtgcctaattttgattttccaatgcaacttacacgacttcagaatgttcgtggcctctcctgccacagcagacaggttcttgaatgaagattctaaacatgcacactcttatccacacaataaaacaaacagaaaattgctcctaggtgctatttttaaatctccactaagtattgaacttaaaaaaaatatttttacaagagtatcccattattagacttcctaggattactataagtcccctgcaagatgactttagttccaggcttatttattcatttatttttaaatcactgctcaaagcttggagacactaagaattaactccaacaagtggatatgaagtccaacttcaccactgactgggttttgaactccagaaaaattaatgcaacattagaacctgagttaactcatctctacaatgggaataataatgagaataatgactaccttttataaattgaattatgtcaccctcaaaaaaggtgtgtctgaagtcctaaccaccagtacctcagaatgtgactttctttggaaagagaaactttaacagaggaaatcaaattaaaatgaggtcatgttgaagtgggatggaccacttatccaacataactagcgtccttttaaaaagaataacgtgaagaagagacacacggtacaaacatcatgtgaagatgaagacagagattggaatgatatatctactagtcaaggagtgccaaagattgccagcacaccatcagagctaggagggggcgtgtctcatctccagagctatgaaataatcaatgtctgttgtttaagctgctcagtttgtactactttgcaatagcaggctcagaaaactgacacactactcaaaaaggtgattgtgaggtttaaataaagtgatatataaagcatgtcacacaggataagctcttaataaattaatattaaaaatagtaacagtggtgggatattttgaaacataaccatttggtagattatacaacaactatattcgatttattcttcatttctatttttaggaatttaaataagaaaatattccagtggtaagtcaggagacaatgaaggaattataaaggagataaatttcttaccagtcagtgtgtgctaattgtttcaatcccctgtaaatggtttggcacgagaggaggttggaacacttagctaaattgaagtttggggattatctgtgaatttaaagtatctatgccattttggcccctattagcacaagtaattgagaggaaaatcttgccagttatgcttttccataaggcttaatgtggacttcgatatttaagtaattcattagcaggcttaaatggtatcatggaacaacattaaagtacgtaagagatagtctgtgaccttcattttagagatgaacaaattgagacccatagaggttataatgaactcaaggtttattataacagtttacagtggaaaagctgacactggaatccttgtgtactagtttcttgtaaaaatggagtgtgcctttcaaaattctgtgagtttgatttttagaatcccgtggagctttttaaattatcagaactccaaattctgcacatggaactttaagatcgaggttgagggaactcagatccagggagaagaaaatgacattaacattttcagtaaagaaacctcaaaagtttcatttggggaaggagatgcagtggggacggagggcaagtatttttacactaaaattatcagctgtatacaattttagaaaaatcgttttacattgtttagaagatccattaaatatggcctggcacgacctttctaggacaagtcattaaagccctaaatggtatttggaaatgctgctacctcagattgaggtcatttgcattatataataaaacacacagcatactttgcttggcaagttcactggaatggctgaactttggccccttgcatgattttgcaaatacagagtgtacttgttctctacttaacaactaaccccacttaaattaaaacaagctgcccccttttcacctctggtgtgctctgcttttaagtatgcattgtgagaagaaatgttagacttttaatacaacaaactttgtttcattgcattagttttttcactttggtttattattttatattttcagtttttataggacatttccatgtggtctttccccaaggacatcactactgtaattgaggggcccagtacagaatctattccagaaagaatcattcagtttcattttgtagcttcatagcccagaaccaaaacgtttcaaaaaacactcaataacaccaatacagggacccctctggacaacatatcaatttgtgttatgaagtgaattatagctggacccgccagagctggtatagttaagtgtctgtcagtgtttccattatactttgagggctttgttcttggttgcaaaaatacccttcaggctaaagcacgcaaggctaatgtggggagtgactgttccctttgtttattttttaccatttaaaaacactagctctcttgtgtgtttgcttgttatacattttaaaataaagaaattttggttttataaatcaacagtctgccagagtgatggtggttttaatggggtgagcttagggtatgaaagttcacaagagttggtgtgatccacattgtgcatcctggaggttatcaaagcctcaaaaaggaaggtccaatgtgtcgcagatgctctctgaaaattacaggtgtaattattgggcctctaaattttaaattcagaggtcaccatttatatcttggatggaatatgactgcattatgtttagggtttagctttgtcttccctttttcatgcccctatccttacattgaatccatgcaaattcttcccttaagaacctagctcaaatttcctattttctaagaaaactcggatttcctcaaatagactcagatgttcttcccataagcttacttagatcccctagatccaatatagcaattattatattataccatttgtctgtgtgtctttttcttcaccaggctggatgatctgaggaaaagaactacttattagcagaatgctagacatattaaatattaaatatgctcagtaaaaactgattgcttgaatgaaaggatggagggatgaatggaaatgtgttctgtgaaacagaattaatgacaagggaactggaggaatgaaagagtctttgaaaaacagggactatctttaatatgacttcctggttctagttttcaatcttccagagggtacaaattcttacacgccccgtaatgaagaacctcccaggaaactggatgacttgtaaacttttactggaagaaataaatgcaatgggatttgttgagaaaactactgttcaaggagcaaggagatgaaatgtttattctgacttagtcactgactcggtgaccctcttcaagttacttaacagctcagtgattccatctctctgcaaatggtgataaataatagcagttcttgacggcttcacaagaatatttggcaaaaaatgcattagcatctttgagacattttattaacaaacaaactatatatattacacaatattatactgatattacatgctatgtactaaataatttatttttaagggcactatattgttgaaattacattaacctaatcacaaagtataattggaaggtttgtttcttctacttgttacaggcagttggactatattctaaaaagaaagtttatgtaaagtagattgttcaattgtttctgcatttagcatgtgaggacagcctatgtgattggtatgctgaataagctgtcacgttctacctgaatcaccaaacacatcttcaataaaaggtgctaaggagaattaccaatgcttttagaagaaaatgatggaggaaattattttttttaatcacaggtttgcaaagcaggttagactttaaggacttgaaagcttccagtgtttatcaaaggataatttgcgaatcagctgctttgatgtaacctggaatattgtactgcagagccacagaccccattctggatttaaggaataagaaattttggggagatatacaagaatctgcatattaaacaagatctccagatgattcctataatcactcaggtttgagaaccccagtgagatcttgcatcttttggttcaggaggcaaatgaaaagagtacagactgcagaagatcaggagaaggaaattgaacttcccagtgtaccaaggggtgataaatgatcatctccctttaaaatcactgagtatgctaccttttgtagaatttgagaaggaattagaaattgttttaagggtaaaaattgggaaaaaattgtactaaaaagacaggaaaaaggaattgacagcttcagtttgttgtctgttaccacggtttaagggtagattgtatttttggaagaataaggcagagctcctcaaactcttcctcattctttcttcctcaggcctttggaggcaagctgatctgcttaaggttcacaatcagttttatatttttctaaaggtttgtgcttccagcaactatgaagaaaaattgggtaaaataacaaatatagtacagttattataatccttcgctactgttacttgatacagcttggttgctttgtttctattagtaaggtagcatttacacacgtggaaatttaagcaattgtataaaagaatacaaaggcaaacgaaaaacacctgaggttctgatacagcataggaattactgctctcattttggtaaaaattcatttagacttacttactcattgtcaaatattattcaatttatataaaattatacctgtaattacatttacatattttacatatataaacataaaacatataattttatattttaaaacattttatggtttgcttttccatgtcaatgatgcttttaataattatataatcatgaataccgttcttatcaagtagaaaataattagaccgaggttagagctgctgtcagctgttttatctccttcaattcttatattgaagaaatgcattccctctcataaacctttatattcctcttatttttagattgaggatatctggaaaactccctccttctttcaacacctctctgttctaatatcgacctcaagccactttagaaaaaaatattctgacgaacgacagagatgaacataaattctaactctgagtcttctggagcaccagagggttatgtgagattcattagcttctaaataagacaaagtctatggtttctctctcagtatttgcctcttgtgatgactttgatccacacttcctggagagtgcttgctagaacactagttcctttggattcaaaagagagctacacaagtttaacattgtaacatttattcagttttaacaatggtttacgttcattgtattggttactttattgaattcttacaaccaccatataaggtaaaagccatttctatctatataggaataagtgggaaactgagcctcaaagagggtaagcagaaggtccacacaacttattcaagtggagcagatagggggtgggggttggaggaatggggaacaactgtttagtggatacagagttttcctttggggtaatgaaaatgttttggaactggatagagtttgtgaatacattgtgaatgtactaactgccactgcattgttcactttaacatggttatttttatggtatatgaattttacctcaataaaaaaattagtagagcaagcaattaaaccctgtcagattccagagaccacagtcttaaagattacaaaatactgcctcccatgtggttaagctagctccacatttttctagactgaacattagtgactttctactgcagaagttttcaatgtctttgttgtgctgaaaaacatgctagtcgttttcaaattactttttctgtgaagctcattttacctggaaagtttccacaagaatgtgtttcataaaatacttttatagaatcactgttttcttcaaaccaatgaaaagaatgtttattacagaattattttatcttagatggtctacttagtatgacagcaaaagttcacaggaattcaggccctataacaaagattgggcagtttaccgagattccctttatgaccattccttagcagttgttcataatataaagagtaaaagtgcaaaggatactaatcaattttatcttttattctctgcttgaaaacatttaatatttactcttcggttaagtttcatgcaaatagtagctctgctacatgcacataaatctatttaaatatcatgataaaagacaaaagatgtaaggaagtatacattggcatctgcaatttttaacacagcagcttctgggcttaaataagtctttcataagcaactgaaaacactaattttatgaatttgaaaaaacaaatggatgtttaatgtaaattttcagtatcatttttgttcagttattttctcaatagggaagacaacgatttcagaaaaagttaaaacacttggaaattcagagcaataatttattataacataattatctcttatttgatcaaaataacttataacccaatcttcctattctctttttaatatattagccactagaatttcatagaaaggatgtggggtttgggattagctaaaactcagtttgcctgtcacatattatgcattctattattcagtttctcatataaatataagaaaggatatgcctatcttataaaatcttcatcatgaattcataagccatccttccaaaaatatgtatatacttttaaccatcttactcatcataactaagaattttgactctgctaatttttaccagcctgccattattgacttcacttccttctttgcacattgtggagcccaagtgaagccatttcctggggggttcctagaacccccgaatctctgatctaagtcataattattaccaacttatcagtgcttacatttggatagttccactgccatatctgccggtgagcctctcgtgttgctggggaaaagtccccaaataatactgattgggtgtattgcaaacacatcctaacacctgcgggctgtatttgaactgctcagttcacatctcaagagtaaaaatggcaaaaaaaaaaaaaaattgtattctcccttagcagacttttttttttattcctgaataaaaacatcacttatttccttataaaaaaacagacattattcaatgtagctctcttacttccattcgcttggcttttgtatatttttattgatgtttacttttaaggcagtttttattttatgaaagcaacacaaacccatgtaccttctcatatgtgaagactgctatatgcccacctgtgatggtggctgatgaggggtagggatgggtaggagaaggtcaaacctcagccagctctgccacattaggcaacactatagaagtgccctcaagaagtaatctgaagaatcaccaaatgattgtgagagaggcagcgtgtgagttccaggttctcagaaagtacataaagccaaagatagaacagtggctacaaccaacaaaggagagacagcacttgccaaggagagttacatatggaaggactgtgtccctccttcctcccttgccccaaccaagacagacagcagggaagcagaaaaagacatgagaaagcaaggacgctccagaacctcttaccattccctcatcgccacccacccccaacccccatcccactactcccaccccccatatattcagagcaactggaacatcaagtctctcttgtgtacaggcaaggggaagatctctgaatcaaatatgaggttgaagatttaaaataatcaaaactaattcttaataataaaaataagacactttaataacaaaaagtgactgaaaagctatagaattgtcaaatgtgattaaggtagcaagtatgttacccagcaagaaaggaatgctgtcagagaatggaaggtggtgtttaaagaaaaaaagttgtatcattttataccctcaagatttcagactttttatcaaaccaattttgatgatttccgtagtaaaataattttcaaaaataacttattccttaatttctatctttgagcaagcaggtccctagctcctttttcacagtaaatctattcctagcctgatgcccctgagatcctatagtaatacacatatggtctagcctgtgttcagtcagtctgtactggtaatgattacattggttattaaaatattaaactactatgtaccattggtaaactggcactgactgccgcaaaccccagcccctagtgctctggtagtcttggtcgctcctcaagaagtccccacaacccagtaattaaagtgttaatgctagtacagctgaggagcctcccagtccctgctctactgagtggagttctgtttggttagcaccagtaccttattagttttaaattttgagtataaactcagtctgtaatgtagaattcagaaaatgatgcaaacatcttcaaatagtcaaggtctgtcttttttttttttttttttttgagatggagtctcactctgtcacccaggctgaagtgtagtgacgcgatctcagctcactgcaacctctacctcccaggttcaagcaattctcttgcctcagcctcccaagtagctgagattacaggtgcccaccaatacgcccaactaactttttttatttttagtagagacggggtttcaccatgttggccaggctggtctcaaactcctcaccttgtgattcccctgcctcgggctcccaaagtgctgagattacaggcatgggccactgtgcccggccaaggtctgtctgaaatgataaattgtttcctttgccactggatctcctctgtaaacaaatatgctctattctttctataatttcaaatatatctttctttccttctcctctaacctggtgttgtacattttgctcatgttaaacttccagtattgcctgcttaactagattgccaagattgtctatcactagacattcaagataatggattttccctctgaagtttctcatagtgtcttgagaaggatctcgttacaaagtggatatcgctaccctatttctgtgtgtaatctgagttctagattgtagcctcagcaagcttttcctgtctccccgggtctatgccacatatcaaaaatacatctactttttttttgttactgaaaacattcatacatcttactgaaaccactcaaatgctggtagtatttaaggtgtatgataagtgagaaaaccttagtgttttatgtaagacaaagtccaggaaatagaagagtatttatttacatacagtaaaatttttgagggtaaaacattattctgaatttcaaggagacacaagggcttgatatttttgccctccaagacctgctccaataccttcttaactgtcacatgttcataacctttatttctatcctttattgcttctcaggacttcggacttatatgtacagcctcctgattgtctgtctggactttgagagatctcttcttccccatcatctttactcagctatcatacacacacacacacacacacacacacacacacacacacacacacacacacacacatatatatatatattccagcactgttcatacgtgtactcaaaactcagcagtttacaaataatctgatgaggaaataggcaaactacatgaagatttcactgaagaagatagacagatggtgagtaaccacatgaaaagacgttcaacatcaatagccattagagaaatgcaaattaaaaatattaattcaatgagatatcagtatatacctatcagaatggctaaaataagaacgatcaacaccaccaaatgctggcagggatacagagaaatgagctaactcatacatcactgctaggaatataaaatggtacagctacactgaaaaacagttgggcagtttcttataagactaaacatgtaactgccatacaatctagcaactgtagtcttgggcatttattccagataaaggaagacatattcatataaaaacacgtatacaaatgcttatacattagtgtaacagacaaaaactggaatcagcccaggtgtctttcaacagataaaaagttaaactgtagcacatacatacaatggaatgctgatcaaaaataaaaatgaacaaactattgatacatgcaacaacttgggtgaatctccaaaaattaggctaagcaaaaacccaatcccaaaaggtatgattccatttatatatcatgtttaaaatgacaacattttagaaatggaagacagagtagtgttgccaggaagtattgtttaggaagagggttggggtggaaaaatggagggaggtgagtgtagttataaaaaggcaacctgtcaaatgctcgtagtgttggaactattcaatgtcttgactgtggggtaggatacttaaacttacaaggtgatagcattttatagaacataatgaagacaaacatgattacaatgggcatggggtaaatctgaacaatattgggggtttatctcaatttcaatatgctggttgtgatattatactatagttttccaaaatgttgccattagggaaaacttggcaatgtgtacagactctcttatgttttatagctgcatatgaatgtaaaattatctcaataaaaatttcgatgaaattaaaaaaaaactattcattatcattccatcaaattgtctccccttccccccactctgtatttctacataaactgaacagaattagtcccaattgcctacatcaaaatctgcgaattattccatgctccacctctttcctctttattttgatcatgtttgcaaaatataatattttaatattcattgctttgggatattggtctgcttgggctggcttaacaaaataccaaagactgaatgacttaaacataaatttattttctaattctggaggagagaaagtccaagatcaagtgtggcagcaccacctccataactgtaggccagtgtccgaatcccaaggctataggaaaccccacccttacatcactccaggacagtcctgccctcaaggctctgaacagaggttgtctgacctgttgaaactgtggcagtagccctgataacttccctcttggaagaatagtgaatgtttgcagccaaaaagccctattgtcctgtcaagtccaagaagtccaacagtctttcttcactttgtcccatctttgtcccttcagtaaaaactggcaggatttcagctggtataatcccaaaagctcttcttgaagtgacagtctagctacactcttggtgttctcttcagagtacgcttgctttttttgcaatataaacagactgaaaattttccaaatctttaggtttggttccttttatttttgtttaacagtttgttcttcaattcctctctctcctctgacattttaccatagcaatcaagagggactaagccaccctttcaacactttgctcagaaacctcctcagctaaacatctaattttattgctcataagttccacaaaacactagaacactattcagccaagttctttgctgccttataaaaaggattgattctcttccagtttacactgacatgatcctcatttctacataagacttcatcagaaccgcatatatttctttcatgcaactcagaactcttctagcctttattatcaagatgtgaagacacttccagattttttaggtattattcatagcagcaccctatttcttgatgtcaaagtttgtcttaatcagctgggttgccatagcaagataccatagaccaagtggcttaaacaaatgaaatttctttctcacatttctggaggctgggaagttcaataccaaggtgacaacaaggtagattttattctgaagctcttctcttggcttgttggtggttgccatcttgctgtgtgttcacatgatctctcctttgtgtgtaagcagagagggaaagagagagcgatctcttcctcttcttatacagcctccaattctatcaaattaggatcccacctttatgacctcacttaaccttaattacctcttcaaaaccctgtctttatagcagctgtgttagaagttattcaatggattcatcctacaaaatgtaaaacacatcaaagtttcaagaaaaaatagaaatcacacatatgcatacccatgacatagagataatcactgttaataatgatgggtgtgtttcttttcagtctttttctaagcattttcctgaaccctgtcccctaacaaaagcacatcaaatacatgactgagtacccatccatatgtatctgttttacatacataatatatatgtattaaaggggtatggtattataatattatttcacaatttgtcctgtttttaagaacagtcttctttaaaaaatcttcaaaattataattttagtaacagtaaaatatcccacattttatcaaaatttataaaaggttccttattattttgtttcccattatcatgttacaaataacaatatgataaacacatcattcataaatcttagctctgtaaaaataacctaactataatctacatctaccttcaagaacaaagtaaaagggttcagctccccactttccaatctgtacacttactgctactatcattgtttgacttcagacaacacattctttatttcactgtccttcttcttttttgataatttgcattaaaaagtttattaacccctaagtactttaattccttttgtcatgtcacagaaagaattgaaaattatatatttttaaatagacacaatcacattgaaatattatgcattcttgacgacctctcaccctcatgcctctatatatgactgatatttggccaattcctcattttttaaaatatatgaggtgtcaacccctccaagaagccagattgattaaaatttattttatatttgcacgacccccattccttgagcacctctccattgtagcatattgtgttaaaattaatgtatttacatgtctcttcccatctaagattataactcttatgaaggcaaataatgtatctgtttcttctttgtacccttagcacctaatgccatatgacacataattatttattaatgagagttgaaacaaacatttgaactaaaatattatgggcatgctatggaggtataattttttctaatctatctacattttataatgcggtgttccatctttgatcatactaacaaaacctaaaattaaatcaaatgcattcaaaatatgcttgtgcaacatgaagaccccttatgtatgacacacaaatctttaaaaaataaatgaaattttgaaaagaagttcgcaaaaaccgttgcccccacttcaaagaaaagagtgcccacctaaaaagataaagacaaatattatcacatgtgcttacataactcaaaacttacaagtgtatattagaatcattcctcttctattaataggatgattgagattattattaagaagtttaaaacaaaatccagctgattacagaaatggaaaaaagtaaaatcatatttattatatgtttattacataacagatataagaaacactttaggctaattgtatcattttaatgcctccacaacccctgtgattattgttaataaattcattttatatcttaggtagcttctccaggattccacggatagcaagtgacagactcatacttcaaacccaggaaggtccaatttcaaagtcacgatccccccaactgcctcacagtgtaataacacctaggaaatgttctagttttcagttcattaccagaaatatcattttctggaatatcaggagaaaagagtggtaatgactaacagcaggctcgaggttgaagctgcacatccatgggaaactgagattatttgcattgtgctatgtttgattaagtccctgccaaatgtcatgccaaagccttgacacaacagagatttgtgcctggagccattcattccctgtctggcagtgcacgtcagctggcttattttctttggatattctaaagtcacattagtctctttacagatatggaaaatgaccaaaaaattatatgaaaaagagtggcaaaaaaaatatctgggagagttttcaattttattatctcagaaaattattaacatacgcatttataggaggctttcttcttccatatgagtaacactgcagaaaacatagagtatgttttgggccaaataaaaaatatgagtatgtacatataaccgtatttccccaagcattacgtttgcatgagatagaacaggcatcaattactaatgatagtatatatgcctacatttttctgataacctcaaaccaaggatgcccaacttttatttcaatgtaaaattactctaatacagggaaaaataaagaacagtgactcatcaagtcatgtgtggggctggaagaaccttgaataggatagctgatgtagagaagttttagagaaacccttgtcagacattgtgaatctattcaatatttaaatatatctacaaaaatgataactaaccttctcccactacctaatcctgaagcttacgtaaattcttttattcgtttatttatttttgagacggagtctcgctctgtcgcccaggctggagtgcagtggcatgatctcggctcactgcaagcttcacctcctgggttcacgccattctcctgccactgcctcctgagtagctgggactacaggcacccaccaccacccctggctaattttttttttatttttagtagagacggggtttcaccgtgttagccaggatggtctcgatctcctgacctcgtgatccgcccgcctcagcctcccaaagtgctgggattacaggcgtgagccaccgcgcccagcccgtaaattctttatatgttagttcaagcaatttttctcttgttaatttctctttagagaagccgtgataattaatagctcctgtatgtgatatttattttgtcagttgtcatcctccttcacgactgtcctcaggaatcttagttcccttactcagtactcacaggttttcctctatgtaacgtttattcatcttatacattttcttttcaactctcttttataactcagttatagctcatgatcttttcaataatctttaataacatcttttttcatgatagcattccagtttgaaataacaggcattgtgtattaaccttgaactatcccccctatctttcatgtagtacgtttatatactgtttactgagctgttaatgtgtttattttcctaattccttcctctttttaaattggttttaattctaaatgtatttctctatttgttcccccaaaacctagatacttttaggtagttcttgcctgataatttaatttacatatgtcctatttcaataatttcatcttcagagtcattaaagacatgttaaacatctttcatcaacctttgaatagttccattatttaacttgcaagagcattagtgttaacagttcttttaatatagattttatggattaaggctttctgtacccaggcaatggtatatatttgatagccagaattctaattctgatgttttctcactattacatattaccagacaaaaagtgcatgtcccatgataccgtatttccaagcatgcaacagtaatataattattgtcataatatttttatacttcatttatggagaaattttaaaatatattttaaatatactcacctttgtccaaggcacattctgctgtggtctcaggacagaaacctaatataaaagaaagaatatttctattaatatacttagtaaatgcatagattgagaaataccaatatataaaactaaaataagaacaaattttaaaactccatcattgctcatattgtgtatcttcccattaatttcaaaaagatgtcttatcttttttttttaattaaagcacattaagacaaaaaagacagaatgcaaatactctgtaatacttcataatttgaacccaaaggacttctgttcctttatgtcttaaaataaactttccaggaaaaaattatagaaagaaagaacatatacagatatcaattttatgcaaaaaatcaaacatcgcttttcaaaaatgctacatgaattattagatttaaatcagaaagatgaagcaggttaaatagattttataataaaagcattataatgtttgttcatcaaaaagtggcagtgaagcactcattaaagttaacagagatagacttttatagtaataatgtttcaaaaactttcaggcagtgcatctagaatgaaggcacagataatagatttaaatatgttctaatgaacttgagtactttaaacatcaaaagagaaaatagaattgctgagttgaagcaccaaatttctattatttctagcttattattctatcagatgcagtgtcacatttctaaatatgttcagaaactcatctacctaaaggcacagattatctaaatctgagaactcacattgcaaatgtgataaatctaattataagaatttcaattaaatgtagaaggaaaaaatcactttgttcatatgttctggcattctatctgcctaaaatttccagaaaaaatctatttatcttgtgatctctaccactattttggagtaaaattttttgctatgaatgaaaaataacaccctaaaaaaatagaagtataagcaattttcttccatatttaatattctcaaactcaaagaatttcagttctagaagaaacctaactggaccatccagtaaactggattcagacttatgatttaagggattggttgttattgttatatgaagatgtctatggagctactgggtgatggaaggaaatcaggttactgtgtgttctagaatgctccgtaagctatcatcgaaacagcacaaaatacaagtgcatccatacatacaccatcacttagatcatataataattagcaacaggatgttgttgcttaaaatacatttatgcttgtggttttatacatatataaaatcccctaggccaacttctttatttgatggccaaaactagtctttttcacaccttctagattttatttgaatcttggttccttggatagctaatcagccaacgctgtagactacttacataccctctctgagacttgaattttcatgtacaatgaagcagttgtaaagattaaatgagtcattacaaataaattgcttagaacagtttttgggacatagtgactaataaatgttagctattaaaactattaacatttgaaaagtaaaatattaaataattttgatattttaaatatacttatgtcttattcataaatgatatttctactctaccacccgtcagtgtaaaaaccttagcttatgtttcatttcttctcttattatgttcaaattaattgagaaacacaagtatggatgataaactttattcatgaattttacatcagagaaatcaaagtaaaaatggcagtactttttttttggcagggacgaaatgaggcattttaaattcttcctaatagctataattttatgttctatgcttacatgcagtctggcatgactagagaaacagaaaacctccttaaatgacaaggaaacaaagttttccacaggtcacataagaatccaattgtctaatagccatgaaaacaaaagtatggggtaaagggattgcttaaacctctgaatagtcagcattactgccaggctatgatgaatttatcacagagaaacgtggtacgaacgtaatcagggttgagcttaaagagtaaacagacaaacttcagtttgtaacatgcacatctctctagccattaggaatagcttcggcattataatcggattaaggttacttgttctgatttttctgataggcacatacaccctaggatgggaataagttatagaacgaaggaaaggaggaggcatatttactatttaagattggtttaatttaactttaatataggctaatattaggaggaaataagacttcagaagacaaaaagaaaaaatgaacaaaataacaacaaggaaagaagaaaaataaaacgactatgagcttaataagaaaagttctgaaagtcaagcttacagggtggacgatatattttgtaaactacattttaaccagaagcccttttatacactggtggtgtcaagcttacagggtggacaagatattttgtaaactatgttttaaccagaagcccttttttttttttttttttttttttttgagatggagtctcactgtgtcacctaggctggagtgcagtggtgcaatctccgctcactgcaagctccgcctcccgggttcacaccattctcctgcctcagcctcccgagcagctgggactacaggtgcccgccaccacacccggctaattttttgtattttttagtagagacgaggtttcaccgtgttagccaggatgggctcgatctcctgacctcgtgatccgcttgccttggcctcccaaagtgctgggattacaggcttgagccaccgtgcccggccaccagaagcccttttatacacatgtgcagaacttgcaggtttgttacacaggtatatatgtgccatggtggtttgctgcacccatcaacccatcatctacattaggtatttctcctaatgctatccctcccctagccccccacccaccaacaggccccggtgtgtgatgttcccctccctgtgtccatgtgttctcattgttcaactcccacttacaagtgagaacatgtggtgtctggttttctgttcctgtattagttttctgagaatgacggtttccagcttcatccatgtccctgcaaaggacatgaactcattctttttatggctgcatagtattccatggtgtatatgtgccacattttctttatccagtctatcactgatgggcatttgggttggtcccaagtctttgctattgtgaacagtgctgcaataaacattcatgtgcatgtgactttatagtagaataatttataatccttggagtatatatccagtaatgagattgctgggtcaaatggtacttctagttctagatccttgaggaatcgccacactgtcttccacaatggttgaactaatttacactcacaccaaaagtgtaaaagcgttcctatttctccacatactttccagaatctgtagtttcctgactttttaatgattgccattcttacagcgtgagagaaattttatattacatcacaatttaacaagtaacaaccaaagtcacttttaagaaaaatacggtggtttaatcttactttttttaaaatttacaccaaaataacaactgaacttccataagcaaaactaagatacatttgtattggtattagttatataaagatgcaatatgttcagtgccttgaaataaaactaatccttgaacacagtattattttttgtcaccatttaatgtaatctaaagtgaaattttccactattctcattctgcttgttttcaaatgtctcattcctatcataatactcagagtacttaacctgtaaaatatgaatgttttcttaatattgatttagtgatgctgacaacataaaaaacaggccatgtttgtttgttgattgcttccaagtatattcactgcacaggttgaaaatctggagaaaaaaataattccataaaacagttcattaattacagatggatttctagagccaaagaagtatattgatgaaatgagaagaggaagggtaggaggtgaggggaattttgtttttgttgctgttattttacagttactgtgctttaaaagagaggtctatatttagagcctacttggaaatggtcaaatatgcacagtaatgcagtatcattagaactacaaatctttcctgtgttttgactacaataagaggtattcttacaaaagcagatggaagtcaacaattattacttcaccagagcagaatcactattttactccaaaacaaattaaatgatcatcacaatgatttatgcaccttatgcccaatctgaatgttgtaaagttgctcaagattatgttctttttcccacctttattaactattagtatctaataaatttgactacataatatatctatataatttccagagatacacatagagtcaatgttttatatcatttctcatcactgtctatttcttttaaggtatctgatagttaacacattcataagtgtgtgtatatataagctgcatttaaaaaacatatttccaaacctaattcatattctgaagtacataattattttatgtcatttgtggtcaaaattcgatgtatccatcttgttactgtaatggaaccaaccatgtcacacatgacaagtttataaccataagaagttgagcttatcgtggaagcctttctctcagttgtatcattgtttccctgtcaaagctgtcagaagatcataaggataggcagcagagttactccacatcaccttatttaaatgttaagcctttaaaataacttacttttttcaacctatcttggaggaacttttaacttcattttaaattccctactgacatacaacccaatttcaagagcatacatccctactgatgtgtgacgtttcaatgacattctgtattccaaagaaagatgctctatacagtgtgtaaaccgaatttaagaaatcaaataaaattattattaaatccaatgtctttgtatctgcttaaaccagatgtgttgtaaacagaatgacttcaaaataaatccagaacaataagtgtgcaacatattttactctcataaaagacagtaatgatgccataataattagtgaataaacagataagcatcattgtttatttgtattacattttaagaagaaactagaaatttcaacatattggtgttatgcgctgaattgtgtcccataaaattcctgtgttgaagtcctaacccccagtacctcagagtataagtgtatttagagataggatattttaaagggtcattaagttaaaataatgccattagtttgagccctaatccaatgtgactggtgtccttaaagaggaggatgctagaacacagcgagagatacacagaagacagaccacatgaagacacagagaagacggccatctacgagacaaggagaaagactctcagaagaaattaaccttgctgatagcttggtcttgaacttttagcctacaaaatcatgaaaacatacatttctgtggtttaagctacccagggtgtggtacttttctatggcagttctagtaaactaatacaactgataatttccagttagagtgtagctttacacaaatatgcgacgggtaaattttatccttagtgttcttgcattttacatttaacatttatctctcacgggctcatataatagaagctctcttgatattcctaggtttcaaagggttgtccatcagtggacacaagcttctctttcctgctctgcaaatgccttctaaagcaatctattgacctgaagattgtctatcacaaacactttagttactgagaatagcttagtatatatctgtctctgatgatatctgtctatataaagtaaatattatcttttttcatatagcaagtctttcacattgttttgatagtaatgagcaggtgtgataaaattgccatcttcactcattgctggtggcactataaattgaaaagcaatttacaagcttgcatcaaagtcttaaaaaatatttgctcccttttactcagttatttcacttctaggaatctctcaaaacgacacattcacgtatgctgacaaacattgatgtattctgatcatccatttcagtactatttatgctagtccccttctttctaaaaaaggaaataagctaaatgccttatcatagaataaacaaactgtagtattcccatagcacataggaaatattgtgcttttatttgtaaaccatgttttcaaagataacttactgtcatatgaatatcaagtgaattttatggttttagatgaagagataagtgtataaaaagatctcattgggttaaactatattaatacaagaaaatcaagaattccctttaatgtaaacctcctttccctcctcatccccccaaatgaatagtttctttttataaatcagagtaaaacactcagaataaagaaggatatatgccttacaagggtttttcagcacagttctccatcctcttaggaagcccagggagaagaatgtttcttcccacagttataatatatgaatacaatgtggtaactgcttcactcttgaagtctcctgcttctctctaatatatacatgatgattgacagtgatgacatccaattaaaacttcccctttctcatttggaggatcaaaaggtaatcttccttaattctctaagagaggtattatagaatatctcatgacataagacataaagaataaagagtattccatcctctgctccattccctcattataaggtacatacactgctatattagaatgaaacagtctaagccttgttgtaccatgatctccaagtgagagtttagcaaattcatatttttacaaataaagaaagcattgtaaaaggcacctggtcatgaatgccaatttatgctgctgaagcaagactgataccaggttgcctggaacattccaacatccaattcttttataaactgtgaagacaggtgcaaggcccttttggtatactctacccacagaaatcttggggaaaaaaaaagataagcactgttcttagtggttatctctgagttgtgattttctttattctgcatctttaaattatttttccaccataatattatattgcctgtacaggcaatgtcaatgttttattccagaggagtgaagtgttaatctcctattctacaaacatgaaaaataggctggactcatgcaggtaagtggacatctactctgcctttgcactaaggtctgccttgttcaagtcatagtgctcaaaatgagttatactgacaatgctaaggatatcggaatcaagagttccaggtcacagtgtgccccgcagctagaaatgatgaatcttcaggtgctacttggctcttcaagatcattaaaacacatggagtttgattttaatttgtatcatcctagaggactttttatctaaaattcaaatttcctaaatttagaattttgggggctaagagaatattgatacatatttacatacattcacattttaagatgtattttactatctaaacaacagtgcactggtgaaagtgcaaaatccttttaacacagtggatagggtgatgatttgggctcagggtccaagggttcaagcacgaggttccatcatttattaacctatgttctttaagaaatcacttgtccttactaggaattgtagttgtctgattaatctcatagtgaataccatcaacttcaacagccagctaaggccaccagcctaaataaatatctgtacctataaaacattctttctatatatgagctactagttctattcatcaggcattgagctctttagtttgaaggatccattatacttttaaatgtgatgtaggcattcatatagaagccttgagggagttatttttttaaaaaagattctaagtaaatgctaatcattacagtgtgtcatagccttaacatatttcttttgtctccgttttgttaacatattgtaaacctggcagtctccaggagggttaatcgttatattcttttgctgttttatgcatgatagtacctcataaatgcctgatcttcaaaacaatcataagctacagcaacagaaaacaaagtaataatggaattaatgtggagtaatggcagctctgacattatgctgggttgtacatcattatcgaaatgtagcattagtacctgaaaaggagacaagatgaaggaagtaagtccctcattatttctgagagctaaacttgagcaccagtttggagagtcgaatgctccattatcatcagtctgtaacaggcatttacgtatctgtcaccccacaagttcatcaactaattgcattaataatcgaatcccattttcctgtgtctttttaattttaaccacagagaattttatccatgaaggtcacttgttttattgtactgctaacacagacatatcaccattaatacttgagttaaaatatttctctgaagctgaagggctggttccttgtgaattttaatctacgggttttaagaaggaggagatcagggtcctaaattcttgtttagtcagaatctctccatctttgggcaagttatttaacctgtttgacctcatttccctcatcatagaataaaataattagaattacaatcaaataattaattcacctctgtatttctaggattttacacctaaactttcttctggagagaagagtagtagataaaagattcatgcagcattcagaggctagaattcctaattgatctccccaccttcaattttatcttcatccaatctccctttcattctattatagggagattactaaaaagcgaattcttggctggttgcggtggctcacgcctgtaatcccagcactttgggaggccaaggcgggtggatcacgaggtcaggagactgagaccatcctggctaacacggtgaaacccagtctctactgaaaatagaaaacaaacaaacaaaaaaatagccgggcatggtggcggacgcctgcagtcccagctacttgggaggctgaggcaggagaatggtgtgaaccagggaggcggagcttgcagtgagccaagatcgggccactgcctccagcctgggcaacagagcaagactctgtctcaaaaaaaaaaaaaaaaaaaaaaaaagcaaatcctttttatgtcactcccactaaagttcttaaagagcttctcatcacctaggttaatataagcactttctagtaaaagatttcatcaagtgagtgactcctgccttgctcagcagtcttacatgcccacatttagccatgcccacgttctgctggaggaaaactaaaccacttgctgtccactgaatatgtatgttctctttcatttttgaatgtttagattctattccttgttcttggaatacccttttcctgtttatcctcctatctaaaactctactgaggctaattctttcagtactaagttcataccatccccctttccatctttatcctagtcttagttgtatgttcctaattcctcttatatctcttgaactcgtgtgccataaccctttcctgcaattgttgctttactgatctgtatcttccattatacttatgagcttccagccctaataaactttgctttttgatttttctcatctagcatctagcataatgcctggcacacaacagacactgagaaaacatctgttgaatggatatgtgaaaaaataaacaatatgattcatagtgtaatttattatttgttgctctttttgcatgtgttgaatccaaaatacgatctactcccttctagctaacaagaaaaaaaagaacatgctagtttaacaacctaatcagccattacatgttaaaatgaagatagtgacttttactaaacttttcctttactttaaaattactttttttcaaaaccttaaattgaaaacaaaaggaagatcaatatagtctcataaagcactatttatattctctttccaacaactgctcacttccacttcatagcacaccagacagcaaagcccattcgttaactagataataaccagctaattttacacacacattttccagtcagtacatactttctcctgtcctctgggttgaaaggcataaattcaggggatcaattttctagtcatttactaaaaataccttttaaattgaacatccatgtgaggacagtctgggtaccactgaagagttgttttataaacacatagcttgtcatgtacaactttacattttgaaacagatatgctagttgttatggctaacatgtaatatagtaagaacactggaaagtaaaaaattagaaacactcttacctctggtcctcagatgttcctcaataaaatgaagtgatcaaaatacatttttaaaaacattctaagtccaggatacttattttggaggagaaaaatctttcataaatatctggtaccactttcctctgaagcatccccaacacaaataaaaatatgcacatacatgcacacacacacacacacacacacacacacccctaaatgtttacgtgtcaaaaataaattcaactatttaagataaatatataattccagctaggtgtggtggctaatgcttgtaatcccagccatttgggaggccgaggtaggtggatcacttgagcccaagagtttgagaccagcctagagaacatgaaaaaaccctgcctttaaagaagaaaacacaaaatttagccagttatggtggcacatgcctgttgtcccagctactcaagagccggaggtgggagaattgcttgagccaggaggtcaagtttccagtgagccatcatcacatcactgcactgtagtgtgcgcaacagagtgagcctctatctcaacaacaaaaacaaaaaagttaaataaataactctggaaacatgttgatattgtatactaatattaaagaaggttttaatggttttttttgtaaaatgcattataatcagtaaaatgcataaattgtaaatttctataaagagaattagagtaccatcaggtgaaaacatcatacccttcaacacaattaccccaaatgggtttatacatgagtcattgtctataatgccatctgaatagcagaaagaaaatgctagaaaagcatggacaaagaggatattccaagaataggactagcactagctgtgattcctcaagaaaggcagtgatagagaggggagacaagatggctgaagagacgcagctaggaagtgacactcccattgagagagatccagttattgactaaactaccataatatgggcagatgtttggaaacaaaaagctgtggtggatggagaggtgacattgaaggcaaggctgaagaggaaggaagttaggaaccctgcacagcataagggaatgctagggctagttcccagccccgaatggctcctgggagaggggtgagtgcaggaactaagggataactcactctctctgtggacctctaggatcctagctacagggtaagctgtgtcctccatgaatatgtgatctggcagggggatttccctggggaaaaggcagagacaggccttcaggtggtgtgtagcacagaaatgtttgtgtgctgggcagctccagcaaaaagtagccatagacgcccatccccgggaactccccgattcccggaggcattgttctcagctgacctccgagtcaggagagggcaagactggcttccccatgactaaggcatgtctgttttgtaagtcctgctgtctgtctgcccctcccatgctccctgtctgccccctcctaggggccacgcatagccactctgcaggaacaggtacacagtgtagccttagcagcccagcctgaatgctctacgttcatacactcctggtgaccgagaattacatcagatccccaaatacagctggaacctgacctaggccatgttctggtgcctccaggctatggcacaaagtatgggagtacagagttattcctacaaaacaaccaaagtcattgttcacaaaattagaaaaaaatttctaaaatttatatggaaccataaagaaccccaatagtaaaagcaatcctaagtaaaaagaacaaagccagggcatcacactacccaacttcaaactataaagctatagcaaccaaaatagcatgatactggtacaaaaacagagacacagaccagtgaaacagaatagaaaactcaaagcctcacacctacagccatgtgatctttcataagactgacaaaaaaaaaaaaaaaaaaaaaaaaaagcaatggggaaaggactccctattcaataaatgatactgctagccacatggaaaagaatgaaattagggtctcacctttcaccatatacaaaaattaacttgagatgtattaatgatttaaatgtaagacttcaaattataaaaatcctagaagaaaacctagaaaatacacttccagacattggctttgacaaaaaaaatttggctaagttctgaaagcaattacaacaaaaacaaaaactgataagtggcatgggataaactaaacagcttctgcacagcgaaagaaactatcaacagaataaacagacaacatgcagaatgggaggaaatattcacaacctatgcatccaacaaaggtctaatatccggaatgtataagaaacttaaacaaatgcaacaagcaaaaaccaaataactttatttaaaaaaatggacaaaatatgtgaacagacacttcacaaaagacaaacaggcagccaagaaacatatataaaaaatgctcaacatcattaatcatcagaaaaatgccaatcaaaaccacagtgagataccattttacactagtcagaatggctattattaaaaagtcaataaacaacagctggtaaggctatggagaaaagggagcaccaacttatattcctaccaacaaggtttaagtgttcccttttctccacagtcttaccagctatgtaaattagtatgtaaattagttcagccacttggggaaagcagtttggaggtttctcaaaaaacttaaaatagagctaccattcaacccagcaatcccattactgggtatataccccaaagaaaataggtcattatgccaaaaagacacatacgctcatatgttcatcattgtgtcattcatcatagcgaagacgacatggaatcagcctaggtgtccatcagtggattggatttctttttttaaagagatacatatacaccatggaataatatgcagccattaaaaggtaggaaatcacattctttggagcagtatggatggagctggagaccataatcctgagttaacacagaacaagaaagccaaatattgcgtattctcacttataagtgggagctaaacattgaacacacatcaacataaacatgagaacaatagacactgcagattccaagaggggtcagtgagggaggggagcatgatttgaaaaactaccactgggtgctgtgcttactacctgagtgcaatatacccatgtaacaaatctgcatatgtacccctgtatttaaaataaaagttgaaattttaaaattaaaaaaataaaagcaattaaaacaatacccaattttcaaatgggcaaagcatctgaacagacatctcaccaaagaagatatatagataacaaatatgcatatgaaaagatgctgatcatatatcattggtaacaaagagttaccaccaaatgttagcaaacacagaataacaaggactcttattaattgctggtataataatgcaaaaatggcacaggcactttggaagacagtttggtgatttcttacaaagctaaatgatatgatttaaccatcacacacctaggtatttatcagaatgattagaaaatttaagtcctgacaagaacctgtgcattaatatttagagcagccttattcataattctcacaaactggaagcaactaaaatatccatgaaaacagtagtttataaacaaactctgatacatccacatagtggaatactattcattgataaaatgatatcaactatcaagccaagacaaagcatggaggaacctgaataacaaatgactgagtgaaagaggccagtctagaaaatctgtgcactgtatattccaagtgtatgactttctgtaataagcaaagctatacaacataaagatcagtgatggccaggggttggcagggagggtggagaccgaggaacaaataggaggagcacagggggttttcagggcagtgaaactattctgcttgatgctttcatggtggacattaggtattagtcaaaacccatagaatgtacaagaacaacagtgagcccagatgtaagctatggaattcagttaataataatgcagcaacagtggttcatcaggggtaacaaatatatcaaagtaaagatgtcaataatgggtttaactgacagtgggaagagggaattccttgttataaactcaatattttgtacatctaacactgttctaaaaatacacaagtaatttaaaataatttaatagtatatatgattttataaacattcgataaaaatacgcaaaaatgctcaagttaaatgctatgtaatgggaaaaaaagaaagacaacggtgacattggaagaaggaaatctagtcaaatttaatcaaatcagtaagatctaattgaccaataatatacagttgcctaattgaagtatcaggtgtggctatttgaagacatgtgaaggcatgtaacacaggaagtctgaagcaccaagcacactgaaatacagtaggtgctcaacaagtgtttcctttccctgaattatgctgaaacttttggagtttagccttaatgaactttacaactttctcgaaaagactattctctctctatccagtaggtttttacacaatccgatttgctaagtcccatctccctctattatcttttgactaacattttttgtctggactcatattttttttttttttagacggagtctcgctctgtcgcccaggctggagtgcagtggcgcaatctcggctcgctgcaagctccgcctcccgagttcacgccattctcctgcctcagcctcccaagtagctgggactacaggcgcccactaccacgcccggctaattttatgtatttttagtagaggtggggtttcaccgtgttaaccaggatggtctcgatctcctgaccttatgatctgccgtctcagcctcccaaagtgctgggattacaggcgtgagccaccgcacccggcctttggactcaattttgatacctttctccagaagtattctttgactcccggtggttgcttggtttctttttccagaaattttcataatatcctacagtcatctcaacacagtgtgtatatgtatgcatgaacatggtcagtatctcagtaaacactccctggatgtcataagatatactgtcttacaggtacctctaagtcctaatttaaattataatttaaaatgccgatgagattaagattttctaagaattcctaaccccttaaagttactaatcacaatgtctattgctatgattgttcattgattgacagtctgtcaattggaggaacacatttgcatctttaaatgattattgagaatcatagactaattgaggtatgttaccaactgattaactgaggaaagaatattttctaaacatttaacagatgaggaaaccctaggttgtgataaattaagaaacataaaactggactccctcaactttgaactccctgcccagtaatcctttgacttaaccatgctgttcctggggaaaaattattgcaatgagtatagatagctctgagttatttatgtggaagacaaaagaaggaaacaaaaggttatgtgggaccttcttaattataacattctctcaagtcctcacagttattataataaaactccagtgtataacaagttatcgaaatttgaaatcagcatggtattctgaatactcaggaaacccacaaaacgaaagttcatcttactgttttgtgattggatacatctgcttccttggaatttgtctaatgctattcttccagtactttataaatacatgttgactgacttattttgtattttaagatatctggatagataagcccaaattatgaagtcatataatctaaatacatgaaagtaaccaaatcatcatggaatttattattctgcctttatatgtatgtttaattatcttgtttaaattcttccaagattatcagtgattttcattccttgacaattaaaaaaagactaatgttgaaacttttctcccacgcaacagtaattcttaaagtttatttagaaaagtaaagctgtttgtttttgattctgtgcatatttgctatcctcaaatgattttccccattataggagatgtgcatttgtatatttttttaccaaggttttaaagtgagcgtattatacagtgcagtgaggaaaatttccaatttctttcttgcatgaaatatctgagctaataattggactaggagaagtagaatctttcttttcattagacttctcttttcaacaaaagctttgttagcctactgaatcatgacaagtaatcctttatatgctggggtacactgttcttcctgatgaacttacaaattaaaatgtaatgtgaaacgatggcactgggaatactgaggaatagccactgatgtgggaagagatctataattaaaccaagatgtacattttaattataattttatcaaactgataatacagaataaaatacagttggagaaatccaaggaagtcataataaagagcacaagaacgctactttgtaccccttgttgtctcctctaccttcttttgccagttcctcccctcccaagccttattttaatatatcttgccaaagattagaaagcaatcaagtgatttttcaccacctttatcccaggctaaggtaattattcatctgtttttctctcctgcttcgttttttttttttttttttaattaaacttggtttgctcaagagtaaaatgaaccacagtacttatcagctcagtgcatacgcaagtgatactgaaggcaactgccagagactaaagccataggttagctgcaaatccattagtgattttaaatagtggggaaaaaattcttggtgagtcatgataaagctgaacaataactgcagaagtcacaaaacatgaaaatgtaatttgcatcaatatgtcgtcagacagatttacagaaagctaacacaagtgcgaaagatttcctataagataagcaaagccatatttgctgttaatgtttataaaagtattttttaaattattctttgacatataatgcatagttttaagggtcatagtttaggaagagctgtacaaaggataaagctaacatatctaaaagatattcttcccaactgcaaagcattcataaatcagagaaatacttggaatttactatggaaaattttaaagtgaatattaagaaaaaaatctagtgacgtaatttttatttaaccttgcaagctttttatggcttatttacaataaataagctttcaaccacagcatccacaattatactgaaggaaaaagatattattttaagtcattctaatctcacattctagaactacaacttattttactactttctttttcctgtttcacaaatttccttccaaagccatggtaaacttccataagggagctctaaagtcaaatccattaagccatcaaggtacatcttatttcaagattttttaaattagcagatcaataacctagcagaccatactgactcactcaaagcaattacaaagtatttgttcattagtggaactgtgctagcttaaaatctgaagtgaagtccagtgtcaaaatatattgtccatgtttattaccagcatttaaaattttatgtgtgtgtgtatatatagatatatatatgtttatatctatatcataaaacatatattagatatatgtatgatgtcttaataatgtattatatattatatatatacacacacacacgcacacacctatacacacatataatctctcctacattttatcaacaaattgtatatggtttgagcagggtttgctatgtacagggtttgggtgaatataactgctttcaccaacacggtttagctaaaaacatgttttggaaaaaaaaaactctagtccaacctagctagagtctttagaaagaatgaaagaaaagttttataaaataagtaggaacaaaaatatgaaattgtatatttttgtttctgctcaatattgatggcaaatactattttaagtaacaaaaatcttattgtataataaatatagaaaggatcagaaaaatacaaaattgccattcaggaaacactacagtagtaattattgcaggcaagattcgcaagggataccaaaattactgggtgaagcaggatatttgcataatctcacagtatctcctacagtatatttattagctatgaagggaaaaacactaaatttatggtggaaaaacctagtacatgctactttctcatagacaaagtatatatcattatcatgtaccttgatatgatgtactgaaaaggacacaacatagtttctgtagtctttatgcccaaaattcagaaccttagtctaatcattcataaatattacataaaccaaagtgagaggcattccgcaaaacaactaaatggtactcataaaatgtttcaagataatgaaagataaagagagatttagcaatggtcacagatcagcagaaactaaggaaatggagcatttaaatgcaattcgacatagtaatttgggtgctggaacagaaaaagaatatttgttgaaaaactagtaaaattccaataatgtctcatattaattaatattatagtaccagtgttaattatacaattgtacaaataaattttacaatggctatgtcagttgttaacattaggggaagctggatatggggtacatacaaaaggtaccatttttgcacaattcctgctagtcaataattattcaaaaaaaattcaaagccaatgcttcaagtaggtcatgatgaaatgaaggcaacatgctccaacattttctttgtaaccactaagttatttattaccactttgctaatgttataattattcactatcctggttttttctccaaatacaatgatgagaatatattacttctccatatttcattatcaataatacaaaccaatggcctaagcctgttttctattattatatttacctaacctaaaaatttttcatgtctattagagtatttcatcaaattcaagacaagcatttattgattgccattatttgccatgcactgaagcagctgtaagatgattacatttacctgcataaactaatgaaaactagaaaaatttacatcttctatgcctactctaacccattataagttaaaactattttgagaattattgatacatttgcatgcatttcatggttatattcatggtggaaaactttattagcatcgagagagtatcaagaacctgaagaattttactgtaatagatttgtatataatggtatgaggtcatataagcataagagtaaaataaattaccacataatcagcattttgtaccataaatgctaatactgaaaacagcatgtgagaaacacaacagaatgttataggcacagaagtaaatcacagtggacattcccttgctggtagaagcaagacgaggagtactttaaaatcacttgcaggtggctgggtcaaatggtatttctagatctcgatccttgaggaatcgccacactaatgtaaatgatcagttaatgggtgcagcacaccaacatggcacatgtacacatacgtaacaaacctgcatgttgtgcacatgtaccctagaacttaaagtataataaaaaaaaatcacttgcaggtaagttgcactctagagattcccatcttaatactaatttttattaacttcatatttttacttataaaattggctgggcacagtggcttacatctgtcttcccagcactttgggaggccgaggcaggtggatcaggagttttgagaccagcctggccaaaagggcgaaaccccatctctactaaagattcaaaaaaattagcttgtgtggtggtgtgcgcctgaagtcccaactacttggaagtctgaagcatgataattgcttgaacccgggcagcggaggttgcagtgatctgagatcgcaccactacactccagcctgggcgacagagtgaaattccatctcaatttaataaaaaaaaaatacataaaaatgtttaaaaatcaattttatttctcatttaactagattttataaaatatttcattaaaaaaaaaagaacaaacagtactacacaacagtgacactctcagtagtaaaatagttgggtggtagagagtgctacctcaccaagctcaaaatctttgtcagcttccaggtaaaggtccaattggtttatgatatatgatgacatataacgcattgacaaatatgtatcaagattcaggaagtgtttatgtcaactatgtaaaaaaaaaaaaaaaaggccaaatcctttacagtccaaaatttaattaatgttactttttttctgtcaattttcttttgtcacagtttaactaatatactctcctaaatacatcatttcataaagcaaaggaagggtaaaataagatttcagaaaaagaaaaagaagattgaggaatggagaaaaacataccaggtaaaagggatttgggacacccaataaggtggataaaggaaaagaggataaaataatgctactacaaaaggtcagagacctgagaaagattaaagacacaaaagaaatgacaaacagtagaaaaatttgaatctgaacaacgtatatcaattttttatttattattattattattattattatttgagacagtgtcttgctctgtctcccaggctggagtgcaatggcgtgatctcggctcactgcaacctccacctcccaggttcaagagattctcctgccttagcctcctaagtagctgggactacaggcgcctgccaccatgcctggctaattttttgtgtttttagtaaagacaggattttgccattttgaccaggctggcctcaaactcccgacttaaggtgatccaccccacctcggcctcccaaagtgctgggattacaggcgtgagccatcgcgcccagcctgtataccacttttacaatcagtagacacttgggaaatacaaataaatcatgaagttataatttttctaaaaatgtttctttccttttattgttttatacacatatgaatgtacagaggacaagctcctagtcaaattttctttcacaaaaggatgccatgaaaaaagatataaaaatagctctctggccgggcgcggtgactcacacctgtaatcccagcactttgggaggccgaggtgggtggatcacgaagtcaggagatcgagaccatcctgactaacacggtgaaaccccgtccctactaaaaatacaaaaaaattacccgggcatggtggcaggcgcctgtagtcccagctgctggggaggctgaggcaggagaatggcatgaacccgggaggcagagcttgcagtgagccgagatcgggccacggcactccagcctgggcaacagtgagaagctccgtctcaaaaaaaaaaaaaagaaagaaaaaaaaaagaaaactaaaacagctttctaaggggtggtaatggattttatttaaatcccgtagacacagtatataatattaatctgatacaaaagaaaaaaatgtttaaagggggagaagtaaaaagaaaagcccaaatagccaccaggtgagctccaggtggttataacattttaggaaatgtgataaccaaatctggccatattttaaagaatattttttttttctgcatgaagttgacatgcaataatcagtgaagtgtttaaacaactatctaactcttctttcatggtcttcatctagggtcaaaattagatctaaagtggaaacaactaaaagaaccctctgctttagttatcgctttactcacaagtttccggtgcctctctaacactttcaaaaattgattcaaagtccttcattaagtttatgtctatatttcatcacctatcagcctacctgacacattatacatgtttaaatattttctggctggctacatggacatctggagggatcttataacattttttgcctttccatacatagtatttattgtagtctactttgagttgatatttatatttgtatgcctatatatttttctaaataggaattacatgttaaaacgtttcagaaaccaggctctaactttggtggagaaagcattaatatacatccaaggtaagcatcatcaagcggaatgccttggcctataggcaagttcccgtagcgtatgagattttcagtgcgtaactattcaagcttgggaagtgcactggatgtcacataagaagttcacagaatataaataaactcaaacaataaattacttgctccaaaatattttattctgcactatttttccctgttcacaggccaagacactctactgagggggagataatcgacatattccctaggtgattaaaacttttaaatcggccaggtgcggtggctcacgcctgtaatcccagcactttgggaggccgaggcgggcggatcaggagatcaggagatcaagactatcctggctaacacgatgaaaccccgtccctactaaaaatacaaaaacttagctgggcgtggtggtgggcgcctgtagtcccagctacacaggaggctgaggaaggagaatggcgtgaacctgggaggcagagcttgcagtgagccgagattgcgccactgcactccagcctgggcaacagagccaaactctgtctcaaaaaaaaaaaaaaaaaaaaaaaaaaaaattaaatcgagtcgtaatttatcaggacaagtgcaaatcaaacttaaggtaaacattgtagctactgaaatctctcataaattctctggatgaacttcaattatattcaggtcttcaaaaacagaggttaatcatttgagcaaatattttatttatctttgtgaaacaactaaaagaacacacataatttcttaacttcatgggatcaaagatgatcttagcaggccagaacctctttctaatctggtcccaatttcctctaattttaatgtagaggtgggaatatctggctgggaatctagactgtactattcgttagctctccatcctcagatttaatgtacccaagtctcgagtttcatagccttaaaaagtgaatgtttgttttgttttcttgatgtattgtcttggacattggacaatttttcttaaatgagaaaaaatatggcaaagaattttataaaatgtttatcctcctcatcatctaatttgtttcctgccgctgaaagccaccttccccaggggcttgagaatgacacctgtccactgtgtcaccagttggtttgcttccctgcttattgttttctctatgaaatcttaaaacctaactaaggctttgctgcccactgcaggtggagaggagaataaatcaattcccttctgcctgatttcagtggctttatctcaaatgttttgtaagttattctgttgctaattaaacaatctcatttatagatattttcttcctatgaactcaatactagtttaataggtataaatataagttttgatcaattattaaatccataacaaagaaaaataacaaggacttaatgtatatcaataattatgttagcttgaaattagacattcacacaaatgtttgtctgtcaaattcagttcttatatttttggctattttcatattaaaattgtctaatgaatctcttcaaaacttgtaatgtgtttcagtagttgcctagaatgggaccaagtatgacaataggcaataaatatattttgaataaatgaatggatctacactaatatacaagtacatgtaaaaacccaaactagccttataacaagtatggtaactagttcagtttgaacaggtcctatggcatcttggaagacagatggttcagtacatatcataaatatatataatgaaccagaaaacgtaatagataaatgcactgtgttttaacagcttatagtagaatgcattaaaggattttccttaaaatttctactctagtaaaattttgttacagattttttttaggaactataaaatattttttcccactgtctttttgttatgctgcatatagccatcattaaggggattctcagctggttttaaaagattttagtttagttatatcctcagttaattgtgttagctaaaatcggattatacctttaaaaatgaaaaaggtgttctggaattatttgttaactgcacacgtttgttctttaagaaattcataagatcatagaatcatgttttttttaagctgaaatagactttaaaagatggtaaatgtaagaagtttgttttgaacctgtgcaattataataacgacctttaattcttttctaatggcctagatggaattaattggttatttcaatatcagggctcatcttgtgtggaatcataaaagagtctctttcttataatgggttctatcacccctgatgataagtttctctatcaagcttatttaacatgttctgaaagcacatttttaagagccttggcattctctgtctttcttcctttcatctttcttttacattatttgcagggaggaagaatccatttttgtttctttgtaattttgttttggtcaagctatcatttagatcttaccaacagtctttccttttaattatgtttcctatattgagactttttttgattggaaatagtatactatttacaaaaatcgagaaatcattttttgcttatgggaagttataagctatccaatttctaaatagcagccatgctgccatcttctggttatcttgtaagaattttcttatgcttagaagctttattttaaaatgcatcttgatgtaccttgaatttttttttatgtctactaaggacacatatttgaataattagagcactgcatctagagttctgttgtcctgaagtcctaaagcaaataaaaacttaagtcttatcattttaaatattataatcgaatgggactccaaggattaaaaaaaatgttttatcccatgatttggaggccagtgagattttctgacactttttaaaaaaatcacattactctttatttttttcacagcttttcagtgtggcagcaagatgaccacccttccctcagtgagtgtgaaacttttccaaatccacagttcctgttaatattagtactgcatgttatttaatgctgtttcaggtagcactgaaccacttgccaatttaactgtcttatttcatttgaaaactctgccagcacctatagtgcaggccaagggccacaaaggaagggtagaaggaagcgagagtttcatctatctttaagagctttttcattttaagtgatcattaagacttatagcactctttttttgtacattagtgtaacctaatgatgttcaatttttgtatgtgtgaaaattcccatttaccccactggcattcttctcctagtagccctggaggaaaaaatagaacaattttaggagataaatttatgtctcacactgaaaactgattttaaaatgtaagatattacatacattgcttcaaattcaaatgaggaagtacactcagtggcttcaagctctgtgctattttcagatgactatatgagagtataaatcataatagctcattgaaaatcagaatgcaaatggccccagtaaatgtttagcaacagaggattttctcaactgtttattaagagcaatccaaaatctaaagcagctgggacaggtgttaatttcaatcctgttatttgtaattagtgatgaaatttaatggtgtttataagtaactctgaaacatttgtcatataaacatggtctaaatttaaggggtattaaaatggagtttttaagcttaatagacttgggcaaacaggtattttgaataatcaacacctctgagagcatataccaaatttaaatggcaaaattggcccatttattgtaggcacaaaaatgaccttgtaacttctggatactgtgtgtgaatggatatggatgtgaattgtaccatacctagatggttgattactatttgtttactaaaatacaggacctgaaattccattattttgccatgacaaaattatttttagtctcctatattcacaaaaattgctattatcataagttgatagatgccaattgaatggaaattttatcatcccatagctttactatgaataaaatggatgtatctataaaacgtgccatttgatccatttctctgagttgttttgttttcttccaattacgaagacataatcttttttcatatccagaaacaaaagtaaaactcctacttggtcaaactcatgatcttctattatcagcagcaaagtagaagtaaatgtattaaaatgcccacacatatgtatatgttatcaatataagtagatagacaaatggatggatggacggacagatagatatgtacgtctgtcaacatgtgtttcctaaatttattttatgctgttaagaaagattatctctgttagtaaaaagcataaattatttattcagaaatttactcctattatatatatcctaaacgtgaatcaagcgggaaaaattttttattcagtattttcaaaggtttcaaattcagctcagaatatattattttagaaaaaaaaatgtaatggtaaaaagtatcttatttgttcttccttctgtgtagttcctacttggtttccattagattaaatcccaaattccagttaactttaataaatggacaaaaagtataaaatagtaacaatattaaaattaaaaagttttgaggataaaatgggacttttagttgtatggtactggaaatagtttatgaaattcaacccactacttcctaaaatataagagtatcaaagagctgaagaataatcaaaaggagtaagaaataaaaagacttaatctgattccaccaacatgtattgatcttttgtcctacgcgaggcattaagctaggttaaaaaatacgtgtttggcacttgtccttccctcaggtgttcagagctcatcaagagagttagacagataaacatctattaaaacaatacaatgaatgtatatatgtacatgtatatatatatatacatgtatatatacatatgtgtgtgtgtgtatatatatatatatacacgtacatatacatatatatatatggtgttccaaaaagtacaaattacagtcccattaattatgcccatgttgaccatggaaggtgttaccaagaaatgacataaggactaggccttaaaggatgcttagatttttgcaaggcaaatgagtgggtatttgaaaaaacatgagtaatatagtgaaaggtatggagacttaacgatttatggtatttggggtactggtggcagaggcaaaagtgagtgtatcaatgtggctagagcagagaaggcatggggggtatatgtagatgacaaaaatagagaggtaagtgagggatactgaacgataagctaatcaaacaaggagaatttagactctttaaagagatgagtcttgatgataatcatgactaacattgtttgtcgactatttcacatgtgagatttaatctgatcttcaaaagagccctgaaatataagaattactatgttctcaattttacagataataaaaccatggcttagagaagataaatattctgtctggaatcaaacctgtagtaagtaactcaaactgagtatctctctaaaggtcttatctcttctgctaaactgccaacctgactagaatggtgttttaaaagataactttactggcagtgctaaattagaataaattgaagggaagagaacctaaaaggggaagataacagtttagaagatgctgcaatcatctaaaccagaaatatcacaggtctaaatgaatgagggagtggaaagagcagaggtagcttcaccttaaaaccaacagcttgagcttcaatgtgctcactggcacaggccactcccaagcccctgggaggagcccttgcgtgggcttcacatgatcatatatggtttaaaacgtgagaatactttaactatgtatagttaaggctcctgtctctttctactttgtcttccaatctgtcacacttttgctcctgtcctatggtgttggaaaggccacatgtatttggagatctggatagagaaatatttgagaatatatttaatttggaaatagtggggtatattgagttttagaatagtgggacctaactatcccattgtagggaaagtttttaggaatactatcaccagatattaactcacccagctttgaaatactgttatagggctagagatctgatcacaatattgagggccattgccacccagccaaggaagcatttggatagtggaaaaaaacaaggtttgtatttaaggaaccaaaaacaagtctgaggaaaattcgtattcatgaaacaaataaagtataagcatagtattgtgttatcattgatacttagtcaaaaagggacgtcaaaagggagtatacatgctagataatgaagcatatacaattataaacatgtcattaacctttttcttatttttgatggaaataaaataaaatagatttgattagtatttctttgtggtaggacaaaaacctccagcagtacttcaaactgcaaatacacctgtgtatgaagttgcatggtttatgtttcctattgtatcctattgtatcagatcatgtcttaccacatctgacacatcttcttctgacaatgtctgggagttccagactaaacagtaggtaaaattgccactgacataacaaaatgatccaaatatactagaaaaaataaaaagtacatttctagtctctctacagaaactatcacaggattgtttctatgtgaagaatatatcaatgactatgcaccaccgtcacaagaaaaaagaaaatatatagaattacagaattatattaagaaaaagattcttctaaattttaaggtatttttcagtttttttaatatgcaatttattgtgatttctttgttcattctaatcaaatattcacttccaaacagaggctgtatttttaaagaggatccccaaatggatactaagttttgtttctgaaacacaaatcctttcctcagttgaaagaagaagaagaaaaggaggctgggatatctgagaaacgttttgaagataaacttgctaatacttcttaatccagttgcagggagagtaagataaaattccatggtgcctatcatggatagagtactgaaaaggattcaaggtttgcatagaagacagctcaattttagatatgtgctgtctgaggaatcaatgaaattacgggaagaaatatccgggaggaggttgaaatgatggctctgatgttcaggagaaaattgaaaaatagtcatgtaaatttgaagaaactaagcatttgctgacagctaaagctaagaaagtagatgagaattctcagggagggacttttcagttggaagaaatgaagagaggtacaaaacctgtagcctgataaatgtgtggagtaaaatgaggaaccaaagcacataaaagaagaaaaaacaagcaaaaattgcattcaaaaaggtaggcaagaactagtagaaagctgaatttggaaggtaaagtcggaaaggacttcatgaaaaacctaaaaatagcaaagtcttcaggaatgaaagggccatgaggactgagaaaaggatgctagtgttttggggttcctttaaaccactttattgaggtatgatttggcatatacaaagctacataaattcaacatatacaacttgatgagtttggagagaagtatacaccattacgtcattgccacaatcaaggccataaacttattcatcatctgaatagtaatatttaaaaggatggtggtaaactcagtgtaagaagtttttatcaactaatagagatggaagattgaacatagttttctgaatagtagatgggatatctgagagcaaagacagtggtcacacactgtactttaaagaaatacatggggaaggaataaaaaacacattttagaagagagtgttacaaagtatttggtacagaattagcttaatttaaaaaaatacaacatatgcataaaatatctagatttataccaaaatagtaataccctaggtagcagaatttcaggcagttttttttttttttttttttttaaacaggcagtttagttgtttgggtttttttgcatgtatttcaaatttttaaaaaaattaaattattttataagaaaatactataaattacatatttaaaatgtgcaaagcaaatttataaaatttaagaaggtaattattgtttaagaaagtagtagttaagattagaaggttctggaaaataaggaaaacatcaaagataatagatggaccaaaaatctagaaaaatgagaaagaatagagtgaataatccaaaactgatgaggctatacttgacgaaaaggatcgtcttctgtcaggtcgtgcatggtggctcatgcctgtaatcccagcactttgggaggctgaggcgtgtggatcgcctgaggtcaggagttcaagtccagcctgaccaatatggtgaaaccctgtctctactaaaaatacaaaaactagccaggacttgtggcaggcacctgtaatcccagctactcggggggggctgaggcaggagattcacttgaccccaggctgtggaggttgtagtaagctgagatcgcgccatcgcacaccagcctggcggacaacagcgagacttaatctcaaaaaaataaaaaataaaaaaaatcatcctctgtcataaaattgggaaggaagtagtaataaagttagaaaatgatggatttgaggtgaaataaaagtaagttaaagagttaatgtctgaatacacgaatgttcttgatcatattagagatacatatttcagcaaaatttgaaaaagtcaaaagacgattggaacctcacagaatagccaccagggagagaggacaaggaagggaaataaaacaaaagaatttaccaagtgatattgggggcccaagcagtgtctgataatcataaattttaataaattaataaatactatgttattttcttcgataacattgtaggggaggaaacctttattcattcctcactagatttatggctgagacatatgtaataaaagaggtcaacaagggaaaatcatatttatttaatatgagttttacctgacacagacaccttcagaaatgaagactcaaagaaatagagaaacctgtgtatttttacgctacatttgatgaagtaaatagttgtgaagtatgattggacaaaaaggataagatctaatgggaataaattggggggaatttatcaagggttgtttgttcagtttcctctgtgtccttgtgtcttcagacataaggacgttcctttcttccaaggatagggaagggacttctcagacaagaatcttatgacccatttcatgggagaaggtcagagaatgacctttctgcttctgctatttttctcaaatgttaagatgccatattttggggtatcatgttctgaattccatcagcatgcagcagcctagaagtagaaatgcagtaagaaatggtttggaataagccatatgtagagaagagaacaagaaggaaataaagtagttgctgagagcgcaggtaaaatgactgatttatgaagcagacacagcaaattggaagcaaaatcaggtagaggtcttagatatggagatataatcagagattagaaaatatcacccaaattaccaaagcatagtgggtgtgaatctctaatcctgagacataatggaggtaaaatgttttggtttttcttttaatgtttttaaaaatgctttgttctcaaaaatattttgaaagttgggacatttttcacattagatccccatcttacttattaacgtaacatcagaacattattcctgttattattacgggaatgactgcagaatcaaaacttatatatcttatctacacattttaaaattcatttgaccagaaggttccctccaatttatatattttaaaaataaatgcaattaacttccatatagcaaataaatgagataggtttgtagtcaggttgaagagcacattaaatgctaatagattaggttgagataatatgttttggaaggagagttaaacttaaaaattaaagatcttacagagagagcaattatagaatgtagctctttaaatgagttaatcaatagaatagaatcaaagaccactggaatttgaaagtcttcagagttcagaatggaacattcagaggatactaaagttatccacaatgttttgaagccctaagggtagaaagggactctaaaggccaggccaaatacttctaaaaatgaaagtaaccacttgcaaatcagtaagccttgcttttgaaagaatgatacactgtgtttccttgggggcagataaggaagagtcataacctaagtgttgtcagttcaatattccataaacactaatgagaaccaaggtaaagcatacatttgctaatgctaaaattcacaagagaccgaactgtctctttacaaacaataaaaaggggggtaagcattagaggaaggttaggcttcaataaaagttggaaataaaatgatgtcccaatgaatataaataaagggttaaaagtaacaaaagagtttgaggccttaacaaaaggacaaagcaaggaagataaaatagtcatctaaagggaatctagactgagagagactaggtggagagctttctttttgaactctgattaatcacgaagacaaaagaaaaagacttagaaacacagagaaaaaggacaaggattaaacctgcttcaaagtacaaaaagaaattcctttcagtctccaaattttcattctcaactattcctacaggtggatgagccacttgacattcttgtcaaaagaaaaaataataataaaatattgaattcccgaagagatttctgtcaaaataagtaaaataaagtttccaaagtgaaatacattttggaagtcctgcataccacactcttttgggattatcttaatgcccatttgttttataaaatgtttgattagccaggcggggtggtgcacttgcagtaccagctactccagagactgaggcggaaggatggcttgagtcaaggaattccagcctacagtgagctatgattgagtcactgtgctccatcctggggacagagcaagatcttgtctctaaaaaaataaaatatttaagatattccccagttttgcaaaaatctgtatttaatatttcataaatgtatatgaactcagccatttggaaagaaaagggactagtgtgatcctgaatcacaggatccctggagaaaaagggtaaaagcaaacggccaattgattaaatgattttaaaagatcctttaatgatttataactaatgaattataggtctgtaaagagagaacggattatttgaaatttaatagatgaacaaaggaaggatcattgtctatagaccatgaggtcttggaagacagaaaccacttgtttgatactttgtagctctgtcagcacatggtaagtacctgataaatgtattttgactgattgaatgatatgtcattaatattaggtatttaattatatttgcccaatttatccaatgttgaaaggtgttcaagggtcaataaaggagctcatccacatctctagctgatagcagtacctataataagcaatttaaagcttgtaaaacaacagccactcaaaatttaataaacatttcttaagggatatgcaacagaagcatttacatctctgaaggagatacacgattagttgagctttttgacaactgtccaagcactaatctccttgttctatactaagagtttagaatgtatttaaataagaaagatattataaatagctactcaactgttatttattatttatttatttgcatttgagaaggaaaaaagaatcagacacttatttaaaagtcatcttatatcaaaagtaaatattaggcacttccatcatgtaacaactttgattttagaggtctttttagtgacaaatataaaagcaatttttaaatcattagtacccggtatacattcatagaaaggaaaatgctttcatgcatataagtcctctcttgacaaagtaaagctactagctttaagctgacccacttttctctatgctgtatcaggtataagcaagctaaagaggattaaaaaaaaaaaagtaactttcagtataaaacaggaatggaaatgctctgcacctaaactccaatgggattttccttttgtcaaaggctgcccttctataacctgttctgagtttataaagcaaacaaatctcactgaggctcttattacacctctttagttgttaattttaaataatctgtacaaaggcaagtttaccaaggtatataaagggagcatatttctgtggccactggagagtaagtgaacaaaacttttgttggactaagaaaagtagttttacctgcaattctgaaaattcattttattaactgattggtcaataattgttttgagtttatagggtaataatttcactgttggaaattattggaggacacatttcagctaactattaaaggttaaattcaccaaacaggaggatactaattaactgcctcttaagaaattgacaaggccactgcaagttcttttatccgttgtctataaatcagaaggatgccctttaaggcatttccatcaggatacatgttggcacaaaactcaggcaagcagtgcttacaatcagaatactataatgataacaaataaaggttattgttctgtttatacaagaatggagtcagcttggataattttcaaaattcaaggatatatggcaagttggtgagtattgagaaaaaaatagtctgtttcatcttatgcatttcaaattgaatgtgtttagcaccaattgcttaattgcgactcaagttgcttaaggtttattagaatattgtgtttcatctccttgaattggtgcagacacagtctggtccaggtgtgaggtccaatatgataatttaaactcagtttaaaattgcttttactttactcctgaaatgcaaatgtaatggaagtgtttgagatcaagattcctatgggttgataggaatcctgttgtttccctcgtttttcatccaaatatgtccatattttgtattcttagcaattgtataaactaagatgtccttaggtcaaaagggcacataattatagcttgctccctgcctccttagaatttgaagttaatgcactaccttatattaggccataatttgctcctaaattagccacagaactcaaacttaaactccaggttcaaaatatgaaatatcttgttgttctaacatttggataatctccactttatacatctctggctctatagactagggaactcttataaatgtatgtttggaaactttttgtgggaaagcttagccatatagtaactcatatcacacaaagcccaggatgctaggaacgtttttttttaaaaaaaattcaactctccatacccagtatccagaataggacctagcttatagttggagctcaataaatgcttgttgaatgaatacacctatcagttttttctccatatattatctgaggacttctaacacatgctggcaacctccccctccctcagaaaaaaattctaatgaaacaaacttacaattgtttattcattctctctttctcacacacattttcttttgcattacactaataatgcatataatttgagctattttaagagtaccaaatactatactaattatattaattttaagcatggtaaatttactattactgaactacaaggaatttacttggaaaacctagttccacaaaatattttaatctgatccagcaaaacctaagacatattttgcagcatatgcatatcggtttattgtaaatttaaaaatctataattaggtaaatatattgccagacatgtaagcattacgcaaatagaaaaagatacgctaaatcactgaaaattgtggtggtctaatattggagtaatctggggaaaatactaatgttactttcaccttcactgaactggacgttttgataaaaaagaaaaaaaaaaaaagcaagtcagtaaaccgctcagtgataatcctcattggtagtaaaaaatgtcaaactcttatgagaaacacaaaatttttaagtcactctcaatatagctgcagaattgaagaaactattttttcattagattgcttcagtatctacaattcagaaataattatttattttcttaaattaatgggatatcacctccaacaatagtttttctgcattttctcattttaaatacatcagtgatatttcaacttatcatgatgagcatcccaaatagataaaacttcatggccagcagagttagtactgttttaataaggcatctgacaaataaatataattgtaactggtgccttcttgatgtctaggatctctgcctggtataccaatgatgtctgtgaggagaaaacaaaatttttaatttataaatgcatttttttctcttttctttcaggaaagaaactggttttcctgtaaaactaatacatgtgattattaaaggtaaaaacataacaaatcaaataaaaaaggattaatcatttaaagagaagctcatatgttaatgagcttggagtagtgtaatgaaatatcagaaagatcctgacatagtagttttacaatacacaagagcatacaagagatctagattttgtttagtgtttcactatctcactagaagtttatgggtgcctatcttaactgagttctcttactggagcaatggaacaagaattatgcccacattgcttcattccaatgttaaaatctacattatcagaaatgtagtgtgtgagttattttttttcttttaatacacaaagattatctgatggctgtttttgatcagcttctaacctcaagaaaaactatttttcactggaatcaactactgctatgtatacccagtctcatccctctacatttccttcagtcacatagggctcttttagctgaaagaagctttgattctgaagtaagacaagataattatataatcatgcaatatttcataaaatagcagtacactgcactgaatttcccatccctaaagcccgcttggaaatggctggaaatatggatccagccactgaatcacacattaatgtatcagcacacaggaaactaataaaaaaagtttaaatgggtaaattgaatgtctactaaaattgtgaatttatgaatgtgttctaaaatttctatgaacaaaaaattttatatggcttttaacaacattataaattttcaaccagaaaggaactttttatctttccttaactcttttgaggaagactctcagattttatttcaaccagttcttggcacctagtaggtgttgaataaatttttactgaattcatacataaaattttaaattatttgtggggagaaagcatattatgaaactcatgaacataaaggcatttaatctaaacaagactttgagctaataaaaagcttacttctttagcataccatgcacttggtagagatatgaggtgtgctttttatatataaaatgtttgattataatcagatgattcaaaatataatttttataatattatgttaaatttcatccacattttacataagcaattgaaatatttacttgatagaagaaattccttgttaagtattataattttatatgattgttctaaaggtgaaaatgtgatcatgcataaaatatatttaaaatttactgatagtaacaccttacatttgtaaaatattgtacagattatatagtgcaattatgtaatatctaaattgatcctcatagggactttgaagttaagtgtaaacactctcttttaattagaaaaaataaataccatagtagcttggattctggggccaggctttgggttttggggccaggcttacccaaattctgccatttactgtgtggcctcaagcaaatgtctcaataacccccaaatgaatgatgttaacaacctcacaatgacctagtagtatgagaagaagtaatatataaagtgctttgcctagtgccctttgtttggtaaatgtacaataatgatttcattattagcatcagtctttatagtgatattgttattaatgagagattgggctgtcaattaagtgaccggttaggaagcaacagtattagaaaagaggaagagttcaaacgcaaggtgatttgacttcacaggtttattcctagatcaactctgtaccagctcagttaagtggaaaacagatccaatgtaaatatttgctatctgaaggaaccctttcagattagttttacaaaataaaaaagtaaatttgaatatttaaagcttttcttttattataactcagggtttatacatactgagatttcttaaagtacacttttatgcctttattattggtgctagaaaagctattcttcagtgaaagctagatcctaactttttcagcttaaaaagcaatttggttgaaatggtacctaattactctattctcaaaggaagaatgacctttcaaacgtttgtttatcagcgtcttgcttaagaacattaatgttcctcttgaactcagaaaaatactcctattgagtgagaaatagagcttagaaacaacattaacagacttctgtaagaagaacagaaagaagaaaaggcacaaagtagaaaagaagtacaaaaaaacataaagtgaaccaaattaatatattcactcaacaaatagcttacacagaggtagcttttagagggaatggtgatcctaaccctcaagtggtttaccatgcaaaagccattacatataaaggattactaaagaaaatagtaacaggagatgaagtaaatttacagaggcataagaattataagatgcacgggtcttatttaaaggttgctggtgttagagtaggtaggcagccatgagcaaggcaagagagctccaattcacccccaggaatgtcaggcaaccatcagaagatggtcaggccgttatcacactgtctctctaaaataatagttggttgtagacagtgccaaaaaaaaaggcagtctcccgatacatagaaaacacgtgaagctggtggtgattttaaggtcctctgagctggccgcaccatcgtcaagccattatgacattcccccgcctttctgataatgtactttgtgatattcccatccttgtgaatgtattttgtaacattcctccccgctcttgtgacaatacaccctccccgcccttgtgaatgtactttgtaacattctcccagcccttgagaatgtactttgtaacatccatcccctgcccgcaaaaaattgctcctgactccaccgcctatgccaaacctgtaagaaccaatgataatcccaccaccctttactgactcctttctcagactcagcccacttgcgcccaagtgaataaagagccttgctgctcacactaagcctgctcaggcggtctcttatacagacatgcctaacagtgatcagcagcttcccaaaaagatctcaggagttgagcgagtgggctcaagcatgcacactaagaggcaaaatggcggggtttgactggtatctgacctacctctaggaacactgaacaggtaagagaaaaacagctcttgtgagcatgcatgtaacttcagtaaacacactgcacttgtggcccctcccaagtgctggcaggccactgagtatgtgaacagcccactccaaaggaagaacctggggaaaagaaatgcaaacctcagaacaaagacaatatgtaaaaaccccaagacaagagtcagatggaatactcggatctctcaagtcacctacttggccctcttccaagtatatttctttttgtttctgctctaaaatcttttaataaactttcactcccgctgcaaaacttgcctcagtctctatcttatgcccctcagcagaattatttccattgaggaggcaagaattgagttgctacaggagttactaaagattttgagcaagcaggtaacaatctgagtggtgtggtggaagataccctacaaatgtgcttaattaccaaatacacattttctattccctgtcctcttcttgttaacacatgcaagcacacttcacatacttatgtgaagataagtattgaaaatcctgatttcacgaaacaggtgggcatgagttcagttatggttatcaaacaagatgcgatgttggctaggaagcttgtgggaagatttcagagaaaaggcaatagtagtgtgaagagatagattccctctgctctgacttctccccttgttaagcattttcccatatgccccaagaatactctccactgatgcttgcagctacagcatttaccctgagataactttgtgaaaatatcttgcttttattattatttacacattgctctagcatattcacttcggaaacaaaagacatcattctatttacagcattctatttctactagtggtattttcatttacaaaaatatagtgattcttgatcgctgaaaatttcaaatcctggaaaacataggatttctactcatgatgctaacatcattagggaactgctattggctgaagattcattggaagaatccgatttttccaaaacagatgattctgatgactcatataattctgatgtttgttctgattagaaataaccctaagagcagtttttatattgtattttcatattgaaagtcagatttgcttctacctcaaagaatgtttatgtaaaaattaaatgagtgctgatggtgagctgtccccttttgtttttctaaatgagaaaggagtgaaaccaaaataggcaactatccagcttgagaatatatgaatatatgagattatgaatccttgtttaagccacacttaatcaggttctctaatccttatgtttgaaattgtgtgtaactgttgcatacttcataactattatgttttataggttattggggcacagagaacgattctccaaagtatagagctttggtctgatgagcatttcgaattaaattaaattggaagtccctacatcttcctcagatacaagaactttttaatctcttgttcttcttgcccacctccacctgaagccctgaaaggaactttggaatttccttatctgaccaggaaactcctttccatagaaatgaaattgtcttaaaaccccctttctaggaacctaatcaattgaccagaaaagattaaccactagagaaaagaaaagacaaaatatcaccaccgtacccggataggctttgtatctatttttctgagggcagcacagagagagactgcctgggagactttatctatataataagaccatcgttgtttacagtgcagttttgcccctcattttcctttaacttgcttatcccattcagttttttaaataaaatcgtttaaaagataatgtctgcctcctggttccatttatttcctctaaaaattatttactatccactctaaaattgcctagagacccaactttcatctcccttatgactggggtattagtttaatttttacttaattaatttagatactgggtcttgctttgttttacaggctagaacgcagtggctcaatcatagctcactgaaacctcaaactcctgggctcaagctatcttcccaccttacctcctgagcatctaagcctaatggtacatgccacaatgcctggctaatttttattttgtattttttttttttttttgtagaaacaagatctcactatgttgcccaggctagtctcaaatttttagcctcaactggccctcccaccttagtctcacagagacctaggattacaggcagaagcctccgtgcctagcctgaagagggcatttaatccccaactatgtggcccttcttttgggtctcatatttgtgggtctcccatgtcaatgtgcatgttaataggtttgtaggcctttttttctgtctattctgtctattgtcagttcatttcagcagtgaaccttcagcagataaagggccttagccacaagagatttttttttttttttttttttcagacgcagtctcactctgtctcccaaactggagtgcagtggcctgatctcggctcactgcaagttccacctcttgggttcacaccattctcccacctcagcctcccaagtagctgggactacaggtgcccaccaccacgcctggctaattttttgtatttttagtagagacggggtttcaccattcacaggatggtctctatctcctgacctcgttatccgcctgcctcggcctcccaaagtgctgggattacaggcgtgagccactgctcccagcaggatcaagtgattttacaatgatttatgcagagtaaataaataaaagtttgaatgaatcttgtcagttgttcatgagaggggtaatggaattaggagtgagaatgtaacatcagttgaatttttcaaataattggctaaacactagaagagaaggaaaagggaaatatgaagctaacactgacattcagaatgtgtctgaccaagacaggtgacattccatgatcagggacaggaaatcagaagggaaaatggtgactttgatactggatataaatttgaggttggagcaaaacattcaggaggttggaaattatcaaatacatatcaagtggcagttaacaatagaagcatttatgtaaattcaataacagagttgaagtacacttggcccacatgggtttgaactgtgtgagttcacatatatgtggattttttccaataaaagttataccaagtgtgcctgcctctcctgcctacccttccacctccccttcctcctgcacctcctcttcaggctactcagtgtaaagatgaagatgaagaaccctatcatgatctacttccaggttaaaaaaaaaaaaaaaagcaaatatattttttcttccacacgatagttttaagaagcattttattttgtttaggttactttattgtaagaatatatactacatagactatacaaaatatgtgttaatcaactgcttgtgttattgataaggctttcagtcaatgtagacaaaatagccttctattgaaaaaggatgccatctagcactctgatggcaaaaaaggagacgtcaatacctggcttcaaagcttcaaaggactggtttactctcttgttaagggctaatgcagctggtgaccataggttgaatccaatgctgatttaccatactgaaaatcctagggcccttaataattatgttaaatctactctgtcggtgctctagaaataaaacaacaaagactggatgacagcaaaactttaccacatggttgatggaatattttaagttacttgttgaaacctattgctcagaagaaaaaaaaaaaaagatttcgtttaaaatactattgctcattgacaatgcacatagtaacctaaagagctctctgatgaaggtataaaggatatcaatgtttttatgcctgctaacacaatatccatactgcaacccatgaatcaagtagtaattttgactctcaggtcttattgttaaacaaatacatcttttaaagctgtagctgccatagatagtgactcttctgatggatctgggcaaagtaaatcaaacaccatctggaaaggattcagcattctagatgccagtaagaacatttgtgattcatgggaggaagtcaaaatagcaacattaaaagcagttcgcggccaggtgcactcgctcacgtctgtaatcccaacactttgggaggcctagacgggagaatcacttgaggtcaggagtttgagaccagcttgaacaacatggtgaaactccatctgtactaaaaatacaaaaattagctgggcatggtggtgcacacctataattccagctactcaggaggctgaggcaagagagccgagattgtgacatagtacctcagcctgcgcaacaagaatgaactctgtctcaaaataaatcaataaaagcagttagcaagagattgagtctaaccttcatggatggctttgaagggttcaggaacgcagtgaaagaagaaactacagatgtggtagaaatgcaagagaactagaactacaagtggagcctgaagatgggacagcattgccaaaatctcatgatgaaactttaacaaatgagaagttgcttcttaaggatgagcaaagaaagtgggccaggcgcggtggctcaggcctgtaatcccagcactttgggaggccgaggtgggcggatcatgaggtcaggagatcgagaccatcctggctgacacggtgaagccccatctctactaaaaatataaaaaattagccaggtgtggtggcaggcgcctgtagtcccagctactcagaaggctgaggcagaagaacggtgtgaacacaggaggtggagtttgcagtgagctgagaccaggccactgcactccagcctgggtgacagagcgagactccatctcaaaaacaaaacaaaaaatggtttattgcagtggaacctactcctgatgaagatgctgtggatattgttgaaatgacaacaaaatattagaacattacataaacctagttaataaagcagtgatagagtttgaggggattgactctaattgtgaaagaagtcctattgtggataaaattctatcaaacaacattgtatgctacatagaaatctttcaggacaggaagagtcaatcaacgtggcaaactttactgttatcttaaaaaaatgcaccagctacttccaccttcagcaattaccaccctgatcagttagcagccatcaacattgaggcaagacgcttcataagcaaaaagattacaactcactgaaggctcatataattgttagcagtttttagcaacaagttaatttttaatgaaggtatatgcatttttttttagacatatgctatttcacacttcatagaccacagtatagtataaacgtaacttttatatttatgggaaaccaaaaattttgtatcactcacttcatagtgatgtttgctttatggtgatatactggaactgaacctgtaatacctcaaaggtatgcctgtaataagtccttgccaatcaataattgctttaattgtaaacagatgaaattatccaatcaagaaatacaaagtgacttagtggatttgaaaaaaaaaaagttgcagcaatatgctccctgtgagagactaactttagctttaaggtcacacataggctaaaagcgaagggacagaaaaagatattccatggaaatggtaaccaaaaggaagcagtagtacttatatgagacaaaatagactttcagtcaaaatctgtcacaaaaaaagtcactatataatgataaaggaatcaattcatcaaaaggatgtaacaattgtaaatatacatgtactctatattggagcacctaaatatgtaaagaaaatataaacaggactgaaaggaaaaatagtaagggatttcaataatggatatatcatccagacagaaaatcaataaggaaacagcagacttgactaacactatatcaaatggaccttggagacatatgcagaaaatgccatttaagaaaagcagaagacacattcttctcaagtgtacgcagaatattctccagggtatattgtgttagactgtaaatctgagcaaatttaagaggactgaaattatatcaaatatcttaaaagatacttgttatcatatttggtaagattggtatcaatccagtggtaagaaactagaagtctataagaggagaaaataggaaaattcacaaatatgtggaaagtaaacaacacactcttaatgcaatcaatgggccaaagaagaaatcaaaaagtataaggagacaaatgaaaaagaaaaagacaacatgcaaaaatgtataagacgcagtacaagaagtcctaagagggaagttcatagtgacaaatgcttacatttattaataataaagatctcaaataagcaacctaattttacatctgaagaaactagaaaaagaacaaactaaataaacccagaattagcagaaagaaaataatgaagattagagcataaatgaaatggatactagaaagacaattaaaatgatcaacaaaactgagagtttctaaagaaaaacaaaattgataaacctttagcaaaaatagaacaaaagacagagctcaataaattagaaatgaaagagaagatctaagaacttatgccatagtaatacaaaagattatagcaggttattaacaatacaccaataaattggatagcctagaagaaattaataaattccaagtagcatatagcctactagaactgagtaatgaagaaatagaaaatataaatagactaataatgatcatgcaaaggtttgaagcacttatgaaaatctcccaaaaagaaaagtctggggcaaaacgtcctcacgaatgaattcaaccaaatatttaagtgattaaaagcagtccttttcaaacttttctaaaaatttgaaaagggaatacttctaaactcattttaaaaggtcagaattaccctcataccaaacccagataaagatgcgaaaagaaaattatagaccaacatttctgatgcacatagatgtaaaaatcctcaacaaaatattagcaaatttaattcatcatcactttaaaaggatcattcacaatgatcaattgggatttatcccttgcaaatgggtcattcaccataatcaagtgggatttatctctgggctgaaagatggttcaacatatgcaagtcaataagttttgtacactacactaacagaatgaaggataaatatcacatgatctcaatagatgcagaaaatgaatttgataaaatttattatctttccatgataaaactctgaagaatttaggtgtagaagacatgtaaatcaacataataaaagccacatgtgacaagccaaaagtaaacattagactcaatgatgaaaagttgaaaggttttcttttaagatcgggaccaagacaaatgtgtctctcttaccacttctattcgatgtaataacgtcctaacctgagcaattaggtaagaaagaaaaaaaaaaaagcatccaaatcagaaaggaggaagccaaagtatttgtttgaaaatgacttcattttatatagataaaaccctcaaccccccactataaaaccgttagaataaatgatttcagtaaagttttgtgatacaaaatcaacataaaaaatcgtgttgcatttttatacactaacaattaactatctgagaacaaaattaagaaaacaatcccatttgcaataacttcagaaaggataaaatacttatgaataaatttaaccaaggaggtagaagatctgtacaatgaaaactgtcaaacagtggtgaaataaattgaagaagacacaagtaaataaaatgttcaaatgtccatactacctcaaacaatctacaggttccacgcaatccctaccaaattccaatagcatttttcacagaaataaaaaatacaattctaaaatgtatatgaaaccatgaacgctccaaataccaaagtgactttttttttttttttttttttcgatacagaatttcactctgtcacatgggctggagtacagtggcacgatcacggttcactgcagcctcaacctcctgggctcaagcgatcctttcacctcagcctcttgagtagctgggactacaggtgcacgccaccacacctgactaatttttatatggtctcaaactcctgggctcaagtgcttcacccacctcagcctcccaaagtgttcgtaaagcctcccaaactacaagtaattttgagtaaaaacaacaaagcttgatgcactacatttcctgaattcaaactatattacaaagctatagtaataaaaaatatgatattggcataaaaacagacacatagactaatggatcagaatagagagcccatactcatgcgtacatacattgtccacatataaggtcggctaatctttgatgagagtgccaaggattcacaatggagaaaggacagtatcttcaataaatggtgcctggaaaactggatattcacagacaaaggaatgaaactggacacttaacttacatagtacacaaacattaaatcaaaatagattaaatacttaaatatgagaactaaagctataaaactaaaaggaaacgtagagaaaagtctccttgaaattgatctgggaaatgatttttttagatgacaccgaaagcaaagtcaacaaaagcaaaaataaaccagtggtctatatcaaagtaaaaatcttctacacagcaaaggaaacaataaacaaaatgtaaagaaatcctacagactgggaaaatgcaatccttatatgcttccattatgctaagtgaaataagccagatacagcaagatacatatagtgatgtatgatatcacttatatgtggaatctaaaaagtcgaactctgaaaagcagagagtagaatggttgattttagcggatggaaggaggtaggggatggggcatgagagtatgttggtcaaagagtccagacttataagacgaataagttctggggatttaatgtatgacatggtgactgtagttagtaacactgtattttttacttaagattttctaagaaagatgctaagtccaagatactaagtgttctcaccacacatacacaaatggtagctatgtgaggtgaacttttttaagtgaaagtgtggagatttattgcaaagcgaaagtacacactgaagaaagggacatgcaggtgtactcaagagtcactgcaaggaatgtttcaataagcatggttgtggtcatcattttacaatatattcacctatcatatcaccatatactacaccttaaattatatgtaatttttatttaatttattcttcaataaagctggaaaacaaaatatttgttttcttggctagtctgaaagaagcagacaattttcatgtttaaagttctaacatgttttatgctaaacaaattttttccgttaaagaaatataaatcaatatattcaaacctagaaaactacttataataaagacctataatgtatattgccacattaaaacaaacaaaaatcatcttttattggaaagatcaaccacattatcgatttaataaatagccttatgttccacacaaataagctatctaatgcatcataattgctaaagtgctttggtacatttacataaatctcactatttgaacaatataatttgaataatatatttgaatatttgaataatatagttgaatatatatttgaacaatatatttgaataatatattgaacaatataatactttcctgttaacatatttaaagtaatattttcccctcaaatgccttatgagcttaaaaaagatggaaaaagggaagaccttttgcgtattctgaagcctataaacacgtagcttaaacttttctgggatgccttaccccaaaatatcactgtggctaaaccactatcatcaataaaagtcatgcataaggtgcattcctttagtaatagatagtgaactggaaaaaaaatccttcaatagtaagagctggatctctcttatcctatgcatgaaatgttaatcaccattacactaaggtgagaacaaaaatcacaagatactaataataataaagaaaaaaaagtttgttttttcttagtggaacaattaatagaaaataaggattctttaactgaagattattattttatatacgtaactacagcattagaaaacataatcaggaagctgtaaataagtaaattaccagctgtcaaaaaaattatcactatcaaattaaatgagcttcccctaggcaagctaagattgcttttgcctgaaggctggctcaaaaatgaatcatgagggagacaagtcatataaataaaacaaattttaaattaatcatgactgtgtagactaacttgaaaaataaatcttaaaactcattgctaaatcttttaacaactaactacaacgattagggactactgtaaaccagactaaatatgcctcaatgaactctgatttgtttttagattaacatacttatataatattaacttagatagtatacatgtcattcctgtaggtcagagtaagggatgactttcaacacgaaaagtggaagtaagttggttatttatagatatttaataaactacaagttaactatttatttccactttgactaactactcaaaaattgcttcaaatatgtctttagaggccaaatctaaaagaaatatatttcttctcatcctgtcaagtttacttttgtcctgtatttacacagataggtccataaaaaactgaatgtaaaatactgatgacagttaattttgtttctttcatcttatttacattatttttgtccacccattgtccacagggaataaaacaaacgggctaaggggttaggggtcttctgtgatgattacagagagaaaaacaaagaggataactgtcctgatacaagggtgccttgaaagcacatcagatgctttagcagtgtcaaaaagtcacaggcttttaaaagtgttaaagaaatttaaaattagccccttgtgtctcacggaaaccagaagagctgtgcctgccattgtggagctagttagcaagatcaatgtacaggatactccaccattttaaggactcctatgaggcattttaggtatagagtcaaaatgttgatctcctgagggactttcttcaatccaattccaagggctgatcttggggaaagaagttaatatgttgtatgtaactttggttctctcacagtggcttatgtttggatatgatacttatttagctgataatccatctaaatgccctctgagtatcactgacatggagaatgacaaggatttagaaataatatgtatttttaatgggacccacaccaacaagaagtgtcagacctaaagaaatcggtctttaaatggtgaaatctccaaaattgcagtaatgtacgctgttctatatcccctagacaatattacatagctgccaatgtgtaaaatcaaactttttaaagcctggtgagggaggtaagcctttttatcagctgagcatttcagccttgtgtttcttctgctcattaaccaagctggtgtgacaagtaagggaatacaactcctagatgctatgtttcctcttaattacagaggttccagaaacattatttagtttatgagtaatgttgatgttactaggagaaataatatataagtagaaatgtaggtagggaaggacagagagagatagaaagaggcagacgatttaggaaaactacattgtgattgtgattgccattagaccaatactaacaaacattattattccagtaaagaaaatgggtcgggcgtggtggctcatgcctgtaatcccagcactttgggaggccgagatgggtggaccacgaggtcaggagttcgaagtcaccctggctgacatggtgaaatccagtctctactaaaaatacaaaaagtagctgggtgtagtggtgtgcgcctgtaatcccagctactcgggaggctgaggctggaaaattgcttgaaactgggaggtagaggtttcagtgagccaagattgtggcactgcactccagcctgggcaacagagcaagacactgtctcaaaaaaaaaaaaaaaaaaaaaaagttcgtatgtatgtctttcaattattttattgtaatagctgacaaagatttatcattttctcatttaaatgtaaagcacttcaccaacatgttttacttgatcctgagatactgtcgaaatgttccctgataggtagcatatatttgaataatgcagtcccacatcatgatctactgagcttgctggggctttggaaggctggaggcagagattggtaaggaacactgacttcagcctctccctgcccctcataacttctctccaatgtgaggaagtgtcttcattgatgttgagtttggctggagtatcggcagaaattacaggtctctataacgatttattacaggtctctataactatttatttttaaaggcttttacagtataaattcctccagaatgagatgaagccccaaatgaactttggcggaggtttaataagaattgcactttgcagatttgatatgattcacctttggtttaaggacataagcctaatgataattaatttctactgcatatattgctgtaatacataacttacttctgtgaagtttttattgaaataacttttttcagcttttattttagcttcatagggtacatgtgcaggtttgttacctgtgtacgttgtgtgatgctgaggattggggtacgaatgatcctatcacccaggtactgagcatagtccccaacggttagtttttcatcccttgtccccctccctctttccctcttctagtagtccccagattctattgttgccattttcatgtccatgagcatccgacacttagctcccacttatgagtgagaacatgttcctgcaccaatttgcttaggataatggcctccagcacagccatgttgctgcaaaggacacaatttttttttcttttatggctatgcagtattcatggtatatatgtaccacattttctttgttcagtccattgttgatggacacatagattgattccatatctttgctattgtgaatagcactgcaatgaaaatgcgagtacgtgtctttttggtagaacagtttgctttggatatataccaagtaacaggattgctgggttgtatgatagtcctgttctatgttctttgagaagtctccaaattgctttccgcagtggctgaagtaatttatattcttaccaacagtgtataagcattcccttgaaaccacaccttgctaccatttgttgttttttgacttcttagtaataaccattctgattggtgcatacggtatctcattatggttttcatttgcagttctctgatgatcagtaaggttgagcatttttttcagatgtttgtttaccgctcatatgtcttcttttaaaaagtgtctgttcttatattttgcccatttttaaaatggggctgtttttggttgttcaattgtttcagttccttgtagattgtgaatattaggcctttgttggatgcatgggttgtaaacattttctctcattttgtatgttgtctgtttactctgttgctagtacatttgttatgcagaagctctttagtttaattaggttccacttgtcaatttttgttgttgttgcaattgcttttgagggcttagtcataaattctttcccaaggcccctgtacagaatggcatttcctaggttttcttctaggattcttgtggtttgaggtcttacatttaaatctttaatccatcttgagttaattttacatatggcaaaaggtaggagtccagtttcattcttctacatgtggctaaccagtatcccagtactatttattaaataggcagtcccttccccattgcttatttttgtcagcttcattgtatatcagatggcctgtaggtgtgtggctttatttctgggttctctattctgttccattgatttatgtgtctgtttttgtaccagtaccatgctgttttggctactatggacttgcagcatagtttgaaactgggtaatgtaatgcctctgtccttgttctttttgttcaggattgctttggctattttttggttccatatgaattttagaatagttttcttttttctagttccatgaaacatgttggtagtttgataggaatagcactgaatctgtatattgcttcgggcagtatgtccattttaatgacattgattatttcaatccatgagcataaattttttcccatttgtgtcatctatgttttctgttaagtatttttgtgtgtatacgtggctactataaatggtgttgcattcttgatttggctctcaacttgaaggttattagtgtgtaaaaatgctaccaatttttgtaacattgattttgtaccctgaaactttactgaagtcagtattttgagacatttaaccactgaaatgtcaaatgtaattgaattttatggcttcttggggtatgtggtagggtggaagggattgtacacacatttgtgtgtggctttccctctagtcaacttttagcctacctggaccaatacatccattatgtttggaaagctttcaaaacttacctgaatattccctagatatgtagttatataaagactgtcatgttttgtatagagaatcagagaggctgaagagaaaatatataagatatagataaatatcataatgattattgcataggctattctctcttcttgtaatgtgttttcttcctatgcataaaaatactgatattgttgccacacgtatttttaagcatttgtatctattattaaatgtagcattatcaatagccctctgaaataggttactattattattcaaattttactgaagactttgagagataactacattggccaataccacatagataataagcagtaaagcaaggatttgaatttaaatatgcttacaacttttcacttaaaacttccaaaaataaaggacatgcatgtgcatgcctgtatatgtatgtgtgcatgactgaatactttccttgatttatgacatatatatttataatatttatatatatttatatatattaaattttgtaggataagataattcaaatctgtgactgaagtcttattcagctctgtggtagtaaatatcaccttatctgtacatttgccaaaggcatcatgtccaaaaatcattataactgtaaatttatcacataaactcacttgaaaattggccttataaatatagatagaataggctggatgtggtggctcactcctgtatttttcgcactttgggaggctgaggtgggtggatcatgaggtcaagagatcaagaccatcctggccaacatggtgaaaccccttctctactaaaagtacaaaagttagctgggcatggtggtgcatgcctgtagttccagctactatggaggctgaggcaggagaatcacttgaacctgggaggcgtaagttgcagtgagccaagatcacaccactgcattccagcctggtgacagagcaggactccatctcaaaaaatatataatatatacataatatataatatatacataatatacaatatatatgtaatatatacataatatatacagaacatataatatatatgtaatatatacataatatattatatatagttaaaataaccaactacaaatagtatcatatcatccatttatttttttcctttcttcttgttaaattatttgtaatgttattttttaaagatattctggcttattaaatatttttaaacttacagtcaaaacatatcttcataacagaaaataatcacaacctacacgtactacagattgagaatcactaatccaaaattctgaaagctaaaatgctccaaaatatgcaattttttgagtgctgacatgacctcatgtgacgattctcagcgaaataataatagatgctggtgaggatgtggagaaaagggaatgctcatacactgttggtgggaatgtaagtcaacgcagtcactatgaaaaacagaatggtacgtccacagaaaagttaaaaatagtactaccatttattccagcaatcccaccattgcattcttatccaaaagaaagaaaatcagtatactgaagaggtttctacactctccaatttattgcagcactattcacaatagccaatatatggaatcaaaatatgtgtccatcaatggatggacagataaagaaaatgtggtacatatacatacattcggccattcttgcattgctataaagaaatacctgagactgggtaatttataaagaaaagaggtaatcagttcatagttctgcaggctttataggaagcacagtgcctccatctgcctggcttctgggaaggcctcaggaagcttacaatcatgatggaaggcaaagggggagcaggcacatcacatggtgaaaataggagcaagagagaaagagtgagggcggagatgacacgtacttttaaatgaccagatctcgtgagaacttactattgcaaagacagcacaagcctggagggatctgtccccatgacccaaacacctcccactaggccccatctccagcattggggattacaattgaacatgagatttggctagggacaaatatccaaactataccaatatactatatgatattattcagccataaaaaagaataagatcctatcatttgaaacaacatgaatggaactagagaaaattatgttaaatgaaataatccagttacagaaagacaaatatcacatgttctcactcatatgtgtgagttaaaaaatttgatgtcatggaggtagagagtagaataatgactaccagaggctaggaattatagtgggtgataaagagggatgggtccaaaaatacagtcagatagaagaaataaaatctagtgttcagtagcacaataggacagctataatgaccataatgtattgtatatttcaaaataattagaggagcaaatctgaaatgttcccaacacaaagaaacaataaatgtttgagataatgaatatctcaattatgttgatttgatcattacacattttatgtttgtatcaaaatatcacatgtaccccataaatatgtacaactattatgcattcataaaaatgtaaaaatgaaaagaaatgcagtcaactcttagtttcatgcacaaaattattaaaaatattatataaaattatcttcagtctataaagcatataagaatgataaatgaattttttgtttagacctggacccttagcaaaggtatctcattatgtatttgcaagttatcaaaaaaaaaattcagaaatccaaaacatttctcaagccaggaattttggattagaaatactcaacctgcatctttatttatccttagtcttttcccaaatgtactatttctactttcttcattacttatgactgaaatttattttatattaaactacataatttctgaatagaatttgacatagcacagtatttttcacatgctgtttacttgagaactaaataatttttgtcatacctaccattcatactacaatttgcttaatgctttgtgtgctttattacatgaatacagctttatattacttctgtaataaaatatataaagttttactgttatgaattaactgtaaaaattaatacagcaaaaacccaagcatattaataataaattatggttagatcactttgtgagtatgagacctagtctttcttacaaagaaaacaactggaacatatttcagttgtaaaagatattctagtatcaaaacatgtttttattgttaggaatcagaaaaactgaaaaattaaacaggtaataactttctcaatatgtgatttaaatttactgagatgattttgtgagtcttcaatacaagttgtattaatgatcatttaaaatcttgcctggtaagacaaagctcatcacaaaatacaaactgctctataccagtattcatgtccaggcacaaaaatgaaaggcccagataaaactgtgaattaagacaaagcatataaagtgggctctggtaccagatgatctggttttgaatcctcactggtacttactagctgtgaaatcttgcacaattgaactaatccatctgagtgtcagtttcttatttgttagtagccatttatgctcagttcctaaatccattaattaatgtctagtttcaaatgtgatcatctgatactgcagtttttatgttatttatttgatgaaatacttttatataatgagacaattcccctatctgccattttgtttcttctcagtggtagagttcatataggaaagacagaataaatgcttgattttaattttatttactagttttcaaaataaagatttaagagcttctcaacctctgaaatatatttaaatatacattggcaggtaggaagaaagagaaagaaagagagagagaaagagacaaagaaagagacaaagagacacagagagagacacagagagacagagagagagagacagagagagaaagagagagagaaagaaaaagggagaaaggaggaagaaagaaagagaaagagagaaagaaagagaccgagagacagagagaaagacagacagaaacagacaggtaggcagtcagtgcatatagacactgcatactgtagtctctgacttttaaccattacttagctttatttctgtgagtaatcacattttaaatgttcaccattaactagttgtctgaagcttattctacggggtattctcagggaaaacttaaagaaacgatggagtacaatgataacaggttttctgtgcccttaacaactcaaagttcctttttctgaatataacctttttggttcacgtaactctcattttctttcttcatgtatctccattatgttaccacattttcttcaaaaattgggtttatatttttaaaattataatttttcttccttttattagtcaatttattcttttccataggtgtccaaatgacacatttattcttttttctttaagatctattattttattataatatttcttggtactaataattccaggttgatatccttaagtacatgaaattagattatctttcaatacatagcttccaatatcagcaggaaattattcatgatcataattttgagttatctgttctgctctcttttatttgtttttcttcttcagggactcctgcttgtatgttggtcttccttgtgtatctttaatatttattaatttgtctttaatagtttttacgtctttctacacttttctttttactttctaaaatatgacttcctttaactttttcttagtgcttcatccatcaggtatatttgtttgctcttatcttctttctagttcagtcttcatttctgaaatgattttcttttatctatatttctttcctgagctccatcagctcctttctgagattttctaatactgattaatgttgctcattattgtttacttttactggttgcctttcaattatttaaaaaaaatacaattttgaagtattttgaaggcagactttactggctagattttattttcagtcatatggttattttgagtatgaaattagctaatccagagacagtaccattataaagtaatttatcaaaaaatagagactttcagttcctcaaatagccattattgattataaaatgatggaaaagtagatgtatacatattctgctatttggtactcatagtatacttagtgtccttagtagtgatattctcttataaaactttaagcaagatgtgtaattttcaaacacttttttaaaaagatcttttgcaaagagggacaatttgacttcttcatgattatgtatctagaaaaccccattgtctcagcccaaaatctccttaagctaataagcaacttcagcaaagtctcaggatacaaaatcaatgtgcaaaaattgcaagcattcttatacaccaataacagacaaacagccaaatcatgagtgaactcacattcacaattacttcaaagaaaataaaatatctaggaatccaacttacaagggatgtgaaggacctcttcaaggagaactacaaatcactgctcaatgaaataaatgaggatacaaacaaatggaagaacattccatgctcatggataagaagaatcaatatcgtgaaaatggccatactgcccaaggtaattgacagactcaatgccatcctccccatcaagctaccaatgactttcttcacagaattggaaaaaactactttaaagttcatatggaaccaaaaaagagcccacattgccaagtcaatcctaagccaaaagaacaaagctggaggcatcacactacctgacctcaaactatcctacaaggctgcagtcaccaaaacagcatggtactggtaccaaaacagagatatagaccaatggaacagaacagagccctcagaaataatgccgcatatctacagctatctgatctttgacaaacctgacaaaaacaagcaatggggaaaggattccctatttaataaatggtgctgggaaaactggctagccatatgtagaaagctgaaactggatcccttccttacactttatacaaaaattaattcaagatggattaaagacttaaatgttagacctaaaaccgtaaaaaccctagaagaaaacctaggcaataccattcaggacacaggcatgggcaaggacttcatgtctaaaacaccaaaaacaatggcaacaaaagccaaaactgataaacgggatctaattaaactaaagagcttctgcacagcaaaagaaactatcatcagaatgaacagaaaacctacagaatgggagaaaatgtttgcaatctactcatctgacaaagggctaatatctagaatctacaaagaactcaaacaaatttacaagaaaaaaacaaccccatcaacaagtgggtgaaggatatgaacagacacttgtcaacagaagacaattatgcagccaaaagacacatgaaaaaatgctcatcatcactggccatcagagaaatgcaaatcaaaaccacaatgagatacaatctcacaccagttagaatggcgatcgttaaaaagtcaggaaacaacaggtgctggagaggatgtggagaaataggaacacttttacactgttggtgggactgtaaactagctcaacccttgtggaagtcagtgtggcgattcctcagggatctagaactagaaataacatttgacccagccatcccattactgagtatatacccaaaggattataaatcatgctgctataaagacacatacacacgcatgtttattgtggcactattcacaatagcaaagacttggaaccaacccaaatgtccaacaatgatagactggattaagaaaatgtggcacatatacatcatggaatactatgcagccataaaaaaggatgagttcaagtcctttgtaaggacatggatgaaactggaaatcattctcagtaaactatcacaaggacaaaaaaccaaacactgcatgttctcactcataggtgggaattgaacaatgagaacacatggacacaggaaggggaacatcacacaccggggtctgttgtgaggtgtggggagaggggagggatagcattaggagatatacttaatgttaaatgacaacttaatgggtgaagcacaccaacagggcacatgtatacatatgtaacaaacctacacgttgtgcacgtgtaccataaaacttaaagtataataataaaagatcttttgctaatttacttcctaatgaaaatctaaaggtaagaacctaagcaggattttttttttttttactttgcttgtagttagttactttaccttccaacaatcaatataactacttgaagtagtgtttataccatcatctagttattggtaattaaaagcatttcatgctagaaagaagataaccacaaaatgtattagatggtgctcacttccatttaactctatctttatatatgctgtttcaattgaaatttttgctgtaaatgtagacttacataaatttaaaattgtaaggaaacattatcttgcagatttatcctgcctaatacatctgaaatgagttgatacaaattattattttactactgatgcatcctgatgtttaaatgaatgaggtatagcggggaataaaaaatttaaacatattttacatttatctatgactttgctatttatatttataaggcatactaaagaatattacgtagaacattgtattaaaagttaggaaagatgaattcaaattggtgttgacatatttctataaactggtagcatgtataacataagaatacctacagtgatgttcgtcttctgaatgtttacagataatctaaaaatacctatcttttgatttctactaatctataagaactgatctgtgataaatatatcaaataaaacaagtccatatttattcatgggtattaagcttttatagtgaaatctgtaataaatgtatacaagcacaggtgttgtggaattcattttgttctgattttaatatcccaattcctctggctttaatgtggtcaaatgatgatcctagagaaaaattcctaaaataatatttgtaatctttgttacagaaagattttaaatatatggatggctatttggcagtatgttacctattattttgatacgcagttagccacaaaatcaatgtgacatgtttttccatatacaggataacattaaccaaaaccactacattaaatgaggctcaattttagacactgaatgtttcagctgcagattacaattctttattttttctttatttttagctcagaaaggaaatctggcagacaatagacttggaaattactttcaactatagaaacctacattatcattattattacttttaagagatccattgttttgaaagaatattctgtcatcaagcatttgctactatttctattatgtttataaaatttttgagcccctacaaataatcatagaactcatattcatttaacaaatttttactgagtgcttacaatagagtagactttcttttgcatgcttatctgttaaagtatagcagaaggttaatagttccatgtggtatcaactaaaagcctcagcaagttttcctaaacattcatctctatttcttggcattattaagtaaaaataatattgttttataattttattttaaaaattcatatatatctttttacttaaaactttaataatatttgtgtggcttttgtgaatccaaagtaaaaaagtaaaattaatcaaatatttttaaaaagttttattactactgatagagtatctttcaaatgtctatttgaaatatatttttcacttataaatttatcttcatggccacatcccattttttatttgcctttttatttgttttcatttcattttaaaatgattgttcagatcactatttgtcaacatagaaaatatacctgatatttgttaaatggggtgaagggaagcagcttataaaagattacataaagtatgatcctatttttgatagataatcatatgtacatttaccttgttttcatgactcctagcattgtaacatctttatgatttaaaaacttgttaattttattaatcaaatgagaagtagagttcacttccaactatggaagtcaacaaagggaacagagcttcctcttctcatgtactgcagctagcacctgagtgtgttagccaagatcattcataatctttgcatattgacagactggcacaaataaatcaggacaatataatattgaaagactggcagtgaaatggtgtgaagtccactgatgtggtatcaacagagtagtcttaagcagactttcaaggcaggtccttagctgtgaccccattacaaactcttctatttctagccttgttttcaaaatctatccaatatattccttttctacttaattatttttttttactgtttcttagaatcaaaattgtccaacgtaaaatgtattgtaggtatcagaccctcaagaatatgcaagaactctggatttgttagctgactgcattaggattggagacagggaattttcattaacaatttaagaaaggaatcctaaattgcatgcattttagcatggaaggtgaaatgccttatttattatagcctatggtcacccagtagaagcaaagcttcagggtgtagcactgatgtcgtcattaagcactatgaaggttaagaggaatttaatgacagcatggttgagtaggtatgttaaaatgcactggatagcataaatacagtgaacgacacacacttctaaattctctgctaaaggaacagactgaaacctagagacattttttgacattgcttaaagcatctcctatctcttttagcctcaggctgaggtaaccaaaatacaaaagcaaaattaaatcctattacttatgatttttaatgtcagctgaattcacaaggttactacattttttagatgagagagtatgagtttggaaagagttataccctgaaattgaaatgggaataccccaatcatctaaagtttctgctctcccttaactgacaagtacccttttataacttgtctgatagggttgctcatcgtaagattgaagatgatgatattctttttcctgtaggagttgacttgcaacagaaagtcagtaatccacatgcttgctaaccaactacctctcaatgttctttacctgtattatcagattccagcataacctgaagagctgattacaggctgaagcattttatctatagacaaactgcgtaatttccctaatttatatcatcaataaggaattttgaaaatcagtaaatctttggcttctaatgttatttcaccaaggtggagggatgtatttttagatcaggttcaatttattaatatggatacatttgccagagtttctatattctttatgctaatttgaatctctggatgatgcaatagatttcttggctggttggcaaaaatgtggacccaaccgcgaatctcattaagtggcatttcaatgtcagacattactgggtatgccatagaataaggaatccaaaatgttgagtaaatggaaatgttggagatgacattttatgtctttaacctaccattctctccctaaaaacacctctccagtatataagggtaataacttgcctataatcttgaaaaatgcataagtgagccaagctggtgttgtgacatgtgctattttgaagactatcaagctagtgaaaaacaccgtagttgaaaacaaaccatttattttaatgggaagtagatcttggagtagcagacgaaagagtatctacaatgaagtaccagaagcaaagtagacaatgcatagcaggcaacacagcctgctaagaaaatacccctatctatagggatggatatctgaagatatgtaactgtgtatttttcaggaccaaaataatagataattcattaaagttctatatagcagatattactgatggactatgtaacagtcatagtcatttactgttccatgttaacagaactctaattattttcaggtacatagcatgcctaaaaattaatttatgtgtcctccctcatccgacaaaaatgtggatatctaagtgactttggttacctcattcatacttctagggtaatttaggtttgggggtctgtgataaaattatgaaacataagagagaacttccaggacttcctggaaaggaagcttttaaaaagagtttttaaaataaatgcaaggaagacatagacactttcctatcagtggaacataacctctctggatgatgcctagaactgcagcagccatccagtgatgatgaggcaactagccaatggaccaggattacatgctgactgtagcagagcaaaaatatacaaagactcctcaatgagtttttgtaggaattcaattaaagaatgggaagctttttttctatgtttttttttttcccatatgagagaggaaaaaaagtccttattgttttagaaattttaagtaatattattttatacttgtgggaaaataattccaggcctgttttgctggaagaaagatgctttactggagccaaaatggtagaaattcatggttcctctaataatacctgacaaacatagaacctctgtaatgaagagaaggggcaaggccaggtaatagcaatacagatatatttctaaggaacaaaataactagacaatctgttaagggttctatcaggggacctgccccgataatcacataggttttctattttccaaagcgtcgactggcttgagaaataaaaggacagagtacaaaagagataaattttaaagctgggcatccgggggaaacatcatacattggtaggatccgtgatgccccacaagccacaaaaaccagcaagtttttattagggagtttcaaaaggggagggagtatacgaataggtgtgggtgacagacatcaagtacttaacagggtaatagaatatcacaaggcaagtggaggcagggcgagatcacaggaccacaggaccgaggcgaaattaaaattgctaatgaagtttcgggcaccattgtcattgataacatcttatcaggagacagggttttgagatcaaccggtctgaccaaaatttattaggcgggaatttcctcttcctaataagcgtgggagtgctatgggagactggagtttatttcacctctgcagtctcaaccataagagacaggtacgctccggagaggggggcagttcagagacctacccctaggtgcacattctctttctcagggacgttccatgctgagaaaaagaattcagcaatatttctcccatttgcttttgaaagaagagaaatatggctctgttctgcccggctcaccggtggtcagagcttaaggttatgtctcttattccctgaacaactgctgttatcctgttcttttttcaggatgtccacatttcatattgctcaaacacacatgctgtataatttttgtagttaacgcaattattacagggtcctggaacgatatacatcctcctcaactgacaggattaagagattgaagtaaagacaggcataggaaatcacaaggttattgactggggaagtgataagtgtccatgaaatctttacaatttatgtttagagattgcagtaaagacaggcataagaaattacaaaagtattaatttggggaactaatatatgtccataaaatcttcacaatccacgttcttctgccatggcttcagccggtccctctgtttggggtccctgacttcccacaacagggttctaaatcacaggtactactattggactatgtaacagtcattcactgtatgtagtgtggaaatttatcataatctccatgctatgaaaaaagaaaaaagcccagatctaccatggattattgcatagtggctctgattgacattagcattaactgttgagaaccctgaactccacaaattcaccaatcagggtgaaagtttatagtggtcaggtgaagttttgcccccaaatttgcctcataatcagcccagtgagatctccaattcaccctgtgtttattctaccagttcctaagtatgcatttggaaaagataacagccaccagcaggattattttactggtccatcagtttctgaaataagtactagtttggcaggaaggagcaacccaaagcctctggggtcatttcttattcaaacagttaataaaaattaattgcatatctctaggaagggtaaaacattagtacagccacctaagattttaaaaacctaggatggtgattcctattgcatcctcatttaattgtccatttgggttagtgaagatagctgctaaagagggacactagattagcatatatttaattgattggtgataacagttagagttccagatgtggtttctttcctggagcaaaaactgtgtcctctggtcaaagtaaataaatattaacctaacaggtacttttgttttttttttgttccatcccagataagagcagattcactttgttttatctggtagcaagagagtacttctaccaccttcctttattgttatatagtagatagggtacttagttacataatcatccaaaagggcataaacttttctactatttgatggcatcatattgctagtaccaaagcagcaaggattatatcctagatatctaaatttaatacatagtgttagtacaaaatacaagtatctgcaatttcagttatatttctgcggatccactaatcttggctccagcaggataatacattccaaaatgaaggccacttgtgcctctgccatgagataaccatacaacccctgagacttttttttacattttggattcaataaacagtacatttagttatatagatatgatccattaatcagttacctgaaaggatgccacttttgaagaaggctcagagcaaaagaaggctttctaacttgtaaaggtggcagtgcaagaatctctgttattaagaagatacagtgatgtacattgtattgttggcacactggaatagagtatgcggaaagaaagaaactcccaaatgagaattaaactggagacaaatggggtttgaaacaaattcatgccttctttagcaagcagctcatcttcttttgacaaatagctcttggcctgcactggaatttgacagagtctgagtatgaaaatacctaatgacaggacagaagatgacattgtgaccataccaaagtaagtatttcctgatctacttcattctgaaggtcagagtgaccagcacaggactccatcataacacaggagtggaatcaactgaaggaatgagataagcagatggcacacattctcaatcttagtgccaccctcctgccatattgtaatcccttctataataatcttatggagagtagtcaatcatcattcagtgagaagaaaatgctggtgccagttttacaataagtgatgaatgatattctaccactagatggaaattactcttatagaattacactatcagttttctttgaaagactataaaaagaggctaattcttctagtacaaggaacttttaaaagtgtatgttactgctcacatctttctggaagagatgatggcctaaagcaaaaatctacactaaatcatgggcagagcccaatggtttggacaaatgtttaaggaaatgggaatatcaagagtccaggattagtaacaaggcagctcgtggaagaaacatatggaaggacatcctagagtagccccagaatgtgagcatatgagtgctccatgtacaagttaacttaaggcttatttgaatacttccagaatggaggaaacttttaatatcatgtagacaatatcaggtaaacaagacgatctgctcagtggatctcagaagctctcattctctaatctctgatgggactgctgaatgggctcattacccacgtggtcatagtagcagtaacagagattaatgcaaaccctcaaaaatttgaactttctcttaccaaatctcgcctgactactaccactgataaatgccaaatttgccaataatagatatcagcattctagtttatggggtgactgaacttaaaattgtagtttattgggtggttgaacctgaaagtaatatcaatcctcttcaaaggatgcagagagtaacatagagaaaaactgtgtgcttctatggagcattctttcacacagcatagactacgtgggtaaacatcctggttccactacttactacctgtgtgaatttgagcaagttatataaactctataaaataaggaagaaaacttacctatgtctcagggttgttaaatgacttactatatgtaaaacacttagagcagtgacagatatatagcaaataccatgtaatggttcaataaatagaaaactaccatatcaagaggtagataaattaatagattataacatgactgttatacctctttcaagattgaatgtgtggggcacaccagttggtaaaaagcctcacctatgtgtggtattaattgaagataaacataagtgaatgcatgaaaactaattatatccttataggtgcagaaatgaggtctatagtagctctacatacattcttttccctatgttatgtgtattagagtaaatattcacttcactttccccaatgtttagccaatttttgtgtattaagtatgtgtgtggtggtaaattttcaatgtagctcccagtttgcaagataatgagatggatcataataaatgagaaaagaaatgggcatcatccaggaataccgtagctgacactaggtgagtgatgaaaatatgggactattcttttgagaggatggtttaatgagagatagttacaatatctaacacaggagcagtgataagaaagatggatgtagctattgcatggctaatgttctagaaccaattgcattttagtcaataaccaaattttaggttctcttttccttttggaagccttccccattgtattaatcttgatgggaagtaggtccagtgtcgcatataaaagtcaaaagggccatatagctgaagatagaggggtatgttttaggtttaagcaaccagtctttgatttgcttttgacttttgatggggtaaagcaaagacctagtttcttggggaaattaatctaggcacatatgaaaatgtcaaaggccctgcagtgtcagtgacatgaggggagtggctgtaataacagtggtagcatcctaaccagactggtatgactttggctgtgttttctgttctctgtccttgctgcatttttttattcttttattttattattattatactttaagttttagggtacatgtgcacaatgtgcaggttagttacatatgtatacatgtgccatgttggtgcgctgcacccattaactcgtcatttagcattaggtatatctcctaatgttatccctccccactcccccaaccccacaacagtccccagagtatgatgttccccttcctgtgtccatgtgttctcattgctcaattcccaccaatgagtgagaacacacggtgtttggttttgtgtccttgcgatagtttactgagaatgatgatttccagtttcatccatgtccctacaaaggacatgaactcatcattttttatggccgcctagtattccatggtgtatttgtgccacattttcttaatccagtctatcattgttggacatttgggttggttccaagtctttgctattgtgaatagtgctgcaataaacataggtgtgcatgtgtctttatagcagcatgatttgtagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagattgtatctcattgtggttttgatttgcatttctctgatggccagtgatggtgagcattttttcatgtgttttttggctgcataaatgtcttcttttgagaagtgtctgttcatgtccttcacccactttttaattgggttgcttttttcttgtaaatttgtttgagttcattgtagattctggatattagccctttgtcagatgagtaggttgtgaaaattttctcccatttttttaggttgcctgttcactctgatggtagtttcttttgctgtgcagaaactctttagtttaattagatcccatttatcaattttggcttttgttgccattgcttttggtgttttagacatgaagtccttgcccatgcctatgtcctgaatggtaatgcctaggttttcttctaggatttttatggttttaggtctaatgtttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttttgagggctctgtgctgttccattgatctatatctctgttttggtaccagtaccatgctgttttggttactgtagccttgtagtatagtgttggaagttctggccaggacaattaggcaggagaaggaaatacagggtattcaattaggaaaagaggaagtcaaattgtccctgtttgcagatgacatgattgtatatctagaaaaccccattgtctcagcccaaaatctccttaagctgataagcaaattcagcaaagtctcaggatacaaaatcaatgtacaaaaatcacaagcattcttacacaccaataacagacaaacagagagggaaatcatgagggaactcccattcacaattgcttcaaagagaataaaatacctaggaatccaacttacaagggacatgaaggacctcttcaaggagaactacaaaccactgctcaatgaaataaaagaggatacaaacaaatggaagaacattccatgttcatgggtaggaagaatcaatatcgtgaaaatggccatactgcccaaggtaatttacagattcaatgccatccccatcaagctaccaatgactttcttcacagaattggaaaaaacgactttaaagttcgtatggaaccaaaaaagagcccgcatcgccaagtcagtcctaagctaaaagaacaaagctggaggcatcacgctacctgatttcaaacttgctgcatttttttaagaagcctcgatctctaatctccccaatatccttctttctgttgctggtaatcaataaatctaatatttatttaaacatatattgatatgcatttttaaacacacacacacacaagttgaaaatttgtatatataaatagtactaaaaataacgaaaagtcatacatccaaatactaacagtagttagagtgattcaattttatggttggtttttattattattatttattatttttctgagacagagtctcgctctgtcacccaggctgaagtgcagtggtgtgatctcagctcactgcaacttccacctcccgggttcaagtgattctcctgtcgcagccttccaagtacctggcattacaggcactcaccaccacgcccagctaatttttgcattttttgtagagatggggttttaaactcctggcctcaagcgatcctcccacctcctaaagtgctgcatgagccactatggctggcctgtattttcttattttttctagtatattacttttaaatttagttaaggaaaacacaaatttaatcagatttgaaaaatagactttgtttttttccagttgttgaaacattatccttcagtcttcaagttaaactttttcagagggtataaaacaaagtaaatacgtaaatgtgatttgcctaataatggcatgcctgagtttattcttacattatgtttggtcatttcattggagtaaggagccaaaagtaaaataaaattataaaattgtattagaaaaacaaaatagtgaatcggaaagaaatgggaagggaattagctgggcgtggtggcgcgtgcctgtagtcccagctactcaggaggctgaggcaggagaatcgcttgaacacgggaggcagagcttgcattgagccaagatggcaccactgcactccagcctggcgacagagcaagactccgtttcaaaaaaaaaaaaaaaaaaaaaaaaaaaaaaaaaaaaaacagaaaggggaagggaaatacactggaatgcaatctatgtatgtatttatttatatttcttccaatttggtttggtgataaatataaggagttcaatttttatattcagcagatcctgggatctgtactgttcttaaatagagatggacaataaactgtgagtgatggtgaataaaggaccactgagctagatccaaacaccatgctttagcaggaagttgttgtgaggggagctgaagctgcactggatttagagaaaattatctttgtacaacaaagtgtttttgtctatttttcttgttaaatttgagctgaatatattttaaaggttgcctaaaatatttaccagtaaaaatatctaaattattttgcatcgtcggaatcatactgggggataggagtagtggtagtggggttaacagaaataataagggtacgtaatgtacatattggtatacataagtataatacacacacaaaaaagttgaagtgtaatgggctgatgaatcactgagtcttgcgtttattcataatttctcttactagctatataacttgtgcaagttacttttttttctaagtcttctgttcctgatgttaaaataagcaaaataactatgttactctttgatttgggataagtagtacatgagataatccatgaagaaaatgtatgccagttcatgacaaaaagtaggagtacaataaattttagttagtattatttttacatatttctgttattagaatatatacgctagaacatggacctagcgatagaacggcccttagaaagcatttgtttcatttcctttgcaccattaaagatgaagttgttagcactggagatagcaagtagttacttaaggttcacatatttttagtggtaaaactaaaaatagaatctgactttcctgaatcttaccttgtatttttctctatctggtatctcttggcttctcagatttctgtacaaatgcataacccatacacacatgccataaggacattcatgtaccttaggttaaatactagcataaatatttacactgcatttgtaaaatcttaagaaatatctgttggatttttcttcttagaattgttagttccttaaatatgttggaaagtacacataagtactcatgttaaaaacatttttttttatctttgctaggacaaggaagtaggataaatatttaatatgtctatgaacaactatacatgtttaatattgggaaaaattgcttattttttctgctgaaatagctaaaggaggatatttttggatgtatatatacatatttatacactcatctatattttaaatcatgagtgaaaactaagaagaatattgagaatttatgcttaaattttttcttttacaaggcttttcaagtctgcttctttggaaccaacacacttatggttgtctttttagattaattatgaagggcaatgattcaaaacacaaaaaactcaaagtctactgaaggagagcattttttttttttttttttttttttgtcatggacaccaagaaggaaaactctagtatggtgctgtgtagtaacactgtaggatttttccatttcatctttcctaagtgaaaagtgggattaaatccatgataatattgatagctattaaccaaagctattaattcaagtgggctttaagaaataaataagaaggaagaaagagagtgtgggagggaagaaaaaagaaatatttgggaacaaaaaagagagactagatgtcagtattaattataaaactagtatcgttgttaaaacctgatattctgattatgaagaaaactgtcctttaagtaacataccagttaaaaactaatcaactatctaaaaaagttgttttttttttttttcttttccccccagatcattgcttcattggctttaccttggacaggattcatcagtgttgtgcttcatacaccaggtggtggcccacacagtccacatgatgtggaagaaaagggaatgtctttttacgtattttatttgatcttcagtggatttttttttgcatgtttcatactgaacataattagaacagtagtacttgtgatattctataagtaaaataatgtatcagggtactcatgtaaaactttctatacggttgtatatataagttgtttagagatcactagtctacactgtaaggcaggagttagcaaactatggcccttggaccaattcaacatctaacacttgtgttcataaataaggttttattggaacacagctatgtttgaatattttccataaaggattttgggctataatgtcagagttaagttgttacaacagaaaccttatggcttctagaccttcaaatatttattccctaggcatttacagaaaaagtctgctactcactgttctaaagagacaagaattcaggtcaaagttgtttgtagacaaggcggaaatcataatatcgcttagggacttggttccgggctttataaatagttgttacaccttgaaattttctcagctaacaaaaaaaggtgcaaatgtatcacatttttttttagccataaatgctaagcacactttctgtctgtttctcaaattaggccttttctttattgctaaaggttaatgaccttggccaagttacttatatactctaaaccttagtttacctatataagaaaattaaaataaataatatcttataaggttttataagaattataatacctgcatgtgtcccaaatttgcaaaatgagccctcagtaaatgataaatgcctctccacccacacattttgacaggatatatctcatgtaggtttgactttaataaaagtaacagcaatagatgaatatttctcgatctttgaaaacacatatattaaactttgtttatataaattgtatatctagaaaatcaacataagcaaaaatatgtataaaaacaagatataaattgctgattaaataatattaaaatgaaaaccgaaatttaaatagaggtacaggaaaactgtggctgatcttcaatggttgttaactgattgatggaatttagctaggattttagccagttatcttatcgaatagaccatgacaacatggctcagtttgtgggcttaagattcattggggaagagcttcactacatttaatggttttaattagaaacatatacctatgtatatgtcttcaaatacaggtgttctagtgctgtagttccagtgccataggcttcatttcaaccatgttctttgggtactttaatgactttggattttgttaataaaatcctatattcttaatgaaagtagcaattgatttttttcattgtttactgccttaattttattgttttttgtctagctttcactttcttgaattaaaattttaattgacaaagactgaatatattcaagtttaatgtgatttttatacacacactttctgtaataattatcacaaacacatccatcatcacccatgctgtacattagatcataatgccactagacatcatgctaagtgaaataagccagaaacagaaagactaatactacatgatctaatttatataggaaactttaaaaagtcaaactcaaagaaacagagtaggatgatggctgcccgggctgaggtgtggggtaaatgagatcttgatcaaagggaacaattgatttttatctttataatcctaatatctgcctgggtgcctagaaaatattaaattccaagtaaatatttatagcataaacaaaaaataaaaggaattgatatgacatattaattagaaaaataggggagaaaggacaaaatagtccctcataactacgacaaattacaccaattaacagttattagctttatttattatttatcttttagtgatcagtattatattgtataaataaatctcattaactagaatttgtttaggacacaagttcctagcagaaaaatccaggagttttagaatacttaaaacttgttattgaggtgagcatctggaatgttcaaaatttaaaaagtgtcagaatttgtggcattttattttataaactgaaaaacaaataaataaaagaaattcccaggcttgttagcacagaaaacttgtaacacagacattgtgttataacttggacggtctattttaagtctatatgcaagttaccaactttaaatatgttttttaataaaccactgaaatactgtatgtatatatatactgctatatatatatagctatatatagagcaatatatatatatatattgctctatatatatagctatatatatactgctatatatattgctctatatatagagcaatatatatatatattgctctatatatagagcaatatatatatatatattgctctatatatatagctatatatatactgctatatatatatatatatagcaatagtgatcttaacaattctatttagaaacctatttcagtattttcaaagagaaaagagagaaagggatatattacaaagtcaaaaatgcttatctgacataacttgaatgatcttgtccacaaaagactttggcagtgtccataaggcacacatttgaaggcaaggaccaccagggcatagattagacctagtgatctacagaggacaccccttaagtgaattatagaagctcatgagcatatacgtgtgtgtgtttgagggtgaggtggggggcatcaattcatgttaaatttgagctgttttcaatacctaaggacttctgatatggctagagactccaaatcatagggtccttcagttagtggtgatattcaaaatcatgtcctattctctaagatatgttggattgaggcaggtctaaacaataaacttgaggtagaaagaatctacccatactcgaaaaaagtcctcagcaagaggacgtgaaatcaatcatatgagagaaaatctaaaatgctaagcacagacaagacaaagtaaatcataatgttaattttatggactcagtatgcaaacctggcaatagctagcagaaggctgcaattaaatagctaactggttgtcagttatggagctattcccagctccatgtccagaggaagttaatgacatacacctggagcagagaaggagcagagtaactcaaagaaaaagcaacagtttgatgctcttcattaccaacaactgggaggaactaaggcgggcaggatattaatctacttttgtcttgagaaagagtaattcctagtgttatacaaattatgtagctaggcatggaaagtaactttctatttttaatattagctatttatcagttatctaaacgttaaataggtaatatgcttcctccctccccaagcaagatattttatttctccatttaacattgtattgttcttacccaaatcacccctagattgtagatctttacacctgtgcataaagcactgcagcaagggatatttcacaaactcagtaccctacagcattcccaatcaaaattacttgtcatctccaatgctatgctcagttttcacaaaatttatccaaagtctaggtaagaaatcagacttgtgacaagtaagcaactttcatatgaagatacatagctacactctcgagactttatctttagagaaattaagcccttaaaactactataaataattgtttctaaatatgtaaatcaagttattataaaataaattcttttcaggtaacttagctcatgagagtgaaattctttcaacatatagcaatcatgggtatcaaaacatggtgtacataaagagttaccagacgagtttgcagctaggtggactatgtcaaggagttctggttttgtattgtgaagacagagcatggaaacttatttttaagaaagctacccagcttgttattctgccaaacaccaactaaaccaaatgaaagaaaaatgaaactgaaaggtattagtgctgacactgcttggacagcataaatgaaacattgagagctggaggaaggaggatttccttttgattgactaaaaactgccaaaatcaactttgaaggaagttatgtttaagcccacaggagaattaaagagagtaggggattatgataaaggttttatcttgaacagaactggagtgactgtactgtgatgtgtaaaactagcagggagaatatcatgccataaaatatatatttttttgagtatgccagaaaaaaataaagcatccagacattcaagtaattaggtttttcttctgaatagttttagttttaaaatattaaattgccaagtaaaatttttctttaacttaaatactcttaagtagaacgaataactaaatgtagttctaaatgtcctttcagagtggttaaaattaagccctgtttttctttgtccctgtacatgattaaaaataaacaaccaaatcacatttggctctataccccaaaagtgattactttgttattttcacttcaatgggacacatactatcatccataagaaattactgatgtgttctatggtattttgaaaataaatacaatgtatttttactcatgagtaccatctgcaggatttcaagcatgtcaaatattttgatacttcaggaaattttatacaattgatgctatatttttccgagaaatgacttaaatgactgattatgaaatatctacccagtttaatttgcactaacttttgaaaataacgtccctgttctctggacctaatatgcacagtcaccccactttttcaccaatgccccctaggtttgtcatattcttgccactttacaggaaaacaaaacaaaccttactagttagctaagtactctcaacccattattccattccttctgtttctgtggtagctttccaggcagggccaagtcttcttgtcatgctgttgctcttgaccaggaaacctaattatcccagacttaccagaactatctggtgcctgtgaagttatttcggagcattaaaagaggagctggtagggctgtcggtggagctgagccctcaggctgggaaatgaaagtgctttgcctttccactgatccagctgagatacctgcctgtaggtgatgtacatcacactttttaaaaaaggcagatccacgtgatgaagctacatcctgctagaacagcccccagcaagaagtgccagaaaacgaaaatcacacaaaggcagtggcagtccatgtgattcacaagcagcattgaagacttttctcataagaaaagacttgtgaataagtcagatgagctgagatgccaaattgagagcactggaaagggggaaatctttaaaagggcctctaaacagctgtaacacgcttcagagttttctattttctgtctgatctttatactgacctcatgaattaacccatagattttacattgtaattttcagaggcactagctgtaaagccacagattccccagtactgcttctgttatgttcatttatatcaacacatgtccccttaatgctatatcttagcttgggggttgtaaataaagaaacatggccactagaccatatgcttcctgagggccagaaatgcatttcaaaagtagaatcaaaatcacgtaaaatgatggtaaatgcttagatgtgtatagaaaagaacaaatagggataatgacatttatccattaataagcatttacatggcttatttcgtttaattctcataactcaaaaggaaagtgatgagaagactgagactttaagaattgaagaccttgtccaatatgacagcctttaagtggtagatccaagcttgaaactcaagctttctaccccagaaagctgtgccttcaatctatattttctatgtattcagtaacacatgttaaagagatttagaagaaaatatatcacacaaaatagataaatatcaaatatatccttacatcttcatcattttaatacaaaaacaattttcaaaagtgtgctcatgtagacagaacccattacagcctcatttccctttcttgtaagaaaaaaactaatagctatttgatcttcaagatgcctaagtattaaatgtaaatcaattgcctcaataacatactttaaatttctttaaaaatcaattaataaaaaatgagcactttggtaatttctaattaataacatatttattgaataatccaacatacttcctaaacagacacagagaaatgtctgagcacgtccagttacccgaaaaacagggtgtgtctatgtatttggatggtcacttaaatacatagacacaccctgttttaccctatgtttttaaatacatagacacagggtggtcacttaaaaaataaagttgttgatttactttccgttcaaagttgcagtaaaggaaacagttattggggaaattggttccctgggctactcacaatgaattccagcagatcccaaaggatcacgctgtagagagagaatgtacaagctgtataaggagagctttaggaaggaaacacatgtctgaatttattctagaagacaggtagtaaaagaaaaataaagcaattaacccaggcatcaaataaaaaaaaattgagaagattctgattatcaatgctctctttcagtttttacacaaaagctactgattaactttacctgtgctagtttggctaaatgagaacagaaagtcaagatattactatattcttaaatttatatatagaagtctgatggtgatgctattgtccattccaagttttgaaaagaatgatgatgagccaggaaaaggaaagaatttccaggattaacataatgaactgttgtgaatcattctagatttcaagtagaagcacatttatgtaaggtgtgattgctaagctcttgactggcattttaatatcttagttcatgatcttcagatgtcagtccccactgaatcagtgctaaggaaatactagctgtgtgctaatttgagtggacttttgcatccagctgatgccccactccaaaccagaaagcctctaagaatcaaatcaaaatcttcaaatgcttttcctgaacacaggaaaacattgaaactgtagtagttaggtacactttagggattaacatagtaaaagtcaaggaagagcatggtcctacagcggaataagatctgttaactcagctcctagttcagagcagtcatcaagataatgtgaaaataaatgcatagagagatggcattgataaacaccagagccggatcatgcttgcgtagtgaactcacgaacagagtagttacccagatattccaaatcaacaaacaccagcccgtcacaccccagatccaccacccaaatcacttagatttaactttagaccaaaaagttaccactgaaaggtatttatttcttcaaggatgtaaaaagctgaattttagcctttctttttgaatactgaaacgctaatctttcctgtgatgctttgtgggtttcagacgcattctaaacttgaggcttgggagatcagaagtcatgctggagacaggaaagaattctggctcatcatatagtaaagaagtggagttaacatgtaaatgtttgttcttgttattattagtagtattgctattgtcctggttttctacttagttaactgattggatagatgactgaaacaccacatatacatgagcttaagcaacattttctggagtcatgtgatgaatttcagataattcataactaaaacaaaaattaaatggaaggggaagagaatatttaatatttcatttttatatttttaaatagacaaattaaaattgtatatatagtgtaaatgatgatgtaaaatatatagaatactatggaatgatgaaatcaagctaagtaaattatgtattgtatcacatatttgttttttattgtgagaacacttaaaatctactctctaagcaattttcaagtataaaacacattgttattaactgtagtcactatgttgtcctacatatttttgaatttataccttctaaccaaaatattatatcctttgaccaactctgctaacctcctccacctaccaccaccactctccactgataatcaccattttactctctgcttctatgaatttgaccttttcttgactaaggagagatttaatcttaagcaaaaggctttggaaaatgttaaacaaagctacaatgattatctttggaaccagaaagaccttagttgccacctgctagctatgtgattttagacaaaattatttaacctaacttcagattctttatctgcaaattggggatcacaatacctaaaagttataagcttatttaaggatgaaatgaaattgtgaagttaaagtacagtgcttagcatacaataaactttctatgttgttctatattcttctctactattttaatagaaataatataagcaaaagtagaattagtattacaggcattatcaaaagtgtctctgagtgaaacttgtctcctgagggttaatgcagtatcgtattgctgactgcgagattcaaagtttaaggtgaactgctctcgtcaggccagccttggcatggcagcttctacacagaaataactgttatatctgttccattgagtcaatggaggatcaattatatcttctagaatgtacattataaagatttaaatattgcctctttttgttttggttcaagtgaagttacaacaagtactgcagggcctaaagattcacattcttcaagcaactatctgcatgataatattgaattacattatttacaaaaggtgtaaatataaagttagtgcaggtacttttgtaggatgtatctataatatgtattcatttataatttcactgggttagctgggcgttgtggtgcacacctatagtccccattatgtgggaagctgaggcagaaggatcacttgaacgcaggaggtaaaggctacagttagccatgtttgcaccactgcattccaacctggacaacacagcgagaccctgtctcaattaaaaacaacaacaactaagtataatttcactgggcacatatgtgtttgttgcttcttacaaatcattgtcataataagaaccatgatcccttactgttaacattgacaacatcattgtcataaaagaaatcacaaagtctatgagctatttatattcactgaaaatgttaacagacttgcaaattaagttctgtgaagtccccgatttcagatttaacatggaaatttctcttcctgaagtacagaatatagtatataactcttctcatctgcagagcattgaacagagaccagacatataaaacaagggaagatcgatgcattaaaatgttctcggaaagagataagaaaaattatatggccaactgaatctaattaaaaaaaaaatttgtttttgaaatgaaatatggaatgaaaaggatttttgcaaaaataaaatttacagaagaaagtagaagaatcttccttagggaagagatgatgagagcagttgatctaaaatcagaattttgaataaaaaattctgtaggccaagacattgaaaaacaatttttttgttagctattattcccatcaatacgaaagctacccagacataaaagaatgtggaactaggataaatgctagtagcagacaaaaactattagatatggagattaagaaaaaaaagaataaaagtcatttttcctattttaacatatatttaatgaaaataattaaaaggtaaagtgagaaacctgctatagtgtctagagttatatagaaatatgctcaggttaattatataaaaactagatataattatcactccctcatatagatttgataattttcatataatcctttatattgtctttataaataagataaagattattccttttttcttttaaacttttaaagtaacaattaccaaattttattcaacatttattgtgtatcagacatgatgctagcagaggcaagatttcatttattctaaattatactatgagatagatacaattgtttttctattcttcaaataatattacaaaactccagggaagtttagtggtttctctaatcacataagatatgcataaatctacacaatagcagatcaagtaggggctcttgatctgtgcactatacctgagtgaatcagctggatatctaatggtgttccacaaacaaggttttggttcccagcagtgagcacactaaataggatcacccttatagcatcatgtacaacacttcacatggtctaattctatgctctccatagaggtaccatacattatttaagtcacatattatttaaatgtaccctatgacatagaagacctctagtctcggcagaaggagtgctaaatattttctgtaaaggggcagatagtaaatatcttagccttttcaggacaaacaggctttattgcaagtactcaactctatggttataagcagcataggagctatagacaacatggaaacaactgaacatgggtgtgttacagtatagttttatttatagatactaaaattcaagtttcatataattcttatgtcataaaacattcttcttggttttttctcagccatttacaaatgtagaacaacattcttgtttcaggaccatatgaaaacaggcaatggacctgatttgactcacagacaatatatagtttgctaatgcctagctctacagtgattcggttcttagtggtagtggcttatgcaactgtgtattattgtgtattaatatttttaagggttttttttgttgttttttggtttttttttagatggagtgtcactctgttgccaggctggagtgcggtggtactatctcaggtcgctgcaacctctccctcccaggttcaagcaattctcctgcctcagcctcctgagtagttgggactacaggtgcacagcactacacccagctaatgtttgtatttttagtagagacggggtttcaccatgttggccaggatggtctcaatggtctcaatttcttgacctcatgatccgcccgcctcagcctcccaaagtgctgagattataggcgtgagccaccacgccagcccagttatttttaaaatgaataacacataattgtacatatttaatggggcacaatgtgatgtttccatctgtgtatacactgtgtaataatcaaatcaaggtatttagcagattcatcaccttaaacatttatcatttctttgtgatgagaacattcaaaaacctctcttctagctagttaaaaatatacattatcattaactctattcatcacaccatgcaacagaacatcaccacttactcctcctatctaattgtagtcttgtaaccattgacagatctcataaaatcctctattactctaacctgctatttacattaaatgttaagctttaatttactattttgtgcaatctttttaaggtactatgcagctttgagatgatacaattaattatacctatatggcacaagttaagcaacccatggtcatatagggaacaagacagagcttatctttaaaactaacttgtatttgccataattagaatttaatcataggtcctggaatcaaggaaaaaagcattgggaatttcttctgcatttgacagagtgagggttgggaaatatttatcctatgaatcatataaagtttgtcaaggagtaacttacaagattcccaagaatcttttctcagaaaaaaaagatatctaatttttttctcagaaaaaaaaagatatctaatcttttctcagaagatttctactggtatatataaatttaactaccacagataaatttattatcattttttgtacttctcttattctttcaagaaatgatgcccaccatatttttacttgtttttgattacttatctaaattgttatttgaattataatccagttttttttaaatccctttcaacttcatcttttcagcaaagccagtacccccagaaaaccagcaaaaacaaaaacagaatatctgaccttttgctaattttgacagtgtttctgggtgtaattgtaccttttgctataactatggataatactcaaaaacttccaggagacaccagtagcactaactttagtttattcccacaactggaccaacaaattgaggaatttgggatacttttatactaagctttaaaattaatggaagaaacatgatacattattttgtcaaatggccataaaatgaagcaaaatcaacaaatcctataacaacaacatattttcaagctttccccatagccgatggtggctttgcagacatctaagtgattcaacattggagttgtcctgatcaacctactgtcatcattcagtgttggctttaagtccaagtcaaggtagcctttcttcttttacaagagcaaagggtatataatgttttactttttaacttacagcagctaaaatgaaacattacaggaaggaaatttaaaaaaggaaaagccaaaggatctatgactttcatttatacaaagctttgaagtattcaatatatggtaacaaacttctccccagctgaacttcacaggaacgctgagtaaaacaaaggggaggagctccttctaaaatagcagaggctctctctactttgccacatcatagctgatcataagaaacaaaaaggagaggctagaattgaataaagagaatactacttgaagtactaggaaattaaaacctactttaaaagtaaagcaggatattttcctgatccttttcgtgggaattgtgagggtgcctcatttcctcaacctgccgctctcaacaatttgacggagggagcgcacaagtaaacaaagcgggaactggagtgcagaagcactggaaccagccagccgcttccgcacctgcaggagtgaactccacccctccaggaggcaacacgcaggagagtgggtgcaggagccagggcgaacacttttgggagctgggaggagcaaactttgtgcgggccccatggcaagtccaggagggatgccttcaactcctgaagccccagagggcatgttagggctttttagctctgcagtccatggacggctttaagcgctagcagctcagtgggtcatctgccttttcatgtgaggcagctgctctctaccggtgagggtaaaggggccagtgtgacagcatcctgtatcctcacttgtggctccagaactcttgtccagcatccaggaaaaatgagatcgcaagaatgagtggaagaatggtaaatgcaggggattttattgctgatgaaagtggccctcagtgggaaggggagctgagaaagggataaggtgggtaggtaatcttcacctgaagtccggccatctgcggcaggattattctctgaagttgcaccgtcaagctgtccctctgaagtcaagccgcttctgacatccagctgtagtccctgacatccagccactcttcctctctgccagatgagcttagggtctttataggcacaggatggtgcagggctgggccatgggtggtttacgaaaaggcaacatttgagtggggaaacgggatagaagttctcactttgagccacggtctcagggtttttggcttgagggtagggcttcaccagggacccatccttttctgcctagaatttctcttcctcctgtctctatcaaaagtacagtaacaaaaagaaatgcatccagtgtatgaagcaaagtaatggaatcttcattcctcaagattaacaagaatggcaagaggagtaaagccaaaagacaggatctcaaggtatgaaatgggatgagtgacaattcccagcaatcagagaggaaatgaattgttaaaaaaaaagaagaaaatttaccaaaaaaaaaaaattattgtgaaaacctttggtgggaatttgttatagaatctgttaaagctgtcccaattttctgatggaccctgcagcagcgggatacttttctcagctgaacttaactctctgtattcccccttctttcttgaatggatgcccccatggaaaatggtgttgcttgatgggactggaagacctctattgataagtgagctgagaaggagaaaggaatgtacaaggataaaatgtaaaatagaaatttagaaaaataagctagaataaaatgtgaattaggtcacttaaaaatgggaaatgaaagcagtggttattcttaatggaccaatgtattatttttcctctttttgacctctcaagatcagctgtgagccttggaagtaggcactttggttacagccctcaaagccatagctttgtgcgggccccggggcagcataaagacattaatcctcaactttgtggaaactgtacttagtttcaatccatttgcctagttgttactatgattgtttatgtcacaatttcaaatgctttgccctcaatgtctggcattcgaaatggaatgaaggccattttcatgtttttgtctttcccctaatggtagctttctcaagttctcaaaattctctgagttcttgttaccagggtgtgaagcatcattctgctacttccaatttgacttggcatatattagggaggatggagaagagaacaacaattcattggaatggagccctgagtaagttaaatgcttcctgaataaatgtgcagtatctctttcccaggcctaggtaattgcttttttatttatctcaaaccattttcatcctctcctatagcctaatagagtcactctctgcacacggtgcatttctatcacagaagctcacaggatgctggctctgctgataataaataaataaataaaatcatggagtccatattacagctagtggaagctgaagttttacatttatatattaaattaaaatgctttctgcccatattatacaaaatgtaaatggtagttaagtcaggcagcagacagaagttggctactttttgagcagagatgtcttaaatgtctgtttcagggcaaacactcctcacggaccacacagatatttattaagaagctaatatggctgtgctcattctaatcacatttagtatttgtcttctgaaagagtataagtctggttgaagaaagagaacattaatatcttttaaatgagcatagttgattaatactctacttttttcataaagtaaatgaaaaaaattcaaatggaaagaaataattttaagtgagtgaaaagtgaagatatgaagaatgcattatcatgctataatgaaccattatctatgtcaaaagattcactccttaacaccaatcagaacttgatactcttttcctttaaccagacattcaggaactgtgctatatagtctgtgcaattgttttagtgaatagagagccacaggccctgaattataaaaatacattttagtaatgataaatctttttcatcattaaaatacggattatttcatgatgctctggaagccctataactaaaagacaattgctagtagcagacaaatgtggacaataaatatgatggcaccaaatatttttgctttgtatttagccagcataatggaaacatatctgattttagagacacaaacacctttccagaaaatagtgcctgtgacttcaaacctgcttcaaccttctctgctctcaaatttggtgcataatgactgttctagttaaacaaatatttgggatagcatttaatctatcgatgaagaatgacaaacacctggcaaatgtgccaacattctcacattctactctcagaagagacacaactaattcattatggcaccttttccaccaagccaataattgcacgcagatgactcagaacatgaagcagcagttagccattggtccgtgtctcagtttcttaattattagtataggtaaacaaacttctggcttacagggttgtatataaaattaagaatgatataatgaaaaatgtattctaaaaatctagttagtataatcttattttacagatagagaaaataaagccaaaacaggtaagtgatttacccaaatcaacagttacttttagacccaaatcaacagttatttgtagttcagaaaaggtccctggggaaaaaattaatccaacccatccatttcacagatatggaaactggaactcagagcagaaaactttgcccaagaacaggcatcacctctcatactgatacggtttggctctgtgcccccacccaaatctcatctcgaataggaatccccacctgtctagggagggacctattgggaggtgattggatgatgagggcagttttcctcatgctgttctcgtgacagtgagttctcaaaaaagggctgatgattttaaagtgcagcactcccccatgctcacacgcacactctctctcttctactgccttgtgaagaaggtacctgcttcccctttgccttctgccgtgattgtaagtttcctgatgcttccccagccatgtagaactagaagttaatgaaacttcttttgcttataaattacccagtctcaggtaagtatctttatagtagtgtgaaaacagactaatacccataccaatcacaatcaattgcaacagcttcctggactattggtgttgaggaagattctaaagttgagtctgagcctaatggaaaataatgccttggtcaaccaataatttgtcttagctttgtttgtgggtaaggacgggcagaagaaaacatgctatatgttatgcattatttaacatccttatcctgagccaaattgcaccaaaataagtttataataatgatttagattcccacataactccccccaccttcaaggagagaatgctcttgtcatatttgtataaatattctagctcataggaaagtaatatttgtcaatagctataaataagctggtattctgatttaatacaacaattctgtgaacttagttaatgctcctgagatctagtctcatactgctgacaaatttaaatttctgagtcttcaagtttcaaggtcagactctggaatacggtatccttaccaaagtaatttgttttgggggaagccagctgactttctccttataacatggctctgtttcttcttgtgccatgtaccgttttcttcaaactttctaccagtatatttgtacctatttatagtcaacagtatagaaaaattgcaacttagaaaacagaatatttcacattttaaaaagtgtttatcacaagatctctaacaacaacaacaaactcctctggtacaattcaaataatatttgattctcctgcattatttaaaaataactgtttagtaacatatatgcacacaatgaataaagtaaaattcacatggccatgaacaatatctactataaaacaaaagccaaataattggtaaggtaaaactatttcttattctagagtcagatggtacatggtatttcacaagatctgcttttgaagagtgccaattattttttactgtggagtcactaaagacaacacaaatgatggaaaagaattacaaattcagctacaaaaatcatcattgttaacaacttgtatgtgaaaacttaactaaaggacaattgaactatgtttggaggaattctgtttctttcttgaagaaatgtttggttgtctgcatataaagtaggtacatttgccttatgtgggtaaggagaaacaaaacatcacttttcatggtttcttgtttattgttcacatgtgtttacaagaagataaagatattgagcaatattttactgatctttctggatagttgttgttgcccattcgttctctgctggtactacatttgattgccttatgcctagcttgcaagaataccagtctctgatgatgacaaatacatttcacactctgaaggaaaacaggcaaaagctagattgaatggtgaagcagaatatgtcaatgtcacttagactatcccattttataaatatatacatgaagctttcctaggaccactaaacaattgtagttcattactgatccacaccacaggggtcttgtgtctagtggtatcccttggtcaaagatttctttgtggcttttatcaccaaagcacaaaacagagatgttggttttgttgttttctttaactagcatcacaaaattgctatactcagcatgtgaatctgaaaactggcaactcttaagaaaaatgcagttttgggaaaaagctaaaattgtgtattggattattaaaaaataacagaactgttggaaaaatagacattatagttggaagctttttgaattaggcaattattttttaaaaaagagaaatcattatttctttcaacagtaaaatgaatcccagttggcttttgctattctacactagcatctataataaattattgttacttcctaaccacattttgaccacatttctatcacatgagtgtattgggagaagtaaatattctattaccccactgagatacagttactgcagtgagactcacatggtatgaaagtaattaagattgaaatagttattttattttatttttttgttttttgctttttgtttttgagacagagtcttgctctgtctcccaggctggagtgcattggcgccatctcggctcactgcaacctccgcctcccaggttcaagcgattctcctgcctcagcctcccgagtagctgggactacaggcatgcaccaccatgcccaggctaatttttgtatttttagtagagatggggtttcaccatgatggccaggatggtctcaatctcatgacctcgtgatccgcccacctcggcctctcaaagtgctggattactggcgtgagccaccgcacatggccgaaatagttattttttatcaaaactcatggaaagaatatttagatgttaactattgatatacagtataatattttgtttgtagtgatatgattcatatctttgcagaaaaatcagaaatatattgagcttatatatagaagcactagtttaaaaaagtaaataaattcataaaattattttcaaaagactaagttggtaatgacaagaaaaacaagtcagaattttcacaaataattacatctatgtttatatgtagaggtatgtttattactctccccctgcatcatatttaccttacctgttttgattataatagcagcatatgctctggttaaagaatttgccatgtgaaactcaaaaatatttggttatttccattttttattatgagtaacaatgtgatggccatcactgtctgcatatatgttaaagaaattcactgattcttaagaatagatttgaaaagataagattatgtgctaaatgctacatacatttgtaaactctccctatatattacaagatggtttgcttcaaaagcttttttctcaccaacttattcccacaagcagtattaaagacacctcttgccaaacttgtttgtattgagtgccatcattggaaaaaaaaaaaaagtgtttaccattttgaaaagcaaagacacatttagacaaaacaaattgctataaatccatttaaaagttatattgcattctgcaaaaagaaaggaaacacaaattaggttaatgaaagatctgccccatctatgcagacacaggaactaactgctgtaactaactgccgtatatccaaacctgcctggtaagtgtcagtagttcttcaagatatgaagtgaaaacaaaacaaaacaaaaagccatcttccttgggcttagggagaggtttctcaaagctttttcccatattttctcatccctgttttaattttctgacatggcaaaggcttcagaaactgcgagaatcaaaaacacctgcatctgattgaaagtgagataagaaatactactcagaggagaaatgatttgtatgtagaaatacttgttgtggtgtgttgagctgagctccccaagttctgcctgtctctgaagaaagtttactgcacatgctattggtggggggcgggggggggagtagtccctcaaacaccaaccctaacacttaaccaaagtatgtattggatttttaagaaaagtatctacaattttctaagatgcttctatttaagtctttctgtatacattctatttcaggttttcttgtgccttttctgttatgttttagtagaaaaaacacaacaaaatatttggggcattgaaattcaccttatttcataaaatagtttgtaaactttttcaaccattatttcttcaataatataggagacttaagaacaaatgacaataggaaaaaaagcactttgtagctcttttttgagattttttaaattttactcattcaacaaaaatatttgagtgcctgaagtatttgagtctagaaaatgctgaattaggaaatatgaagataaatttgacaaatctcttcacttgaaaagctgacaacagtccacagaaaagatgagagagaagtccactgcaaattctaaagcagattaaaggttcacggactaagacaaagacagaatggaagtggtgcaggggagttggattaataactatttgagatacattctaaaaaatttgataattgataaaggaaagagtcaagaatgaatctaagttttctagctcgacacccgacagtcatatttttaaatgtaaaatcaagaatgtaagagtgagcatgtttgggggcaaggagggtatagtgaacgttgaatgtgtctgatcagtttccacctcatctttctcccattgtgtagcaactaaacaatttgggggaattgatctcatgtccagagacaaacttgattaatctaagctaatcaagattatgacatcctccttgccaaagtaatggcttcagaggaggcaaacttgagcccattgagcaaggcattcttttccttttccccagagatttattaagaatggacatgtgaccctcttacgtcactgaaatatttgtgagagggctattggagatgaaaagagacataagacagaattgtcctagctactataaacaaacttcagaaagacactctcttttgtctgtgaacaaggtagcaagaattgctattccagcagccaacctacatgcaggacggaaaaaaaaaaaaaagcagtacaaagaaatggacccaaagatttgattgaactatacctgatccctgtccagtctctgaattttgcagttatgtgagttattttgagttggttgatttctcatttattacttgctagaaatatccaaaagattgttccatatgaggcctagtaagtttgaaaggtttggccgggcgcggtggctcatgcctataatcccagcactttaggaggccgaagtgggtggaacatttgaggtcaggagtttgagaccagcctggccaacatggtgaaaccccacctctactaaaaaatacaaaaattagctgggtgtggtggcgggtgcccgcagtcccagctacttgggaagctgaggcagaagaatcgcttgaacccgggaggcggaggttgcagtgagccgagatcgcgcctctgcactccagcctgggtaacagagtgagactcagtcttaagaaaaagaaaaagagaaagattaaaaaaaaaaaaagttttgtgggatatacagatatagctatgaagtaagaagttgggaatagaggtctagaactgaaggaaatacatggggtgtgtgacatagattccgtggtctgcaaagtatgatcagaaatacagaaaacactaatatacagtttctgtttcggattttgttgtttgtttttactttttgtttgtttgttttttgaggcacggtctcactctgttaccctgactggagtgcagtggcatgaacatggctcactgcagcctcgatctcttgggctcaagtgatcctcctgccttagcatcttatgtagctgggaccacaggcgcacaccaccaagcccagctaattttttaattttctgtagagacagggtgtcactttgttgcctaggcttgaactgctgggctcaagcaattctcccacctttgcctcccagagcactaggattgcagacatgaaccaccagccccaacccagcttctgtgcacttcgtagtaaagggtgcattattcacattaaaatttattacacattttatactttctagaagatttcatctttaaaaattatattttaggataaattataaaataatgatttttaatgtatttctgatattatggtgtatattatagattctattaaatagattatctctatattaaaacataaacaaaaatacctctatattcttatttgaagtgtgatgtattttattgtgttctaatttttcctctacaaattgcaaatctactgtttctaaaagatcatagacaatgatatttgtaaaagtttatgtatgcattgggatgaatgacaaaaacatattcctatttcagggctgtgtgtcacaagcaataaatctatttacatttgaaaatcaggttactgctattgtttaaacgtcccttccaaaagtcacgttgaaacttagttcccaatgtggcagtattgagaggcggaggctttaagaaatgattaaatactgagagctctgccatcatggatggattaatctattcccagattaatggattaatgcattatcatgggagagggactggtgactttataaggacagacagaagcctttgctaacatataagcgtgctcagcccctttgccatgtgacactctgtgtcacctagggacaccacagtgtccccacaagcaagaagattctcatcagtgtgccctctcaaccttaaatttcccagcctccataactgtaagaaattccttttctttataagtcacccagtttcagatattctgttataaacaacagaaaatggactaagacaataatgggagaaataagaaagttctctgtaattaccatcaagatcatcagttggttctctggtcaatactctgtaattttctgctaaaagaatagttcccttactaagaaatataagctatcttgggtatttattataacatgtgataacaaaagtaacattccattttagccgattaaagataatttagctcttttcaaagcaagtctcataacaccaatttcctcatgtcgtttttatctgtaagaatctgtaatggcttccaattgtccacagactgaagacagcgtccctcagtgtgttcctcccatctgaacaattcaaggaagagtcccagacactgctcccttctaatcttctttgttcccttctcatgccattctcgtacacttgccttcctctgtacatatgcacttataaacacggttatgtgcctctgaaacctacttctttttcatttaaaatttatctacatttaatatctagttaaggttatatccattttctaaaatatgtctaagttgatttttattccctagactgtttttaatgttagtaatttgtactacacactttagaatctgctatatatgtcatagccttaatcagttgtagttttgttaacattattttcatgaaagtgaattacatagaaaagtatttcataacacttattacagtgttatagctttaggaataatttgatagctttaaaaaatgttaagtaagcagccacaaattcccaagacatgtaatgtggtggccataaatatgtttttatacagtatgaccagaaatttttgtctcttaagcaaaggttctagataaagctcgtattcttagaattttagaggctcttttggtgccatttatatcaaaaagaaacaggtaataagattagttatatacataactatccgctcaaaaatttaaagaggggaataatagtgaaaataaaacaaagtgaaaagtagaaggagaatatgttttaaattttcttcttgaaattagcataagcttctattgagatttctgggttgatttcaacatttcttagataattgtgaatacgcccttgtggaaaacatcttttatattttatgactgtatttatatcaaaatatgttatatttataaaatatgttaagtctttaagtagcttctaagtttaatgcctaaacacaacttcagtaatgctactcaacataactggaaaatagtgtttcaaatgtatctagaacaacaaagttcctattaaaccgcaacagtttttgctttttggtggggtgtaagtacagcttatactaatttgttctttcatattttgtttgagtatagtcatgttatttcttttggctttatagtattcaaacttagtacttagactggaagttttctctatatagactcaaagtttacaaacaaaagggtttctttacaaaatcatagaggttcacctatgctactgttccaattaacggaaaaggagtcaatattattgtatatttttccctaaagcttaactggtaaggattaaggattagaacccaagtctcctgataagttgaattacttgtttattttcctgatcacatagttggcttactcaaagatacgattcattctgctttttaaatgggagttcttaggcagctatgaataatgaaatcattatacccagtctcaaattatcttcctatttaattataccatattctcaaattatgcctcttgttgggtgggattaaaaattcctttattgatttatgatacctatcttccaaacagattcaagatattctgcatgattaaatatggtacataataaacatattttcctcaacatattgcttctataaataatattaataaaggaagaatctcagaggaactgagattcaaaataatttcctcataaatgtgaccagttgctatttcaaaggagaataaaaaataaaaagctcttggctcacatgaaaaatgaagctaactgatacttcaagaaagatataatctccccaaatctaggtggagaaaagtatccggagtccctttaattctcaactcaaacctattgttttctcttaggtcaagaaattatggagttggcaggcaagtaggtttaagctcaaacattaaaaaggaacttcctcctccatggtataaaagcatggcaaccagtgaagaagattcaaaatgggacagaaactgaggagaccttggccccagggtaggggaggcaagtcttctgatccccagaaagaaatctggaaggagccaaacatgagtaagactgtttttctcactccacaaagagctgcacatgagctgaatagctagactaattcctttcccctcacaaggtcaggggagtataaagggacttggtaggaaaaacggccttctcctggaccaacctgattgatggtgtgcctacagcccacaggtgcagatagaccactatgcttttggcagtctataccgctgcttcaggattccaagcagctgagtcctagtgagtagaacaaaaatagttttagcactgtaaaatgttcattagcttgaaagagaaagatcaaagataatcatcaaaacaaacctctaatgtgagatatcgaagatgacagaaaagaacttgaagttataattaatataataataattacagcaataatacaagtagagtaaattaaatacagtccaaaatgcttttctggaataagaattttttaactaaaattttgctatatacactgaagaagaacacagttcctgtcataactctagttattggtgtgaaagagcaagtcaaagatcaaagtagaatttaaagacattgtagtcaagagagaaagataagagatttggaggtagattcaggaaatatagcttgagaataaaagctttctatgtgaataaaaagtagggatagaaaggtgacaatgagataaattattaaaaaaaaaaatccctgagcgggagaataccctaacgtgcagtgtaacagggtttggctagtttcaagcagggtattatgaggaaagatacacacctaggaatatcctaataatatacttaaactcctggaacaaagaaaaatgaaatcttaaaaactttcaaacagaaagcacaaatgacttataaacaataaagaatttggctgttattaaatctctcatctacaacaccagattctaaaagttgatagagaaacttctacaaactcctaagagaaaaagtctgaaatcaaaattcctttatgtaagaaagatatccttcaaccattgacaaggaaaaaaaagaatatttgcaaatatacaaggattcagggactatatcattcacctgaacaaatgcatctaattaagaggcataatttgagaatatggtataattaaaagcctgcatgcagcaaccaatacatcaactacttacataaaaccaaaactatgaaaaatgtatgaaattcaccattggaggtaaaatgaggacagatacttacttttttataaattgataaagggaatcaatcaagcattatcttgacttttctgaacaaaccaaataggctgcaaatattcatgtgatcaaatggctgacaaaggaaagtcttctttatggaagtcttgctaacaaatgcagaagaaatgttgcatttagaaaatcaccattttaaaaccactaataaaacaatgtggttagaccatgattattaatggattccaaaatcatcaggtgaaagttgttgggacactttattaagaatggattaggttgacaccagctgaattcacctatatcttctctgtggacactacctggactcacctatagcttctcttttattgtagaacgttccacatgctggatttgtcccacattcagattgtatctgacattgtatgtttcctgacgggatataatagcaagcatataatgccaccaatgaagtattctttgaaaaagtaaaagacaatacctaaatctaaccaaaaatctagatgtaatgatcaaacataaaacctgggtgaatgaggatggtttaaatgtcatcaagagcaagcctgcaggaaaatctagaatgtggaacattctataaattagtaacaaaaacagttttcaacaagtaaactgcattaaaaaaaatacagaggaaaagaaaggagacatgcaacatggagaactgtttggagactatgtgaacaaaccaactgtaaaaatacagcagagattgagacaagtgggaaaacaattagagaacagccactagatgacattaagcaatggttgctaattttgtaaagtttgtccatagcactgtagcatgtgtatatatgtatacaaacataaaatatttgttagcttacatcaatattatctgttagggtaggtcctattgaagtatctacaggtacttgatacatatatcttaacatgatatcttagatttgtttcaaaatattatacaacaaatggaaaaggtaatctctaagattggtaaaaaggtaaaatcattgaagatgggtggatgggttcatggagactacttatacaataatttctattttgaagtatgtttgaaaattcccgaataaaaagatttttaaaattcaaagaatcttgatataaaaacaattataatgatagatttcaatatatcattcttcttcaaaatctcaatggatacattagacaaagaagaaataaaataatgaagttaaatagggcagcctacaatctatatttactatagacaactttgttacttgcatatagattttcatatatccacagaaaatgtaaaataaataagttgcccataccctttaatatgctcataaagttgagattttacagcaaccttttttgattataatgtatttcatttgaaataaaaattacacttacaaaatattgttgagataattatagtaatttctataagaattacttattatttatattatttctatttcactgatgttaaatttcttggttttgataatgctattttggtcatgtatgagaatgactttgttcttaagacatgtcttctgaaagatttgaggatgaagtgtactgatgttcgcaatctaatattaaataatttagccaaaaaaatttatacacacactccaggggaaattgcagataaagggaaagagaaggtaggatagacacttagtgttgaaatatcttaacaattgttgagcctggatgaagggataagggatatatacgtgttataacaacatacattcaactttctgtacatgtgaagtttgtgtggcaaagagttggagagagaaataaaattaagacatattaatactaaactgttcaattaacaaattactactccataaaaattaagagatgtattcatttgatcccttgaatcagaaaggataaaaatatgaatttacattctctctagtctaaaacattttgtacagatactaatgggttcaacaaaaggtgttatatgaaaacttgaagcctacaaaaattagaaagaaaataaaataatttagtccttacattaagaaattacaatataaaatagaataaaccaattacaagtcaaacaagagagtaagtatggatacaattttagcttcatgaaatagcaaaaataacagtaagaccaaaagggtaggtaatgacaattgcacaagagaaatccattgacacaaaatccttctgagaagtttaatttcatgtagtcttgtatccttgatggagccttgtctattctccattttgaatattttctgatattttactgcaatatcctctctggtttagtatacgaaaggatgggtgaaaaccaagagagattggattcaggggagccgctgtatttctaactctagctcttcaaggaagctcaggggcagagtgtaagcaacctaacctccttgggccctaagattatcttctggaaaggggcctgggaggagaagtgcaggggcagagggtaagcaacctaacctccttgggccctaagattaccttctggaaaggggcctgggagaagaagtgcaggggcagagggtatgcaacctaacctctttggaccctaagattatcttccggaaaggggcctgggaggagaagctcatgggcagagggtaagcaacctaacctccttaggccctaagattatcttctggaaaggggcctggggggaggggttggcttgatcttttcctttaacaataggaatgcataagtctaactattctaaataaatcataataacaaaaactaaggtttattgcctattttacaattgccagacaaacaactaaacactctacatgtataacttcatttaatcctcaccacaaattcaagagtaagcattagtatcctcctgacttgacaatagtaccacagactattgtctgtggtggggtcatgatggctcccctctataattgttcacactataatcactcatcagtttcatcttgcacttatccatcaaagttggcaatcaccatgttcccataaacgaaaggtatcatttcctgtgtctaacttagcataatgattaaaagtgtaggctctgaaggcagccagcttgcaaattgaattccagccagaatatataggatccatgtcaccctgggcaagtgatttgccctcacagtccctcaatttcctccacaattaaatggagactcatggctgtaattccaatactttgggaggccgaggcaggagaattgcttgagcataggagtttgagacaagcctaagcaacatagtgagaccctgtctctacaaaagaaaattttaattagctgggcatgggggcacatatctgtagtcccagctactctggagtctgaggtgggaggattgcttgagccgaggatatcgaggctatagtgagtcactgtactccagcctgggcaacagagcaaggccctgtgtcaaaacaaccaccaccaccaccaccaataaaatggagataacacagctttacaaggagatagaattacatgagatagatacacttaaaggacatagcacagtgcctggtaccttgaatgtatacattaaatgctagatatcatcatgatggtacattacttagtgaagtaacttcaagtagtttttaaaaaagtaattgagtatgttcccaaatgaaaaaccttcaagagaagatggaggagaggcagaaactgaaagcagcaatattaatcagctaagtagaagacagcctatattcaatcatatccgcaagcagagggcctgattaatatttattaagtatgggcttgataaacattggccaaataactcaacaatcaatgtctaagcactttacaattgagaagagttagaagatcaatactattttgataatcctttttaaaataagaaataatctatataataggattaagatatgaaatgtggagtgtttaatgattattccatgaagtcagcacatttcactgaatctcctaccatagtgaaggaagatccgacgaagaaatattatcaaagaaagactcatcaccaatgtattgggaacattcagcactgtctacttaacatggaaagataaactgttctaacctttcatgtaaataaaggttttcttttgagctctctgctttcagtggtggaaacattagccttgggtggctaacctgcacctctccttcctattttatcaaaggaataattaagaatgaaataatccttaaagcacaaagcatggtcaatatatttcccatccatttacaaaaaaaaataattatccagaaactcataagctctaactaaaacctggatcttacttacttttttttttctataagggcagttaataagaggtaaagtaacaatgactctctgggtaatttaccacagagtccaaggaggagggcacagaatttgttaaaggaaatactgctcccttcctgcattctacatctccattaatgccatgcctatagttatctaaacatctaaaatataacagcaaattagaatgtagtttgctatttaaataacacgaattatgtaaatgctccaaactgagataataaatgagcattcttaattcttttaattaaaatattctttctccatcctgaggctcatatttctgagtatccccatagcagcataagttacagaagcatatctcaagacctattgggaattagtgttatgaaaaaagaaatgaagacatgcttgaacttggtaaatcattttaatgggttttatacttactaaagtaaaacaatagctgacgtgtattgaagtagtaatagtgtatattattatatataaaagaaagaaacaaatatgaccaagagaccaatttcttcttaaagcagattttaggattttaagatatttttaggacctcacaacagatgaaatgtttttaggacaaaaacattttaaaggaccttgcccttgtagaatagagagtggtctggatgagtaagagtaaaacaaaaagaagggtaaattactatgtataataaatgaacagaagcctgtcaaggggacatgccagtgggctgtggagtgagacaggaggccgaagacgagagagagggctatgtatacaggggagctctactagtaaagctggctattattcatttttaaatgatctaatttttgattatataatccctagccataacctccaaatcttaactaaaagtctcttaaaaacaatcaactacattacatgagtgatgttatacaggatatcaatattatatacatttgggtcagaaagaaaggaacagtcacaacatatgcaacgcagaactggtggaaacaggaagttaaatgtaagcaggacttaaatgtaagcgtgcctttcaccaatccagagacctaaaacaggtgctagatttagcaaaatgtatttgaattagaaaggaaagaaaatgaactcaacttacatcattctaattcctcgttctcttttatctcaaataataaactttgaaatatgtttttgctttctatcaagcaatatgttcacagtcctccagtcaaacattaaatgatttatttattactcagcacaagacggtctccctaaatcacgtgaattaatgcttattcacatgtacttgtgaaattcctgtacatttggaaacgtatgtaggatagatctaaaccttaatattttgtgtccagggaatttgagattagtgatacattatcctgtggtgcagtctgtaggctagaaatataaaatactttccaggataaaatcttatgattccaaggtttataatagatagattaccttaaaatttctgagcttttgtccaatcatttgaataaagagcacaatcacttgtttcctgctacaaaggattctgagaatgattagataactcaagtgaacacaatggataagttttaacctatacatcaataaggctttttattgtaattcttaaatatttagttcttactgagatcctgcattctctagtcagtttaccccaatgttctctatacctttgcctagaacagtatcaacttggggccctagataatttcttaaaattatatatcttttgagatcctttatgtttattttacagagaagcaaaattacacatcactaataatgcagttaggtactgatattgctaaattactgaggaaaaataagttttattgtacagtaccctagcctggatgatagagtgagactctggctcaaaaacaaaaataaaaaataaactttaaaaatacaaaggctggataatttcaagaacattgaatatctgttaataacctaagtaggatgcaaaccaaagagtatctgaccaatctacactgccttcttattttactttgcatatgctttactctcaggaccaccaacttagataactaccagaattattgtaggttaactattagaattattaaattatctaatatctaactaatagaattattgtaggttaacaatgtcttatcagtttggaaacacagtctgaaacctagtacttagtaataacgtagtttctgtggatccatgctctagacagctgaactaaaagcagagtatttggaatattaaccctttataaataaaaaacatccaggtttaagacaaaataacaatccacaacaccagttaatcttagtaaaatgtgataaatattaatttatgttaactgataaaagttaaaatactataaaaaaggaaatgcagagattggtgaatacagggtccaagataatggttttctctagtgaatggaagcagaaagatgggatgagagagacatatgactactgcaggatcatctggagatcctgactttgttttgcctggtgagtttgcaggtgcttaattcattattgtaagaaaaggaagcaaagaaggaaggaataaaggatagttggaaggaagggaggaagatgggccatgcataggccagtaagagattgtgttttgaaccaaggattatgattactatgattatgggtacctgagttccaatggtgagtcagggaagggatagagttagatttcacatttgctataaaaatttaggaaacttagttgtacacaatcagatttttcttgtttatcaaaatgaatatatgatttctttctaataaagaatcctactaaatgaaacaatcactgaaaaggtcttaggaaaaatactttgaaagactctttttaaagtagggcttcagtagcaagcatgcatttagaaattttggctaacatctgtgaaatttcacttatatttaaacggagctgtgaatgtctcttcagggcacctacaattctattttaattatatcacctcgaaaaaaaaactgttttaacaactaacaaagcacacatgatgtgaaaacacttgttaaaccacctctgcagttttaacaataagacaaatatgagatcattacatttcttaatgctcattatatgagaattagtgcagtggcactatttttggaaagcatttgcccttggcagcatctcctttttacacatatttgtcattttgggagctctttctcaaatttgctttatacaaattctatgtcagaatcatgcaacatcataaaataacactatgttatgttattgtggtgacacaaacatactcaagaaattcaaaataatgacggcatgccatgcattaaggatgactttaagtcatgtttttatgacaaactgtcatcttaaaagacaaattacaggatttttactcattcgtgtcacatcaaatacattatttaaatagactaattttattttaagaaacaagaaaacataagttgcctgtataaataggctgaattatttatccttgctgaagttttgggttcagttacattgctcaagccacttatttaagctttttgatgcctgaatgctacagaattcaagcatccaggcaccaaaaagatctaattacagagatatatttcagctgtcatttgaaatttatcatagtaattcttgggatatagtggtagcacttcagtatggacttggttaactagtgagtcatgcatctcctgagtaactggtaatgcaggtaattctatatttttcttataaaacagatagtgacccaagaacaactgtcttgggacaaaataaataaatattagcttcataaatatactcttttcctccacagtccaatgtcatggggaggataagggaggaagatttgaggcaaagacttcaagccacttttcctccactctttagtccaagaggagaaactttaatttgtgatatggatcagtaacaaatcagggattcttgaatgatatgttagaaccactgtatgaggtggagattcttttctttttcatgactcctatgatcaaagtgagagtgaatcttaggtgaaaggaggaaggagaatgttttctgctccaagacttcatagttgaaggtaaaaagaattcttaattattgtgttgggtacattctagatcaccaagataggaaaacaggttttgattaagtgtacaaactcttgaagaaatgctgggccaggcacagtggctcacgcctgtaatcccagcactttgggaggacgaggcaggcagatcacctgaggtagggagttctagaacatcctgactaacgaggagaaacctgtctctactgaaaatacaaaattagccaggcacggtggcccatgcctgtaatcctggctacttgggaggctgaggcaggagaattgctttaccccgggaggtggaggttgcggtgagctgagatcacgccattgcactccaacctgggcaacaatagcaaaactccatctcaaaaaaaaaaaaaaaaaaaaaatgcatgtttgcccttctcactatatccatcggttgcccctctaaaattcaagtataatctcactgattgtttgatcagataaaggaccctgccaactgtggtagagattaaagaattcaacctcttctcaggacatccagctagagaacaatagtggctttagtatgcttaattttattgaaatatacttaaatactacacaaaatacctgagaaagtatcacgcagaaagacattcatttagtcacataggaatatatatgtcatgtactagttattacatcatgctagatattatatgctatgctatttgagagagttccaagagcttacattgtagtggaagtgtgagtggacctaggccatcacaatcactgggaatgctagctatcgtgggagaattatagggacagcatactgaggggacacctgcaaacttgcagagaagactaaggagagtcatctaagtgaagacttaaaggatgaataggcattatccaggaggggcaaataaatgtaatagcagacaaattaacctgaatgtaagagacttggtaagttagaaaatagagaaaatgtttagacctataagagtaaggtctgtcaacctaagtcctgcgtacattgctggatgaatgatagaactcttggattgtttcttcattttcaaatagcattgttagaatgaactgtctttaagcataacccaccaaatagagcataggtggatttctcataattgttagatacttcctgccttaactttcctctatctacattcttcttctaataatacatggcttttatcacatgtattattagaatttccacaactaaaaaagatgaagaggaagaaccatttttcctttaccttcctccttccctccacaatcaaacatcagctattgatgtccttatcagtctggactttattataggctccagtcacattataggttttgaatgaatggatgaatgaataaatgggaggagatttgttactctatgtgccctcaaaatagattattttatcaaccctcaaaatttttcattcagtattttctatggtgttttataattctatgttgactatcaagtcttctttctgaatgtgaatctataatttagccttaggctccattctccatagagacagagtatgaaggactagagaaattgtaatcagtagtatttgcccttttttcttttgtttattctaaaggtttttcaacctccttagtattaacatttgagacagataattctgtgtcatgaggggctatcttgtgtgtaggttgtttagtagcatccctggcctctatccatgaaatgtctgtattacttcactcccacttgtgatgagaaaaaaatgcctctaggtagaattgaatctgcctaagggcaacctccctcccccagtgagaaacagaactatactataaacaacattccattcaaaatagcttgtatcatagaggaagtgattgatttatcttatttggaaaattaaatagagggtaaattctgaggattgaagaaaaaggtaaaattgaagcttgcaagtatttgacactgcaacaattatatatttttttccaacacaaccaactctccactcacatctgtcagaccaggaatatactgactaaaattgacagagatcctaagtgaaagtttaggttttttgatttagagaacagaagcctcaagatcaagaggtgagatgtctctgagataagatcagatcatccccagagataagaagcttgaaagggtggaacatttcttgcttcttggtttttctgatcagcttaatattgaagaacagcttgaatttccagttcgtcttgcttcagagagcctggagataagaataatcactgccagttgggtcagtattgccaagaaaattatattggaagtttgaagctgtctataaactttatgcctgaagtaaaaacatgtctgaatttctttctacaggtgtgatatggcttgcctctgtgtccccacccaaatctcatctctaactctaatccccacatgtcgagggggggacctatatccccaagtgtccagggagggaggtgattggatcatgggggcagttccctgatggtgttcttgtgatagtgagtgaactcacaagatctggttaagtgttctcactttgtgcactctttctctattgcttgctgccatgtaagacatgcctgcttccccttccgccatgattttaagtttcctgaggcctcctcagccatgtggaactgtgagtcaattaaacctcttttctttataaatcacccagtctcaggtagtatttttatagcagtgtgagaatggactaaaacaagatgcctaaaagataactacgtggttaatggctagcatttaagtgaaaatgttaatgtactcctcagatgttatttacttttttagaatttcaaaaatcagatatcaccattatcactgtgtataattctaaacagtatagaatttatatacaaattaaaattatcatatataatcttcagatatttacttttatttttgtatcaggtatgagtccctagtttactttaccttggcttcaatgcactagaggagaatttaatttgtttctttgggactctgtgtgtgttgtgtgcttgtgtgtgataagcagtgttttatacacactgagcagtaattattattacaattcattttttgtaactatagtaaaagatctttttaagcagatgctatttagtggtgagactattaaattcagccaagcatgtatttctattgatctgttagcctcagaaagttccttagactgatgctgctttgacctttgctggtcatttatttttttttcctactgtctgaaactgacttttggttgttttattttggaaaataattacatatttgtatgtgttcgaaatagtttaagtgaacaaaaatctttccttttaccagtacctatgtgtagtcaaaaagtattttgcataggcacatttggaaaccctgcattgaaaaacatttctagttaaagtacgagaatgtctggaaaagtctcattagccattttggaagggtatattctggaaatccttgggcagtgaagtgaaacttcactcaataatttttttaaaaaaataaattctatattagacaaaattagtagttttttttaattggctaacactgcagaatttggacattcaaagaaaaataagagtaaacagctactttgggacattcaatcatcttttggatacatatctacaacttgactatcagctatttaatatcagactctaccatcaatttatttctctcaccattgatgtttctatgattactattttgcctatctcaaactatgagtaattcctacttccccagttctctgctcttgtaacaagatcaagagcttcgtagtctgacttgggtttgagtctaagtttaccagggcaggttacattatttctcctccaccgcatcttcatcttttataaacagaaaatatcatcctacaaggctgttgtgaaaataaactgggatgattatgtaaagaactcccaattatacatggaactttcagttagctttggaacttcagttagctttgggggcatagcaaagagctggagggatttatgaaccctggtatgatagattggttgtattaaggtgccactttaccgcaaccgtctcacacccccacatctcactctgtgaccttccagggttctgcagctggattttcagagtaaccatatcatttgctttagccaatgggatatcagtaaaaataaaaaggagaaacttgacatatgccagaatgactaggtttgcatcctcttatacctctacatttaccacaagaacatgcctgggctagcttgctggagaaatgtgaaagaccataggggcagagtcaagtcacccaggcaacaccctgggcctgtaaaaccccatccaacttccattgcttttctcaatttccaccatggattgtatagtgtaacactttgcaagttcttcaatatctatatagttgaaaaaagaatgtagacagactaatatatattaagatttccaatgacctgtatttaatattacatactcacacaactttaatatttattggtataacacatatatcaaatacatagtttctctcctccaacatgcccttcaccacctgaatttttttaacctctctcctcattatcatgtctctcatttttttgattgtaagcagaaggatcgaaattagaatattttctagaggttcactaagcactgagttgaaactgagcaaaatctttgaaaggttttcccatcatttttgcttgtatctgtttcatataccatttatatttggccaacgcttggtcaatatcatgatccaaatggtgaagttggtttcttctgctgagaaataagtagtcccaccattctaggcttgaggatgaagggtactgatatatttttattttataaaagggctctactttagaagttctaggcatataatttatatccaacctaaattaaataacctttctgaaggaaagaatgaggtttttcttggtgttatttcagactctgagaattatctataagcccactgtaaggtggatagcaactgttgaattctccatttaggttgtgcattaaatgtctttatgttcctgttaaggaggaagtcttgtccacatgaccctccccaacccccctatacacccccagacccaccctgatgtgatttggatatttgtcccctccaaatctcatgttgaaatgtaattcccaatgttggaagtgggggcctaatgggaagtgtttcggccactggggtgaatcccctgtgaatggcttagtgccctccctgtggtaatgaggtcacatgagttttggttgttgaaaagagtctgaaacctcccttctctctttctccctcactggccatgtgatggtctggctatccctttgcattctgccatgattgtaagctacatgaggtctcatttgaagccaagaagatgttgtcatgatgcttgtacagccttcagaactatgagccatataagcctcttttagttataaattacccagtcttaggtattcctttacagcaacgcaaaatgaacaaaccccccaagaggcgaactcccatccttgaaggtgcttatacttttaaaagataatacacaagaaagataggccccagataagtttattttttcaatcttctcttgttgctgcaaacatctcaacacaaatttattacttcctcttcattgatagtcactgtcatttctttattctgagagaaacgctagaaatttatttataagtagaacaggctgtagggaaaagaaaaacaaaaacatctagaaaccaacattcaaaagaatagagaataaggtgtgaagaggaggtcaactaggagaacaggaaagtataaatgatgtctggcaatcaggggatactaaatgtgcaaagatgtttcaggtacttcccggttttcactctcagtgttacatggtctcttaatcaattatgaattttaagaagaatagatcatcttttaccaaagtcaggcaatcatatatctgctctttcaaaagtaaagcaatcaccaacaattctaaaaatattttggtgacatacaaccactgcctcacatgtactctatctaacctcttagccagcttttattaccagtattaaaatagacatatttatcatttagccgtatactgtgaaatttttccatcacttggttttctcattttccagggcaaacttttcaatacccaagggaaaacaactgaagtagaactgtaccaaagtgcatttccaatgtcatgcagcagaaataatgttcaatgaaattattctgttagtagctcctggaaagtcaagctgaatactctatgctttcagtgagtatttgacatttcttccttttttttaaagtcctggaacttccattctttgttttatcccttagtacatatttatttggaagatatacattatctaagacttattcccaaatatttacctagacaatgaactaaaggatacgcagtaaacacagctgagaatatggctgattgtgttccaaactatgtagcagtgaagtttattttggtccctctaagcctccccatcatccttcaaacattgactatggactgtgttcagggcaccaacatttgacattgtgaagaatggaatgagggataagacacagagttcagtctttccaacttcatacctttatgttgttcagaattttgtttttatttatgattttcttcctaccctaaaagcaagaaagcaacaacatctattctttcaccttcagtgtacatgtaagtcaggaagatacctcttctcagattctatctctgtaagaaagcccttcctcaatattatagcagagctcattgtttacaaacatttaccaccaccaaactaaagcatgtggcatatgtctcctaaaacacacagcaaaagctctgggaatagatggcaggtagaagctggaaaggccttgaagacactatttgtagaagtctgatgagcctagaggagtgatatggtttggctgtgtccccaaccaaatctcattttgagttatagtttccataatcctcatgtgtcatgggagggacctggtgaaaggtaattgaatcatggggatggttacctacatgctgttttcatgatagtgagtaagttttcatgagatctgatggttttataaggggcttttccccacttgcttggcacttctccttgccgctgccatgtgaagaaggacgtgtttgtttcccattctgccacgattgtaagtttcctgaggccaccccagcccaatggaactacgagtcaattaaacctctttcctttataagttacccagtctcatgtatgtctttattagcagtgtgagaacggactaatacaaggtggctttcagaaaagcaaagaaaacgttattggcatctagaggaaaggagacatttatagtggcagaaaggctagtaaaactggtgcctgtagtaacacaaaaaataaaatattccttaaaaattcaatgatagagctaagtagattaccaggcagagagcttaaggtactgcatggtttcctctagctacttatgatataaaaagaaaaaaagaaattaaagaagtattaatatattgaataaaaattagaaattactaaattgagaaggaagggcccagaagagtcctttcaacaagcaaaagtttctcaaagtaagataaggccaacgtgagataaattcctttgttaagatgtaagaaagatttaagatgatgcctcatagaatctttaacctacacaaaagttccactgagaatttcaaggacttgcatctcagatccccttcattatatgataaggcttctaaggatctgaggagtttccctcagcagcttcacaggggtcctacagatggatatattacttacatggcaaacggactttgcagatttgaatatgttaaggattttgagatggggggactagtctgaattgtctagatagacccaagagtccttataagggaaggagaagggagggtagttttagagaatgaaatgtggccatggaaagaggttggcatgctatggggccacaagtcaaagaatgtgggcaacctccagaaaaggcaacaaaataggttatcccccagatcttctagaaggaaaatagtctgctgaccctttttagacttctgatctccagaactgtaagatagtaattttgtatgctttgtgcctgtaaatttgtggtaatttgttacagccacaacaggttaaaaaaaaaaccatggccaaaaagaagagaagggcctatctgcctatctgaaagagatctgtgagtgtagattttgtctaatgtagtggattagcatttgataccttacaaaaccccacatattaaaaaaaaaaaagattcaaagttaaaatgaaaaggataaacagtgccaaatgaaaagaaacctttggactcctgaactgctatggatagaaaacagaatgagaatgtttctcatttatacacaccagccacttccggaaaaagaatgatgcccaagggatatagccaagagacatcagaggacaactccagagagcaagattaggccctaaccaaagaattatcaatacatgtctggctgcatatcagaattgctatatgcccgtcactgctctgggtctcctgttttatatgtttgaattggaatctctctactggttatctcatatttctttaattcacgggcatttacataaacaagagtaatatgtaatgaactgcaaatagctttcttcacatgtggacataatataaaggatattagaccttgagcccgaaactattgccataaaaaagggaggtttaaaaggagagtcctgaagaaaggaggctgtgtatttttcccatgggagggatgtaaattgtggccagaggtcagaccgttccacagtgtattttccaaaatgactgtaccaatatcttctatctcagaagaaattctacaatgtgatcttgacagttctgtcattgaaaagaggtgtctataatctctgctccttgaatctgggcaggaatgggacttcattgtactacaagaatgaagaagaagtaacactacatgacttttgtggttcagttaggaaagacaatgcagcctccatcttgtttgctggaacacttgccagtacactaagttaccatacattttgttcagttgccttactgctgccatgctttgatgaagttcaaattaacccacgtggagagaccacatgggaaagcctttagactacatggacatagaaggtctgtcccagatggagcaggccagatggagcacccagatgctccagttcttgtctgacttgcatccacaccactgtccccaaacacctcccaaattcctgatccacaacaaaccatgagaggccataaacttgtttttttccgccactaagttataaggaaatttgttttgcaacaatacataatggaataagtcccttctcccataccttggaaacacagtgacttacacattggtggcaagtcatttcttctcatactttcacttcaactttcatattttttctcaattagaaagccttctgtcaatatcatagcagaattgtttgttcacttcaccgtatttaccttatttaccaccaataaaccatgaaaattttccttgacattgttcactgtattggatattgttatttctatacctctatgtttttgtcactgagatatgaatcctcaagagaaagagctattctcttctcctgcaagttttgtctcctgcagtgaaaatgcaaaggatacatatagtcatgtgtggcttaagaggctgcaatacatataaaaaaacatgatgcataatacttgtgtaggaccacacatttggaaggagcatgaagcagctgatcttatggtaaagcccatcatcaaggggcagaacaacattagatgttaaacttccctgtgggatgaatgcaggactctttagtgagaacatcagtgtaccatgtactcagacaaacctggagagtcaactggttgcatgaggcgtagtagaaaaacagtttctagtgaaagacctaacttgcacttccttaaaagtatttaatgggaggtggaaaaattagagaaagctaaatatacttttcaggagtagaaagttttactagtaggaaaatgtggagggggcaatatttttaaaatactctttcgtacactgattcagctgacacgtatttatggaatatctattccattacctgaaaaacaaataagacaaatgtgtcccagtaaacatgggggcttaagtctaatggagggagataatacactcacatgaaaaataacaaaataaattcagaaaatggtaaatgccgaaacagaaaatgacacctgacgaagggcaagacaatgacctggggaaactggcccgttagcaaggatggttagagaaggtgtagcacacgttgttgtctgcctacccagcagccattcctctcccttcagtcctaagggaagatcaaatctctcaccagttcttcactttcccatcttcccacatagcaaatggtggaaagtgtgaaacacaattctgagatgttatggaggaatctgtcagtgaagtgaaagtagaatatggatattcccaagaaaggtgttcctgtcagatgaagagcgagactctcctgaggatagtccccaagtcattatctactttggacattgccttgtgaagacaagatatagaggactactgccatcatattgtgaggcgatgagtatacagtttggatatttgtcccttacagatctcatgtgaaaatctcatcttcagtgttggaggtgggggcctaataggtggtgtttgggtcatggggagagggttcccttgtgaatggcttggtgctgtcctcaaagtaatgagtgagatctagctctatgaacgagctcctgggagagccaattgttaaaaataggctggcaattccttcccctttttctttcttccttcctgtcacaatgtgatgcctgctctcctttaccttctgccatgagcgaaagcttcctgaagccctcagcagatacagattcttgtgccatgcttctcatatggctgaaccatgagccaaataggcctcttttctttgtaaattgcccagcctcaagtgttcctttatagcaacacaaatggactaagacagatagggaagacaaagagtattgtagagaaactgacccaacaccctgatttcattgagccagcaccaaatgttagatcacctattgcagtacctctttttatgagaaaggcaaaccctaactgtttagaaaaatttatggtattagcacccaaaagtatgctgaaaaatacagaagttctaggacattatattaagtgaaataagctaggtacagaaagacaaacactgcatgatctcactcatatgtggaatctaaaagagttgatcttatataagtagagagtagaatgatggttgccaggtgctgggatggttgggggtggtggaggaagttggggagatgtaggtgagaggatacgaaattttagacaggaggagaattatttattgtacaatgtactgatatataatagttagcaatatattgtattcttgaaaaatgctgacagtggacgtcaagcatcctcaccacaaaaatggtaactctgtgaggtaatgaatgtgttaactagctagatttagtcattccacaatgtatatatgcttcaaaacatcatggcatacataatatatacaattttatttttcaattaaaaaatacaaatttaaaagtatttaaataaatatagaagtcctcactgaggaggcaactcctacactgagatacaaggagtgcaaaaggaggacttatagattcggatgaagactattatgagcccagagaacaccaagcctctaagttggtgctttagtcaggattttattgcatatatgtgttagtaattgatttactgcctctcagccccaattccacaatacattgcctgttctgtgacaaagtagctggactctaaatatttctcctttgctgtctggcactatattaagcgagctatgtccatagagggccctggagggtcacagcaggatagaggtcctctcttcctgattctgttgtgcttgtctcagcaagttcctgctgagtgtgtgtgtgtgtgtgtgtgtgtatgtgtgtgtgtgtgtctgtgtgtggtctctgcaggggcaggtttctgaagggtgcacgggttctccagtggccactgccagcagtacatggtacttccctgtaggcactttcctgaagaacggcagagggtgaattatcagcaatctggctagcagagggcagttcagcaaacttctccttcatccagtaagccatgaatccaccctcccaaagaggcatggatttcagatctaagaaaggagcttctctcttaaattggtctgtttcttgggtgctctatgttagccttaaaagtagtaatgattccctttatatgacatttctgattttttaaaatatctctttactcctcactagtaaattaaggttactaaatatcctattaacatttttatttttttgagacagggtcttactctgtggcccagggtagagtgcagtgatacgatcctggctcactgtagcctccacttcctggcctaagcaatcatcccaccacagcctccccaatacctgtaactacaagtgttccctccacgcctggctattttttttgaattttttatagagatgagggtcttcctatgttgcccaggctggtcttgaactcctagactcaagcaatctgcctgccttggcctcccaaaatgcttggattacaggtatgagccacatgaccagccagtaattcttcatattaaacttttactattaaaattgctgtgtggtttctgccttttgattggctcctcatttacataatatgccagaattattttacagtatcatcagaagcataaagagcaggttctgggatgggactcaatgaatgacccccaaaacaatgttgcagaactgacccacagagactctgtgcaaaaggtagggaagcaggaagttactggtgccatttccagaaacacaccatcaatcggaaggggtgtaatttccaccaattggaaggggaaagcaggcgcctattctcaaatatactatgtctccaatgatgcctcttaaacactatatccttcagacactcctgaatctcttctctcttatcctatttaattccaaaattgattttgcataagaccatcagagtagctgaatctaaattacattgaatttgagttcaccatatctacatcgctggcagtaagacatagaaaagaaaaacatgcaaaatggaaatgcaagttgattttttcccgtctataaaaaccttcatggaagctaagattatctttcattgactgaagcttggtcatatggtcatgtcttggcaactattggaatatggctaggaaaaagggaaatgtagacgggattgtagtcagccaaccaacggtatatgcacagttatgtatacatctcctgttctcttctcccatccaactcagatttaactttcccagtggtatggggatggggatgagatggactttcaaagaaatatgcaataaactcccaattattttagactttttgttccaaataattaaagaataccaaagagatattaagtttgaaagtaataaatggcatcaggaaaacatacactttttttttttttttagcacagaagtatcattctgcgaaagctgtgagcaatttgtcatttagcatgtagagaaagccattactaacatatagaccattatttcttctgtcacataaatgctatgtatatttctctgcatatttacactcttaacaacacatatgagcttatttttttgacagtactttcagatttaactatttttgaatgctgatacaggtctattccacttcatcaattagagtttgatggttattgagagtaacaggattttttttcagacctctaaacacagatcactggtcaaatatacactatttcctatttataagttgagaaatattgagatgttttaagaatagtatgactggactttatgtacataggcacataaaacttactaaatatcgactacatatgactggaagagttcagttcaagcttttaagtcataagatttagattttatcaaagtattttatacataatttcagctttttgattaaacaggatttaatgagctataaatttaatttaaaaactaaaagacatcccacatattttactatttatcaccatgttccaaggctaagctagaaaacagaaatggccctgttttcttcattttatcagataaaataagttgagaagtcactaaactaaaatttacttttaatttcttctatgtacacattcattcataaaatgagtatttattgaatgcctaccaggttccaggcctagtaaatagacaagtaaaaaagtacaatttattttagggcaggtgctgataagttctatgaagaaaaatgaatcagcaaaaggaaaatgtaggaagaaaagtaataaaggaggaaaggaatggatatttaaataaaatagccagataaggccttatagagattacctttgaacagatacaaaaaggaggtgaaggaacagtccccgctggctttcagaagaagagcaatccatgcctggcggggaggaagtgttgattgacaaaaatgcaaaaaccctgagagtgtgtgcacacttgctctgctcagagaacagaaagtagatctagggcacagtgagccagacggaaagtaaaagtagagaaatttgaagatatagcacagaaaccaaatgattcagatcattgtggacacttgtaatgatgttggcttactagtaagatggaaaaacattggaactagtaagatgaaaaagcattggaacattttgggccaaactgttgggaaatgatctcactatgtattttaaaggatcctaaaatctgctggtcaaagacagactttggtgatgcatgagggtgaccaagagagaaggtacactggttaggagcccattataataacgaggtaaaaaaaaaaaaattgtgtcttgttcagggaaatagcaatggaaagcttgagtggtataatatttgaatacaagtttaaggtaatgttaaaaagacttaaagaggtactggttatagtacataagagataaaaagagtcaaggatgactcaaaggtttcagtctgaaaaaataaaaggagagattcattatggcgtatgttgggaaaatttgtaggagtaaaataggacagtggtgttagatcataaatttggttttagacaagataaatttggacatcagacactcacttagatatgctgagtaggcagtgggaagtaagagtatgaagttcaggagagtgcttcaggcctgagatatacatttggagaatatcactatatagaatataatcagagctatgatcttgttcttttttatggctgcacacactaaagtacacagactagtgacactacaaagcaaccacataaacaagtctgcaaaataagcagctagtatcatgaggacaagatcaaatctacacatagcaatactaaacataaatgtaaattgggctaaatgctcccaattaaaagacacagagtggcaagctagataaggaaccaagagccattggtatgctgtcttcaagagactcatctcacatgcaatgacacacatagactcaaaataatgagatggaggaacatttaccaagcaaatagaaaacaacaaaaaatatttctaatagatttctgcttttaataatgaaatatgtcaaactcctataaaaactatatgtaggaaatataaaagtttatatataattcatgtaatggttaatagtaactgaatagctagtattgaataaccaagcttcttttgttgttttgacattggagaattgaacatgcttaaaagttattggaaaggacccagttaagagagaaagggagtttgaaataccattaagatccttcccaatgacttttaaacataatcacttatcatgttaaaaacaacagaagcttggttatttaagcttggttacctcctctagctaccaccttgtcttcttttagcctgttccttttatgttttgagttttttttagagacaagatctttccctattgcccagactggaatgcagtgacatgatcatagctcactgtaaccttaaactcaaacaatcctcctgtctcaaccttttgagtagctaagaccacaagtgcacaccaccacaccctgtgtttgttgttggtatttggtagagaaggggtttcacaatgttgctcaggctgatatcaaacttctgggttcaaatgtacttcctgcctttccttggcctcctaacgctgtggaattgccagcatgagtcaccactcccaacccttttattttaatatgtcacatgaacacctctatatctccaagataatatctatcatttctcccctaaactccttcaacagcctcctggctggtctctctgcctctgttatgggtctctcaaatcttttccccactcagccccagatttcttctggaaagcaattcagattatagtatctcctcatacttaaaaccttttcacctgtgcattaagaacaacattctttaaaggatcctgaaggccctgtgtgatctttctactacctctctcaaggctcattgtctctacaatttgcctttagctcattgtgctttaatcagattttttaaattcaatttttaacttgtatttaatgtttcatcctgccagttttccttttcctgatacacctattttcttttcatatttgtctaatcaactttcactcatttttgcattgcagttcagcaccatcattttttcacaactttttcactgagttccttaaattccctctgtactcccacatcacactgcatgcttttcttcctaagaactttcataacagttaccatttcacatatatttgggggatgagctaaataatatctctcttttttattatactatatattctatgcattcggagatttaatttgttctcagtattgtaaccctagtgccagcacagtacctgttacatacacggtaataagtgtttttgaataaaatgtctgttttttttctgacacttttgtttctttttgagatgtttctctgattttaactgtaagaacaaaagagccagaaatggcttttgattttaactctaagaacaaaagagccaaaaattcttgttttctttaaaatatttctagaaaaaatctttctagaaaaaagcaaagtacagtctccgggtacacaatgggttgaaataatgtgtaaacaatgcctacatatttctaaatttcttccagatgagggatatgagttacaaagcaatttgaggctttggctggttgtaagactataaaaatgaaaattgtcttctttccttacaagtacttgttcctgactcaaaagatgcatttgggttaaagttcaagaagaaatatacataccaataaaaccaggaattctgtttgttaccagtaagagaaaaaaggaacagaaaataaaatataaaatacaccttaggtggtaacagtgggaagggggaagaattctaccaaggacttttaaattgggaggaaagagatggagataagccatgtatataccagagcctgagaccttatatgtatctgaatagttcaatagaatgtttgataaatttttcttttctttttaaaatttttgctgttataatgattatttaaatttttaagtaatttttcaaattgacatatcaactgtcatgtgcaccatgatgaaaagtttatctcatagaagtagggactacaatggtgataaccagaatccacgatggttacaggagagggagggtttggaaaatgatggtcaaatatatttacagttacacaggaggaatatgtttaagagatctattatactacatggcaactatagtcaacaatatattcttgaaaaatggtaagaatgagcaattatttttgtttcttcaaattgtaaaatgaaggactagtagcagctaaatttcagtttagtgctcatggcatgcagttccttaaaacctcattgatttatacacttggttttttatagttatgataaataacttaaaaatcgagtctatcacgaaggtgatgaataaagtcatttttcatttataatggaaagtctttcttgaggttatatggcacgtaggtagaagctaaacttactcagagcatgaatgatgggtagctaaagggtccgtttgtcacagttcgtctactgcaaacgagatgactacaaagcttagggcccatccatttgtttacagagacagattaatttttttcagcttttattttctctttgggagcttagtttacaaatgaagggagctgaagtcttctctaaacacacacaaccatacacacatacacagcatatgaaaatgtgaaagtcttattaaaagcacatacataaaatatgactatttccatgatatcagggtctctattttgctggagcaaatgaaagacttcggaaagttttaaagacaaggtaagaaaagagtcatggacaaagattaagattcagctagaatgtcagacctttcaaaattatttttttcagcttcaaatcattttttcacatgaatacatcttcactagtgcaaggtttcaagcagctgaaactggaacaggcctcttctgtttactcttagatagtgctttgaattttattagcataacttctgggaaatagtctagtgcatttggatagctaaacacattttttaaaagaaaggaaaaaatctacaatgattggcaaaagaacaacataaaaatcatcagaacatttatatttttttacaaaagaatatcctccaacgaattagatccgaggaattcatatttaagaggatcagtctaagaagctaactgactcatggattacaaaagaatactttaaagaacatatcagaaaatacagttgctttgggcatcaattgaaatattagcaattatcataattgagtacattttcaaatataaatataatgtaaaaatgacctcagttgccatttatttgaattataatgagaaatactttaaataacatattagaaaaatcattaactggagatccatccactaagtgacaataataaaaattgatgagtgaacgtgagcagatttatatttgcaatctcaaagctttctgtagtttctcaaataatctctggacttgcagagttcctcaatggaggcaatgatggtattttcaggagaacaatgtttccctttgggatttgccatatatcacaagaattttgacattcctccttcctgggaagtaaacacttccctgtcattaaaacaaaaacatctcttacacttacacacacacacacacacacacacacacaccgctgctaaacaccccctgggggttggtaaaggtaatgcctaatgcctacttcagaattgttgcttaaatctagaggcagaggtatgagttttcaagcaaacagtccacagttgactctgacttactaatttgctatatgaaatctatatactttaaaccaaagaatatataaagacagtattatgaacctacacacttccaccaagagtttttaaaagaaaaatatttattaggatttttgtaagtaaaaaatacatatttgagggaaagttgaactctacagtaaatctttaggaaaccaaaaaaagtttattcgcaatatagttaatatttttcatctatttttttcttcaataggactatatctatgttaaaatatctgtaacttattttaaaatacccccataggagtatccttgtactttattgtaaaataagctttctgactgagaatatatacagtattacaaactatgtaatatggacaatttaaattatagctgttgattcacctattgattaggattttactcaaacataataattttacatacaatatattatttttagaaacagtattttaaactacttatgagcattttattttaaacttgatattttttaaagtagacaatgtacacttaactgtttttctgactcttagctaaattcagcattggtaagctttcctctgtaagagcctaatagtatacattttaggcttcacaggtcagacggtctctgttgcaactgttcacctttgacggcagtgtaaaaaggccacagaaaacaggtaatcaagtaagcatggctatgtttaaataaatctttacttataaaaacaggtggctttggtgcacaagctgtagtttgcttaattctcatctaaattatgtaatagtaagaatatcttcaacaacatagagaaactaaggaatgcctgttttctcctgtttttaatttattcataatgtatgaaacttctacagttttaaatatgttttagggataaactaggtcattaatattaagagattaacacagaaatatagaggtctatatcaatgcgtcaattaaaatttcagtaaatgaaaaaagtaaccatttcattttgggactggaggtagtgaattccttattcaatggtatgctagcctatttaatgaaggagatagattttaattagctgtttacatacatggtaatgatgccttgatattacttgattatcaataaaagcaggactcacacctgttcatttccactgaaatgagtttttttcagatacttcatgttttattgacattttatttaacagagaaagataccgcatcaaggattacttcatgtgatttcatatgaagctctagattacgctctagatgcgcatgctatttcaatttaaggaatccttagaggttagagacagaagtcacaaaaagattcttttgtgtggttgctgcactgaagtgttgtggttgtataatgtcacatatgctttatatgaacttcaggaatggattgagatatttggcatagaaatgctatggtcttaagtctagtttaagaaaccatatgctgtaatatattccacttgactaatgttctaactttggtcctctgacctcctttattagcatctcttagtgaatttttaaaaagacgtatgttagtctgtatactaaacccacaggattaaaatctctgtgcatagtgactatgagtttacgcatatcccatattctccaggattttcttgttttcttttgaaaggaaaaacaaagctgtctttattcatggattcatgattatctacataacaaatccccaaaaaactaccaaacaaaaattttctgtaactaataagtgagttttgcaaagtcacaggacacaaggtcaatacacaaaagtcaattactttctcatatgccagcaatgaacaattagaattgtaagtttaataaataacttttactatagtataccccaagaagaagtacttaggaacaaatctaacaaaatatgtagagaatctgtaggtagagaaccacaaaacagatgaaagaactcatagatctaaataatggagagtgtgaagagagactatgaaatgggaaaaaagtactgtacttctgaaccgtgcatctaataagggattaatatccaataaataaggaactaaaacaactcaatagcaaaataataataatttatttaacaatgggcaaagaatgtgaatcgatatttctgtaaggaagacatacaaatggctaagtatataaaaaaagttcaataacacaattcatcagggaaatgcaaattaaagccactgtgagatatcacctcacactgctgttagaatggttattatcaaaaagatgaaagataaccagtgttggtatggatgtgaagaaatgagagctcatatactcttggtgtaatttaagttagtacagctattatggaaaacagtatggaggttcctcaaaaaattaaaaatagaaccaccatataagccagcaatcccactactagatatacctccaaaggaaaaaaaaatcagtatgtggaagagatatctgcacttccattttggttacagcactatttacaataacaaagatatagaatcaacttaagtgtccatcaagaaacagataaagaagatttattatacatgcagatggaacactagtcttaagaaagaaaaaaatccagtcacttgtgacaacatagaaaaacctagaagatactatgttaggtgaaataagccaagcacacaaagacacatgacaaacctgaaaaaagtagaagtaatagaagcagaaagtagaataatagttaccagaggctggggggaaaacaagaaaaaaatgaaatattgaagaaatattctgtgttcatggagtgaaacacttaatatcatgcaaatctctctagcaagtggttgttccacagctgcattaagttcttccctgaaaacactccttccttccctaccacatgcccaggctgcagaattttccaaatttttatgctctgcttccattttaaataaaagttccaactttaaatcattttgtactcccatatttgatcaaaaatttttagaagaagccaggccacatactgcatgctttgcagcttagatatttcttcttctatcagatatgctaaataatcacccttaagttcaaactttcacaaattgctagggcatggacccaatttagccaagttctttgctaaggcaaaacacaagtgacctttgtttcagttcccaataactttctcatttttatctgagtcttcatcagccttaccttcactgtccatatttctatcagcattttggtcacaagcgcaagtctctaagaagttctaaactttctttcgtcatcctgtcttcttgagagccctccaaactcttccaaagtcggcctgttacccagttccaaaggtgcttccacattttcaggttttttttttttttgagatggagtcttgctctgttgccaggctggaatgcagtggcacgatcttggctcactgcaacctctgcctcccagcttcaagtgattctcctgcctcagcctcccgagtagctggaactacaggcacgtgccaccacacccagctaactttggtatttttagtaaagatgaggtttcaccatgttggctaggatggtctctatctcttgacctcatgatccgcccacattgacctcccaattttcaggtatctttatagcaatgccccactccttggtgccaattttatgtattagtccattttgcattgttacaaggaaatatctgaggctgagttactttataaagaaaagaggtttatttgtctgacagttctgcaggctgtacaacaatggcaccagcatccacctagcttctggaaagtcttcagaaagcttacagtcatagtggagagcaaagcaggtgcctgtgtataacacggcgagactggaagcaagagtggattttctgatataaccatcccaattatatgtctcggactagcctttagcagccactgttttagagaagcttagcatacaatatttttaaagttctaatatgtcattataattataaaacaattttcagagttcattaatgttttctttaaaactattagaccttcgatgttcaacctcctgaaatagtgcttaaaacctagaggcaacatgtgggataagttgtcataactatggatgagatcaaatcttaaaaaatgcattgcaaagataatcctctttcattatgcttttacaaaaggatgatgctacattaacacagtaatttctgataaataaaatatattaaatatctaagaattaacagttgctggggaaatatataaccaaagtttaaaatatgtcagaatattttaataaattattaaaataaataaattcttaataaaaaagaccagagaaatctgacttctttctttctccgaagctagtggtgagttgattatattagttagttctcatattactataaataactacttgagattgggtagtttacaaagaaaagaggtttaactgactcacagttctggaggctgtatgggaggcatggctggggaggccccaggaaacttacaatcatggcagaaggcaaatggcaagcaagcacatctttacatgtcagagccagagagcaagagcagggggaagtgctacacactctcaaaagactagatcttgcgagaactcgctcaccatcatgaaaacagcaaatatttttatttagatagtcgttaggattgtatgatctgtaattttcatattacatcttctatttcacagttagtatcatatgaactctttgaaatcagacttcctaaaatttagctaataggtctggtaaatacctattggctgcttctactcttaccaactttttcccttctccaaaggtttactgttttcatataattgatatgtgttttccatcagccttattgttgattctattttataattctaagcttgtgtgtacgtgcatcagcgcccatgcatgaatgtctgtgctctctatttctttcttatctatttttaatttacagttatctcactgtgttctaatttatgtatctttgtgaatacttaaataatttttgcaacatcgtgtaaaccaaagaaatgaagaattttagtttcccataccattaatgtattgttttcatttcctgagtatgattctttagtttctttttctgccggtgctctacttttgaataaataatcatataccaatcactaaaatgcaagagtcatacatctgaagtcatgtatgttgattacataacagtgtagaaatttggtctcaagataaccacagtatttaaaacctcaattttatatttaaataaaaaagaaactagcacatttagaaatgcacacttcaactttgctcacctgactagcaccatgtatctgtttatttagttgctggcttgtgaaggtattattgataacacattcaaaatcatggggtgatgatgagttcagatacagatcagtaggtaggatgatagataccttagatacatagataaaactcaggtgaacttggagatgtaaaggtgagctagagctcatctttcattcacaaactttttccaagcacactgtagtatgaattgcgtttggacatttaggtgatagcaaattttcaacacacagcaacattttctacatttttttgtttgtgtaatatcaaaagtgtgacgttggctaacagtgaaaataaaactgtagctcactctaattctgccaaaatatcctatattttaattaagggagttttacctgagtgaaaaacatcgaaaattccagtaaaaatcaaggattttacatatgtatatgtgtatttgagctaaagacatatattcttaaccacctgtagcatgaaataagtaatcaaatgtgaaagaaacagctaatttgttgaatcaaataattttcttccaatgattatatatcttgcatagcagaaagattgcatgcatatgaatgaatgcatttgcttcactttatattttcttccctaatagttttaattttttattttctaatattgtatgtgatgaagaactcgagtagtattttaagctattactttagatgcttaaagaccattagcactctaacaaaaattgtcattgtctttataaagatctctgtgcctgttgccacattagtaaaactgagataatcatagaaacagtttcacaagttggtgagaaaatattgataaagcacttagaattccattacacacagatcaggtacccaataaataatgggtatttctcatgaaacagattagttctgtatcacttactttacatttccagcatagtacacagtgcctgagactgagaagcagctctgttaatatttactgaaagaatagcattaaataatacaagaaaaataagatataattaaacaaatcaatatgattgatctctgtggacgtccacagtttaaaaccattccctctttcttctttctgtcttaccctaggatcagggatgccaggaaattctaaagtacttgaagtttttcactggatcatcttaactctctagctttatctaattaacatgaagcaccatcatgactatgcatcttattcaatgtgtttcagaacaactgtcttctaagttacatttgaccataacaataaactcggttttcaaaatgtgtcaatcaactaatagggtcattgactcacaacctacagacagtaatagtaacattaacctctatcttgggtcaaagcccctgcttcacttttgggatcatcagcaaaccagttacccctggcaaagttcagtcctccaggtgcactgatgatagtgaaaagacagtttcccaaagcacagcttgttccttttcatcatctcacttctctctcttctcacaaagaatctctctgtgtcagacaaagatgggtggtacagtgtgtctgggtctaaagctggaaatgtttttcttttctaaatctcaaatatgttttcagccaaacgtttgatgaactacaagaaatgagaatcaggaagtcagatgttcgctaagataggtcacttctgtaaaattatcttacactgactaccaaaatatgacaattatttcaggaaagggaacaaaaaaacgcttgtgattagaagattggggaaaaggactacctcttctacagttgttttcaaattgaaatctttgtactgttattttaatattttaaagtgtattcactttttgttattctgaatcctcaattagactgtaattatctcaaagggtaagatcacaaaccaaaggttatgctctcaactgtatcactaaaaatggccacagtaatttttttagccttagcttccttccacacctacaaaataagcagaaaaatatcctgtctcaaaaggattaaatgcaataatgcatttaaaaaaatgctccaaaaaaggtgaaccattagataaacataaggcaaaatataaggttaaaaagacagagaataaagcttaaacatctttttaatttgagaaaatgtaatgacacatgcaaatttatttggaaaatagatgacataaaagacattcaccgaagttttgttcaaccaagatcaaactcagagaaatcgtaggtgggcaatgatatgccttggtgaaataacgaagtggggatttaatttctcatactgaaagtgcctttaatctgtcccatattgttattcagttcattaaagaacaacatgcataaacatggatttttttgtgtgcttaaatcatcttcctaaatatgcaaatcagtgaggcatatattatcagtgttctgtttaatattcattgtgatctactcagtagttttcctttctaatgagagcataccatctaagtaactcaccttcccatgcctgaacttagccaatttagttcgtacttgaacacgacattttttttcaaagttctttctagaccattacacatacgtatgtatgtttgtatctacatatcttctgtagctcctcatttactttgcaaacatatagtcaccctaaattcagtttgattattgaaagtcagggttctttttttaatcagaattatatttcaggtagagttttaaataattagctcaattgttgttattgactagtaaatgaacactaaagagcatataaaatacattctaaatctaagtctgcaaacaactatattgtcacatatgtcatcctcatatacgacaacaaggtttatggctacatacaaaaacttggctctacatacctatatactagttatcaagccagtcagatacttatcttaaaaagttgttcaataaaggaaattttataaaataactatacacatgtgttcataaaaataatatactggtccctattctcagaaatttttacaaatgacatgctataaaactcagcacaaaacccaagatatcatgtaattaaatttcctactgcgtaactatatttgcactactaatacagaagaattcaagacactaagaggaaaattaaaccaaaactggacgagtagataaacagacaaagaatatagacattactatagtcaggaaaaagtatacaaacaaggacaaaagagagaactaaacagaacataggggcctaaggtataagtgcaaactcatgaggaacctgccttgactggagaagcatgtgtgtggagaattaacagactattaagataaggtgggaccagaatacggtggttttagttgtcagagataaaattttaagccagatgctctaggcaatagaagtctttgtaacttgaagtacagctgagaagcatgttgtaaagctttaggaggacacagaatagaaaaaatacaggatgcctgcgaggcaaactcctggagttttgtgcaggcatacaagttattcaagtaatctagtcatgggggaagaagagagtgtcaggctctagtaaggaaaagaaaagaggagaatcttttaaagtacaaccagtttcatgacatatttgttataaaatattaaggaaagaaaaaaagagttaattcaaaatttttcatcttggatgtgagaagtgtgcttttttgtacgtatgtgatacagctctaggtccctccagtaattccaacttcactctatactcaattgttatcgttgtctttattttatatagactacactatacagataatcattgcttttatcttatcttttactggttaacctgtattggtgcctacgtaatcagtaggcaactggttgaagcttttcgtttattttctgttacatgatgatagttacattggtcatccaaaataaatgcttaataaagaagttagttgaagacagacattcctatgacacatttatttaagtcatactacacttaaataattccaaagagaattcatttatgatgttttaactcacctatcatataatcagcatttctcaaggcttagaatgtattatatgtagacaattcataggaaaggaaaaactcagtatttttaattaaattgaaacccacttttcaaaagtgtatgtacatggagttttttgttacagaccactgttagttttcaaaagcacattcataagattattctctttcaagaaatctaataaattccttctgaataaaaaatcttgatagattaatatgagatctggctcatagaacttattcttaattcactgcgtttgtggcctccaagatttcagccatactgacaaaagtgaaaaagcaccactgccaaaattaagatgaacacagcagactttaggaaaaattacctaagttttcttattttaaatctcaccccccatactctccccaacacacaccaaatccttatatggtcagttcctaatgatgagaggagttcagctagcatcttccaagcaagagttctgtgtccttttttgcctattccccaaactccaggtttttgttttgcggtggcaaacacagtctaattaggtcatgtgcaattgtcatatacatgatgattatcaggagttttggagtctgttatttcacttgggttcttatataagcatcattgcacaaaacatcctattattattatattagtctgctagggccgtcataataaaataccacagactgggtggctgaagcaatagaaatttattttctcacagttttaagaggacagaaattcaagatcaagttgttggtaggtctggtttctcatgaggcctccctttctccacggcttgaccatggttgtcttcttactatgtcctcacatgacatttactcaatgtacacatatcactgatgtctattcttcttcttctaaggatatcagtcatgtaggatcagagtcctattcttctaacctcatttaaccttatttcttttaaagctctatctccgaataaagtcacattggggattagggcttcaacatatgaatttcagggagacacaattcagtcccataaaagtgaacactaaccaatttcagaaaatactgtcattcctaacatagccaccatttacacaattaatcatacaattctcctaaccataagcactctttaaaatcagaaccctactgattcttgtaatgaaaatagtgaatcacttaacagttgtcattttcatcactcataccagtaacatgtattatagaattataaattactatgaagcttaatggaaaacaggtgtaacaactcacaatttttgcaaattataattgaatttaatgtattaatgtatcatgtacctgacctatagcatcttatactttgaggactatatagtatacagtgagattataatatgagaacatatacaccaagattaggataaagagaacattaagacaaaaaaaaaaatcttagaatagaaatgagaaaataaaattaacagaaaaaaaagtatctagttgggcaaaggaaaagtccatggagattgaaagaagatggtaaattctggaataaaaattaaatacctctctggaatttacacatatagaacattcctgctcaatgtgcctatgctggcagtgattgctgtatcatctgagagttcttccacactaatagtatcaatagctggtataaagggggagtgtcaaggaagggaacagagggcatttcaactggaacatgtgaacaggtgggaaggggtctctccagcctgtctgaggactagtcctttgaaagtactggatccacaccttgttaaggacattttcactgtaggactcaaaggaaacagaattgtacttgttgagcatcctttctgctgggagtatgtgccatccacagggttgttaatgtatattatttctcaaatgatagtccacagataaaatgaagtattaaacgttctggatgagggaaatgggttttaaagatttagttgtctatgcagtctttaaaatatatactttctatccatttgctatttaatatgtgagttttctgttctttatcttgcttatattttttctgtgctggttgcttaatatatcaagtatttcaggagtgatgaacaaacaaaatataacatatttatctatgaaacttatctttgggaagtttttgaaaataggcactcatacaaatgctaggtctaagaataaaaatattattgtctttggtatctaggtcggtaacacttctttggagtttaatggtcagttaaaccaaaatattatacagagagaagatataggctatattcctcaatttatctgaaactattatatagcaagtggtttaaaattgacatgatcatatattaacatcatattctatcaatatcactgaggtaaataaaggatttttttcacatattttccaggattgaaaaagcaactccaaactactgagctcagaatttcctttttattatggagggagtagatgtaatgatttttgattgctgatatacatattttgttcatcaaaaattaaatgaagcagcacatttctacctgaaatggcatatctgtcagctgtgtgcttagagtgtatttttcttctctcatataatattgctatggatgaatagcatgctgatgaatgggattttaggttgagtttttaatctgaaagttttttttttttttttacggcttttcctattaatttaactaacaagattgctgggggcaggggcagctgctaggaagtaatattggaaagactttaaaatatttacatatctgtataaatgcaaatttattaaaaatgacagttgaaaaaaagcagtgtagtattgagttaaacataggccttaacccctccattctaaatgcattattggttgatatatttatatgaatttattattaggcactatcttagacatcactgtaaaatgtataaaatatggggcagtttaattggtgtaaatatgtcaaaatgtaaaattacttttttaatttctcaatttaatattgtcagacttttctttatagtgcatttatatttcaatgaactaattaagaaattgactaagttgacttcaacatacagacatgtgagcctttgggacatcatttgtggattgaatgtttttttttgtcatgagcatgcactattcactagacctgattcaacatctgtttttgcctataagttcaattattttttccctaacatgcagctagctgtatatttttttctttatagtaaagtaatacatattctttgtaatacctatagatagtagataaggcatgcatacaaatgacaaaatcatcctatcagttagagaaaagttctaattccttggtgttactattttatggtaaatatatggtctctggagccataacctcaggttcaaatgctggctcaactgcttactactttcttgacatcttggtcaagtttgtacctcagctttcatatctgtgaaggcagaggacaacagtatctcagttaccaggattaaataagttacatacaaagtactcattagagctcctggcatagaataaatgttaagctgatgaaaattgtattattgtagagtttcatgcaaacccctgaatttttacataaaatagacatagtttatgaacatttttgctgcttgatgtaatgtgaattttttcatctctcatgatacatgtgtgcaatcttttaaaaatatctgtatagcaattttcagtcaacatctgtatacgagtatgcagttctgttcaaataatcccacgattttctagaagaaaatatactgagctgaaagaaatgtattcttgaaggatgtttgaaaacatacgtactcctcttgacagtgtaggggtctgaaaatttctgttcagcttttctagtacaaagtattgccattaactctcttctttttctagttactaaattataagtgtgttgcttcaatttatatttaattgcttgtggaattaggcattgttttttgttatttaattttgtcttttatgcattatatatagatgtatttgtcattttcttattaattaccatgagatcatttgatacaaaacttgagtttcttaaaatatcggatgaaattattaagcaggtaactgttttccaagttctagtgtgaagtcatgagactcctaatggactgaataatacttggaaaactgagaagttctgagtttaatcactctaaagtgatttcaatctttgtcaaaacccaacaatcattacattatgggctcgagtagcgtagttctcattccagtgggaatcattttctttagaaactacttgctttggtttggtgtctagtttccaattcattgtttcatatctggatttgtcttttggctaactccttacagttgatagtttgttcttccatttccagtctgcttggcttgtaatcctggtattgctcctgttctttggtttattgtgtggataatatacatcagccccatcctctcctttaacaaggctttcacatttctagctttagtttgtttgggaaggtagacagctatgacaacaactattatccttgtcaggaaacaaattccaaggctggataaaatattgctctcgtcccatactgcattgtgacacttcttatagctaaatgcaagaactcttacttagagtctctgtgtgtgattctatctaattaaaaagaacacttccaaacttgtttgaatgcaaatgtgcatgaaaatgaacattagccacaccataaagaaggcatttagaaacgcaaatacacacgaacctcatgtcagagttgactcccttaccatttgttatggtttggggtttgttaccccaactaaattaccatacacagagttatactgctaaaataaaatgcagtgtaaaatttataatcattttaataaagttaacattctggaaaacaattatttcattttcataataatttgcattttatcagacttcaaaaaaatgttgcttttatatttccctttagatataaactttcataacattcaaaatgccaagtaactgggctaaataacagtaggatataggaagcaaaattaatataactttttatttctacttttaagtaaaattttcaggatcataaataagagaaaatgttaataaaataattcattttaaaaattttcctgtggtgatgttgtttaataaaaccacatttggaaaactaaatcttcaaaagtggccaggtcatttttacttaaaatacaaagagatcatctgttttttcttgtcactgttatggaaccagcttatactaccataattcattagacttaaaagtaagatcttaataatgtttatttattaatttgagaatgtcaatcaagaataagaaaaaataaagtcaataatctacagccttgctgatatatctgcaatatatattgtaagtgggggaaaaatactataaaataaaaccttgatggaaattcagtaaatttctgtcaagtatatttagaagtaaaagtgaaagcaaataaatacacttttttaatcgtttaatttaaaatcaaaataaaagataaaggagcaggtcagcccctctggaaaacctgccacttcagttgaaaaaacaaaggactgtcatttgttctgagttggaatatacaaactacagcatacaaactaaaacatttgtccaaaatttagagtcaactcatttatcatgaggtagcagtctcccttgtcaaatgccaactttgattatgctgtaaattccactatttctctggggttatcttggactcctcagcataaaataatgttctttttgccatatgaattaaggttgagattgcactgacactcctcaatagcacatgttttgcctcatcactacctagaaataatttggtaatgaagctcccctgagagaaagctgaataatattaaatggtatcgttggcaatcagtgctgaagcctgacacgtgagtttgcatctccctctggtggcagagagaaatgaatagccagtaggtattataatccataattacaattacaactgcactaataaaatgatgtcagaagccaataacccaagttgagaatgatattccctagactatccagatgtaaagattttttttctttttgtaaacaaatgtgattcaatagcactgagaatattgcaagagtttttatattttgctaatgttctaacttcctcataggaaagaacataaaaatagagtataatcaatgcatcttacaatttcctaaaaactgatacttttttgctcttccttctctctttctttatgaatgcaaataaagacaagcacattaaataacaatcagattttctgtaaacattcttataagtttttttaagtctgcttatttcattttataagatcatacaaatatgtgatcgatcataaatttcctgggatatcaacagaaagtgtgacaatatagctccaataaaaaataattccaaattacattctaattgctatataaattcatttttatgaaaaaagaaaagtatgttatgcatagtatttcactgttaatgtggttagctacagagcaacactgaatataaatttccttaatctttgataaggagtcttgatattagtcaacagtgataatgaatctattcagcatcagtatttcccaaagtaaaagaatagtgataaatacatgctatataaattgcaggaggcataaaagtgctttaagatcaaatagggaaaaaaaaacaaaacagagtgatctcatcaagatggctgactacagatgcctagcattcatctctcccagaagaaaggaccaagttaatgaataaacagctaagattggactggagtgtcgaagggaaaggggagtggagatgcaccagtagtgactggaaattcaggagggcagcacagaggcacccagaatctgcagacccatctccccaaccctgatctaatttgctgagtcaggagggacttcctattgccaggaaaaggtaagcagaagaaccccacaagccccattgcctatgtaaacatctacagtctcatacaacaggagaacttcacagtccacacaaaccctgaaaccagtttagagaattgctgggaattcattaccctggattaggagcacaaggtgtgtactctctccctccacctcccacctcccattccctgccattagccaagctgccacagcatgttgccatctcaagatcagagccacctctggaatatgcattgttctgggggccaacacagggcaccatcttcattatgacaagccgacaatagtgactgaatgctacaaccccagctatgtggactctgggcctaggatcagctgtgattctggtcctgtacagtacagaaaccagtatttggtaccacacttctagccagataaataatcttacagtcctgccttgggcaaacccacccttgaactagccaaatgctgcactcctttcccaatgcaggagagaactccgaggttctgagcagctaatacacccccagactagtggagcagctatgttcctgcattcagggtctgagaaacagccccacagcaacccctgctactccagacatgtctctggcttgcttaacagccctgtgcctgcagtcagcgtttgagaaacagtcccaaaggcttcccctagtgggcacacccatgggccaggaaaacagcaaagagtatatgtcttgggccttgagcttcaggtgtccacccctagtggacatgctgagtagccgtgtagccacgtcaggggcctaagaaataaccctgtgcctgcacttagcagacacaatcagaggccagccaaacagcctttctctcacattctaggcctgacttacagccttgcagattgcccttagaagacacacagccaggctggctgaacagctgagggcctgcgttccgagtacgtgtttaccgcgcctgtgttctggcactgtaggcaacccacagcaaacatgcacccagaccagccaagagagcatgtgattgtattctgagcttgaaaaacatccccatacataagctgactaccagcagacacactcccgggccagctgagcctgcttgtgctcatatctcaggcctgagaagtagccctgtgggtcacttgggcaaatatgcccccaaactagctaggaaactgcttctatgtcatgggcctgcaaaacagacccacaggctgcccttggaagacatgcttccaggctggcagaaaaactgcatgcccatgctcctagccagagtaacatccctgtagccccaaacccagtgagccagacaccaagttgttggactcactgtgtgcacacatatgcccctgacctgaaaaatagcccggtgagccaactttcagcaaagcctcgccattatcaccacaaactctcttagcataggctactgagcaacttgcaaatgcctttagcatgggttagagctgtagaaacgacatggagacaacacaaatgtgtctacctagaatgaaggcccacacaccctaccaaactgacagcccaagacccattcgtatgaacatatctttccatatgaaactaacaccataaaattaaactagattacttttctaccaaatgcatggaaattaatgtaggaacacatcaaacataaaaaacaaaggaaacatgacatctccaaaaaaaactgattatctagtaaacagataccaatcataaggaaatatatgaaatgccagaaaaagaattcaaaataataaatcttaaggaaactgtgagatataagagaatacagataaacaattcaagaacatcaggaagacaactcatgatttgaatgagaaattaaataaagagatagatatcattaaaaaaagaaccaaacagaagtactaaagctgaataattcaattaatttaaaaaaatactattgagaactttaacaacaggctagaccaccaagcagaagaaacaaatttctgaccttgaaaacagatctttttaaatgaaccaggaaaaaaaaataaataaaaaagaatgatgaagaaagcctacaggatttatgggagatcattaagtgaacaaatatgttattataagcattcaagaaaaaaggtgagaaaatcatatttaatgaaatgatagcagaaaacatcttgttttgttagagggatggacatccagatccaggaaggtcaaagaacttcagattgattcagcccaaacaggtctactccaaggcgcattatagtcaagttgaagaaaatcaaggacaaataattctaaaagctggaaaagaaaaacattaagtaacatataagggaatttccactagattaacagcatagttttcagcagaaaccttagaggcaaggagagaatgaggcgatatatccaaagtactaaaattaaaaaaaaaaaaacaaaaaactgtcagctacaaatactatattcagcaaaaccatctttcaaaaatggaggacgaatgaaatgtttctcagacaagcaaaactaagggaactcattactactagccagtcttacaagaaatgttcaagagaattgtagctctagaagtaaaaaggtggtaaataccatcatggaaacatacaaaactcaaattcactgatacacacaggagaaagagaaaagaataaaaccatatcactatagaaaaccaaccaaccacaaataataaaagaaaaaaggaacaaagggtatataaaacaacaagaaatcaatcaaatgataggtgtacgtcctcacctatcaataataactatgaatgtaaataaactaaatccccatttaaaagatataaattggttgaatagatttttaaaatcctctctctatatatatatatacatgtatgtatacatatatacatatatgttgcctacaagaacctcatctcacctttaaagacacatatagggtgaaagttataaaaaaagatgttctgtgcaaacagaaaccaaaagctaacagtagttatagttagatcagacaaaacagaaaaacaaagaaacatcagatttaaacttcaccatagaacaaatggatctaatttacaaaacatttcattcaacagttggagaatacacattctgcacatcagcacatggaacattctccaggattgacatgttaggacaccaaacaagtttaaatattttttaatcaaaatcatatcaagtatcccattgatcacaatagaataaaatgataacaagaggaacatttgaaataatacaaattaatggaaattaaacaacatgttctctaataatgggtgtaggaaaaagttaagaatgaaatttaaaaatctcttgaaacaaatgaaaatggaaacacaatgtaccaaaacctatggaatgcagcaaaagtagtattaagaggcaagtatatatcaataaatgtctacatcaaaaaaaactagaaaaattgtaaataaacaatctaacaatgaatgtctagaaaagaacaaactaaatccaaaattagtagcaaggaagaataaagatcaagcagaagtaaacaaaattgatactaaaaaaatttttaaaaatccacaaaacaaaaagttgggtttctgagaagatgaaattgacaagccattagctagactgaaaaaaaaaaaaaaaaaaaaagagagtagacctaaataaaatcagaaataaaatcaaagtcacaatggagatcacaggaatacaaaacattattagagaccaccatgaacaactacactccaatacattttaaaatccagaaaatttcctaaaaaaaaaaaaaaaaaaaatccaggaccagatgtctttaccactgaattctaccatatctttagagttaacaccaattcttttcaagctattccaaaaaaatgaagcagaaggtattcctcccaaattatttgttgaggtcagcataaccataatatgaaaagcagacaaggatataaaaatagctaaacagaaaactgcaagccaatagcctgatgaacagagacacaaaagtcttaaacaaaatactaacaaaccaaatccaacaacacatcaaaaagataacacaccatgattaaatgggagttatctcagaaatgcaaggatggattaacatgcaaatcaataaatgtgatacatcacatttgtagaatgaaggacaaaagccatttatcaatacatacatttgacactaacatcctttaatgatttaaactctaaattaattaggtataaaaggaacatatctcagcataatggaggtcatatatgacaaacccaaaacatcttactgatcagtgaaaagctggtatctttttccctaagaacgagaaaagacaactctcacctgtcttattacacatagtattcgaagtcctacccagaacaattaggcaagagaaagaaaaggaatacaaattggaaagaaagaagtcaaattatctgtacctagatgacatgattttgtacatagaaaaatctagagagtctaccaaaaatctcagacttgataaataaattcagcaaggttgcagaatataaaaatcaatatgaaaattaagtcacatttcaatacaggaaaaatgaactagctgaaaaagtaatcaagaaaactatctcatttacaatagctacaagaaacttataaaatacctaggaataaatttaaccaaagaggtaaaaaaaaaaaaaaaaaaactccacaatgaaaactacaaaacattgataaaaataattgaagaagatacaaataaaaagacaccccatgctcatggattagaagaatattgttagaatcacaaaactatccaaagcaatctgattcgattaaatctctatcaaaatgtcaaggatattcttcaaataaatagaaaaaaaatcataagatgtaaatggaagcacaaaatacttcaagtagccaaagccatcctgagacaaaacagcaaaactgaaggcgtgacgctaccagacttcaaaatacactacaaagctgtagtaactgtaaaacagcataacactggcataaaaacagaaagagaccaatagaaccaatagagaatgcagaaattaatccacgtatctatagccatctgatttttggcatgggtatcgagaatattcactgttgaaaaggtagtatctttaataaatggtgctaggagaactggatagccacctgcagaagaattagacccctgcctccaaccctatacaaacatcaattcaaaattaatcaatacctaaatatacagtacagtcctcagaaaaatggcatatagttacagatcaatgaatgccattattgttttttattctaattttaattaatcatactaatcttgatgttgaggagatagaataacatctggcagccttttatttgctaatgttaaacaactaaaaatagctttaaaaaagttaaaatatccaaatgaatgacaatatttgatttatataaaatgaataagtcatattatttaaattttagggtgtttttgctcctaattttttgttactctacttttcatactgatttagcacctcttaaaaacataccctctcttccttctaactagtttcaggaccctattaccttgacctccagtcatctctctgagtcaattccattgagctgggtgaattggtggcttggcccaaacttcacctcaacccagtctctctttgggcaggaatcaaagtccccccacaggaaggaatgtatctttcaactcatgtgccatttttgcagaagcttttcagacacctcccttaccagtgaactcagtttcccaccctttagatggctgtggagtcctgcatgtgccgcattcggataattattcaaatgaagtacacttaagagcttgcattgtctaaaggcccaatgattcatgtaactcccctatcagcacaaatgagaagttcctgcctgaatgcagcagatggaaatggaaattacagactttggtaaggcagactatattgcagcttaatgatttgcattttaaaagttgggagttctcataaatactaaagagaaagaacaacgggctatattaggtagtttcaggtgcttgtatgacctggtgctaactatttaacctgcctgagtgagcctcagtcttcgttactgcagcatttgtaagatatcaatgcctgtttgaattcatgtcttactaagctgctgccaggattgagtgacatgtggatataataggacttcaggaattacagtatttcataaatgcagtaataatctgttacatttgtaacacctatacgcttttctgtttctatcttcatatacaccttgaagttttttttcatcataatcaaagatcttttcttgaggttacaataaacgggatttaacccataagcagcaatgttagcaattttcaaatttcttagacatgttttaagttttacatttaaatcagtgacaaaattgttgtcagttttggtttgtgtcttccaaaacagtgtctcaggcacttgctctttgatgagacactgtgcaaacgttgaaggatattagaaaacagaacagtttgtttacctcagctttttgtggtctggataatttgcacactgcttttcaataagctgatttgtcttcttgtttacataggctgtgctatagccatttaaagttcaaaattactgctaaaaggtaattgatcctctacttcaatatccctgctgtttcatgagctctctaacaattcgaaggaatctatttctcactgatgttgaaaaacataataaggtcacagcagggaggctttagcttcattaaagaacattattataaaaataaaatgatggagggcaaattgtttttgtccttgtggtactgtttctgcagatccacattaatctgaacgtttaaagcaacaataaatttgttacgtcctctttatcattcacttcaccatggtagcccctagtggtagaaggagatgccaattgctcactgctcaggttccaggggatttcttcctcagttgaataagaaggagttaagcctctttagaaaggagggctatagcctgtcgataactaaatttattcctgcttttaacatatcagaattctgatgtccagaaaatgtagatgccagcattatttaaaaactgagtagagaagtgaatagaaattttgacccactccggcttccatctatcatgggagcctataacgcaggatgaacgaagaaggatttaagatagaagatcagtgattgctctattaatctagtttaactgatactaaaatctgacagagcgaattacaagttgcaggcactaaggcttatcaattcattactactttcaaggctctaccttgctttctttttgcctttagctcctggcaaaggacagccttttacagttcaatttctcagtttatttttgactgcttttaattaaatttgatggcctgcttctgcaccactgaagttattggagttgcaaagcactttgctgttataatgatagctcccttgatgtctgttcattattaactgcttttcaaaagtgctgctttcaactctcattttataaatatttaaataattgtgaatttctataacataaatgtctgtgcacataagatagggtttctgtttgcctgtttaatacatagtaaaatagaaatctctttttgtaaggttatataatattaattaagaatgtgtccttaattcattcctaacataaattctcacatgaatagcagtatctcaaaataataatgatttaagagctatgacactcacacatataattaattctagtaaaatatcttagaatgatttttttaatatatagattaagaaagtcctgattctttctggtcttaagatgaaatagagtatattcaagagaacttacaaattacataatagttttactgctcaggggaaaaaaatggcagaggataaaattaaaagccctgatttttttttttttaaacaaagactgatgaattaacagtaggtatcaatctcttttccttctccaagcttcagacaaattatgggaaaataatttttaaaaagccaatttatagaagtaaaaaaaaaaaaactaaagatagtagaaaagacaatagtgtaattgagagcagctgatattatgtgtcccacactgttctaattcatttagcaaccataacattcctatcattacctccattttataaatgaggaaatggtgaatcattaagcaatttgctgattatcacatattcagtaagtggcaaagctagtattcaagtccaagcagtgtcgttgtaaagtcatacacttaatccctgtgccataattcaataaattgtggaggatgggaagcaggtggagaaatgattcatatagcagggctgagaaagtactgcctatatgcccacagtgtggagcccccacaagaagttagcaaatcactcagagaagctgtgagcaactcaccacttggaaaaactgagtgctttagaaggcacgaatgaactgcagttctgaacagagaaaaattcatcaagttctaaggtggttgctctctcttcctctacagtgggcaattacctcttcattcccatcacctccctttctctcaatcccttgaatccgaagtatactattctgtgaataaattaaacctgttaaatgttagattttgatcagagctattattggaagttcacataatcaagggacctgtaaccttctttccctttttggtttctagaacaccaattatattacccaagcccccattctaaaattcccttgtgaaatatgaatgaagagccacagatcatcagcaatggaagcaaaatttcagcatgagtagttgagacctacagtaacaactaaaaaggactgaaatagagataatgtctataatcaaagaacagggaaatattacacataaccaatgttggagtgagaaaacagtatgtgttgtactaaatcaaaaaatgaatgctataaaaaataacaaaaaagttattggaaaagtatgaaaaataaaatttaaaaaaccagtagaacataagacaaaccaaaaacaagaacattctattaaaaacagggggaattttatctttaaaaaatggtattgtcgtgaaaggcaagaaaagctggagaggttttccagattgaaggggactgaagagatatgacaactaattgcaatacatgattctaggttggactccatgctggaggaaaatcatgctataaagaattggctcaattgatgtaatatactgctagtattctaattctatcaaagtattttatcaatgtcacatttactgaatcttactaccatactgtaggtaagtaagactatctttatcttagaaaacacacattgaaatatttactggtgaaagaccatgtaacgtaaaatgactaaggaaaaaaaaaggactgtgtgtgtggggggtgtgtgtgtgtgtgtgtgtgtgtgtatgtacagaaaaaggaagcaaataagacaaatgttaactctacagataatctgggtaaaagatagtgaggtgttgtatatttttacaccctttctgttagttttttttttcaaataaaatattgtaatgaatagaagagtggaagataaaaatcaagaaaatctatcaaaagttaaaagaaagacacaaagagatggaaaacgacaaaagacaggaagaggagagcaatgcagaaggtccaatggctgattaatcattaaaaaaatatttgtgacagttgcagttgataagactaaattatcaattaaactatagaagaaaatttctgagcacacacaaaaaaatcgatctccaaacgaaatcagttccacacaaaggtatatcaagaatttcagaaatgcttaaacgtttcctacaaagaaaaagcatacaacaaaacaatttaaaaagtaaaacaagtcatctacaaacaaaaagggaatcaggctggcatcaaagtgatcttttcataattgtgagcaagaataatcttcaacttaaaatctcaagaaaatgctcaatcagatggaagggtggaggaggtaagctcattgaagagaagtacacatctaaaatgtatacttctcatgggccgtattttttagaaagatactagaagttgtacttctgcaaatatgaggtattgaaatcaaggagaatgaagtgcgatctaggaacaagaagtccaacagagaaaaacaaagacagggagtcttagagagcaaccagtgagaggggagcagaaggatgaaaggctagaggagtgaaatctaaacatatgaaggatggaattaaaatattttcattattttgtatatttgaaatttgaaatcatcactaacaactttataaacttcaggaaaaataaatatattgtgctaaaaatgtaaacctagagaataatatttatgtagtcataatcatgtaaataggaaataatgatttcaccagaaacaacacattgagagaatagtgggaaaagagtcctgtaattggtgcacctgtcctaattcctatgtaggcatcataatagaagttattaggtaatgtttaaagttgataaatcaagataataatacaagcatattaaattaaaaacaattaaggtagttaccaaaaggaccagatacacgagctaaacattgctttctctattgaacaggactatagcatagagaagtgtcaaacaagctgccattattctgttgctgttattataagcctcttaatataatactatttgattactagatcatgagctcctatttataaaaataaaagcaaattttaaagttataacaactcatgttgctacaaaagccctaaagtcatttcaacaatacagcacactgatgacactttccttgcccgaaacactttccttgcctttccagtacgctttcactttcctttccttgtttagaaactttttaaaagaaacatggtcctgtgttacatgtaacatgcttttgaaataaaaaccatctcctatcacaaggagtttttaaaagagcctagatgttcttattgtccttcgtatctctaaaaataattgctttaaaaattagcttattccctttgacagatacttgaaagctaaagttttgtgggattcagtacaaggataggcataccacatatctctactttttatgaaatttgttgctagtaatgttagaatatgtttgaatgaagcaccttctgtccttgctttcaactcctagctagagtgcatgaaatactaatcatctcttgtgttagtaatagaatttgtaaatttccacaaataaaatatgtttactataatttctaaatagtcaataccgagtagcaatacctttgactttagcagctggtatataattgtctatattacagtgtttatattataactagtatatattacagatagtgttattcaactattatagtaggttgtagcagtacaaaattaaattatcacaaatctacaatttgctcacaaatttttagtggcaatgatcacttatactactgtagagaggcagtagttgcccatgtgctgcctaaaatgtgagaaagttcttattacagggtaggataaaattgttgccttactaaacagaaattcacatatttccctctccagaaaaacaaaaatgtgtatatttaatatagtcaaagttgagtttttaaggtaatatgtcatctctaacaggagggtgactgctgaatgtttggtatttaaggtcttacatacaggaccttgaaggaggttctatattatataaataatctttgaagagtgatttatggttttggataactaaaagaatatgtgcttcacttcacattagtttttttaaagcatgtttttattattataacagtaatattaaatatagtggtcttttttcagtacttctcatttttttcagcattcagatgacaaaattttttaaaaaaaactcttctaccttacctacctgcataactaaactgagattattccttctctcactcattatgctaacttctaatgtcgtgtctcaaaaaattttcttctatgcaccttttttccttttatctttgtttcattgtaatgctagatagatgatgacttgtgagaaagaatctcaaatctatatactaatctccctttgtttgtttgtttgttttgagttagggtctggctttatcacccaggctagagtacagtgtcatggtcatggcttactgtagctttgaactcctgggctaaagagatcctcccacctcagcctcctaagtagctgggagtacagatgtacagcaccatgcctagaaaattttttttaagtttttgtagaaatggggtctttctatgttgcccaggctggtctagactcccaggctcaagcgatcctcctgcttcatcctcctaaagtgctgggattacaggcatcagccactgcacctggccaacttctcttatacgttccaggcttgtacttctaaattctacctatcttatacttacctaatattttcctaagtcaagcccttgaaaactcagtatgagcaaaagaaacattaatattttttgagaataactgtatggtagtgttaatcatctcagaagaattgctgggaaacagtacaataaaacaggaaaaatagtggatattaagacagaaagggatcatcatcatacaaatttttagttgtatttgcccaaattgtgttgaaggggataaagccagggaatatggaaagaaaaaaggaagatatcaaggaggctatgaaagaggactcagatcttggaacgatgtatttttttcagtaaatacatgatgaatgcatacaacagagaaaaagagcagaaaagagaaagaaaaaaccaaactctatgatttaaaatttcactgaatgtgaagataattgtatcattaaaataactgagaaagggtagaaataaaaatcataagcttcaaatatatatgacttattgttgacaaaaatgatagttgaaagctaaagccaaaatttctaactagggttaatgtgaagatttcaagagaaaatttaataaagaactacttatgcaagtgttttgagaaatcaaaggtatagtttacccatgagcatttgtttagagagataaaagtcactgaaataaaatttgtattttaagctgtacattttcagtgttatatcataaattggaattgtatttattacaaatggaaaaagctttcctgtagcacaccaagattagttttaataggttcaagaattgttgatttgtaaccttaagactattagtgttgtggaaaattaaatataattaggtattgcaggaaaaagtgttcattgaagtttatattttatatgccttaggagattaattttgcttattagttttgtgatatttaagcaccgctataaacatcacagattttgtaataaccattatatacttaaccagtataaaatattgagtatttctatattagaatatttaaaagcatttctacttgtgatttcactgggggtacaacacaatgtaaactatacccactgctggaggaggagcatgaaataaagaactcttcgggcgaacacttaaaacccacctaaatcaatctctgtgttttcttttcagtattaccttccattattactaccctttattatgaaagcattgctagctgtcctttcctaagtgccctctacattcaaattcaccatttctgtatgtactattccctacatctgcaatgccattcccagcccacacatctgccctattggatttatatcaaattcagctttcctcaagaagccttctcagttgctttaacaaaaattactggtctgtcttctggaaaacaattggtgtctgatctctccttatcttttagcacctaacactaatagtatagttatgtaaaggaatgcgtgtgtgtacataataacatactatttagtatctaaatacaccgtgcatctcctatgatggataaattacaagtatattattaatatctatctatttttcccatacatctaatgcagtgcaatgttcatagattcttaatattgtttgaaatattgcctctttctttagtcattgagagccatctttttcagagtcaatttcattcttctagccctagcttattttcatgtcatttgcattttcttgagatatgtgaataaaggacacgggaagaaaatgcagttgagaggttggcgagtagaaagctaattcactcagattttactacatattgtttggaagcctaagttgtttgggtacaactaacataaaacttgtttttatgtattataggcatatattcttaaatgactaatgaactctgcttcatgtgaacaacgtttcatcttctgatcattttcaatattttattacactttgaaaagtattgtagtgctccagaaaatataatgtcaaccgttaaaattcaactttactacagttgttggcaatattaaataacttttgttgctgcatgatgttagctgcagcttaaatttcagatcatgaagtgttattaatattacatggttagaattaatttccagatcaatgaatcaatgctatcttaatattctttgcctttaaatttcataccacattattttgtgagtggatttcataaaaggaagatgctttatgttgccaagctcattatcttgagtttttgtccagaactgaattccctttgttatcaaaggacagagagagcaccttaaaaactattgaacaatgctgatttgatgggcaggcaatttacattaaacttaaaaggagggaattttctttgcaaatatgtaaagatcacttacacaaagtaaagagatatttcactatgggaacaacaacaaagacagactcacaatgccataaagtggaaaaaatgattaacatggaaaaatccattactactgttattagaatattaactaatctgaatattttatttgtaaactcgactagtgatacctgaccttgtatttggtgaaagaaaataaagaacaaacttaatttcacacctaatacagtagcagtcatctctctctctatacacacacacacacacacacacacacacacaatttgcattttggaagaaaacttaattttttgaagccagttattttctttaaacttgatgctttggtaagctattatttcacttggtaatatcaattagttttcacacttataaagtacttaaacatttataaaatatttgtaaaaggctttcacaaatacagtagttgatttataaaatagagactatttagaacaaataaatgatttaagtctcagaggttcgaagagacttatatgctctggtctgtataactcatacatggcagagtagataattgagcctaagcaatagataccatatctgtccgctatacctattttactatgtcactaactctgtgatccttctagtctccacttagtgtttgttagctcccacatttaggatgtgcatactgggggagaagaacacaagaaagaatgatgaaggattatcaagagtaaattaacaattaaaatgcttatattcacaaacttgcccctttggaccagtaaagttaacttgagtctactcagtcaacctgggcagcccttcctctataccccttgctatcaaggagtattttgctttttgaaacttgataatggggagggccagaagagaaaacacttgttttttgagacagagtctcactactctgtcaccaggctgaagtgcagtggcgtgatcttgtctcactgcaacctctgcctcctgggttcaaacgattcttctgcctcagcctcccatgcagctgggactacaggcatgtgccaccatgcccagctaacttttatatttttagtagagacagggtttcaccatgttggccaggatagtctcaatctcttgacctcgtgatctgcccacctcagcctcacaaagtgctgagattacaggctcaagccacagcgcctggccaagaaaacacttttaaagaggtttctgaaagagacagggcctggataaggttgatttaataatggaggatgtccctaggaagtttaaatttaaaaagttacatagagctatgtgatgaatgtggtctacttgtactacatcatgttctacaaagagaatatgagttattttgaaattacagctggtctgttttcttttgccatagtactgctctgattttggatgacatgggtcacaatataatgaggacaccagagataatggacagtactcatactcaaggttatactcatttaccacctagttcaggagtcagatactcagtctgtaggaaacaaaacaaaacaaaacaccagagcataagaagtactatgagataaagcagagctataggaatacactacttagggctgggagctccaggagtatctacctgaagaagttacacaaatgagcgctcaagggaggaaggaaaaaccagacatcagcactggaaacagtttaggagacctgcagttcatttggtatgttgatctagtacacaattagagtgtgcctttggttagagtcacagaattgggaatatcgaagccatggacataagtgagatcattcaaatagaacacacacagagaataaaaagggcaagaatggacctggaaaccacagtctatggggaagacaagaacagagaagtctgagaaagagactgttaacaatatttctacagagtttatttttaaaatgacattttcacataaaaacaatttcttgtatgtttgagttttcaaatgtaaacaaatgtacaactcattcatgtgtcactcaaactggataaagaactgcagaaaaagcattgaaacagaagtaactttgaatatttgataaagaaaaatcttattgtgattatataatgtaatttttattaaaaatgcagtattttaaagtttaagtatatgatgaaagatagcattgagtatatcagtatggctattctgcttacacttgacacaaatataatatttaaatttatgaaatatgtattatttatacttttccacaaaatgaagcagaacaatataagtgagcataatatgtatgtttatccatgtaaataggtcaattttgattattataaacactattaaaagcacatttctgtatggttacccttgaagtccctactcaaatttctttccttttaaaggactttacgcatttactagataggaattactaccatgactctcccgaattcataattttccttagtataaaataaaaatatatttaaatatgcttttaacacaaatagaattttactccaattctgtattataacttgattttaatccctctagaaaatatggtgactattttttcacaacctcattattcttctatcctatttttatgaaacaatttaattgacaattttcaaaattagaagttacttttttcctatagaaaaaaattgattgtaacaacaagttaaaaataaaaaaaagaattaaaaattactggggaggagccaagatggccgaataggaacagctccggtctacagctcccagcgtgagcgacgcagaagacaggtgatttctgcatttccatctgaggtacagggttcatctcactagggagtgccagacagtgggcgcaggtcagtgggtgcgtgcaccgtgcgtgagccgaagcagggcgaggcattgcctcactccagaagtgcaaggtgtcagggagttccctttcctagtcaaagaaaggggtgacagatggcacctggaaaatcgggtcgctcccacccgaatactgcgcttttccgacgggcttaaaaaacagtgcaccaggagattatatcccgcacgtggctcggagggtcctatgcccacggagtctcgctgattgctagcacagcagtctgagatcaaactgcaagacggcaacgaggctgggggaggggcgcccaccattgcccaggcgtgcttaggtaaacaaagcagctgggaagctcgaactgggtggagtccaccacagctcaaggaggcctgcctacctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacagcagagtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaatgcagagtgcctctcctcctccaaaggaacgcagttcctcaccagcaaaagaacaaagctggatggagaataactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctccagaactacgtgaagaatgcagaagcctcaggagccgatgcaatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctaccagccagaaaagagtgggggccaatattcaacattcttaaagaaaagaattttcaacccagaatttcatatccagccaaactaagcttcataagtgaaggagaaataaaatcctttacagacaagcaaatgttgagagattttgtcaccaccaggcctgccctaaaacagctcctgaaggaagcgctaaacatggaaaggaacaactggtaccagccgctgcaaaatcatgccaaaatgtaaagaccatcgagactaggaagtaactgcatcaactaacgtgcaaaataaccagctaacatcataatgacaggatcaaattcacacataacaatattaactttaaatgtaaatggagtacatgctccaattaaaagacacagactggcaaattggataaagagtcaagacccatcagtgtgctgtattcaggaaacccatctcacatgcagagacacacacaggctcaaaataaaaggatggaggaagatctaccaagcaaatggaaaacaaaaaaaggcaggggttgcaatcctagtttctgataaaacagactttaaaccaacaaagatcaaaagagacaaagaaggccattacatagtggtaaagggatcaattcaacaagaagagctaactatcctaaatatatatacacccaacacaggagcacccagattcataaagcaagtcctgagtgacctacaaggagacttagactcccacacattaataatgggagactttaacaccccactgtcaacattagacagatcaaccagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaaggtctcctcagaaaatgtaaaagaacagaaattataacaaactatctctcagaccacagtgcaatcaaactagaactcaggattaagaatctcactcaaagctgctcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaacgcccacaagagaaagcaggtaagatccaaaattgacaccctaacatcacaattaaaagaactagaaaagcaagagcaaacacattcaaaagctagcagaaggcaagaaataagtaagatcagagcagaactgaaggaaatagagacacaaaaaacccttcaaaaaaatcaatgaatccaggagctggttttttgaaaagatcaacaaaatagactgctagcaagactaataaagaagaaaagagagaagaatcaaatagatgcaataaaaaatgataaaggggatatcgccaccgatcccacagaaagacaaactaccatcagagaatactacaaacgcctctatgcaaataaactagaaaatctagaagaaatggataaattcctcgacacatacactctcccaagactaaaccaggaagaagttgaatctctgaatagaccaataacaggatctgaaattatggcaataatcaatagcttaccaaccaaaaagagtccaggaccagatggattcacagctgaattctcgcagaggtacaaggaggaactggtaccattccttctgaaactattccaatcaacagaaaaagagggaatcctccctaactcattttatgaggccagcatcattttaataccaaagccgggcagagacacaaccaaaaaagagaattttagaccaatatccttgatgaatattgatgcaaaaatcctcaataaaatactggcaaaacgaatccagcagcacatcaaaaagcttatcaaccatgatcaagagggcttcatccctgggatgcaaggctggttcaatatatgcaaatcaataaatataatccagcatataaacagagccaaagacaaaaaccacatgattatctcaatagatacagaaaaggcctttgacaaaattcaacaaccattcatgctaaaaactcaataaattaggtattgatgggatgtatttcaaaataataagagctctctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagaagacatgattgtatatctagaaaaccccatcatcgtctcagcccaaaatctccttaagctgataagcgacttcagcagtctcaggatacaaaatcaatgtacaaaaatcacaagcattcttatacaccaacaacagacaaacagagagccaaatcatgagtgaactcccattcacaattgcttcaaagagaataaaatacctaggaattcaacttacaagggatgtgaaggacctctccaaggagaactacaaaccaatgctcaaggaaataaaagaggatacaaacaaatggaagaacattccatgctcatgggtaggaacaatcaatatcgtgaaaatggccatactgcccaaggtaatttacagattcaatgccatccccatcaagctaccaatgactttcttcacagaattggaaaaaactactttaaagttcatatggaaccaaaaaaaaagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgctgcatatctacaactatctgatctttgacaaacctgaccaaaacaagcaatggggaaaggattccctatttaataaatggtgctgggaaaactggctagccatatgtagaaagctgaaactggatcccttccttacaccttatacaaaaatcaattcaagatggattaaagacttaaacgttcgacctaaaaccataaaagccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctaaaaaatgggagaaaattttcacaacctactcatctgacaaagggctaatatccagaatctacaatgaactcaaacaaatttacaagaaaaaaacaacccaattaaaaagtgggcgaaggacatgaacagacacttctcaaaagaagacatttatgcagccaaaaaacacatgaaaaaatgctcaccatcactggccatcagagaaatgcaaatcaaaaccacaatgagatacaatctcacaccagttagaatggcgatcattaaaaagtcagtaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacccgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgtaattggaaatcatcattctcagtaaactatcacaagaacaaaaaaccaaaccccacatattctcactcataggtgggaattgaacaatgagatcacatggacacaggaaggggaacatcacactctggggactgttgttgggttgggggaagggggagggatagcactgggagatatacctaatgctagatgatgagttaatgggtgcagcgcaccagcatggcacatgtatacatatgtaactaacctgcacaatgtgcacatgtaccctaaaacttaaagtaaaataataaaaaaaaataaaaaataaaaaataaaaaataaattactatattggtctcttttatcttttttctctatatacacataaaagttatcttataaagacattttaatccaatttctaaaatttaaatatatgcctgctccttctttcatgtcagaagtattttttctcaagcatgtgttttaatagttccatagataaataaaaaaaaaaaatagttccatagaattttactattagaaaaaatattttataaattttatacaagtatatatttgggctatttatgactataaaaacataattctgtttaaatattttcagatattcctaattatttactcacattaaatcacaagatacagaattgctatggaggagggattgttgaggtatttcataaatagaccaaatacttattacatgtttcttgtatctattttatagcatttgtcctagtactgttgatgagtttatcttctttactattctttgaaactgtggaagacagattgcatgtgaattacccataagttatgtgtaggcccaccatgtagttcttacagtgtatgaaaatcatttaaaaaaataagctgtataatacatatatttcattccctaaactgttattctattcagtttaccaaagtttcatattaatgtttctacatgatgtgattaatatattctggctatggatttctgaaggtacagactcagagtggatcataactggaattggaggcagagatcttacctcttgtaattttaagactggtaatcgaggagtcttttgagttattggattatctgcttgcccttattgcctaactctggaaatgacaaaacctgaggtcctgaagggttactcggccctcaggtgattaccagtaaggtggcactgaacaatgtgtcagttgaaatgcttaatgataactctggtttcccactctggatcactactacaaacagctttcagtcttatgaggttctagcatttactctacttctagctcagatattttgatcctcagttcagaaagaaatccattcatagttacctgttctacaacttgaaattaggtggattaaaaagtatatgcattgacctaaagacactatcgaattttaaaattatactattttaaagaaatgcagtgttttcgtattttgaaagcgtaaaagggttgatggagttacatcattaattctgtagatagaagtccaaaaaatacacatcttgtgtcatgggaaactagcatacccagtcatactgaactcacctggagccgaagcccatcgcttccctcggtgccaacatgctgtcagtcagacacctctaactggaatatcacgggccaggaactgcttgccttttattttccacctggaacaaaacatagtgtcagtcatttcttcatgttccttgaagcacaataagatattcattatgttatcttttcctgtcacattagacactcatttatcagaatgctcaacacaaaggaaagaagtataaactcttcacctctataatttacatctgagggattaatatagcacctgtataagtcaaagggaccatctatattttatctcctataaaatcttccttataaaaggttatttattacttgagcacaatcattcctatccatttggtataagtaattgatgcgttaatttaagaagccattttccatatagtgtccttggaaacagtaaatcaaaatacatttttaaactccagagagaagctgatgttgaaaataattcattttctgaattcctttttttttttttaaccatgaaaaggaatctcagtaggaaacagaatgtgataatgcaattgcattagttttatgcctatgctcttttgtatttctcaacttgagagacactgataaagaacactgatgttttctcaaacgcaccagagtgttgctactatggaaatagaccgcttgacctcatgataaaaattataggcttgacgaaaaccatagagcagggctcctgtatgaatggaatgtgccaggtagggtcttgtactgcacacaaatagagctactgacctttagtattttagccttgctccagtttggtagacaactgggtggttgtaaggaactctaaaaatgcaagagatgcagcactgtagcagtcttcttgtggcttgtgcagtctttgatttgtctatgtctgcctccccaagatttggagtttgttgctgaactgaattcatgatgaagatcctgcaatttggtgacctcctttttgatgctcactgcttatctgaatcttcaaaaccaggattgaccaggtcaataaaacctatttcttgatctaactgccagagtacccatttacctcttgttgtacctacttggtattaattgcttgcttggatcatcacctgatgcctggtaacaccctctgtgaatgaatcatgtggctccctgtattttggtaaatgcagtgaaatctgtcttctggtgtcaagcttggaaccacttattttgtctcatcttgctaatactcatttagcttaagagttttttctatgcagtacgatgtgaagggctcaagaaagtcccaccagaattgcttaatgtaaatcaaaccttaagagcaaatatcattctctccttgtagccctttttaatctcagatcattctggaatccactttatcaccttcatttcttctgctactgccacaataaactttcatcagttctcacttagataataacttcctgaatatggatcttgtgccaggtgaaaacagatggcactttcaaattagggtaacttgagtagagcttaataaagaactcatttataaaagtgtgggctgtatgtggggaaaccacaaggaaggtatgatggagttgataccatctctagacttgcagggatgaggggagtgagcagttactgacatctaagagtcagatatatagtgggcctcttggagaggagcaatgatcttggtttgggagtcacaggtagcgtaagatggcagcacagatggaagtctgaggataaaggataaaccccgctcatcttctcccttacctctggtttcttgactagactacctatgggacaaacctcactggaagcctgagtgctttggagcctgtcaatgaactccatcaggctagttgccaggggaataggataggaaagaaagagtgagtctaaaggaaaaacggaagagatccagctaacactcttatgcatacttaatggggtttgaaattagatttgagtcctatctctacctagatgtataattctagaccgataacttttataaatcttgatatcattatctgtacaacagagataatacattcttctgagttttgttaaattaaatcgcatagcatacctggaggctataatattaacaaaagtgtcaacagctctcctgttgaaatacaaaaataaatcaacaaacacatatatgctccagtcatgctgagctcttcaccacttgttctaattgatcatgtattttcaaacttctgcactttcgtaagggttgttccctccgcttaagaatgatttctcttcctacatttcaaccctgatttgcctagaaaactcttgctcatattttacaatctatgagatatgatctgaaggctttctccagctttttaatcaagaaaaggtgaccattcccttcttgttcttccatggcacacagctctccacaaatcacttagacctgggggtgggcaagcttttggcttccctgggccacaccagaaaaaaaaagagttgtcttgggctacacataagatacactaacactaatgacagctgatgagaaaaagaaaattccaaaaaaatctcatgttttctcatgttttaagaaaatttgtgaatttgtgttgggctacattcaaagccgtcctgggccgcatgctgcctgtgggctacaggatggacaagcttgatttagatcatgcctggcttcctatatgactatgagggaagggaaaagctatgtctgacagatttgtatgctcaaaaggtggttcacagccaggttcttaatattcaataaacattaagtgaatgaagaaatatgtgtatcttattttagacagtctcactctgatgcccaggctgaagggcagtggcatgatctcagctcgctgcaatttctgcctcttgggttcaagtgattctcctgcctaagcctcccaagtagctgggattacaggaacccagcaccacgcctgggtaatttttgtatttttagtagagatggagtttcgccgtattggccaggctgttcttgaactcctgacatcaagtgatccaccggcctcagcctcccaaagtgctaggattactggcgtgagccactgagcccagccaaatgtgtatatctataataaatttgtcacaatgtaaggaaagggttcagtaacttcaatcctcttttcccaaaggacagatcggcctgtgacaactggtgcatggtggagagtagaacaactctgaagaagaggtcccaaaggaaactccagtcacttttgtaacttttctctgggaagccttgctggaaaattcatgtcattcattccaaggttgccaaaagcactacaattgattgatttccagaagaaaaatcagtagttattagctaactatgacaacaaatacttctgtgtatatctaatgtatttgaatgatttaaaataaagagttgaatctccaacattttctgaaagcccagccaaaagttctaccccacaattgttaaaacatttattccattttgtgactaggtaatgaattcctgtgaatcatgaatctaagccacaggaaatagtacacaggacaaaatattactctcacacttgcctccatgcttcccatttcccaccctcaccaaaaccacattgattggcatctgtgtgtctttgcaaaatttccttctggaaatacaaacgaatacaaccatacatatattcttattctccacctcctttaaaaaaattcaatgatttaccaatattatgggtcttacatttttcacttaaagttaggtgggcattatatcagtaaataaaaagcatcttcatcatcttcattattttcagctttatgtttttctattttactgatataccataatttaaccagcactctccccaaaacgatttaaaaaacccctttacctattaaagagtttataataaattactatttatgcatcaatttgtatataagatgtacatctgtagaatagatttctataagtatgtgtaggaaggtcaaggggcaaatgaatctgtaactatcagatatagtgcccaatttccttccttgagaatcaaactaatttgtgcttctaccgacaatctacaagattgcttgggtgggccgacttctacaattttgcaaatcttacaggtgaaaagttttatatcaatgctattttaattagcatttaaaaaattataaggtagtttgagcatgttttcataatatttaaagacatttgtgtgtatttttctgtgaaatttgttaatagctttgccattttttatccaagttgcaatttataacattctttatcatcctatacattttcaaaatgaatgaaagccattaactacgtcagcaaaacattgctctgagttgtttttttttttttttaaagcttttgtcccaagcttttcttgcaatcccatatatgaaaactgaaaatcacaaagcggtgccacagtgccctctggtggcattctgctccattgcatcttccctgcactaactcggggcaaaagctgatagtggatatagctggatgtcagtcttacataggctgttagcctacccaagtctccttggtcctgagacaatatcgtagtacaatcaaactcaaaatgaagacatattagatctgttttaacccttaaagaaccagattagtacctggaacttgttagatatcctaataggcaggattcatctccttcctagttgttacaaaagatggccttggaatattttgtcagagggctgcagtggaggtttattctaggcagtcaggctctgcttcattttcccctgtacagtagtcagattaaaagggctatcatcactctctggaatttttagtattcaatgtatcacaacgtcaggtcagtaagaagtttgaaattcattcattcattcattcccaaaatatttgaaatactatgtgtagtgttctaagtatttgtcaattatgttattgaacaaatcaacaaaaattactgtcttcatggaacatatcttctagttggaggagacaatgaatagcgaacatgtaattaagcaaataatatgctatattagaagatattagaagctgtgggtttgtggctgttagatggcgatattttagtttaaaataaaagtgtagtcatttcaagaaagcaacatctgaataagaatttgaaggaggtacagaagctaattgtgcagttctctagaggaagagccttctaggaagtagaaacagccttaaacccatagcatgcttggtaagtacagtagacaactgaaaaatcctttttcaggattaaaggattctttttttccaagctgctgggagtgctgctggactgctagccccagctctcatcccaatctgcaaattgccctaagctgtccatgctccttcaccaatgtctcactaaatatatcttcctacatatttcattaacagctccattttactttttcttgatttttatcttcatgtcagagtatctaaaagttggaaaactcaaggctttagtcttcttttcttttaaatgagcccaacgactggtaaatacagaggagaaaggcttagcctgttagtcacaagacagaaaaccttccagtgacgttggctgaagcctttgttgagattgcattgcagctcatctttcctgtttgcccattcttgctttgttcccttctctttcacagatgtcaatcactacaaaactccttaacaacctatagtagatatctacttataacaatctgtctcagtccacctatttgaggagtagtaaggtatccagtgtgcagctgacaactcgatacaacatttattcattatttccataaacattttttgagtatctactatgtgctagcactaaggctggcacttaaaatacaggagtacaaataaaatgcacacacatttctttctccatatgaagctttaattatagtagagagtacaaaaattaaataagattaataaaaagattaataaaaagatttttttaatatgggaatgaggtaaattcttactaaggcaacatttgagtgaagacctgaaggaaaaaagggagtcaggcatgtgtataactgggtgaagagtattccaagaataggccacatgaagagcaaagtctaagaagagagcatacatagattgcttaaaaacagcaagaaatccagcttttttttttccagtggattgaatgagggaaagacatgaggagagtaggtcagggtaatgaggagacacataatctaaatttgagtaagttattttaaaaactggagacattagcttttacttcaaatgaaatggaaagccagtggggtattttttgagtagaaagcagagaaggtccagtttggccagatgtagagatgagactgaaggaagttaaaatgagaagcagaaaaacaacaaaaaggcctactgtaaaagtctagaaaagagatgaatatgaccagacaagtagtggagaggtgttgagaggtagctagaatatggatttgtctgaaggtaaaaagaatttgtgagcagatttgatgtggtatgttaaaagaaattgataaagtataactgtatagttttagatctatgtaagaggttaccatttttcagttaaagttgattaccaagatagtggcttggatgggattattaggagatccacgtggaagtgtcagttgtaagatgcccgttaggcatttgaataaaactaatagggaggtaaataaacctgagattacggagaaaatatgcctggaagcataaatttggaagttattaggatataggtggtattataaacatagagatcacatgaggtcaccaaagggtgatgaaaggaaaagagatttaaaagaaaagaagactaaagccttgggtagtccaacttttagatactggtgatatgaagataaaaatcaagaagaagtaaaatggagctgttaatgaaatatgcaggaagtcagagagtggggtcccagaagccaaccaaaaacagtgattcaaaaagaagtgttctcctgtgtccaaggtggcagttaagtaatgcaagttgaagaattgcacattgcacatgcaacacagagctcatgggtgaccatgacaagatgtgctctagtaaaattggaggaggatgctggattgtaatcaagataatttaagaggggagaaattagagtacctacatatattattttcacacataaatagaacacttctgaaagtcaaccagatttatgctgaaaagcaaaccttaatacagttccaaaaattgaaatccaatagaccatgttctctgaccataatcaaaataagttaaaaatcagaaacaaagagcacacacacaaatctatacgtacctgaaatattttttaaaagatggttactgacatttgtaaataaccaaagaactattattgtaaaatttaaaatgatacaaattaaatgatataaaatttaaaatgatacaaattaaatgatataaaaactactatatgttagaacttgaggaagccttttggatcctttcccagttgggaaagtcatccttcactttcccaagctggacactgtttacagaggagtacttaaatctgccatgcatactaaatcattaccttgtaccttctaagataataaggctttgtggttttcttcttcactagattgcaagcagcttaaacacaagcaattatacatcttgctcattctcagcacttggcaaaatacctagaaaataggtggtactcaatacttgcttatttaatgaatgggtaaaaatgtgtggacaattaatcatgttacaataagtataactgagagatgcacaaagcactacatatggctgaaaacatctagcttagtgagtggcatgtaagaggttatacgttaaattgtgtcaaattaattaaaaaataaactccctcttcaaagtagctgcaaaataaacttacagaaagagtgcagggttcaatagctgattattagtccccagtagggatccacttctgattctggctgtgactttttgcctggatcttaccgaggcacactctttttgcaaagggaaacatattctttccttactgcaggtctccagaccactgctcccccaaccctcctgcatcgacactggcttctgggagaacagcttgatcagaggaaaaactgggaactatctcgcacaatacagagaccctctaatgtagtaacagacatctaagctctaaaagcacaaatgttgttttacttcaactcatgcctaaaatatcaagggattttaacgatagaattaaagcaaaactcaagtagttccactgaaacttaaaatatgctttaattgaagtgcaatattatgtgaagcagaactatgaatatttgctgacacattatcatttttacaatgcaaatgacagaatgaataacgattatatatattaaaatcctgattttggaagccatgcatagagttctatttgcttgtgaagatcagaaaatgccttagaaaaatgaagtttttatcccaagagccccaaaataccacaaaagaaatgatctttttataaaaaataacttggaagaactgaaaagttgacacgtccctttatcatgtattcctatatgtacaagaggcatattcagtacaatgagtagttcagctatacagatactctctcatttagttttcagtaaggtactttggaatataatggtacattttagatatccaaattcttttctagttatacttaacatgtgctctggagattatatatatattttatatatatattatatatattatatatgtattatatatataatatatattatatatattatatatatattatatatattttatatacatattatatataatatatattttatatatatattatatatatattatatattttatatatttttatatatactatatattatatatattttatatatattatatatattttatatatataatatatatattatatatattttatatataatatatatattatatatatattttatatatatattatatatatattatatatataatatatatattttatatatatatattttaaatatatattttatatatatatatatacaccatggcatgtaggtagtaaaaggtcaagttagattttcgttctgatttttggttctaaggactaaaatacttgaagttagcactgttgtgagaagttcatcttccaagagacttttcctataacatgtatgaacctaaaaaaaatccataaagagattcaagtaatggtgcctactaagcttattttgttaaatcagccatccctgacagtgaatatatctatttttagatagaatgaatcaagaaagacagccttatagggagcagatcagtagggaacttcatttgtctagaagttatctacgagtttccttgttgcaggaatatcctggtagcaagatttttttcttcttgactttatgaagaagggagatagatgaagaaaggtaaaaatgaagacagaggaaaaaggagaaagctcagaacatgaagagtagtcaagatttttattgttgattataaaatgtgttactatttatttgccttatggggtctgctcatcattcagggccctattcaaagtcaccttccttgtgaacatgaggctatcctcctaaagcacagtttttgttctattactatacttatgaactgcactgccattctctatcaacacgactttcactgtatctcaatttttaaaaaatgtgactatcttccctcaatagattgggatattctaggaagggatgtgtattccttattgctgccactcttctcccaaaatttggcctcaccgtactccattcccaatatcaaacaacatgcctgaaaaagaataagtcttactgaatctttggcaaataaatggcaggtgatgaacattttaaaaaatgtgagacataaaggataataaaagtaaaatgtagagataaattaaaagtccaatagctgcacttttagcctcaactctttagtgattggcttatgtatctgatgacacaatattctgcaaaaccttttttccccaaaggttaaattttaagggtaagtatgcaatacttagccaaaattgtaagaagtgtattcacttaatttctgtaatccaatggcagtaattctaggggcattgttaaaaagataagagaaaggagatttattagcctaacccaataaataggtagtattatattagatctgatctcaacagtaggtataagggcaaaaaagattgagtagagacaaattttatgacaataaaaagataattgcaaagaacaagatatggcagtcaaattttgagctatttgaaatataaataaagcagtagcattatctaaataaattaatattacagtgcaatgagaaacactatatctgatgcaatgtcagcatgggggggcctaagatttctgtggtgggataaagggtgaagaatacgagaaaacaagatgtagagcaaaaattataagaattgttcatatgtctcaaaatcagagaaagttcaaacataaggggaagagatggaagcaattattttatgtttaattacctcctccatgatctgtagaaaatattccttaaaaagtgtttcattaatgtttatgagtttctcattttttatattttccacaaaatggtagccattttctaaacactttttagagattttaaaaattgagaccaaagcagtgcatcttacacaccaaggcttcctaacctttaaaacattataagacttaaaaattatctcccattaacaccttcttaattatttgatgaaatccacattctatgatgttttttatttttaaatttagttgatttttaccaataagcaacaacttactgattgggataatcactcttgttttccttcctccatcttcatgtggatacttcttctttgcaacagccctcgtagggagttaatgatttattttcccagggataatgctactcacataccaaagggaaaaatcatacgacctaggttaagccaatcactacatccaggctcctagtcctactacggagtaggcattttctgaatctctacactttcattggaaactctggcaaagaaacaaacaaacaaactaacaacaacaacaaaaaaaatgctttctcattcttgacgaatggggagcaagtatgtagactcaggtcatgtgttatcttcagatcagatgtgacatcaactttagactgaagccaacactctgaagagcaagtagagatcaaaataaaggaaattgaatctttgatgaccgcattgagttattgaatcatggctcttctgaagccagtattatcaaaaaatttgtttgtagggtcaataaatttccatttttctgtaagtcagtgtgaaattgatttttgtttctgcaaccaagctatttccttaagtttgattcttaacataaagtctcttagttattcttaacgtaccatcatagtccagcccatagatatcagacacatttcctgtatcacgtcaggtttccctggccttgttttttgtcccagctgtcactgtgacaacgacctttgtgtgaactgtggctgactttatgctgacctaacctgataatgatttgtcttaaacctgtgcaacacacctctcgtcttctctctgggacttccatgtgacatccagatggggatgctgtgaattcttgtttagacagcaattatgtgcaatgtagaagtgtggggagttcatttcccaagaggcacaactttgacaaatgagctagggaagctggtggagaaatttctcacttttctttatttggaccaactgtcttaagacctagtttatttggcttttaagaagaaagtggaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggtggacgcctgtagtcccagctacttgggaggctgaggcaggagaatggcgtgaaccccagggggcggagcctgcagtgagccgagatcgcgccactgcactccagcctgggcgacagcgagactccgtctcaaaaaaaaaaaaaaaaaaaaaaaaaaaaaaaaaaaaaagaagaaagtggaagatcaaactatcttttatacccctgaatcaataatgcatctttttattattttcctcatttttccttccctcattcctattacatgggagtatggtctcaaataacagtagcagcacataatttctgttctaatttctgggaaaactaggttaaagcatttgaaatcaggcatagcagcagaaagctgactctaagaatagaatttgggggctggattactcactggtatgaaagtaacaagagattctatttctggtagtagctgaggtgatgataatccatggcatgtaaatgcgtcataagtaccaggaattttcacctcaggttaattagaataagatgtaggaggagggtgaaatatgtatatgtagccctttaatgtttcagggacaatggaactatgaggtctagcttctattaactgaattagaagctttgagggaaaaaaaagtgataagtcttggggcatccatctccaatctaaggcaagctataaaagcctaagggcctcaatggcagtgtttgaagatattcttatctcctaaaattaaaaggccgactgtgttaaaaattagacctaggttttaattatgaaagtggtaggcctgtaaacaccatctagccttaatatatttatgacaaagctatggctcttattgaaaaaatgaaacaaaattcatgagaaactatgtcctagggagggacacttgagcggataagcattaagaattttgaacccctaaattcttctgaatcctcctggctgttaaaaacagcaccccccaatgtttctgagtaaagtttcccctccccttgcctggagggcatacatggatattatctgagatgaatttcttacaagttaatgtcgttctcctcaacattccttcctacagcccctctatgccttcaggcaaataaccagggtgaggtttcagtatactttgaacggggaagtataattctgcatcaggaggaaacagattatacatcacaggaaaggtagtgcctagccagtatttatagcaggaaacaagattacatatgtagcagtcaattcagtttatgggactaaggtggcggagcaatgtaaagactaatatgaagagaatttattgatacccatcatttactcatgatcttaattgagtacttgggtaagaacacctggccctggcccaaatatatatgttggaatcacccccttgaagtctgcacacaattatggcctacaggaaatgaaataaagatgctggaatatttttggcaaagtattgaggagggacagaggctgaggatggtagtaaaattagaatggatttaccagacaagatctgagaactcaccacctgaaagttatgtgcctaggagagtctagaggacacaatcctaacacagtgaaaaagtacattggtgaaaggagaaatggtaactttgaagagctcaaacgtggctatgttcttttgtcctggttaaaggtgggacattattgggctctgtagtggaattctagaatgtaagaagccaggtgatggtacttaaacagaaggtgtatataaaagatgtaaaatgtgtaatgctcagcaacacgtggtgccttgaccacaggcatttttggcaacaaccgggaaatggtgttcctggggcaagatgtaggtataacaaacaaggatgttgttcaattacaaaactggtggaaaatagaatgatggtaagcagaaggccaacatcgttcattgcaatggaagattgtttctcactcgttctgacaatcaaattagttcacagaatccagagtacaatgattgaatggaaggctggttttactgaggaagaccagcgctattaactatatatataataactattctcccttccctaaagagtccttgcaccattttgccaggataactattcactggggaaaggtgaatgcccagaaatttaaaagatggttagaactagggtttaaacactgaagatagagtacctgtaatactgtcatgaacctccagttagagtgagggctatggagaccaggagataaatttattccaaatccactgcacagtgtttctgatctgttcacttatctggctgctatttcccttaaaaatgtaaatatttcttaaatacctatataagaatgatataattggcaagtagaagagccctcatactgcttctcaaacctgtggggtaaggaacattgtggaagccagaaaaaatcctatgcaagaatgaattttaggatgaactgcagaaattagtatcaacatcaaagacttgaaaaatgcaaaaggtggtgacccacatcatatgtctattagatttatccattttgttcatacagaaccaaaatggatggttaattctgtgtgtcaactttcctgggtcatggtgtgcagatatgtggttaacattatcctggatatttctgcagcagtaatcagtaaaatttgtgcacgcagactgccctccacgatgtggacaggcctcatcgaatcagttataggcatgaacagaacaaaagactgacctcacctgagcaaaagggataaaaagactacatactgggtacagtgtacaccattcagtaacaggtgtactaaaatctcagaattcaacactatagaattcaaccatgtaatcaaaaactacttatgccccaaaagctactgaaataaaaaaaattaaattaaaatagagggaattgtggacacacacacacacacacacacacacacacatacatacacactcacttttggttttgtttctctggagaattctaacacaatgataagctaccataacattaaacaacacgtcatgtaggatctggtatttgtactggagcaaattaacagtctgtgatattggtttatctgacttatgctcactgagatcccctcagtcccatgtttattgtaaccactgctgaagcaaccggttttaaacatattttaactagtttttgcaggtaccatctggcaatgctttatgtcatgctcatgctacatagctcactcttcccgccatagggttttatcgacatatgctacatgatgcccagaagaaattgtttggcatacacacactcaatgttgcaactagcctttgcagttgctttttgtgtaaagggaggatttctttgctgtgttttttaaaattatatttttccatccatttgctaccttgaaggactctaggtatatagggcacttgattgaaagagcaggctggttgcggtggctcatgctggtaatcccagcactttgggaggcggaggcaggtggatcactgaggtcagaagtttgagaccagtggggccaacatgatgaaaccctgtctctacaaaaaatacaaaaattagctgggtgtggtggtgtgcacctgtaatcccagctacttgggaggctgagggatgagaatcgcttgaacctgggaggaggctacagtgagccaagactgtgccactgcattccagcctcggtgacagattgagactctgtctcaaaacaaaaaaaaaaaaaaaaaaaaaaaaaaagatcattgtcctataaacagtattactaataaactcatctatttagggagtaatgtaattgtatcatctttttttctattaagtatacttattctaaaaagcactaactttaaacatgttgttttaacattatgaaaatacttcttgtaagagaactattaataagaacattacttataaaatacataatcagacaataaatttttcatagtttaaaacaagaatataaaataatgcagaaatagaaaatctgtcatttatgagagcacaattaatataaaatccatgaatattaactagttttcttttagaatactataataggtacataacaaacatccttatacatataaaatagtaatcctccctcccatctgaaacagttcctattttttatatcaatttctgtgtatatcccagcaatgttatttgtgtatagaaacatagattaatacagtaatagatacaagtaactatatatacaatataagtagaattttccttcaaatggctatattgattagctagacaaatattacaaaggaatgagatcaatttgcatcttattcaaaacgagattcacgaacaaacaaaactcagttttaatattaaacctctattaagataaagataccatttcagctcactttataaataattgtgcaagaaatgttaaaggcctcccactaaaaaataaagagtacaggtcaaactaaatgctaaagagcttgcattttagtgaagtaaagaatgaagaagataggcaatctactcccatcatatagtaggcatagaaagcctaacagcaatgtagtcaggtcctcttaagtaagcactgtcagcaaacaaaggaacttatctccagtataacactggaaagggagcatgaaattgataaagaacaaatgaataatgcatgaatgagtgaacgagtactaaacggtgaaagtgtaaaatgactttatcatcctgaaaggaaccacaagaacataaagcagtaaaggatatgtacgtatttaagctatattcttaaataaatttttacttcctttttgtgattctttatcattttatgaatcttaaaataaaaccttgtcttcttaccgtttgttatatatcaatttggtacccaactttacattggccacaacattgaactctggatatttgggttttcgttttttttgttttgttttgttttgtttttttttttttttgagacagagtctcgctctgtcgcccaggcttgagtatagtggcacgatcttggctaactgcaagctccgcctcccaggttcacgccattctcctgcctcagcctcccaagtagctgggactacaggtgcccgccaccatgcccgactaattttttgtatttttagtagagacagggtttcaccgtgttagccaggatggtctcgatctcctgacctcgtgatagcccgcctcggcctcccaaagtgctgggattacaggcgtgagccaccacgcccggcctatttgggttcttaagaaaataatcatactgctttcaaataacaaagattttccaaaacttaatgtaactacatgttcctgaaacagtatcagaaggactactcaataaagagttatcaagccatttttaaattataacaggagtggtgggggggatctaaaatcttacacaataattatttgaggcaggccacatttatttgcaaatgtaccaacccactaactgttgatcacgtgttaaatgcaagcttttaaaaaaatatatagattttgctcatattttagaaatgtccaatctaatatatggtcttcatttcatcataaatataatacattttcctttggagaggtatttttcttcccatcaaattatgttactttttgttctttatggggaaaggaaataatgtaaaagagattaaggtgaggtttacctcagccctgattaaagtcaaacttaaaaaaaaaaaaaaaaactctaccaaattggtgagtgttatgagacaaaagtagtgtagtgatttaattgaggctgagagtcagatgatcagaaattttttatttctgcacgaacctgaaagattaaaatagttataaataagcactacttgatttcagaaatccagttcattgtttttaatatgtgcctgtgggtttgcaaaataagtggattatgtttcaagtggagagaaacccataatattaaaaatattcaaaattaatacagaagatacatatgttttgttatgtggtttatcattttgtcacacatttaatctagtattaaatacttattcttcacaaatagctatttcagataattaaggtaggacatatgtgaatgagacaagggaatggcccatacatgaatgagacaagggaatggcccataggagctagttacctagtaatagagacagatcaatgtattagcattaataaatcacaagttagagagcaatgagattttgttttctagcactgaagaatctaaataactgaatcttctccacataaaatagaaagcacataaaatgtatgaataaattgtaatcaatatcaactttaaacacatattagatgaaaagaaaagatgatgtttatgttataactgcccataggtggtagcaaaaaaaatcagtgcccgtaactagctaagggtcagaacctaacaagagaaactattgggctcaagttaagttgaaatttggagttgagaactccatgtatagctgaagctcatggagaacatacaactaatttaaaaataaattgtttgagaaaaagcatgcccactgtattcattttgactccacaaaaaataaatcccatttatatgtatgtatatataaacagacacaaaaagtgatccagagctactaacatccatgggaacattaacagaggcaaagaatactcctctttttaagatatctcataaatccaaatcatatggaattctgaaaaataaaatcctgtgaaacattaatgtacaacctaaaattacaaaagacatattgatacaaagcttaacaagaaaggacttgtacacatgcagacaataagataatacttaaaattattaatgtttcaaaggaaaaaacagataaacaaggtaaaatgttacaagagagcaagcatatttacaaaaaattatacaattaaatatccgatgatttaaaaataattgaaattaaaattcaaaggaaagcagaaagaatactttctatctcattctatgaggctatttttctaatgccatcaccaccatagcaaaaacaaaacaacaacaaaaacctgtagggaaatatctctcataaacaaaaagcaaaaaaccttaacacaatattagtgatactgacaaatgaatcctaaaatttatatgaagaggcaaaagacccagaatagctaacacaatactaaagaataaagttggaagactgtcacaacctgacttcaagacttactaaaaatctacagtaatccagacagcctggtgttggtgaaacaaaagatacaccgatcaacagaatagaagattagcactataagacagggtgagaaaaaaaaaaaaattagaagagcccagaatcagacccacatcaatacagtcaactgatctttgacaaaaaagcaagggcaattcaatggggaaaaggtatctttcagcaaatcttggaatgactggaagttcatttgtgtatgtgtaagagagagaatctagacatagagcttacacctttcataaagcataacttaaaatagatcaaacacctaaatattaaatcaactcaaaaaattctagaagatacacaggagaaaatataagtgatgttgagtttggcaagaagttttcagatacagtaccaaaaacaatctatgaaacaaagaaggatacattggactttattaaaaacttatgctgtggctgggtgcagtggctcacgcctgtaatcccagcactttgggaggctgaggtgggtggatcacctgaggtcaggagttcaaggccagcctgaccaacatggtgaaaccccatctctactaaacatacaaaaaattagctgggcgtggtggcacgcacctgtaataccagctactagggagactgaggcaggagaattgcttgaacccaggaggcagaggttgcagtgagccaagatcatgccattgcactccagcctgggtgacaagagcaaaactccatctcaaaaacaacaacaacagcaacaaaacaaacaaaaacaaaagacttatgctgtgtaaaacaaactgttaagataatcagacaagaaatagttgggtaatttatttacaaaacacatatctgccaaaaaacttttatccaaaatatacaaaggacttttaaaactcagcaataaggaaacaagtgacccaatttaaaatgcataaggtatctggacagatacttcaaagaaaatatgcagatggcaaaaatattaaatgatgctcaatatcataaaacctcacacctattagacactactatacctattagaagggtgaaaactaaaaatactgacaataccaaatgctagtgagaatgtagggcaataggtgggaatacaaaatggtacagccattttagaaaaaggtttggtgggcttttaaaactacacatagtcttaccataaaatcaaacaatcttgctcctaggtataaaccctgttgtttctaaaagttatgttcacaccaaaaccttcctgcaaaagtttacagcagctttattcataatttcccaaaactggaagcaaccaagatgttcaacagatgaatgaataaacaaattgtagtatatctatataataaaatattattcagcaataaaaagaaattgcctatcaagccacagtaatcttaaatgcacctttgatggctaagtgaaataaaccagtattgagagctgacatatttgtgattacaattatatattattctagaaaaggcaaaacttgtagaaatagtaaaatgatcagttgtttccagagcctcgagaggaaggaagaggggtaaataggtaaagcacagaggacttttagaacagcaaaattattccaagttttactgatattgtaatggtggacacatgacagtacatatttgtcaaaacccatggaattttacagcacagagtaaaacttaatgtatagacatttaaaaaatttagcagattggatgatcctagaaaaacttcctatggcaagagaatctatcttcctacgacaaatatatgaaaaacctcactgaagagaatgaggtagaaaggtgctgacctaaataactttgaaaataagtcaagtctataatgctagaggcaaaaggaggtgcacaaaaacagtgtacttgagttgataaagttgttttccacagggtacaggttaacaattctgatactgctacatgaatgtattggaatggaactgaataaatggacagcagatagaaccagcagtgagctttttcagataagcaaggagaggaagctagaatgacttatgttgtgatggattagagttgtagacattggtatgaactcatatttagcataatatatagatgtttacatatagagatattttagagagatatgtctatacatgggttatgattaagcacatatattttttgctctgtctgcctagagggcctagaagaaatggcagacagtagcaacaaacatgcctagcaccctgatactggtttctaataacattctctaataaaaagaaattagggctccttaaataaacgactgactctaggtctgaggcaggaaatatgcaacaacttggaacaaccagtagtggcagaatgcaaggacatattcaaaaaattttaaaaatgaaaaaaggagtatgaaaaaaggagtatgaaaatttgaaaaaaaaaaaaaaatagtgtgtcaaaggagcccaggagcaactgggatagctcccaatggccaaagctatgacagcttgaataacaaaataaataagaggtgatgaggaaaacaacccacgtagaataattctaaataatgtatgtagctactctatctcaagaaagtggagcgtaactttccactcctgcgctgtggcctctatgtagggacttgcttccaagagtacagtatggaaaggggggacaggaggagactaacttagcagtggagaaacctgacatatactacctcagcgaggtgatcaaggccagtatcaatatgatagcatgatagcatgtacttttgatgggatgagatgaaaatggtacttgacctctgtggtatttcctcccaacaaccaattatcttaatcttacgtagagaaaaacaggagacaaattctaacagaggggcatcctgcaaaatagttgagcaatactcatcaacaataaggaaagtcagaaactgtcacaaccaagaggaccctaaagacacatgataactaaatataatgtaatatccatgaacatttattaaaaacaaagaaaatagaaataaaatatggacttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaacaagtgggtgaaagatatgaacagacacttctcaaaagaagacatttatgcagccaacagacacatgaaaaaatgctcatcatcactggacaccatatctcctttcaaatatgaattacaactaggttaaatgaattactgatatcacttgtatatacatatatatgcatatatttaaaatttgtatatataaatatagctcacaagcagatacatactctttcctttcaagaataaggattactatatgtatcttgcactccctatcaaaacctggaattggaattttcaaaaccaaggaacttgaggcacaaacaacatgcctttgtcatctgttccttgtttgagaaacaataggcaatgtatttgctgaaacagtggtttttaataaataagtgaaattgagaacaaacaagaagaatgatttcctatggaccttttgttttgaacattaatttaatatgataaagtcggctcatttgcccacaaggttgaaagttcccaggagcattagtaaaaattcattcaaggaccgttaaatggagctggctatatagcaattggtgtgcttcattttggaggttaaatactgaataaagtattatttttgcccttacagtgattacttgactgccagcagagtgtgggaaatgttatgacagagtgtgggaagcaggatgctggcaacactgagtgcaattccatgccttcacttactctgacaatcagataagatgatgaaatacagcactgtaatacggtgcttggcaaacatgatgatcaattataaaaatgtaactacaataaaatctagaagtcacagtccattaaaatgcaaaacatagttattgtcacatatgtctcttattagtcatggtattatttccactagtgcttttaaaaacaatttcatagaggtttaagatgatgaatatgctaattaccctaatttgacccatcaacatatacaattattatgtaccaatttaaaaataaggaaaaaaagaatttcatagaaaataacttagaatcaggtagaagaaaataatcccatagaaacaagtataagcaaattttagttcacctaagttgcagaacatcctgggtcttgcttctgacagcagaaccaaatttttaaaaagttaatgattaaaagaatactgttaagctttctaaaatcacaaaccaagcaatgaaggctgaacatatcaaaatacgtcaggaatttatgactggtcaagttatcctaggagaaagaaaagcatgctaagtttgaggttcattttaagacaaccaaattgagaaagtgataacagaaaacaataattaagttatagagaaacacaataaaggaagctaaaggcagtagttaattaaagaattaccaacaaacaatttgatttcctatctatccagctaaacaaatcctttataaagaaaattagaatatctgttgaacatattgaaccttatataaatgttctcacttgtgtgagaacatttaaagcacaattcacccaaacattaagccattaagccattaagccacagtcaatatttagaaaattgcctctgtaaactccgttgccctttttttctacaactgccaacattatttcagttgtctaaaagttacgattaacggtagacataaatactatgtccatccatccaccttttatacttcttttcgtatggtctaattgttgtatgtatctacatcttatcacctcatatgaagctgaatgtctcttactggctgaaactacacattcaataagtttcatatttatacatctgacttagaatcttagcagaaatataagagttcaataaagactgttcccaaaagaaaatatagtagcacaattttcaagttgtaatgcaccataacttgaataaaacaactgaatgagaatgaataaacttacgtcaaacactagaaatataatgggagtctgctgtggccataaagtaatagtatagtagtaccattatagtagtactttatatagttacactatataaagtaaaagtagtatttaaaggttatctgacaagcctagggatgtataagagatttattatttcagccagataatttgactttagtaacaagtttagtagaaaagtaaatcaggtggatttaatgtcttcttccattttaaaaaatgtttttataaatccataatacaatactgagatttaaaaaatccttgtcaaattcaggcaaatttaaaaaagaaaaaaacttacttgactccattaaacacaattgtatgtacctaaatttcattttccattactaacatctaacactttaagtctatttggcactcaatagatccctgtaagtcccattaacagcaatgggaattctatgggcagagagaaaagagaaatgcctctaagtgtaaatagtttctcctttataactttataattaacctctgctttctacccaattttctatgttggatgttttaattacttaaatgaaaatgactggattgtaatggaaaccagatggaagcatcatcgaataaatcaaggaaatacagtggcaacgtcactttacacaagtatagagtttattgtcataaaaaaggcagcataaaatatgcagtcaaacaacaaaatttgggtaggtagagacagttgatgtttaatcatgtaacagagcctttcctttttggtaataaaaaccccaagttcagaccaagaaggacaaagcgattatcaactaaaagctttagaggtgatatatgaagagatgaacttatggcttcaatttagttcctgaagggtaccatgcactaactcaatgataattagaaagctgtcaaaggattcatcaacattggaaactaaacacttggattcacaaacgttttaagtccaagtgaagttcttatttacaaatgattctacttgctccatggaaaattatgcctcatttccatttttatgagcatttctttcatgcattaatatatatgaatggcacatcagagatttaaaatgtgtatgagtcagagagacacagacagagccagacagaggcagaggcaggcagagacggaggcagagacggaggcagagacagacaaagacagagacagagagagacagatgcctgtatgggcttttgaaatataaccagaaagatatctatttcaatttgaaggtttctcaaattgggggaaaaaagaatcatcaagtcaatactgaatttagtttgggagtgagggaatcatctatcaaatatttaaccgctactaggacaagaaagaatgtaatagcaggcttgttagaaatacgttctctactttaaaatgcatgatgtattttgaagacaggtgcaggtcatggtgtaaatatgttgctcataatttcttagaaaagttttgagagaatgagaatgttttctttccgtataattccacatacttttaaggatgcagagtaaaatctaaagaagcttagcaggataggacaatagtttccttcgcaggaaaaaagcagaaaattttaccttaattatgactcagtggaaacgggaggaaatcctcttgacgtgggttaggagtggggcaaatctacttttccattagaaccttacaacaggtttgattttctttttagtttataaagtttttaaaaaatgtttagtttataagcctattcaaactgtggttagcaggctaaatgatatttacatttctttaggaaaaaaatacattcatttttatctccattgcttataacttagtgttcaaaagtgaaaacattttaacaatgtaataaactaaggcttagtttgtgaggataaatacggaatttgtatgctttctgtttcaaccaggaagtataatatgtactccaagatctaactaaactaatttttcatttgaaatatagggaaataaacttatttttgtcctaatttttcttctcttacttgcaagtaaaatatgttcatgcaaaaataggatgctaacaaaaattcataattttattttggtattaggactcttatttcaacaatgtgtaataaattaagtctgttcattacaacagaccttcaaatgaggatgcacaaacacacacaacgacacacagagtccaaattagcaaatttttcataacgtggatagattcaaactgcccttaaaaattgcaagaatattagttctgggaatgctagaaccatagaatcatgaaaaataaactgctgtggaacctcaggttggggtggttgttaattttactttggagtggatgcagcaggtagatttaagaggagcaacaggcaaggcttctaagaagaaacaatatgtgagttgggtgttaatgagaggagaaggctttcaaaacggaggagactggtgaggcaggtataaagacatgataaatagtcacggattagcagaaaagggaacatctcaggatgggcttagagcacttgtcggggacaggagataatgttagacaatgagattgaatatgtagacagcaggtcagttcaaaaggacctcatgccatgctaaggagattcagagttaattgtggctctaatagtatttattaaggaaaggcaatatttttctgttctattacctactccttcttttctcctctgacctaatacttgtttcctaagaattatctggagccacacagatgtgagttgaaacatcggcttttaaattttggctgtaagtgttgggtaagtgttgtaagcccctccactcttcagatatcacaattgttaaatgaaatagtaacagtacttatgctacattgtcaacattaaaacttagagctcttgaaaatcatctaggacagcatgacatacagtaggtgtacaatgaacactatttgtttatgcatattagcatgtctctttccttagtgagcatgttgtatgatttaacatatcaacagataattgcatgtatgcatgctctcttttgtttgcttttgagtatattgctaaaagcaagcacaaaaagtcaggtttttatattacttatttgagagaggcttgggactgcatagaagcatgctgttttccactttggtatttacacatagagaaactatgccctcgactctactggctttcggttttttaataaaggatagataaaaggagaccatcctaaattggcaattctatttgcacacctggacagaaactaaagacctaaggctatttttcgcaacacaaggaaagatttattctcaacttctaatttatcaataaaatatatattctatgcaatcacctaagttcatatcatcagtcacatttactaaaatcttcagactttctaggttcatagacctcgtgattatttttctttttgacacatcatatgttctttcaaagtaaattttactaaaactgtttctaaggtaggcgtgtgctatggcagcaaggaggtaccttatcagtaaaagctcttgcttccattgtagagctaaggggtttcaatgtgaataacaaattattctccataaaaggctgagctattaaaataaggatctccacaaaaagattacaaatcattttaaaaagatatgccctgcttattatctgaattcacttaaatatgttgtagtcacattgagctgtgcaaactgttttaggaaaaaagtcatgaatggggagaagtggatttgggggaaagtccatcatatgaatgatggcagatttcagttgtacactccttcggtcagtgttaactgctcctgaggaatcaaggagacaggaggaagattaacttaaaaatacaaaaacttacagatgctttagacagagcatcgaggaagagaagaaagaaaactggctgtttctagccattaacagaaacagctcacttttactcatttccattgtagcaggcattgaataaacccctttaaatactgcctctgtgaattcttacaaatgctagtcccatttgacagaagtagcagcaatctgaataatggagagtttagggactacagatcacagataggagatagcaatgacaggatctgaccttaggcagcatgtctccaatggctgagaacttcaccagggtaagtccctgtagtataatgtttcagtcaagttctgtagtcagtctgcctgggacccatgccttattatctgcacattcttagacaaatgcctcagccactctttgcctcagttttatcatcagcaaattgtagatataaaaatagtgcctccctcagagttgtgagaattacatgcactacactgaatgttagcaattcttgtcattatcattattagcaataaagtgacaaatttgtagaaataaaggcccttaacaactagaatttatgccaagttgtcattaacagaggaaaatagagaagggtcgtcacagtaagcctcttcccatcctgttttaagttctgtctattaaggatagtgcagaatcattggttgagagagggaaggaagaaaacatttattgagaaacaattatgtattagaaggtatgctaggtaattttacatgttacatcattcaatccttacagtgaccataaaagatgaatattatctcacttttcagatgaggaacatgaggttcatagggtttaagagactttcctgaagtcatagagaattaaaagttgtattaggattaaaacagaaaatgagaagtttaagcatcccatggggttggcagttttggtttgcaatgtgctttcgcttttttatttcaaaatctttaagaactattgatatagacattgaacatgcgtaaaaagttgaaaggtaaatcaaagagaattgttaactcaaaatccttttaagcataccatacctgagaaatagcaaaaattaataggttttacaagtatacttgatagaagctttgttttcaatatatactgatattatgatacataaacatattaagaaaaatttgtcacaaaattttagaatttgatatccacattagagaagcttttgtataaactattcagatcagaagacagtgataaaaatgttctctcacgcatatcataatgactaaatgtacacaggtccattactttaaagattttggactaggtaaaagaatcctattttagaatattaaaaatttatcacattttaaagggaacctattattcttcaatgaaaccatgaagccacaattttgagtaataaccacatgcagtgtgctacactaggacatttgaaggccacagatttttcaacttccagtgaagctggagaggaacagagctgatttgactaaaagtgataatgacatttctagtagattcattcagtagtacaacccctaaaacgtcattttgcactgtcttattaagaaacatattttaagatacgctttgagtaaatgtaacagcaagatattaaaacatacacctgtaaaataatcaagaaaatatatttgcatatctaattataaccattcaaattagctataaagaattaaatgcaaaagtaaagagcaactagtcaataatcttgacatagtggtccagagaatgctgtactttgggagagaagcagagagcaccaaaaagagggtctttgcctaatgtggtgtgttttgagaatggaagggaagggtaggcttcctgatcaagttgtcagttcctttctttatgaattctgaggattcccaaaaagaaaaattcctcttccactcctacaaaaaagctaggtcacagaaacaacaacaacaacaaaaaccaaacaaacaaaaaattagcacaacgccgttaatctcaaccttaattcagtttggcattagagaacgagaaaggaaagaaaacttaatgaaaaagaaccaaagacacagaactaaggatgtgataacttaataactgaataagttattaagaattcttcattgagcaactactactgaccagtaactattcaaggcccccacgataagctggtaaattcatgagatgtgatcttggcctcatagatactgcagttagtttagtaggagagagtccatagtcaaataattacttaaatacttgtaaaattaaaaccattgtgccacagtctttggtcctacgaaagcatgtgacacgtccataaaagtctcactgaggaaataacaaagctatgacctgaggttacatagaaattaggtgaaaggatgagagctgaggataggatttagcgatcaaagaattacacatctgaagaaagagaaaaaggctagggtggctgcagcacagtctcagggatagtctagtgggagatgaagctgaacactagcaaggaccaagtcctttaagatcttgtggcctcattaaactctctctttcctcctcaacttcctcttcttcctactcccaccaatagggtacccttgaaaggttttaatcaaggagatagagggtactgtagtcaaatgtgacaggaattgatttcatattaaaaatctcaggtatgcagaaatgcaacttactcaacctctgcttttaatggagtttcaagtcttggaagcaaaaagatttaaggagtcactttcaggacttctcagtctaattcagtgtgaacattatattgtaaacacagagcacagaatgagatcaaagaacaagtttacattttacttttgtggctcattaaatctgctccttggggctgccgcttctactgcccctggatgacttctctgatcaaccttgaatagaaataattcctacagtcattttaagtggcaatgcccatcaaatctgtaattaaatatcaactttgcaatagcaaaagatttcaaacttttaaaaaattaacatgtcttcccacccaagcccagttttactgcttgcagaaagctgtagtggggaagcaggaacttgtatacatttttctcctggcctctggcatttctaagcctccccagcttgctaactgcactgtgctttcttatctctgtccactcctttatgattcaagatgcatctggagaactgtcattcagtagacattagagaaaaatgggtacatggggacagtggcacctgtatgggccttaaggtgaaaaggagaccgtttgtatttataaggccatattaaggattataggttttattattaaggataatgaggaaccagcaaaccagcaaatggttttagtcatgaggtgtcacagacatgtttgcattttaaaagaattactttactttgggaggccgaggtgggcggatcacgaggtcaggagatcgagaccatcctggctaacacggtgaaaccccatctctactaaaagtacaaaacattagccgggcgtggtggcaggcacctgtagtcccagctactcgggaggctgaggcaggagaatggcgtgaacccgggaggcggagcttgcagtgagccgagagcctgggcgacagcgagactccttctcaaaaaaaaaaaaaagaaaaagaaaaagaaaaagaaaaaaaaaattacttttgtggttgaattacctcatctggttgggtggacagtcagacatggctcttagtgcagcaggtatgtacctagtaggaaaaaaaattgtcctcctccccccacacagggcagacaagctaaaaatcttagcaaaagatttgtatggatctgtcaaacggtcttttgtttaggtagttacagagaacatgaagaaagggcattcaccaggagtcgtcccgctggttgaccgaatagagtcctggtcagattcaatagctaggcttagctgaatgggaaggcagagcttctggagtatcagtatcactgtttctacattgctctggcccacagaaaaccatggcttagagaaaaataaacctggaatgtcacactggaacatggcgctaatttagacaatctgcttattttccaaggaactggtagttaaatacagactgtttattgttctaaattttaaatttaaattttcagctttgttgctatttttaatgaaatatccttttaaatacaaaatgttattcaagaatctcagttgcttttatttagaatatctgaaattcttaagtaacaacctacaaagatagaaaatttttaattggttctatttgtcaccctgcctaaagaacttttataaattcagtattcaaaaggagaaatattaaataaaaaggtaaaacaatcatgtgattaacaataagctaattaaaaaaataaaaacatcaggtaagatttaagttccttttaagtagtaattcttcagtctgagtggttatcaaaagcagctgaacaggttgaaataaatacagatggatttaaattcactaggtctggagtagaaaccaggtgttgagcggtatggctatatttggaggaagaataatagatgaagcaacttagatgtccctgagttgatagttgttcattttgaaggtagaagattattttaattttatattaaaattagcttgaaagcagtataactctacttttgtattttgaattttccagaaagaagtttttataaaaagcaacaaaacttctcaactctgaggaattcaggcttagaaactaatgagttagattatggcataggattcaattaatttatgttggattctgaagaaaattcgagaatttactttttagtatttgtataggaaaagcattcagcatgctttgacaaggatctttgcactggtttggtggtggctgtgcaaatagcaccaccaagctgctgtcatgatttatttagagagaagtaatctatgactcatgtaacaatataataatttcaaaaaatgtaactttatcccataatctctttgtgtacttaaattttaaactgtataactacttaatgctctcggggcatatttgggatgggtcacaaattcacaatttgtaaatagtatttcatgaataaaactctctttggaaacattgctggtaacatattagaacttcagctttagtgacaaaattgatcaattaataaaataactgaatttttaaaaatatatattaagttcttcactttaaaaagtttttcttcatctgaatgaattgcacttttcccagtaatacaagccacagttgcagcatttgacaatatgcaaaaattatactatattcctatttatctggttacgtagaaattgacagtcagaaacatgactttgaattatgttatagcccacagagaaaattatcaagcgcatcttaacatttctagtagtgttctttcttttgccacattaaatagcaaacatacagtgtttaacatgcacatttcctccttacctctgttccagagtgaaaacttgcccctatttttgctcttctcaagaggaatcaatttaaaaattattagtagacttagagaacacccttggacttttctgtttcggtaactgtcatgatagtgacagtaaggctatggcgaaacttactgctattcccacattactcttttgggttagcaatctgaatttaatttcattcactcccttcatattatagaaattacttgagtgcctatttgtacaaagtccaggtgaatttgtttcttattgctaccataatacattatatacacattacaaatatagtagcttgaaagaacacaaatttgttattgtacagttttggaggttggaaatccaatatcaacctcactatgctaaagtcaaggtgtcagcaaagctggttctttctggaggtcctgaggggacagtccatttccttacctttttcagcttctagaggctgcctgcatgccttgtcttgtggcttacgggcatcattactagcttttgcttcctttctcatatctcctactactaactctgagcctctgcctctttcttataaggagccttctgattacattttgcccacctgagtactttcccattgtaagatccttaattaattacatctgcagagccccttttgcctttgtaaggtagcatattcacaggttcttaaattaaggcatagacatcttttgcaggacatgatgcaagctagccaaaagagaaggagggaacacattaaaaactgatattggaaagtaaattagaaaattccaataagtctagaatttagttactcctaccagaagggaatagtcatttctctctctctctctccaacagggttaactttttgaacagtaactaagttaaaaattagcagatgtggctgggcgcagtggctcatgcctgtaatcccagcactttgaaaggccaaagcgggaggattgcttgagctcaggaatttgagactagcctaagcaacatagtggtgagaccttgtctttcaaaaaaaaaaaaaaaaaaaaattacccaggtgtggtcgcttgcgtctgtcgtcccagctacttggaaggctgaagccggagggttacttaacccaggagacaagagttttcagtgagctgaaatcatgccattgccttgcaccctgggtgacagagtgagaccttgtctcaaaaaaaaaaaattaaaagtagatgttttcatgacaagtagagattgacttggtctaacttattcagaaaattgccttaattcctcactcactttagcattctaaaactaactttcttcgctaggaaaggaagaagctgcattctctttatatctgtaaagaccaagtacatggggcactcacagatagacgagtctaaagtaaggtgtcttctgtgggaattttagagcttaggagcaagtactttgagctaagaaaggatatattggtgtgaaaacatgttacttggcacagagtaaggagtctttttttttcatttatatttttatttgtattttatttgtatttttaatcatcttatttttagaaattttctaattagccagtaagtgcaaatgtgctctaatagacacttatgtgaactaatgaaaaattgagaggtgatcacaagctttctataccactgacattgatttgatatttttaaaagagggagaaaacatattctgatggttctgtaaatagatttgttcccatcataggaatttagaaattgtgactcctgagacaatttgcttccaattatattatggaaacagcttttatttcaggcagctagaattaggcttgctcaacatctttaacttgcagaataaatggagaagccatcctcaatttctattctatgtatcagagatttgttttgttgtatgtgatctatgacacatatgtaacgattacatagcctcagtgtttgattttaaactgcttaactctccagatgtttaaattataaaaccaccaggtaaatacatttatttttctatacaagtatgcacagctggctaataccaaatgatgccaaaatgtctgcaccaagcctttctcctttgctattaaggaaactgcccatgggttcatgtggacagagaataaaattcatttaacagtaaaatatcgtattttgtccccctttccacaacagttctttgacttcagatcaacaactctggccaataaggtcacctggcataaggatattttatatttttctctatttgaaaataacatttaaataaacctccacttaatctttgaatctagacctaattaccccactaatttccggataaatttcctaggctgagtgtttctctctgaagcttccgacatcttttgaaaacctccttaaaacacttccatacacagttatggcaagcatattttattccttcttctaccctacctagactgtgagctctttgaggatggggactgggtcttacacctttaacttcttacctattggttgacataggaaatatttgttgacacagtaaatattcgttgaattaataaattaataaatgtagcatgcagtgagtgagaacttgctgagttctttcattcagtgggaaaaggggagaaaatgtcataagccttatttctgagatatttatagtatattaaggggtagagagaaggaaaactggcgaagaatctgaaaatactacatacaattaaaaagcaaggacaataaatgctcaaaatttgagattttctaaacacaggagaaggtcgtatcacaatcaactgaggatttctttctaacccactctcccgttagcactgtctttctgtaaatgtgcgctcccatttacagagggcacattattatgttgacagctgtgcccagtagacacagtaagactgtggtttgacatgatggacttcagtcttaccatatccatggactcctttatttttctttatctagatccccagataagctttaagacaaatcctctagctcctctctttgaaccaacccttcgtatagtttcagacataaatacttaactgtggttctttgctttcactattatcctgaataacatgtgagagcttttcaaaatttagttgcttttaacctctcttcaaatttcagtagtggacaatgcgttaagcgattttgctgtgtttccaggattgagaactgttgagccactctgagtgaggacctaggactagcagcactacatcacctggaacttattaggcattcagcgtctcagacttttccaaagacttcgtgaaacagagtacgtattttaacaaaattctctatgtaactcccacatgcattaaagtttgtgatgcaatgctctacattatatcaacctactaaaatacacaccaccaccaacaaggagatctctgttaagataataagaaaggctcctggaggaggcaatagagcccgtagatacacaggttctggagtcaatctacctggattctaacacttattagttctgttaccttgattgcattacttgttaggcctaaacttcagtttactgcattaaagtggggatactgataaatgaccaaatccgtaagatttctgtgaggtgtacagcattatttggcatacagtatccctcagtaaagttagtgctactaacgttaagtgaactagacctgaaaagcagtagaaggcattcccttcaggtcattatcagctttggatagctggagtaaactagaacaccagtcttcaaatgaggcccacatattccgaaaggtcaatgaagacattccagatgaaacataggaaccattcattttaagtggaacattttcagatcccccacatccatatacatccatttgtaatttatctgaaattaaaatttgatatgcctgcagtagtgtgtgagctttgtctttcttttccaacttgtctttcacaaaggtccccctcccagtttacaaaatagaaacttaactcccagccattttaaattttagtctagtatattctctgaatgaaaaaacaaaaaacaaaaacaaaaaatatactttgtcaccacaaatacactttttatgcatcatccaggtgattaactatatttatttttattttttttgagacagagtcttgctctgtcacccaggcaggattgcagtggcatgatctcggctcactgcaacctttgcctcctgagttcaagagattcttacaccttagcctcccaagtagctgggattacaggtatgtgccaccacacctggctaattttttgtatttttagtagagatggggtttcaccatgttagccaggctggtctcaaagtcctaacctcaggtgatcccccgccttgacctcccaaaatgctgagattacaggtgtgagccactacaccctgccaccaaaaaaaaaaaaaaaaaaaaaaatttactttttttatgtctaaatagttagtcaccactagctgactattaatggcaagtctgtgttcttattctctagctagctatctgtcttcttagacagttcactcctgagttgtctgtaggagtgataaataataacaagttaaatttttaaaaaaatgaaataactctttactcacaacaaatttgatttggcgattggtttggcaataaggattaactttgctgttgaattaggatatttttccataaattgaatagctaatactgaagatacaaagtttttgcagatatattttaaccacatgaaaatatatagcactggcaaaatagaatatttatgactactaaacaaacaatatataaaattcagatgtcaacctaaaaatttaagagcattatgttaagttttacaaaatctctgaagcttgcagattgcactttggtgatgtcagctcaggaccttgataggtggattcccagctctgctactatttgtgacgtactataacacactgggaggtctaaagtagaacttaccaatttgaagctcaaaagtgcatccttggcttaataaaaagagaaagtaaaacagtttttggcacatatctttaacctcaaggccctattggcaccctaatacatttataaatataatgtgagatttcaaacatatttctgaaggaggagagcctagatgcatgcatgaagcatagagttttgtactctcagatctatgtttaagtttttaatgttgaaaaaataaattcataaacatattatcataagtagcatgtaattagacattaacactatgaaacaaggaggtaagtgatttttaaggggtttccaagcctttgttcaaaaatactaagatataacaacttggcttaaaaatgataagtgaacgcaataaaaattgccatgagtacgactgacgaggacatatcaattcgcgtttgatgattcttattatgtttaataattatccagcaggaatagaattcattgttattttgctttgagttatttaaagagaaaagtaagaaagaagggaatttagggtttatttgattgtggttataattcaaccaaagccggtttgaagaggcaatggaaaaataagacatttaaaggtctatttaaatttgaaatgaattaatatttcttctgacataatatggcatttgaaaaaatatatttaacatacctttccagaaaaaaaaaagttatgtgcttttgctttcatctagcacatggaaagtgggaaaacctgttgcttccaatcaaacaatgaaaaaaagtcaaagagaactatcaaagtataacttttctcaagtccatcagatagctgatattgtagagcaaccacttagccaaaattaaaacacacacacacacacgtgggagaaagtgattggtaacatataaatgtgtaagagtgattcagtcaaaatcagaaaaccaacaaaaaagagtgaaaagagataagataatcaatagaactggactcatagatcacctgagtgttagatttactgggtaactgctttaaaataactatgtgaaacctgttgacaatctagtaaaaaaggtggagaacatagattaaaagatggggaactttagcagagagataaaatctataagaaaaattaaaatggaaacgctaaaagtgaaaacataatgcaagaattgaagaattccgtcaatggatacataagtactcggacttcatctagctaaggaaaaaaataaaatgtatgcttgtaaaaatgactgaaactgaaacacggaaataaatgaaggtaaaatttaaaaaataaataaaaaagcagagcattaagaggcatgggacaccatcaaatgactattatgaatgtccttcagtcccgcagaaagaactgatggagaacagaacaaatgcacgcatgcatgtatagatgtatataatatatgcacagatagatataatgactgagaattttagaaaattaaggaaagaaagcacactatagatccaagaagctcgaaaaaccaataagcagaataaataacaaaataaacacaaaataaacacagatcgaagagtacaggtacacactgagatacatctcagtcacactgatgaaaaccaaaagagaaaatccttcaggtagccagagaaaaaagaaaagtcgacacattatacaggaatgaaaacaacaacaacaaaagaattacagcaaaattcttatcagaaatcatacaagccagaatattcagtcacatctttcaagtactaaaagaaagcaaaaactatacaccagtaattctattctcagagaaaatattatttttttaaataaggataaaatagttttcagacaaaactaaagctgatttattgctagcacacttgtactatgagaaatgtcagaggatgtccttcaggcagaaggaatatgatatgggacataaacttagatttatacaaagaaagagtgtcaaaaatggtaaaaatgagtataaatataaaagccttttaaaattatttttcatcattctaaaaattatgaatgattatggcaatattttaaaataaaatttcaggtattttgcttttccagatgaataattttcttaaacccaataataatttcagtaaggtttttaaaatttaacagttaagtgtgtatcttctggaaaaatatacaaaaattgaatagtggtagttatctgtaaggagggggagaatgagagggagacatttcaataaatatactcttattttttgaatttttagatattaaaataaaaaatcaacacaattaaaaaattaaatacagtgatatatacaatttaaagatggaattgtaacatataagtagaacaatgatctcaattggaagattcaaagcaatcaccataagaattttacctgaaatattatgaagaactcaacaaactatagaatattaacaaagaataatttatagattgtgaataattaagtaaattctgactaaagattgcaacgagtgggaatttaccaaacagattttaagacatactgcaaacgcacagtattaaagagtatagaatgatgagtgagggagaaacccagctaactcagacataggtctttatatagatgaaaattagatacatatcagagattgggcacagcaacgggcaaaatacgggatgcttgataaattgtcttgaaaaaatccagttatgacactgagaaaagtaaaattcgatcctgatcatagactcttgttgtattaataatccacatgtgagaggagaattataaattgaataaaagggcaaataggaaaatactttgtaaaccacaattgagaaaatatttattaaacaagaactaaaagagataactcataagattggaaaaaatcaatatttcaaaattaagcattcttttcaacaaaatttaacagatatgaaaatactagctattttgataaacaaaaattaacagattaccgtagtagaaagttattttaaaatattaaaaccaatgagtgatttttaatatataaatcatatatatacttgtaatatataaacatataacacatatctgtggtattaaaacttcgtggatgggccggttatggtgggtcacgcctataatcccaggaattgggaggccgaggtgggcggatcacctgaggtcaggagttcaagaccatcctggccaacttggtgaaactccgtctctactaaaaatacaaaaattagccgggcatagtggtacatgcctgtagtcccagctacttcggaggctgaggtcggagaatcgcttgaacccgggggggcaaaggttgcagtgagcagagttcacgccactgcactccagcttgggtaacagagtgagacaccttgtcaaaaaaaaacaaaaaaaaaaaaaaaacaaaaaaaaaaaccctttatggatcaaaattcttaggaaaaaaaagtctctgaaagcttcacagaaagggtgatacagaaaaaaaaattaacactggattacagaacatacaaagaattctcataaatcaacaaggtcgcaaaaaagccagaaaattaatagataattaggcaaagcgtatttataggtagttcacagaaaaggagtttaaatgttcaagcttgtttgcaataaaaaatgctaatttaaccatgttacattcattagaaaggcaagctattgagagaaaagggaattcattatactctggtaagaatatccatctgtatagtcattctgcagaaaagtctcacactattcatttaacctgaatatgtttaggtccaggatttccattccaagatctatttcctaacaaagttctccaaaagttgatgaatgcacctccacaaagtctacatcacgttattattttttagtggaggaattcgtagcaaactaaacatctaatacaattttacttattggcataaataaaatgcagtggatgtatactatggaaaaatcggcagcaggtagaagcaagtaaatgaagtgaacatacacagtcagatggatgagtttcaaacgcagttttaactttaaaattgtaagatgctgaacaacatgtatggccaataacatgtaggtaaatttaaaacatatactcacattaaacaattttttttttttttttttaagacagagtctcactctgtcgcccaggctggagtgcagtggcacgatctcggctcagtgcaagctccacctccagggttcaagccattctcctgcctgagcctcccgagtagctgggactacaggtgcccgccaccatgcctggctaatttttttttgtattttttttactagagacggagttccaccgtgttagccaggatggtctcgatctcctgaccttgtgatctgcctgcctcggcctcccaaagtgctgggattacaggcgtgagccactgcgtctggccaacgattctacattcttaatatgagtgcaagcgcattaaattgggttccaatggggaaaaagaaatagaagtaatgatcaggaatgtggagataaaattttaaaggcgctttttgactcgtatcatactctattttcttcatttccataacaactatcatctaaaatcatatttattttacttgcttattatttaatatctgtctctttcttttagaatgtaagacacataaagacagggcttttctgttgttgttcaaggtgtctcaaacacaaatatattttacattaccacagggcatgacacattattaggtgataaaaattacttgattaattatcagtaaatgagcaatgataatttaccataatttgctttaccagattgcttcccctaggttggctcagtggaaacagtatgcctctccttggtggacagcttcttgagccgaacatatggtgaagcacggcttctatgcttcctgtaattccgaaagggttgccaaaatacagatctgtgccaagaaacctctggcttcctaaccttgacaagcctttttgaggcacttagccagtcgtctttatattcatctttgtcactgaacagatccacaaggaccaaacaacacccatattttccatatggatgtaatattgcaacacattgtctttaagctaaaatagcatttttagggcacaattatttatgtgctagttatggatgctatacaaattatttgtcagtaagtcatcaaaaatctcttatatattcaaatgtgggtacatagatacatatattgttgttgtggtggtggtggtgtgtgtgtgtgtgtgtgtgtgtgtgtgtgtgtgtgtgttggcataaactaattgcaattctcttatttatgatcacagaaaagtgacttttcttccctcctgaggtaagtttctttcttccctcaggataagaatcaacacttccagttgcattgtgtattattagaggttatgcaagaatccagaagtcagatcaaggctttcctatgattagtttttgttttgtatttgatgctatctgttaaggtctcagagcaaaaggtcctaaaaattaaaaaaataaaataaaataaaagcttaatgaagcaaggaggacaatatttcacttcttgattatagctttctatttataatgcttttctgttttacattcagcttcctcacaaatcaagcctgataatgattcatgtgctaaacactgttctgacgaagatgatttctgtatagttctaaagttttctgtatggaaaaacaaggtgatgtggcggaaatctggaatacatgcctgcctaaaatcaatggaatattctatattttaatagattccctttagtgtaaatcaaatacttaaatatgttataccaaaaaaaaaaaaaaactttattactgggactcatttgtcgctagggtacagataggtgatttggatgcaaatcaaatgtaccgatgctagactttgattcagaatggattacactgggaaagaggaccttgattttgctagtgctggtagcagcagaggtagccccattctgggcagagttcatggtggcagtagcagcctccttgctaaggggacttagaatagttccacagcatttctgccagagttcttggaatcttagtgcagagtcaacactgctgcctttccaaagaatctctaaactatggaataaatacactatagtaaaatgtcattccaaaagatgggaaaaacagaacaaacactctgtatgtaaaagtatgcaaagtcaaacaccaaaagctggcaagtattttgtaaagtcctttattacaaccaacaataaaatacaggcaaagcacttagtaccagctacaccgtaagccctatgtatagagccattaggcagctatttctttaaatatgtttcacatgggaaccaaaacgtacactcacatacaaatacaaattgaatatcatgaaatgacacttacactctctctacttcaattctgtttaagttaaaaaataaataactgcaacatacttacgtgatttcacaactaatgtgatcaacaatttgaaaaatactgtcatagaatgtccacgcataatttcaatttcttaattgatgcctaattgagcattactgaaaactaggatattggagtaacaactctaatctttggagggtaatgacacaggtagcagttcaccgatttattcattaatttatagtatcattctcttcccagcaattactctctagtgccctcttagagacataactaaggcttgatttagtatgcctattcctttgtcaacctgtaattgaagatcagatatcgaagtaaaacaaaaaaattgagaagcagtagcagtgattggaaaaatgactttttaattgttttattcatactgttttttctcattttaaaaaatcatgattattacaaaaaattttaaatataagtgaataaaaataataaaatagcattcattaataattaaactgcaaactaaagattattacatggagtagtctgagtctgatcatgagaaagaaaccacacagtgattttgttaggggacatttaatacaaaaattattaaatcatgaaaaaagattatagaatataagaaaacttttctatctctggtactctaggactgggaaaaagtagccacagaaggacaaatttggaaagagactcccttctcaaggctggggttcagaccttattggagaagatgtagttgtaacccacaggatgacagagaaatttatcggtgtgccagactggacatggtctgtagtcatgaggcaagtagtaagcaacattcagagtgcagattggacgcaggtgagccacaactggtaggtgggtgtatgggtacacagagtgactttgggccccgtggctaccttctggaatacaagtgatgtcaggcaagctatagctagtggaggtgcacatgggcatttacacttaatgggagtaggggaacaggcacagcaggtgaattgatacaatatccctgctgggaggaccacagtgtcctgaagaccttgggacacaaacctggggcagcagagagaattagggtgctgctgctgctgtctctcggaggcctggaatacccagtgtccatgtcaggaggacagtgcattctgggagcatggctgggcaagcatcatcagtgtcctcactctcacactcctgaccaaccatgcacacccaaaaaccaaaggggagtgccttcttcctgcaatgtgccctacagctggatactgaggaagattaacatcatgctcactataaaggagagatgcttaaaggaatttcattatcacacagcatatattaagggtttaaatatgtttcacatggcaaccaagacatatacccacatgcaaatacaaactgaaaagttaaatatcatgaaataacacttatgctttctctacttcaattctgtgggttacaaccagtgggttacaactacgtcttctccaataaggtctgaaccccagccttgagaagggagtctctttccaaatttgtcctcttgtgcgtacttttccccagtcctagagtaccagagatagaaaagttttcttatattctataatcactcttttttcatgattttataatttttgtatttgcaatccttaataattaacaatacacaatacagttaagttttttttagacctctccattctttgaactgtagccattactactctgccagatatgctgttttaaattattttatttacaacatgctggggccatgccatataatctttgggaaagattcttttacagaaagtagtcaaatattgaaacaaatgatgtgctagtgatacagatgatggtcaaaatgatatctacatttaaagacttattcataatccaaacaactgatttataataaaaggaactttaaatacttattgtattggagattctatagatacaccacctttcattattttatgaaacaattatatttttaaaatattatgtccacatggcataaatataagtgatattagaaaaattgataagatattatcatttataataacagttttttgattatgaaaaacatttataaataatattttatattattaatgagttatcatatttgaaagaacactattgtacaattcaaactttattctccctctcctaaacactgggtcagaacaaggaaataattgtttctaaccatgaaaactaatgtataggtagagttgaaaactctgaaaataactaaagaaaattcattttactcattggaagactacttaatttggtttggggaataaggaggacagctacaggcacccaggaattttgtaattcaaaaatctctcttctacacttttcactaattaaaactgtattcattaagcaaaatttacaaagaatgattattaactgttagctggttggggagaacaagccttcttttacactgctgagatataaaaattggtacaaagttctgtagaacgctccagaatgccgaaagttttaaaatgttgtatttcttctgatccaaaaattccacatctaggaaataactggacaatagtaaaaggtgtaaacatcacttttgcattgtagtattagtataatagtgatgaagtgagatagactaagtgtctatcaacaggaaattaaataaattataggttattgatataatggaatactatgtatttattgaagtaatattgtagaatatttttaggtgatatgacatgtgattaagaactataattataaagtaatatcactgctgtaagtaaaatgtatgcatgtgtaaacccaaaagcctcaaagcataatctctaaatgattaacaatagttatctcccacaggtggggcaatgagaggcttgtattgttttcttaatatgtgcatatattacctaaatttttaggttgaatataagttacttttataataaacaaaagacaaatttatgttaaggaagaaggcattcaactgggttaacacatttactttttaaaatttatcacttagaaaataattaattcacttttgtgattgaaatactctctagagttactatacaatggatatagagtttcaataatacaagatgaacaagttctgagatctactgtacaatgggcatatagttaactgtactgtacacttaaaatatgttaatagtgtagatttcatattttttttttactgtaattaaaagatactctctagaattctgaatatttaaactggcccctatttcctgaacaggaataacttttagctgaattcagtctcagagatgtgagagtaattcaggaaagtagctagtgtataagagagaagatgaaaaaagggaaatcgagagagcttgactggggaggaagttatatagcaataatcaagcagagattagactgtaactcaatagaattatgttttttgaactccaaccaacaaccttttctctgggtaggctgactattaatagaaataataaacatgggtagtgaatctccaacccagtttttacatatatgattagtacttacatattaacatcaaataataatttcatagattagaatttgtgatgctgtgttgtccattttcacactgctgataagacatgccggagactgggcaatttacagaagaaagaggtttaatggacttacagttccacatggctggggaggcgttgcaatcatggtagaaggcaaggaggagcaagtcacgtctaacatggaaggcagcaggcaaagagaaggcttatgcagagaaactcctgtttctaaaaccatccaatctcatgagaccaattcactatcacgagaacagcacgggaaagacctgccccgacaacatgtgggaattatgggagctacgagatgagatttgggtggggatgttagccaaaccatatctaatgctaaagtaattatacctatcacttcttaataaagattcattaccaaaagtaattccttcagttatgcaactttggtttaccttaaagatttaatatgtatctcaaaatagtatttaattgttcatactcagtttacctagcagcatagtaatgtatggaataaattctttcttatatgactttttcagtatgctagttgcaaattggatgaagacaactagttcatttaaactctttgtttttttacatttttgcagaaggaatgttatttactattacaagtaataaaatactatcaggcaggtttagggtaatattaagctgacatatttgccgtaacagcagtttcattataatcgagtcaaaacatttcttctaagagatatcaataacaaagaatttatgcacttgtctgcttttaaacaggtgtctgaaaatacaagaatatttatttgggagtgtttgatagctaaatttatcataactcttatttcaagagtaaattgcttgtattgattatgcaaacataatgattaaattctgctacaaaacacataattatttattgaacatcaatatgataaagcaaaacttttcaaaaatatttttgcacatattgatcagttttcaaaacatattttatgaaattatgttagttatttttaatttcttcttgtctgttatttagtgttttgttttctctatcagaagttcagacttgaaaactgtttattatgaatgccaactttccagtctttactaaattgatcagttcaagagttccttgacctccaagcatgcagctcaaactgatttccttgaagacaacagatgttattatctattaaattagatttggtatctgtatttttaggtttacattttaaggacatgcagaacataagtctcaaagataaagtgccagacctaaatctgtcaaccataaatgtatcattagtgctgaattttaaatctttttttctgcctagtaaagtaaaatagcccaaataatgtcagttctttttattttattaaaaaaccccagagtaatttttaataacaagtgctgttacatatctaggtatagtagagctcagtatataaaaactctaaaaagtgtattaagtaatttttaagatacatacatttattttctttgttctaaaaggaaggcttttattttctttttatggccacacattatataagggatatcttttaatctacttccatcaggaaaaataaacaattgacctttgaaatctagagaaataaacagaaaaccaaaatgagaccaattaccttctggaccaatgactgtacaacatatgtactgtcaatgtctctctctcccaaacatcagaagagcccttagtttcactgaccaaaaaaaaaaaaaaaaaaaaaaaaaaaaaccacagactttacacagttgcacccaaagagttgctctggggaggagttatgtcctctgccaaaattaagaagttcatttgtagattctatatttttttcatatttcttacatgtatcaacatagaaaggtgttgatacagacaggaatcagggaaatactgggtagaagtggatgtgggtccctggcgagggtccatcctcaagtctggacccacggccttaaatgagagcatgcattcctgttttcccacttgaatgttgccttttccaaaaccaccctagccttctctgcccccacattctgtacccataaaaaccccaagctccactggtagaggagcagagcggcagagaagaaaagaagagaagagaagaagcagctggatgttggagagaagcagcctgacttcagagggatggcttgatggcaggactttggagaagagttcagcctgggacagccgaactccattatcttcccattccatcccccttctagctccccttcttgccgagagccacttcctctgctcactaaaatcttccatattcaccaccctccaattttttcacacgacctcattcctcctggacactggaaaagggcacaggtgtgggtgcaagaggctgtcgcattgactctccactgaactgtttaacatttaagcaatccatggatggcaaagctaaaagagtgcactgtgacacacacccgctggggctccaggggtcatgggcaatgcctaggcactgccatgggcccctacggggttcgttcttgctggtgcccaaagttgcttgccccagctcctgcacctgctcacctgcatgctccctgcaccctccccgctacctccaccacgcaaagggtttgagcactgtgggctgagaaagcaagccaccccttcacaagtcccgcaaaggggtcaaggggactatcccatctcaactgggggctctcccaggattcatcagatgtgtgagtaacatggggatctgtctctccttgtcctcggactttcctctgagctatgccacttacaggggagaggattcaaccatctctctctttctatggatgaaaggaatgttggttcagtttcccttcacagaggtttagtcattacgtgggaccaggacaaggtcctggggcaactgaaggtgttggccaaggtcctcaggttttcctatggtatctttcctttcttctctcatggtttgaaatgcctcctatctcttctttcataatgttaagtgttttgctgcaaactactgaaatgtaactaagtacaatgtacgtttggcccagccatcagatgtgcagttcagaacaatgtgatttctgtttatggaggtgtcattttcaccccaacagctgcaagtcagtgagggggcttggcggctcccctccttaccacctcccctcccggctttagcacctgggtgtgcccattccaggcatgactgtgcccagtggccaagcagagcggaagtaagctgtgcacactgcccaggtcctagggaaatctcagaggcccaggcccctacacaatcagctggaaatgtagcttcttcttagaaaatagaaagtagtttagccctgggctgggatgactgtgaggggtgagctgcccaccaactcagccctgttgcattgattttcttaaagtttactctggcaaaatggcatttgcttacattgggcattattacaaatatctccattaaatttattatcatgttaccctaaatacattagagaggatgtgctcaccacattagatactgtccactctatgagggtcctcaagagagatatattgtctcagtgtcaacatagttttgtaaaatcaaaatgtaaaatcttctagggaagatgagtaaaatagtctttttttttttttttaagacagaatttcactttgctgcccaggctgcagtgcagtggcgtgatctcggctcacaacaacctctgcctcccaggttcaagcaattctccggcctcagcctcctgagtagctgagattacaggcacccaccaccacactcggctaattttgtacttttagtagaaacggggtttcaccatgttggtcaggctgatcctgaactcctgacctcatgtgatctgtctgcttcggcctcccaaagtgctggtattacaggcatgagccaccatgcccggctgagtaaaatattctcataaacttggggattggaaaaatttcttatacagaacacaaatagcactaactcaaacagagagtgaaaaaacaaacattaaaattcagagattctctttatcaaaatatacttttttttttctttttttgaaatggagttttgttcttgttgcccaggctggagtgcaatgttgtgatctcagctcactgcaaccaccgcctcccaggttcaagcaattctcctgcctcagcctcccgagtagctgggattacaggcatgagccaccacacctagctaattttgtatttttagtagagatggggtttctccatgttggtcaggctggtctcgaactcctgaactcaggtgatccacctgccttggcctcccgaagtgttgggactacaggcatgagccactgtgcccggcccagcccaaaatatacttttaaaacagtgcacagtcaagtcatagagaaagaaaagatagggatgatgtatataccaaaggtctcatattcacaagatgaatagaacttccacaagtcattgtcaaaaaccagacaattccaataacaaatgtgcgagggacttcaacagcaccacacacacacacacacacacacacacacacacacacgagttccaaatggccattaacataaagaaaaggtggtatacacattcagtagagtaataatcagcaataaaaaggagtgaagtactgacacaatgctacaacataacgaacctcaaaaacattacgctaaatgaaaggagtcagtcattatatgaaatgcccaatataggcaaacccatgagagttagaaagtagattcgtgattgtctagacctggaggctgtgggcggtagaatggacgagactgctaatgggtaaaagtttctttcttggagtgatattctggaatgagatagtgacaatggttgcatgactgtgaatatactgaaaaccactgaattgtgtgttttcaatgattgaactatatgtgatttaaattatatctcaataaagctactaaaagttagatggaatgaaaataaaaagttataataataaaaattcgtggtaaagaaaaataacgtattctagcttatcagtcatcattggaaactagttcaaccattgtggaagccagtgtggcgattcctcaaggatctagaactagaaattccatttgacccagccatcccattactgggcatatactcagaggattataaatcatgctgctataaagacacatgcacatgtatgtttatagcagcactattcacaatagcaaagacttggaaccaacccaaatgtccatcaatgatagactgggttaagaaaatgtggcacatatacaccatggaatactgcgcagacataaaaaaggatgagttcatgtcctttgtagggacatggatgaagctggaaaccatcattacgagcaaactatggcaaggacagaaaaccaaacactgcacgttctcactcattggtgggagttgaaccatgagaacacatggacacagggtggggaacatcacacactggggcctgctgggggatggggagaggggggagggatagcattaggagataaacccaatgtaaatgacgagttaacgggtgcagcacaccaacatggcacatgtatacatatgttacaaacctgcacgttgtgcacatgtaccctagaacttaaagtaaaataataataaaaaaataaaataaaataaaaagaatttcaaagttaaaaaaaaacagttagatgccaatgtgaactttcataaatagttgttggttaaatacatactttagaaaatttaaaagtatcaactaaagctgaaaatcctttccttctggtccagcctttacattcccatgtgtataatcactagtatgagttggcaaagatgtggagtaactggaattctcatattctcctggtgggagtataaattggtctaattactttagacatcatttggctatatctactaaatatggacatatgcataaacaatggcctagcaatttcattcttaggtacatatattatcctctccctccaaagagcaaacgataaacatgtacatcaaagtgcgtacaagaatgttcaaggtcgtatgtttttttgtaataggcacaaactggaaacaacacaaacattcattagtagttaaagggataagtagtggtgagatgatcttataataaaatattaagcagcaatgaaaatagatgtgctacaaccatgtataacaatatggataaattctctaatataaagttgaggatgccaaagtaggaaaaatacattttacttgattcattttatatataatttagaaacaaaaaattgctctgtgacgctggaagtaagactaactttggagaggaagcaggggtttgtgattagcagaggtatcaggggctaatataacaagagtgatatttactccttgactgaaatactaattacatgcgtctggtcacttttgtgaatatttaatgagttagacatctgtgattttttgcaatttttctgttatacttgaattaagaaataaaacagaatctgcttttctccaccaatgagatttttaaaaatcatacagacacagtgaatcatgttaactgatcatggtgatcatggcaaagaaaacttagagctagatgtataaaccatcttttagagtactactactgctacttgtaaatatgtataatacgtactagacatgattctaaatcatgtgtactcatttaatacaacaattttttgagtgggggacaatttatccccattgtacaaataagaaaactgagatacagaaagattaatttaactgcctcagatgatagctagtaagtaaagtcagagcttgaaaccaggaagtctggctctaaagtctttgtccataaccacggacctaatctgttgctctagcagggatttgggattttattacacacattttgagagctcaccctcttggatgcttcctttctatatccttcctttttcctcatttgttccatcttttgaaaatacttttatcttatggatattaaatttgtaagatagtttctttaaaaaagataacattcagcaccaatgtactttattacttaaacttcacttacctctctagaataatttatgtttatctcttctcccatactgtatattaaaattcagaactgacgtcttatctgtttgtttatctccctccctaggatattgtctggtacatcatagatgcccaataaatgactgttttgaactcagctgttataacacaatctgttaaaggacaaagaacagtgtcctttgtcaaaaagaacaaaacctaaaagcataaaagaaaaaacaaacagaaaattacaaaagtaaaagagagaaagtggggatatatatgaaatgtcgagtttatactcaataaagaccatgtgcatcttaaacaatcacaaaacatatttacaattgaacaaatgtttagctaaaatatttatcaattgtattacattttaattttagaaggcaaacaataactttttgttttactaatgatgaaaacttcttgctttgtctaaaatatttttaggtgagagtagttaagtctccaaatagcatattatatataatgttaatattggatactgcatccatgtttttaaaataaaactatattcactgtattttaaattaatattcctttagtacatttaaaatttaaaagcttaaaaacaggtacatttacatatataagcaaaatgagtttattaagtttaagcttatttttgtaaactgaatttagatttttatgaattaatctaatctctttactatgtagaaacatacaattaaagggaaaaatattattctggctactttttgcctaaggctatcattctattttctaataccaaaagctaaaggcctccagaaaaatttaaagaccatggagctattggtttggcagcatacttcacttttctttaggtaaaatagggcttttatagcattctctaaggtattctgtcttcccaatatttgcagatggtgaaactaaaaagagaacaatcaaacaaaaacaaggcccccaacagttgtaaaggtaagctataaattacaaagtttatagctttgtcatgctaattcatgaggtgtacatgtcctgtggagatattaaaaatggtctaagagataaaagtttataaatctccctcacggacatatgtgctacttttacttgcctcttcagatccattctcccttttctccaccccactctgtatcctgagattgctgggcagtagcttggcagtggccactttagtcagattgccttttcctaaacctcctggttcaaggagctgtttcctcctgttttgctcttaggccttagaagtaactccctgctgtttccacgtctgaatgattctcttttactctacctacttcctattacccaattacagtgtattgtgtttcttgttgggaccctgtcagacatgtttattgttgctatttatttgatacttttctgcccccagattatattcttatatttttaggtggtaaaatgctctgtaaacccacaattcaatcccctattactcagttactgttaatttacattccacttgaacattatcagtgactgggagctcactacttccccttcccaaaacaatccatttatttctaccagatcttaattgtataaatttcttttttcttttattctactgtaccataatattttgccatttcatttttacctacatttccagctcgagtctcattttttccagatatttccctttccttcatttgaaattcatgacacatgtattaaatcatttaaaaatattatctttctactgtgattatatgtcatagaatgtattgcccagaaataaatgaaggactgatatccttatattggtctgatatcctactatggtgttagttcataacttaagttgggagttactccagtaaatgaagagagttttcatatctaataattattaattaaattgattcaaaagcctctcagaagacaaaatagtaatttgttacacaatattaccatagtgaattaggatattaaataaataagataagctctcagtatgggagaggctgataaaataaaagaaaacaaaacactggcaaatgagatgtccatagagagctctgagagaatgtaaacatgcctggaatcaggaagacttatgcctgggcaaggtggtgtgaatgcccaggactgacctgagggtccctaatctcttacttctagctgaccttgagcctttgtgaaagcagaaagtgaagctgaggaaaatatgtaaactgccttgctaagtattgaagttgtgctgtattaaaacacagaggccttctgcaaaggttgggagacctattaattcaaagcatttaaggtaattattgtctaattattagctgaccactataaggtcctcagaagtgatttcagtggcttcatacggcaaggaatacagactttacagaattcatccaggaaggttactaaagaaaataatattaagaagaacaacaagacaaccttcaacaacaaaccctgagagaaagaagagctgattttcagagttggcatatttatattagattaaatatccagttatcaaaaacatacatttggaaacatttaacaaaccaggaagtatggcctgtatacaggaaaaagagcagtcagtagaaactatctttgaagaagcccaggcattgaatttactagacaaacacttcaaattagctattgtaaacataatccaagacctaaagaaaacaatgtccaaataattaaggaaaacctaagaataatatcttgccaaatagagaatctcaataaatagttagaaattataaaagtgagtcaagtagctattctaaaattgaaagcaaaataactgaaattaaaaagatattcactagggagacttaacatttgaaatggcagaagaaagaatcagcaaacttgaagataagcaatttttttttttttttttgagacagagtttcactcttgttgcccagtctggagtgcaatgatgcaatcttagctcaccgcaacctctgcctcctgggttcaagcgattctcctgcctcaacctcccgagtagctgggattacagacaggcatgtgccatgatgcccagctaattttgtatttttagtagagatggggtttttccaagttggtcaggctggtcttgaactcccaccctcaggtggtctgcccacctcagcctcccaaagtgctgtgattacaggcgtgagccaccgtgcctggccaacatgcaattttaataaaggaattattaagaaataattttaggcagatagagagagtaaaaagagttcttggtaaggctttttcttttaatagaaacagctcctgaaacgtttttttctagcagaaaggcagcttgaaaagccaggctggcaagtattgatatgctaatgtgggtgattagaaagtaggtgcacccaacatggccaacatggcaattcccaccctcttctccttgtcaccacatatgccaggcatcatggccacccccagatagctccacatgtgcaggactacatgacagctataatttgcatatttaaaaggctaggatgggagggccaggtttttcacaggctacatgaatgacacacctggtgataccaatcgcctgggccatatgcaaatcagacaccttctcctccagcctctcaatattaccaaccacttttctgccccacacagagtttctttcttggaacacaaacctgcacgctgtgcacatgtaccctagaacttaaagtataataaaaaaaaaaaaaaatatatatatatatataaaagaagaagaagaaggaatgcccaggcagcaagatgaagccacctcgaccctgtccagcctgtggtgaagaccactggagacagaactgccctcggaggtggaggtcactgggtggagtctcacagatggtccagcaggattgatgggtcccggggctcaaaccgtgggtccagcagctcaaactgccattatagcacaggagccccaggtgattctggaaattgaaggaaaaaaagtagacctccttctaagcactacagccagtctctcttttctcctctctaatccaggcctctccccttcccatagcatgaccttaaggggcatctcaagaaaaactctaatccaatatttttctcaaccttagttgacacatacttcccagacattatcatgatagctctactagtcaaaaaaaaaaaatccctccaaattaaccctaggacgtaatttagctgtttacactcaacataatgtggcaggatcactgtcctctaggggagctctaagctaacaaatagccaggaaagcaagaagtacacaaggcaagataagcagtagttgctctaaataacgtctctctccaggcacaagtgctcaattagctgagctaatagctctaacaagaccacttgagataagcgagggaaaggtagctaacatttttactgactccaagtactctttcctgattctccatgctcatgctgccatttggaagaaaagacattttcttaccatcaatggatctccaggaaatatcaccaagaaattaacaggttattatcctcagttttttttccttctataagaaatagcagggatgcattgcaggggacatcgaaaggaaacagatgaggtagccaaaggaaatagattagctaatcaggcagctaagtcagcagcaaggaagcctcaaggcattagcacaactagcaaatggccaaccccaggaaatgaaaccacgtttatttaacccaggagatctggtattagtgaaaactctcacttctgctttcttccctacgctcgggctgggaaaggcccgacactgttcttttgacagttacaggaatcatctcctggatgcaccacactcaagtcaaagcctaaaaagctaagggagcaacccctgaaagcccagaggaaagtcctgaatctcaatgtggagaaatagaagaccttaggctgaaaatcatgaaagataagtaactggggaagggctgctcatcttactcagtcccactgctacctcaccagactttttattatttctgcccttccctctcaaaatttgccaccaaatattagaacttctttttaacacatatttgcagggagaatttaattatacatgggattgcatttgtaactttgtagcttcccaaagagaaatgttgtcttggcaagtaaagttttaaatggaaattatttactacgtcactctcatgggaattgttatagtcacgctactatttgcaatagaactatacactatgacacccacgatgtggaattctggttgtaaaattctaattgctgtaatattttgcctcattatacttagagcaggataagtagttacaggaaagatttcgtcaaggttgttttgcttacagcaggagtaatagtttttactatcattaagtttgacgggactttttaccgaaggttgctaatgtgatgcactctaagctatgaaaaggttatagagaaagagattttatataaggaaggatcttgtttggtaaattcttgtcctaaaaggaaatgaccggttgtttagagaaagaatgtttaggacaagtcagaaagtttaagtctgttgtaagagggtctgtgaaagtcatgaaaaaatttaataattaaaggaaaggaattgtcaagattaatgccaaagttatttagccaccgaataatgtatctctcccaatcatactgcaagttataaaaattgcctaagcctaaagttattctccaatggcaagtcaagggggaaatgtatgctcttctcaaggaaaatgttgcttttatattaatgtttctggtaatgtacataaacatctagtggaggcaaactggtgttgcaatacatgggtgtaactaacaagagtcaaattacactgttagttatagtctataggacccccactaacagtgataattttaatactcataatccaaccctatatttttaaccttcttgtaaaatttatctcttttcacctagaaacgatcaaactcaaaatggtgctgcaaacagagccccacatggacaagccattcttccaagtacccttaaatccacctcaggagaagacccaactgctgttccccgacatgacgccccttttcatcaggaagtagccagaaataattgtcgtccaacacccactaacaacagttaggtttacttctcttgaggggggaataatacaggagttattaagaaataattctaggcagatatagagggtaaaagttcttgataagactttttcttttaataaaaacagctcccgaaacatttcttttctaacagaaaggcggtttggaaagccaggctggcaagtattaacatgctaatgctggtgattagaaactaggtctaaccaacatggccagcttggtgattctcacccttttcttgtcagcacgtgtgccaggcatcatggccacccctagctatctccacgggtgcaggacatctggtggcctgcatttgcatattaagagcctggggtgggagggtcaggtttttctgggctatgtgaaatacacacctggtcaaaccaatccactgggccgtatgcaaatcagacactgctttctccagcttcccaatattaccgaccactttttcgcagcagcacacagggtttctctcttgggaaccccgctccctctatctctgtagcggggagcttttttttcttctttcttgactattaaattctccactccttaaaaccactccacgtgtgtctctgtcatttatctaaattggcgtgagaccaatgaccctggtgttcctccagtcaccggatctgtatcaatttgacatcatccattccgaagagcagaaagataaagaataaagaaaaatgaaccgagcccccaaaacctgtgggataaagtatatcagcacatataaaatgaaactccttgaagaggagagaaaaaggggtccaaaagaatatttgaagatataatagtcaaaagtttcccaaatttggtaagaagacaatctgtatatccaagaagcttaataaattataaggataaactgaaagagatccacaagtagaaacatcatagtcaaattatcagtagacaaagataatcttaaaagcagaaagataaggaacttatcacatacttgtcactgtcaataagattaaaagttgacttctcttcagaaatcactgaagccagaggcaatggaataacgtattcaaagcactgaagaaaaagactatcacataagaattctctacctaacaaaattattttttaaaacataggagaaataataaaataaatggtttaacacataaaattaattaatgtaactcaccatactaattaagagaaaaactaaaggaattcgtcactagtacagctgccctatgagaaatactaactggagagtccttcaggttgaaatgaaaagtctctagacagtaacttgagtccacatggaggaataaagagtacagacaaacaaacaatatagggaaatatacaagataatgtaaatatatttttgtttaaaacgcttttatactcctacctgacttaagagataactgcatgaattttattaatgggtttaaaattataaagatgtaatttttatagcaatgttaatacaaaagggaagctaaagaaaggagctacattggagcaatgtttctgtaaactattgaaattaagttgtattaatctgaactagattgttttaaattaagcagttaattgtaatcccaagcacaataactaagaaaataagattttaaaaaatagaataaataacataggaaccaaactggtatactaaaaatgtttatcacaaaaaagagcaatattaaagaaacataggaacaaaaaaaagacacaagacatacaaaaaaagtaaaatggcatgcataaatgttactttataatttgtctttaaatataaatatatatatatatatttatataaagaattccaatttaaatgctgaggttgggagaatagattagtttttaaaaatcaacacttaatctacctatatgttgtctaaaaaagaaacactaaattcaaagacacaaatcagttgaaaataaaaggatgataagatacatgtcatgaaaactgttaccaaaagaaaactaaagtgtctacagctactatcagacaaaatagacttaaacctacaaaattttactagcacaaaagaagaatattttgtaataataaaatggtcactctttaaggaagacataagaactgtaaacacatatgtacctaatgacagagtctcaaaatacttgaaaaaaaaaacttacagaaacaaagagagaaatagaaaatttaacaatatgtaggtactgtcatacttcactttcaataatagataaaatgaaaaagtagatgataaaaaaaaaagacttcaataacactacgaaatagacctaatgaaaatctgtagaagatatttcatacactagccgaatacacaatcttctcaagtgcacatggaacattcttcaggatgtatcattattaattatatcttatagtaagcctcaacatatttaaaataattaaaaatttaaatttaaatgaaagaccaccaactaaaatgagataaaattacaaatcaattataagagaaacagttaataattaataattacttggaaataaaataaaggcactatgaaagaggtgacatatcaagtgtgtcttaaaggaaagatagtcttctgttagtcaagggacataagaaatgagttccaggcagaaggaagaataaagccaaattatggaattgaaaggatatgacacatccacagaattacatgtagttatatgcctagaatactggatctatggagatgatgaggaatgaggaagtgagataaaggttagaaaggaagacaaactactaagatacttagatttcataaatagatgatgcaggaccactgaataatttttaagcaataaaaccatagactcaaaattacattttagaagataatttgaagttgggggatattaagaaaaatgggttggagatgaattaagattgaatatatatgaatccaattataagaacaattgtgtgttctgaattagattaaaaagggccgagatggtataagagatagtgaaactaaagaagagaaagtgctattattaaaagatagaatctcaacttattccaatgataaatctttttataagagataaagttaatactaaaataacccaataagattaatattgggttaatattaataacccaataaggctgataaaacatatgacaacaataaaacaatttaatgataatatagccatttgtgaatactattttaagtactttatttataacaactcatgtggtcctcacaacaggcttattaaacaggtactattattttccccaatttgaattaaatttcaaattctaaatttttttaataccctaatggccaaattttaaaaagccgacatacccgatttatttgcttacagaccctaatacaaattattcaaaattaattttgaaataaatattgccttgcaagattaagctctctacaaataagaggaaaaaaagattggaattgagaaacttcaaaggttattttatttaaccctggtacactaacagtcttcaaaaaataatttaatgggtatttatggaggaactaatattcatcaaatattatactcagcatgtggctacaaaaaagaaaagaaatatatagcccctgacatagaaaggttttaagtttgatggagaaaatgtgcctaaatacattaaaaaaaatttaggttgtatatattgggtgttgtttttccagaagataaaattgttaagtatacctggagaataaaagcaatcattaggctatattaaagccacattttgaatgataagagggaatttgccatgtggaaacaaaggagaaagtcatttcaaaaaactatttattgaggaattaagcaaattaatacattttatatttaaataatatttgcagaaccccaatccccaaaatgtatatgtgtatggcagataattcacatcattttcttttcttttcacataaaaatatgcaatcattcattacccaccggtcaagagaataggtatataagcagaaaacaaaatatttttaagccacatattatacaataaataattaaataattttaaggtgccatttagctctctgataagttttacattttaacacacacacacaccgcacacacacacacagtgtaaacataacgtttttagataattctatttttaaaataccaaatagtgtcataattttataaacaccaaactttataaaatcaatggttcccaagtacaacctttcagtaagcaaactaagtttacagtagtgtattcaataaataatgcaactcaacaactgaaagttgtcacactgagatttagttctgtttaaaagcagatcagggtttactattcactcattccctcgaaggactggctctagcaaatttttccaagttggtgttttctagcagagggtcttaaaattaactaactcaaaagtagtccaactgtaaatgctagtttcatgccatgcttaatactaatggaaaaactttacttttcttagcttgatcatatttctttgcaatgaaaaataaatgcctaagtgtaaaacgtggacactatttcctataagatttttttttgtcttttatttttcagcccatttaaaggtcattgtataacctttgggcgattataataactgttactgtcctagggcagcagataaggcacaaagctaaccttggtgtttctaaagcacacaaccaacagctttttaaagtaaaagagaccttaaaacatgctaccactcgatgattctgatactaggctttatttctgtatcatgatggctatttcttttcgaggccaacagataagaccaagattatcaaaaagcagttgtaggttctactgtgctcagttcctgcggactgctgcttggctaagttgcagctccctctctccttggcaggaagcctggacaagtagcagaacattgtcaaaattattattgtttctgttttttctttctttttcagatagctcaaaaatggttatcagaaagtcgagaatttaagagtgtgtctttatctcctttcttaattcttcctaaagaaatagtagaaatgtctagggcagaaatgcataagcagatggttatgtgccttcattaatcaaatgcagcttttccctcacctatcttgtccctctggcatgacactataaaaccttctggaaaggtacctcgtaatatatattgataaaatgaaaatatacatagtctttaacccagttattgcccttagagagaccctctcctcatttaacaatctgaaatgcacacaaattcataaagatatttcattatagtattagatataaaagaacaaaattgtactaaaatatacaaaattatggtaaatgcttaattaaataatcagtcaaatgaggaaatattacagggcaataaaattaaaattctaaaatctaaactgaatttcaaaaatgcttatgacataagaacaaggcagggcatgcaattataaacatatacacatatgtacatatgcaaatatatgatggtattatacaaaaaatgagatgagaatcaataaagaaatattgcagttaatgatttcctattgcttttcatttttagatttcaaagtttttaagagaagcactaaaaatgtaaataagagtaaaacctggaaaaataatcatacaatttaatcattttaatacattgatgatttacatcagttccctgctagttataggataactcaactacttagcatttgatacaagcctttgacaatgtgactagtctgtgcagctctagtcccattattacaattttttcattgatttaatatatatagccactttgaaaattatgctatatgctgatcccacttacttaaaatttatttttcctttatagctttctaattattttatattggcaaaccgttacttattctttatgatctagtccatatatcctcccaatgttagaataagctatatttggatcatattcccgttttacagaattcagggtattagcatttctgcagagttgagagaatatgcatgaatataatcagagtataattaatattgtttcttcaaataactgagcagggtgtgtccctatgtcaggtattatttagttccctttacattggacgaataatcagagccaatatttttacttgattaggtaggatttcttctatgtttcttaccattcatccagtattgctccagcctatcaatgaaacaccaaagaatgctggtcaaagacttactacaatctagatatattctattgacaactttcttccattccattctatctactggtgtaataaccttatgaaaatatggaacaaggctattctgacattttacattttgactttcaatagtcaaaatttcttttaaaattattttccaataataataatgttattgctggtattatcactattggtataatagcaataattttaatgtaacaaatccccatgatataccaactctcttgatgataacattatagtctttgagctcctcaacaccactctaaggcagaagtgtttgtctctgtttttaaaaagaaaacattaaagatcaaagagtttaacttatttaaggacataagtcagaattgatatggtccaggattcaaatgtaggtgtttatctctgcactaaactatataaacctttagtgcactgtcaagcacatcattttgcttcatttttattacttttactttatcatgttggaaaaatagatcagaggaaaaataaaggacataagtagagttttaaaattcattaaaaatggcaattttatttaactctatagaagatgatctaataaacagtaaagggctttaattcgaccaaaagcaataccaaggaagaataaataattttcttattataacagtgagaatacgatacgaagaggcgttctgaattacttgtccttgggggccagttaaataagacagaaggccatctgtttggatggtttgggcactaaattgcaaagcattaaagagctgaaccatatgatctcacgaatgccttctggtcatatggttccatttcaacagtgtttatctcttccacatcaaaattgttcttttgagagaaatatgagagaggcaaaattttgttcataagccacctacaaccccatgcacatgaggaatgttttggctaaaatgttaaataaaattgtgaatagcttcagcatttaaaaaaatatatatttaaaatactaactgcttgtccaaaatcagaacttgttagaaataaattatctgttacaattgatgcataacaatcaaattttatttatcagccaatagttactttagtaaaatttaggttattctattaagatcaatgccatgttaaagaaaagtatatttattttctcatcatatttctatacttaagaaccattatgttcttagttctagttaacacttataaatcttagtaagtttataaagtaataaaccagctataatttgaggaaatattcataaggcaaacctgcaaatctgggggagctggcatttccaatttgataaaaggtgagaaataacaataaaatcttaagcacctcaacccgcttaacaaattccctgttggcccagggaacctcagagaaaccttgaaaactgagttctcacctgtgatgggatgggaggtcacacatacctcactatatcccctccctccctgtcagtagactttcattcctaaaagttgaaccaaaaccagccctctcaaaagatttgctgaattcccctccctttttgtgttttcaaccacattcaaccagcattccttcctgatgagagaccaccaactgtggaccagctgtgtctgacttaagagtctgaatataggaagcctgtgtggcctttgtttcacattttgacatatagagcctaattttaatgcatgtaaatgttaagtctccactccaaagtgaacatgggatatatgtaacatgcatgtttgcttagcatgcatatgtgtgccccatttcatgcatattcacagctcctcccatatcctgtgagcatatatatatacttagccaatccattcagcataaattcctgtctcatccttccttatttcaagtgtctgcttctggtttttgccagaagctaagcttcccagtctgcaggatggacagcctataggctgtaacctggtattaggaataaagctttccctataagtttaaaaagatcatgatacttcaattgacaagggttaatttccagtcaatcagtaattctctataacaaattcaagaaagaccaaaataaagaaccacacttgcctctggtgaaaaatcagaaaatggttaaaaatgagtaaataaattgactaacaataatataaataataattaataatcaatattagttaatggaaaataacaaatgattggattttattttttccctttttttctctgattgcttattgacaaatcaaacttgttctctaataatgaagcatggaaacaggttttaaagttatttaatgaaaagttactttgaaaaaatcaattacctaatgtcatagaaagttaaattaatgcaattctgttgacaataaggaaaatcttttagagtcttaaagctttcgcctggcacttgatgtatgctatacatttgtcaacaataaagagtcaaactctgtgatatatttaaaaaggtttattctgagccaaatctgagtgaccgaggctcaaagtacagtctcaagaggttctgaaaacaagtatccaaggtggttgggttacagcttgattttatacattttagggagacagacagatatcagtcaatacctgtagggtgtgcacgggttcggtccagaaagccaggacaactcaaagcaggggtttccaggtcataggtggattcacagattttttcattagcaattggttgaaagagttaagtaattatctatacacctagaagcaatagaaaggagtgtctggtttaagataaggagttgtggagaccaaggttctcattatgtagatgaagtctcataggtgcctaccttagaggcaacagactgtaaatatttcctgttgagatctttaaaaggtgctagactgtcagctagtctcttcaagatcagaaaaagatctggaaagggaaggggatttacggaatgaaagtttctcccgcaaaggacagctttgcagggccgtttcaaaatatgtcaaagtatattttgggataaaacattttaatttctttcagggcctgtaaagctctcgtgtaacgctatactagagtctgcttggaatttggtatatttttgctacagtctgttctgtcagtcttaagacctctgttttaatggtaatgctggtcagttgtgcctgaattccaaagggaggagagtataatgaagcatatccaattctcccttcccatcatggcctgaattagcttttcaggattactttgaaatccccttggccgagaggaggggtccattcagttggttgagaggcttggaattttatttttgatttacacatttaatctttagaacaatctaatcggttggtattattatcttcattttaagttgagaaaacaaatttaggaaattaactcacttgtccatgttcacccaactagaaattggaaaagaaactgcaatccacatgtctccaaacaccatgacctcagggcaaagagactgagtatagattttaaattattttaaaatgtaattcatttacatagtaattttctcaaaatgcattaagcaagatgtctacaattgttcgaacatgtgcgtttatataattgcctgtttgcctctcagattttcagtaatgtctgcttgtgttgatttttaaatttaaaatttaatttaatttaatttaatttaacttttggtggaaaatgagggaggggattggtgaaaaatgaggaaaatgagggaggacttattcaggtattgatgagttccataggatgagttccacacctgggtcagtgtagtgtaccttcaagtggccatgcacagcactcaggcaagttgtatactcaactcagttaatggtggctggatttccaagccagaggtaaccattaggtcccaacttctactctttcacacaaatgcacataaatagagatattttgagaaatcaatggaataaaaaatcgaggtttgaaaacaattttatttagatcattatggtaatgaggagaccaaaagaatgctatgaaacttctgtgttaaaactaacttaacactaataacatttttcacattcccaattattacatatgtctttgcattcaaaccaaggcaataattgttctagtcaaaagaaaaaaaaatctaggtaacattttaaatattctagtgttatcaggaaaattagatcataaagtaattatggacaagaagccaataccaaagtatttcatctggttaggacatggatatactgcaaatcctacaaagttgttcatttcatacaaatattaaatgaatacataaataattgctttaagaagaaagtcattctccacaatcccttcaccacaccttatacctgtagaaggcaattattttaaaaagaacataatcacacagattagactatttttcttggattggaaggttcagcagaaccttgacagtgttccaagttgttaacttttatttcaaatactaaaaactgaagatctgatcattagaaaagcattgaattgtaaaatattggtgggttggattgaatttagttaaattgtttccaattttcttttccttggtagttaagtcactacatatctaaagagatatcaagaagctggcatttcctagcaatttggaacttaaaatttaacaaaacaaataaaagaagaacttattctaactcattttttgcttttagctgtcgaatgcataagtatcttaaattagttttcattgactcctctactttatttaacaaaaaccaaggcacaataataaatagactagcatcaaaacataatgccttccctgctgataaatacccagtgcaagattggcttagataatatttgtgtttttggtttacttaaaaatgggtataagcttattcctcaaaaaaatatacattgtaacatgttgaactctggacatttgtggatttgaaatagtaatttatgattacaagtttgagaagaatttcagagtcattcagtcccttagttttctattaaaacattaatttgaatttagagaagcatttcttatatcttatcagtcacctcctaaaatggattgtatttaatcagtaatcagtaccctcagttttggaggtaaggatgcagagacagtggggataaaccttcatagagtcccttccattgtgtctggccagtggtattgttttggcctttgtatgttccggaaactcgcttttgttttgctaattaactttttatcacattaaatccttctttttcaattataaatattgatattgacaggaaacatgtaggtataactatttgtgaaaagtactaacatatgtaagaattcccttcatcaaatgatttttaatatttatttaattattgaaagttgtttaacattgtaagacgtatacaaatggaactttgcaagaattttgaagaattgtaaaaaagtacctcatagaatattaaagggataatcatctatatgaccaaattgaaatgaggttttaatcacaagatgaagtgagagataacaaaaagggggtagggtcggtggaagattcagacaagaagaaaaaaaattagctaaaaaagtggaaaagcagatggaaaaaaaaatcgtgttttccactgttcctttgagtactatcacagttgcaacttttcacttatgtgtaagatgattttttaaagtttaagcaattcccatctcaaaaaagtcattctccacaatcctttcaccacaccttataactaagaaggcatttatttttaaaaagaaaataatcacatacattagattactaaactataagagagaagtctagtagacaagaatgctataggaaaatgtcagattttactcactatttcgttacccaagactagcactgttattggaacatgataattcctcagtgtaaggttttacacctatcacaagaacactgcaatgctcaatatttgggtcatgtgttaaatatagaaaaaaggaaaaccccgagtgtgttcttgatagaaagatttccaaggaccaaactgcttgcataggtattgaatcatatgtaattgggatagctgcttagaaggtaaactccaaagcacaaaataacagaagacatacaacccagcaaacacagtcaaatcaatgagcatgagattaaattattacctggaaatgatctttgtaattttcaagatcatgaatagataaataaaatacttcaatattttaataatcatttccatgatctgttagaaaagcatatccgctagagaatagaataagcacaggaaacgagaagtggcaaatcaatgatttgaacttcaattacacaaattcaaagccagtattatttctaccatgttatgttgtgagtataccgagtatacctacaataagtctttattgtcatgattttgtaaaagaataaaagccttcagaagtttttcagtgacttttacaaggccacagatggacactggaggagacatcaggtccctggcctctagttagagaattttactgtgctaatgctggcgaaagacagttatcacagaaatcaaagaataaaattaaatttgtattcaaatgtaaatttaagtaaatgaatattccatttgtaaataaataatcaatcctgatttatgttatttgcatattttttaaacacttaagactatataggtactccttatttcctcttataacaagccataccaaaagggcaggaaacagagattcacctcagaattttttaccaattaatttcagaggtaaagtcagtgtacaaagctgaagatcatctacttcagatacaatgtagtagctgaaaaaaaaaatttcaacacagataagtaattgatggcaattactacaagtgtaataaattttacaaagactccagtacacatggatgaaatacttcactgagtttttaataaaaatagatgtaggtatgctgacaacttcagaattgtttttcaaggtgctgtttcaatgaaagatatattcaacttttatgttttaaatttctgctagctattttatattttggttcacataataatgttctagaatttgatattcttggttaatatgcagagtcatctcataggtttttttgtttgtttcttctttgtgtatagctctcaaaatttaggttttgtacccttctgcttaatagcattgaatgaaacaaaggacaaatctgtaattctaaacatgtgttctttattttattccttagtctaaagttatctccaaggttattagagtttctgaataaataaatcttcacatgtcagcccctatcatccattttcagttgccaactagaaaaatggtatcgtaaaagactagagagttgtttgcttaaagttacataacatttcagtcctgaatataatacaaaccaatttactgacatcaatcagtaatgataatgaaatgtcccttaaagcaggaaaataaatgtttttctcacttcacagatgaggaaactaagactcagtgaggctaagtaatttgagctgcaattcccattcaggtaattaggttgcaaagcccatattctttccacttctccattgtcttccaagaaggaatgttacatttacttttcacattttattatgtagactgttaattgcatatataaaagtccagtgaccatgaagcattctaggtgcattttgactttgagagttattgctgtattcaaatggttgttttctaatgacttggtaacatgaaagacaattgtattcactctagaaataatgcatttccttacaaaattatattttatttacatgtcattaacactttcagtatattttactttattgaaaagacacagcctcaacaagtcataaatgacaagaggaagctgactttacagatgagaaatgaaacgtgaaataagaatagaacaaggaaaggagagaaacactttgatttggaacaaatgcatatttttaattatccattaaaattatatgatatagacctattttggcataaatctgtattgcaacaaaagacctttgatgtgactaagtgcgtggttatttctatatttaattgtgttttttcttctatccttaaattgaagagacttactgccccactttatggggcatttaaaaaccgcttcagttagcacttcccctcattgaattgtttgggattgagtaattaaaatgtcttcaatatatgggatctgtaaatggtaatagccacatggcatccactagagtagttctattatgggtaatccacttgaagtaatttctgaagacaagtgtcttactcacaggtatggaactctcaccacctacctgggcagcttttctataatttacttttatggctttcagtttcaattggattttataggcttaatggcttgggaaatgattatgggcaacaataactcagaattgaccttttcagagttaccagctttttcattggtttagctaacaatgccgctaattgaatttttcagcaacaaaaatatgtgcaataacagctgctgacttagattttataattattgttattacactaaataaatatttaagtagttaagaaaatcatggcagtaagacaagattatccacaatagcacaaagtcaatgtgtctatgtgaaaataatttacactcaaattactcatgcctcgtttgaaagaaaccctttgggaacaattaaaggtgaagttgcaatcaactgacaattgagctctgaggctgtataggacatagtagaaatataaaggcagttagtattttataggatactgaagaagtaggagtcaatccaagcctcaactttaaaatggggatcactgtgagatttaaattgtgtacttacttgcaaagcctttaacacaaagccaggtaattctgatatattactaaaagaaaaagaacgagaaggaagaggagtagcagaaagaagagaaagaggtgggggaaccacaatagcagccagcagctgccaccattatcatagtatcttaagaaatttatttctcctctggtaggatctagaaactaagcaagttttataatgtaagatactacaaggtcattttgaaacatttcatttcaggatcacattgagaagtactgctctcctgatcttaagactttgtaccatgtgtcccataaacctctctctctaattaccagttgactgacaccacactctgtctacaagacaatatacttgaatcgacttctcctgaggcaggtaccaggctacaaccaccttcaatgactcctattggtctttgtccctcagaacctggaaatatactggctatcaatctcaattaaatcatatgtggttggtaaaggtctaatgtgatctccctaaatatgtatacaattttgggaggtttgtatatgtacatttgttatttcttcttttcggcaagtattagaaaaatgcttgtttttaaaaatttgctaatgacattgttttcttttaaaatacacttgtttatagtaacccatttacagtagtgagttataactatttgaataaagtagccatccgtgtgtccagggaaatgagatagatgatagaaagattagatagatagatagatagatagatagatagatagatagacagatagatagggaaattctttcttatttcagtatgccaagaaatatagataaaatgatggtgtctgtaaatcatcaaagaaagctaaaactgtgggtgaaagttagagaaagaacagaatagtctcaaagcatgtctctatagggtacttattaattattaaaggaaaattgcaattttaaagtggagaaatgtggagattgtttccaggtttgtctgtttatttctagtgaaaatgctactagaaatactactgaaaatgcctcctgtgggttgttttttttttccacagaattttgttctgtcagccaggctggagtgcagtggcaggatgatggctcactgcatcctcgatctcttgggctcaagccagcttcctaccttggcctccaaagtagcagggactacatgcatgcaccatcatgtctggctaatcttttgattttttgtagagacagggtctcgctatgtttcccaagctggtctcaaaatcctgagctcaagagattctcctgctttggcctcccaaagtgctgggattacaggagtgagccattgtgccctcctattgtacatttgtaagcatttctttaggatagtaatgagaagtttgtgtcacggttgaaacacctttagtctcataagaaaatatcaaattgttttccaaactgttccaatctacattcccaccagtaatgtgaataaagttcccaatcatacacatgtttactaacaagtagtaatatgcccaatgtttttagttttgacagtctggtggacatcgaatattaattattgtgtttaatttgcatttatcttattgatagcatattttcataaaggtataagctattaacttgtaaaatttgtccatttctttgtccatttattttatctttttttttatcaatgttcaggagtcctttttgtaggttttactgtttaagttatatgtgttgcatatatttaattttttggctttactaattttctttatggactataaacatgttttataaacagttcttatttttattggtataaaatgtattaatcttttccttcatggattataccttatttaagcaaagcttgtcttagaatcctccacatcttaactatacagatattttatttttcatgttcctcaagtctggaagccttgttttcaggtttaaatctttagttcatttagactgaatggtgtgaagtaggaggccaattttaatttttccatatgaaaaatcaattatcttagtacatatattaaataatccatcttttctctggcaatcgcatctctttctggaatctgtattctgttctttacttatttctgtattactaaaccaatgacacattttcttattatatttatttaatattttgatatttgggagaattaatttttcaagaatgtcttgatgaaactttccccaattgaatgccctcatgtaaaattgtaaccaacactcaaatgaagattaaaaacatttgaataccctcacttaaaacaacactcaaatgaagtcccagaacagcaggggtccccagagatctcccccatggtacattctaggacttagcttctacccaagtggagttattatttttagttttaacagcataagttagttttatttattgtctttttctgactctttacttttgattagtaatttcattactagattattaggttatgaaatcccctctcatacacaaatacacaaaaataaagaaccaggatctgatgagaaagaggaagaatgtgagggagggaggggaagaggaggagagagagagaaggagtaggaggaaggggaggaagacaaaagaaaaggaaaggaaaaaaaaatcttggaatttagaggttttgattgggatttttccctttctatctcttttatatattccaataaatcagaagcaataagccgtcagatacaggcagactttctcagtgtatctgtcagtttcagagctttcttaagtgtctagatctgtgtccccttataaatttcatgtttatcgtgtgatacaaatagcagataaaatttttattttttaagcttttaaaaatatttgttctcaaatataccattactctgctaaaatgatttatttaagaattacatttctttttttttttttttttttttttttttgagacggagtctcgctctgtcgcccaggctggagtgcagtggcgggatctcggctcactgcaagctccgcctcccgggttcatgccattctcctgcctcagcctcccaagtagctgggactacaggcgcccgccactacgcccggctaattttttttgtatttttagtagagacggggtttcaccgttttagccgggatggtctcgatctcctgacctcgtgatccgcccgcctcggcctcccaaagtgctgggattacaggcgtgagccaccgcgcccggccagaattacatttctaatacacacattgttaatatgcacaatactttaagggtatttttctgcaaaaatatttacaaatgggatctaattaaactaaagagcttctgcgcagcaaaagaaactaccatcagagtgaacaggcaacctacagaatgggagaaaatttttgcaatctactcatctgacaaagggctaatatccagaatctacaatgaactcaaataaatttacaagaaaaaacaaacaaccccatcaaaaagtgggcgaaagatatgaacagacacttctcaaaagaagacatttattcagccaaaagacacatgaaaaaatgctcaccatcactggccatcagagaaatgcaaatcaaaaccacagtgagataccatctcacatcagttagaatggcgatcattaaaaagtcaggaaaaaacaggggctggagaggatgtggagaaataggaacacttttacactgttggtgggactgtaaactagttcaaccattgtggaagtcagtgtggcgattccttagggatctagaactagaaataccatttgacccagccatcccattactgggtatatacccaaaggattataaatcatgctgctataaagacacatgcacacgtatgtttattgtggcactattcacaatagcaaagacttggaaccaagccaaaagtccaacaatgatagactggattaagaaaatgtggcacatatacaccatggaatactatgcattcataaaaaaggatgagttcatgtcctttgtagggacatggatgaagctggaaaccgtcattctcagcaaactatcgcaaggacaaaaaactaaacaccgcatgttctcactcataggtgggaattgaacaatgagaacacacggacacaggaaggggaacatcacacactggggcctgttgtggggtgggggggagctgggagggatagcattaggagttatacctaatgttaaatgacgagttactgggtgcagcacaccaacatggcatatgtatacatatgtaactaacatgcatgttgtgcacatgtaccctagaacttaaagtataataaaaaaaattatagtgctttcttagtggcattgtgagttaattcatatacaggttaatgtatataaacggtttattacaatgtttggcacaataattttactcttgttttatataactcagtttcagatgttgaagaaagacggaagttattaataaccttacttttgtgatttgaagaagttaaatatttattattaataagaatactatcttctattttgaaacaggaaccattttataaccaaacagtatttttaaaagttactattttatttggacattgttttctctgtgcttaaaatgaaccaacaatttggcaccgcacaatactatcccctagcttaggtgtatatcaatacaatattagtttctttttctttttcttttttctttgacggagtcttgctctgtcaccaggctggagtgcagtggcatgatctcggctcactgcgacctccacttctcgggttcaagcgattctcttgcctcagcctcccgagtagctgggactacaggtgtgccgccatcacacccagctaatttttgtttttttagtagagacggggtttcaccacgttgcccaggatggtctagatggcttgacttcatgatcctttttcacatttattatgccactagaatattcttagaaatacatgctagccacttaatatcaatgtgactggaaaatcctataattctcatcatccctgcccacttatgaatcccttgcttcatctgaaaactcttactcatcctctgtacggcaaacattaccttctctgtgaagatttgctagacttatacacaccagtatggttgttctaaactctgtaaaaacacaattgtgtagatcacttacgttaaacatttctggttgctcatcaacagccaaccgactcccacatacatacacttgcattcccttctaatagatctgccttccatcatagaatatgaaaatgtgagatgcttgatcttgtaatgctgctttcaaatgtggtcagtggcacttaagagagcctgcctgtacatttctgtagaaggtgttcaggcatgagaaaatcaaagcctttgaagcagtcatcttgcagtcaccttgtgaccgtgggtaaataaacccaagaacggaaatccgaggaaagcagagttacatacaattaggacttttcctgaatcctccatgacatgtgtgtcacaggaataaccaaacctggaaatttgaactttcttccttgttatgttcgatgataaacccctctaacataaggcagtttgggtctcatatctgttacttatttctgatacactgctctcatacatacctttctaatttattggcacacacagtgagcaatgaataaatgtttgttgaatgaaagcaacagagaatcactttccctttcatattcaggtgctaccccacaagattattagtattaggttgatgcaaaagtaatcacggtgtagcttaggtgtatatcaatacaatattagtttctttttcttttttctttgacggagtcttgctctgtcaccaggctggagtgcagtggcatgatctcggctcactgcgacctccacttctcgggttcaagcgattctcttgcctcagcctcccgagtagctgggactacaggtgtgccgccatcacacccagctaatttttgtttttttagtagagacggggtttcaccacgttgcccaggatggtctagatggcttgacttcatgatcctttttcacatttattatgccactagaatattcttagaaatacatgctagccacttaatatcaatgtgactggaaaatcctataattctcatcatccctgcccacttatgaatcccttgcttcatctgaaaactcttactcatcctctgtacggcaaacattaccttctctgtgaagatttgctagacttatacacaccagtatggttgttctaaactctgtaaaaacacaattgtgtagatcacttacgttaaacatttctggttgctcatcaacagccaaccgactcccacatacatacacttgcattcccttctaatagatctgccttccatcatagaatatgaaaatgtgagatgcttgatcttgtaatgctgctttcaaatgtggtcagtggcacttaagagagcctgcctgtacatttctgtagaaggtgttcaggcatgagaaaatcaaagcctttgaagcagtcatcttgcagtcaccttgtgaccgtgggtaaataaacccaagaacggaaatccgaggaaagcagagttacatacaattaggacttttcctgaatcctccatgacatgtgtgtcacaggaataaccaaacctggaaatttgaactttcttccttgttatgttcgatgataaacccctctaacataaggcagtttgggtctcatatctgttacttatttctgatacactgctctcatacatacctttctaatttattggcacacacagtgagcaatgaataaatgtttgttgaatgaaagcaacagagaatcactttccctttcatattcaggtgctaccccacaagattattagtattaggttgatgcaaaagtaatcacggtttttgccattgaaagtaatggcattacatttcagcaagtaactggaaagaaaataaggccaaaaggcacttgtagtgcacagaataaaaaacaaactacacaatttttacacagtgagtatttcattctaaactataggaaaaaaatcattaaattaatttattgtggtttatgtagattgggtagcagttaagatttacattgactaagttttattttagccactagaatgaataaaatgctataaaggggagccaaaatgctgaattcccattttaaaaatgatttcttccattaattgttttcctgttctcaataattcaacattatagagcagatagcccattgaattatatggttgtaattaggttgttcctttagcatgttttatgcctcagtatttttatgcttccagaaacatcttatactggctttatataaagctgtctttaaatggaattgtattttgcctcagaaaatattgtactagacgcatatattctttgtccaactgttaaaattaaaataatattttacctatttttatatgtatactacaaattctcaaatgaaaggaagatttttgacacattgattataagcaaaacttatttagatttctgtaaatcattaaatatgtttctatgtacacgtgtgtatatacataaatgtatcactgttacgactaatcaaattagaattaatcattttaagtgtataaccaatcattataaattaacagacaacaatttatcttcaaacttttctaataatggagaattcagggcttccattgggaaaggaacctgggcctctccagccatgccacagacatgtatgcctgaataatggggtattataaactgaaaagcaaggactcctgtccgtccttttgtgaaaacaaaattcaattctgcacatgatttcttccacgtacttgagaaagtaaagttctacatcttttctgtatataaagttaacttctgtgtttgtaccatcaaatatttcacaaatctttatattcacttgtttttttcttttattttcttcacatgatcatgatctctcatgcattttatttgccagaacttacatggaactatttttttttttctaataaagtgtgagagttactacagaattatgggaaattttactttcttattagcctcagccattcaattatatattgaattgcaatttagggcctaagtacaaatgctacagaagtgttaagtccaaaaaaaaaagctttgggaaaaaaaacttcatttaataaaggtttaataaaggttaacattcttcacattcatgatagacatagcagtgtttcttctcaaaaatgcttctttgttcttatgcttcaaaatgacttcagtggtttacaatataatgattatgaattacttcaagtacatatttttcacaatgacagctttaattgatatgctctaattattttggtttaaattaaatagcttattatttccaatcatgagtactttctatatttttatattaacactagatatattttcaatcatttttagatatatttccaaatgtcatgtgaaagtaatatttgctttgtcagtgtcataagatgtatttttaatgtgggataacaaatgtttcagtaatgtataatttaattatgataagcatttttatccttgttggttacagtattagtattttatttaagtaatgaatttaatttattctaaagtaagtttatgcactattacctaaatagagacttataaattctagctgcttctgaaccaggaaggcaattttctcctgaaaggaatttttatttgttgtttattttgttttattgctcagtgtgaatgcctggtgtcttgagaaaatggaaccccttattatataagtcttttgtgacagactcaacacttttatagtaattgtataattaactttcataatgtgatactttaaggaaaaatatgacatgctgtgttatattcagcactgtagtcatgtcctaattcactagtctcaagtgtttcatttctgaactccttacacatttccaattttgtccaaatccttcaagaaatttagaaattttatgattcttttttttaaattttattattattatactttaagttttagggtacatgtgcacaacgtgcaggtttgttacatacgtatacatgtgccatgttggtgtgctgcacccattaactcgtcatttagcattaggtatatctcctaatgctatccctcccccctccccccaccccacaacaggccccagtgtgtgatgttccccttcctgtgtccatgtgttctcattgttcaattcccacctatgagtgagaacatgcggtgtttggttttctgtccgtgcgatagtttgctgagaatggtggtttccagcttcatccatgtccctacaaaggacatgaactcatcattttttatggatgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttacaatcctttgggtatatacccagtaatgggatggctaggtcaaatggtatttctagttctagatccctgaggaatcgccacactgacttccacaatggttgaactactttacagtcccaccaacagtgtaaaagtgttcctatttctccacatcctctccagcatctgttgtttcctgacattttaatgatcgccattctaactggtgcgagatggtatctgaactgcttacacatttccaatgtccaattttgtccaaatccttcaagaaatttagaaattttatgattcttaagcaattttgcctgagaatgataattataaaaatatgtgtagatgtacataaccataatacaaaccattagacagccagatttaagctggttttaccagattttgccaactttcatcataggagaattcacatttctttcagactctcttggtacatataaaagagatttagaatgggtgtttggctgagcacatttcaaatacgatgcaaattttagagaaatctgagaaactttttaaaaaattagataacctttaaatccctcacccacttttagaaaataagaaattggatgatatttgaagacgatttccttggagagagctgtgccgcctccactgactttaaagaaatttgaggtgtaacctattcatcccaagtcaagattgaaagactctgaggaaaccatgtggatgattaaataaacacctgtgctacagttcacggaacatttcaacctcaccacttgagaaatataaagggtaagaaaagatcctaaccaaaggaagaccaggcaggcatgaacagatctcaagaaagagaaactagagattaactcaggatacttcaaggctaaggaagggttaagcaatggatctcagtagagttcaccacttgcataaccagtgctgctctaatatgtctcttgcaattgatggtgtttctggagaaaccacaaatgtactgatgagaaagtgccagctttaaataacgaccagtccaagccaatgccagttaactaaaaatttgagtgctcctcatacagttctttcaccatgtcccaaagccaaacattctaaaactgcctttggctagctggaggaggagaaatagtacaaagattgaacaaggagatggaaagaagctgatgactccatctttcttagactactagcctacaaatggcacaaacttggcagagaagagaagtctcaacattaaataaccatgggactggaaataaactgacattgtttaaaagatctgaaatgattgtgaacatattttttagcatctaaaaattactagaaaagtcaagttgcctgcctaagtttctcaagagtcatggaaataactgttttaatagagtgaaacaaaaaagacaacgatggacaaaaaataatttttgtttatcttagcccataatctgtgctcatcctttggagcagtcacagtacagttacaataatacacctgccatcacaagggggcattgttttctcaatagaggagcactgtcagtaattgtaaacagcaaaatctgaacctccccacaatttcagtgtagttttcacaatagacaatattatgtatcatgactttgacacaaccatcacggtggggactggattccatgtatgttatacatttacaagaattatttcctcagaaaaaggaagttgcggtctcacaagcaagtaagacacttggtttagtgagtgtctttcaaaaaaaaaaaaaagacgtgagaaggatataaaattgcaacacaccactaaacctgcagtgcttctcaggtgacagagaaatagctccaatcgattttaacatcccattaaaggcagccagcaaaccagagaatgtattgtctgcaataataaagcatttctctagagacttggccttggtaaaataaataaaaaggggcaattctttctattaattcagttcactctggccattgataggaattagagtcagattcctgaaaatcttacacttggggggaaatgtctgctataaataaatagaaagtgaaatacaatgtgaatgaatatattatatcatatatctgtaggtaaccaaaatttcttcttccagtaattaaaatatatgtttagtgaataaatgggaacttttcatcatgttgttaaaaatagttgtttgagataaaagcacaggcaataaagctggggggaaaagaggtagacagaatttgaccttttccaagctgtcagggaaacaaagattccctagttcacaaacatggcccactatcatggagagatacataggtacctccttccaacagtattttgggtctgctaagtttctgtacaaaagtgccaaaacatgattaatatttggtcaagtgtaagcatgtcatgtgtattataaaatataacaggataagagaagaatatacatgttcagtcaatatatgtggaagcatttgttataacaatatatggcacataaggttattctcctttatactgcctattgaaaaattttgagcattgaacttgtcatggttatggcaaaaaatacattttttctaaaaatatttatataaaaatatatgcacatatatgtaatagaaactactaaagtattaatgaaataaaatcatacagattgaagtttccagtaaaaggcattgaactaaatggtaaaatataacagcattacctcttactttgatatgaattgcctttttctcctttagatgagggtgattattttgtttttcctaatggattttgtttccactgatgaattttaaacatggcttaaaagtatattggattaagtttttattattcctgtaatatctcccacctgtccattgatgggtcatatggtttgactttgtccccatgcaaatctcatgttgaattcccatgtgttgtgggagggacctggtgggaggtaaatgaatcatgagggcgggtctttcttgtgctgttcttatgattgtgataagtctcacaagatctgatgttttttaaaaaatgaagtttcccttcacaagctctcttctcttatctgctgccatgtgagacatgcgtttcaccttctgccatgatcgtgaggcctccccagccatgtggaactgtaagtctattaaacctttttcttttgtaaattgctcagtcttggggatctctttatcaccagtgtgaaaatggactaatagagtaaattggtaccagtagagtggagcgctgctgaaaagatacccaaaaatgtggaactgacttcagaactgtgtaacaggcagaggttgcaacagtttggagggctcagaagaagacaagaaaatgtaggaaagtttggaactccctagagacttgttgcatggctttgaccaaaatgctgataatgatatggataatgaaatccagactgaggtggtctcagatggagatgagggacttgttgggaactggagcaaaggtgacttttgctatttcttaccaaagagactggcagcattttgtccatgccctagatatttgtggaactttgaacttgagggggatgatttaggctatctggcggaagaaatttctaagcagtaaagcattcaagaggtgacttgggtgctgttaaaggcattcagttttataaggaaagcaaagcataaaagaaaatcccattttcgaggagaaattcaagtcggctgcagacatttgcataagtaatgaggattcaaattctaatcaccaagacaatgaggaaaatgtctccagggcatgtcagaggtcttcacagcaactcctgccatcacaggcccagaagcctaggagatggcagggtggggcccagggtccctgggctgtgtgccgcctagggacttggtgccctgtgtcccagctgctccagttgtggctgaaaggggccaacatagagctcaggccatggcttcagagggtgcaaggcccaagtcttggcagcttccatgtggtgttgagcctgtgactacacagaagtcaagaactggagtttgggaacctctgcctagatttcagaggatgtacagaaatacctggatgtccagaaagaagtttgctgcaggggtggggtgctcatggagaacctctgctagggcagtgtggaagggaaatgtggggttggagcccccatacagagtccccactggggcgctgtctagtggagctgtgagaagagagccaccatcctccagaccccagaatggtagatccactgacaccttatactgtgcacttggaaaagccacagacactcaatggcagcttgtgaaagcagctgggagggaggctataccctgcaaagccacaggggcagccatgggaacccatcttttccatcagcatgaccaggatgtgagacatggagtcaaaggagatcattttggagctttaagatttgactgccctgctggattttggatttgcatggggcctgtagcccctttgttttggtcaatgtctcccatttggaacggctgtatttccccagtgcctgtatccctattgtacctaggaagtaactaatttgcttttgattttacaggctcataggcagaaggaacttgccttgtctcagatgagactttggactgtggagttttgagttaatgctgaaatgagttaagacttcgagggtctgttaggaagacatgattggttttgaaatatgagaacataagatttgggaggggccagggacagaaagatgtggtttggctgtgtccccactcaaatttcatcttgaatttccatgtgttgtgggagggaccaggtgggaggtaattaatcatgggggcgggtcttttctgtgctgttctcctgatagtaaataagtctcataagatctgatggtttttgaaagagtgggatttcactgaaaaagctttcttctcctgtctgccaccatataagatgtgcctttcaccttccgccatgattgtgaggcctccccagacatgtggcactgtaagtctctgaaaccgctttcttttgtaaattgccacagtcacaggtatgtctttatcagcagcatgaaaatggactaacacagtgggtttgacaaggtttttcgagttaaatgataagataggtgagaaggtgagaaaggagtcaaatatatttctaggtttcttttggggaaactgggtagataccctttaattcacagaaatgagaaaacaaaagaaaaggtgtttgtgataatatgaattcaattttcacatattttaaggtaagcagctaatgtgctatcgaatagatatgttgatttgtttctcagaaataaggccttaggagtacctgttggtttgagtatcacgagatagaaatgacccttgaagctacaagagtagatgagttctatcatgaaagctatagactgaaaagagaagaaacatgagtgactagactaatgttaactcctaggagggatacctgggagaaggaaaggctcagggaaataagaagggtcaaatatatgaggggcctggtgatgggtgagaaaaagactggattccacgtggagaatctatcccatagaaaaattccagttgagaaaatcttggttttgatcaatggtatcctgtgtcctgaacactgcccatggattatttagtgaagatacaaaccaggtaatttgtcatactcccatcccgcttcatcttcaccttcggactctatggtttgtcattttattcacaagcaaccttgaactttgagtacaaagctgcttaaatcttcattgtgttctgggaaagtagcaaaccaacttttccctatttaagtgtttggtagatagtagataacacagatacctttgtgaagtgaatgactactcagaaaaaacccaatgcaaaatgaaagagcaaaattgattaatctatctgtgcttgtctttctgtagaggaaaaatatggacaaattccagggtccaagtatagatactgtagcgccaggtagtaattttcttttaagacaagctaataatatgcactatgacttggttaggcagaaattgatccctaaaatatagctgaatttaagtgaattatctaacagctgggtgacctgtgaaaaacgccataatcaatactttactggttaatactgttaactcgattggattgaaggatgcaagtattgatcctgggtgtgtctgtatgggtgttgccaaaggagattaacatttgagtcagtgggctggggaaggcagacccacccttaatctggcaggcaccatctaagtagctgccagtgaatataaagcaggcagaaaaatgtgaaaaggcgagactgtcccagcctcccagcctacatctttctccagtgctggatgcttcctgccctggaacatcggatgccaggttcttcagttgtgagactcggactggctctcctcctcctcaagcttgcagacagcatattgtgggaccttgtgatcatgtacattaataatacttaaaaaactccatatatatatatatatatatatacacacacacacacacacatacacacacacacacatatcctattagttctgtccctactacaaatacgtctttaaggattcacagagttgtgccagcagagcctattttttttatggagtttactagattcgtagatcaaaggaatgatgtagacacaatgtatctgtatttcagaaaggtatgcatattttttgaagacaagagatggtgaattggcccctggataacagaaaatttaaaaggattttgaattggttcagcagtattaggttttgaatgagaagtcccaaataagtggaatcaggaattaggaatgctttcatattaaagatttaatgtaggctgcctagtctggaatgtcttgaatttgtcacttaacatcctacctgcctagttttggagttgaactgaggattaattaaatgtgagctactattggaaggagtaggaatgggaagatctcgattaatactcaacactcaaaggaagttatctgatacactgtgaaaaacaactgttttatagaattggtggttcacacatgcagaaataacttgggttaaatggtttcttactatagccatttaattttccccttttctcttcatagtgtaacatcttgtagcccaaaactaaagacattactaagaaaaaaattagtaagcttatccatgactaagggattctacaatacagtgatcataaatgatgtgtgccaacagatggcaacttgccaagatatctttggagatattctatgggacacaagttattcttccctattgtttgactcttcaattctctataactacctccctgaaattctttcactccctaaactttccagaacagtaatattcagatgagatccctggggactcttctatgtctcctcaaactcctgatatagtgaattttttccacatcagccacatgtacaagcttacttgtatgtataaatgtaaaaacacacttgctaccttgcaacatgcagtatatctattcaatctaatgcttagaattagtatttttgaagaatcatttagtgtcaaatagaacttctggaagttgataaaaatcaggagaaggcgaggatttttaggattgattgggattcccaaaattttattctattaatttccatacatgacttttttgttatatctttttacatttcaactgtatgcaatttatatttttttactattatttatctataaagatagcagtaaatttgcatgattttatagcaatgtatatgaacttgagtgaagattgagtatttttaactgatgaagtattccacccaaacctccactaatcagaaagtgagggcatgagaagtgctgctgagtctgtagtttacatgaattgggaaagttgaaattaactaatggcaacctggatgcgataaatattttaaggagcatgtaagtgtgtgtgtgtatgagtgtgtttctgtacatgtacctacagaaacacactcatacacacacaaacctacatgctcttaaaatatttatgagagagagagagttggcaaatggggaggcgtgttgctgagaaacatgataccaagaaatactaatgctatatactggtaagagagaaacaatgcattgaaacataatagctacatatttgactttatggcataaaatgtatatataataagtatagtgtattagctttttacaagtcatagcttcagatctcttcgtggatcctcactcagctattgcttgtgagccaaggtgtcaatatatataatattctaaaaattagctaaaagtaatactagcacaactttaaaattaaaaatactgctttttattccagcacataatttttgttttatatctataagttttaatatcactcctattactagagtaattaaaaacaaaagtaaaatcatattataattatttttaaaaaagaattattctgtaattagtcaagcaatgatgttgacatcttttgaatcatgctagttttaccttacagccaagccaaagactgtattaaattgagcattaaaaagaaaaattagaatgagtgagacttaccaatgtacagcttccccctacaagatgattttatagctggaggatgaaaagtatcagactcctcaagatttccctgaaaggaaaagtgagagatcgctttaattcacattctctggcagttgtattatgtcacatttaagtcaattgatcagataaaaaaggaaaacaggaaaaactgccttgtagataaatgaaattaacaaattagggctaagaaatgataccttaaaatgagagtctatattatttctttgatgtaaagtattgtagcctataatatttaaagaatatacagaatcttttagaagaatcaatatcattaaaatggctatactgcccaaagcaatctacagattaaatgctattcctatttcactactaatgtcattcttcacagaataagaaaaaactattctaaaattcatatggaaaaaaatattgctctgatataaaagttcatgctgtaggacactaatttgttgattaaccacaaacccacttttttaatgccaaacaattgtcttcaattcacaaagaaagttaaaactaaatttatcatactgacattctttcttacgataatctctgattatttaacctctattccttctgctaaatcatttcttgcacataaattcctgccttttactatttcttcttctcgcactctgtctcagctcctggctctacttttttttttttttttttttttttaagaacttttaagttcaggggtacatgtgcagttttgttacatagggaaacgtgtcataggcgtttgttgtgcctattatttcattaccggggtattaagcctaatatccattagttatttttcatgatcctctccctcctctcaacctccaccctccaataggccccagtgtatgttattaccatctgtgtgtccatatgttctcaccatttagctcccacttataagtgagaacatgcagtatttggctttctgttcctgctttagttttctaaggataatggtctccggctgcatccaacaaagtcctgcacaggaaatgattttgttcttttttatggctgcatagtattccatgatatatatgtaacacattttctttatgcagtctattattgatggtcatttaggttgattacacgtttttgctattgtgaatagtgctgcagtgaacatacacgtgcatgtgtctttataatagaacaattcatattcctttgagtatatggtaataggattgctagtaataggattgctagtaataggattgctgggtcaattttatttttgtcttaaggtctttgagtagtctccacactgtcttccactgtggttgaactaatttacactactaccaacagtgtataagcattcctttttctccacaaccttgccagcatgtattatttttgacttttaataatagccattttgactagtgtgagatagtgtctcattgtgactttaatttgcatttctctaatgatcaatgatgagctttttttcaatatggttgttggccgcatgtaggtcttcttttgagaagtgccctttgcccactttttaatggggtatttttttttcttgtaaatttgtttatgttccttatacatactggatattagacctttgtcataggaatagtttgcaaaaattttctcccattctgtaagtcgtctatctgttgataatttcttttgctgtgcagaagctctgtagtttaatttgatctcatctgttgatttttacttctgttgcaattgcttttggcatcttcgtcatgaaatctttgcccacgcctatgtcctgaatggtgttgcctaggttatcttccagggttttttatagttttaggttttacatttaagtctttaatttctggctcttcttacttccctatctaggttgacgcttggtctacctctccacaccctcatcatttcagccttccttcagtctcaccaccctgctaattaacaactccagaccaatcttacagtccatttcccccaacccaaatgttatggtgcccaaatatgatagcttgagttccttattcatgaaattccttattagtggtttcctgctcaataataaaagtttacttcattaaaaaaaaaaataggcatgaaaagataagtgagtaaataccagcaagacagcatgcttctgacaactaactttggcccttgttcaggaagcggaaatctatatcttcatttgtttgtgtttaaaacttaggaggacataggtgagtgtctaaatcatggggtggaacatacctgaccaatgatcacttcagattcccactggtctgtaggtctaaaataaacttcactcttggatattcaacattggtatctggcagtatacccactgatacttatactgcatatcttccaaataaacgcagtattaggtatttcaaagaaagatacaaatttaataattattttaataaaagtcagaacaggttaggactgacagtctacatacactagtggaatctctgctttctcaggcctattttaatccctttctccttgacatctaagacatacaaatggtagattgttgacaggtaaatgatcatcaatgtgttacccgcatgcttaattccctgatgtatttccctgttaagcctggataaacattctaaagcccttttgcttattaagcatcaagtttatcagcatttaagcatcatactcagatcatagcccaccataaaatgaaaactgatcacttagatatcaaaacaaatagcagcaaggcacacatacacacactcatgcacacacacacacacacacacacacacaattttgccaggattccacaaacagcacaaatacatttttttttattttatttcattttattatatttttgaaacggagcctggttctgtcaccaggctggagtgcagtggtgcaatctcggctcactacaacctccacctcctgggttcaagtgattctcctacctcagcctcccaagaagctggattacaggcacgtgccaccacaccccactaatttttgtatttttagtagagacagggtttcatcatgttggccaggatggtctcgatctcttgaccttgtgatctgcccgcctcggcctcccaaagtgctgggattacaggcctgagccaaatttttattatttatttatttatttatttatttagatagcacctcactctgttgctcaaggtgagtgcagtggcatgatcatggtttactgcagcttcaatctcccaggcttaagtgatcctaccaccccagtctccttgaagtagctgggactacaggtatgtcccaccatgcctagctaattttttaatgttttgttttgaagagacagagattcactatgttgcccagaatggtctcggactcctggactcaagcagtccttctgcctcagcctcccaaagtgctgggattacagcaccatgcaccacaaaataatatttaaaatagaaaaccgatatggcttggatctttgtccccacccaaatctcatatcaaatcataatcctcaatgttggaggtggggcctggtgggaggtgattgtatcaggagggcagtttctaatgttttaacaccatcccccttggtggtgttgcagcaggagtgagtaacaatgagatctggttgtttaaaagtgtgcagcacctctctgcacccttcctcctgttgcggccatatgaagatgcctgctccagcttcaccttctgccatgagtaaaagctccctgagggctccccagccatgctttggtatattgtggaaatgtaaactaattaaacctcttttatttataaattacccagtcttgagtatttctttatagcagtggaaaaaaaaaaaaaaaaaaacaagctaattcagaaactgacacattcactttacatttaaggggtggtttaaccaagacaagttctccatgggaattgactactaatatttgagagaggatcaatcttcgttttcttggaaaagatgtcatttatcttacatgcaaaaagacgttttgttaacctgcaactttaatatctagaaaataattccattgaaggtagctttaaagagagctcaaatatctcatcttaaatgagaaagaaaaatgaaacaaatgaagctcttataggctttgcatcctacatagttattatgttcttcattttattttcagtaatgttctctcaaaaagtagtttaatttcactacctctatttccaaacctttcatcacaccttgtatatgagagtctatctacagacattgatatgtctgaaattgccaatgaccctcatatttataattccaaatgcagacttgaatttattttatctgtcacatctcatatttggttctactgaacatgagtaccattttacaacttatctcctgatttccatgatgctacttttctcttgttttcttcctgtaactctatttattccttcttaattattgaccatgtatatctcatgaaatttcttctcaggacttcatctttaacattttgcccttatcattctacaacatctctcatgatggcctaatacaaagccatagcttgaataataacctattactgataaatcccaaatatatagcccccaaattggacatttttacatcagtatcccaaagacacctttgattcaacttgtgaaaatatccaattacctttattctattaatttgattttgtgttctctatctcagtgaacaataacaatagataacattgattaagcacttataatgtatcttacacttctgatatcttatgtagttactccacaacctcatattggagatactaatattatcaccattttgaaaatcacagaactgatcctcaaagaggtaaagttacttgcctgaattcacacagctaataattattagagttgggacctgaacagactgcctgcacacttcaacattacaccttgaaaatatttgcccagttgcacaaatcagataatttggactcactttatatttttcttttattcatctattctcagagaactgtaatcacttagttctctagattatgggtataaaatgttgtattattattgtatctattccctcccctcaatccctatggccctgaccttggtttatatcctcatttctctcccagattgttttaacaattattgccctttacactagcctctaacgctgacgataaactttaatctctgaccttgattccaaacactttattcttttgttgcttacagtgagtctaggtacaaaaatgtatgactatgaaaaaagttaccctaaatgccatcttagtttttaattggctacatgaaaaagatgtacaggcatgtacgtaggtttgttgttcacaaaactcttcctatccctataactcaatttcctatagaattaaattcaaatcatcaaaattataattgaattcctgaaaaacttgaaatcatctacaaaaattatgaaataaaagtgatcatcctatttctactgtgacaatttaaaactttaatttgaatcaacagaaaatgaatacaaagaaagaccataatttatttgtcaggtaaagactgaaaaatcccaattgtccatgtccctatagccaattatttgaatgctatgtcaaaataaagttttgaggaaaaaggacctatatgagttttctcgaccaaaatgtaaggtatataaatctctattatctgtgtatgtttacatatatacaatagaagttgcaattaaaatggtgaaagttacacaagtaagctagattactactatgtattcaaacacactttaatttccacctgaaaaacattttccttatataaagaacacttagcttatgaactaaaactcctgggttaaaatgtcctagctatctgtgttctaaggaaagtcactaagtatggccctcagttttcttttctgggggaaaaaaaaacaaaggggtatgattgtactacatgaattctaagacttttttttattattctgctttaaccccttctgattgagatatatttatcaaattggatacgactgctttggtatcatcatgtgaatcatagagaggacaaaatttaaagatgaaaacaatcaataaaacaatattatgtctgtttggcaaacaaagaatatgagacatctatgatttaaaatttgagcttcacaattttaattattctaatttctaaggaaaatattcagaagcttaaatgccattctcctaaattgcctttagttcaagggcatagcagtcagaatttcaaaggcatgcacgttgttttcagcaatgcatggctttgctgcaaagtgaggataggactggaatgaaaatagtgaaagacagcagcaaaatcagtgtttggtaggtaatactctatctagaaaaataagctcaaattagagaaagaagtaaggtgagcaagctttttttggttaaacggattcataaaaatgaatgtgctgttgaccagagaacccaaaagtcttcccattttgttgtcgtttgatgttattgaattaggaacactgacagtttttatgcatgctggatgtagctttgaataaatggatagccatccagcacattcaacaatcggtcgaaacattttagatacacctaataaggggtacgaggagcagatgtgcttctgcccaaactacatactgagaattccaattatacaggcagccaaattactataacctaattgccactaccctgagtgtgggatgcaatcactgcttattcacccttgtttttccaaataaccattagtgatcctctcaacagactatccagctatgtagggagaatcagcagcaagctacttagcaacgagaggctatatttggtttctgcagacttgtttatggaactcacatagttaacttcttcctaaatcagtggtcatgggctaaaatggcttaaacattttcttccctagcaagaaaagattcttttaaaaatgagagagaaacaatgaaagaatctagtaaaaatgtattaaatgcaaaattaaattgagcactgataaacctcacttttaaaggtactttatcaaattgaaatgtgttcttccatctcagtttcacacaaagtgcaatatgtgctatttgaaaattagataatctgcttaagagctattattgggcaactccaccctcttgctaaccaaatttactgtaatgtgggtgagactgctttttctttcacaatttctatttgttgttttgaagagtgatacatttttaaatgtttttcatttgcttaaagtaaatgtatttcactgtttttgaaaaacaagaatgtaaaaacataatttttcataaaagcatatgctttctctaaaagaaaaatatatttaaacaactcacaaaagcacattatgcagtagtgaaagaaaacagcttttaaatataactattgtaaatgatattttgttttttcatgcccacacaaaaatttgtcatttgagacatgtgtagttgtatattgaggtagtttgaaattatgtgaaagactgactatatccttgaagaggtttcaatttttattttgaatgtgctagaaagtaaataaatagaaatgtgaaattcagtggaactgatttctaggaaaataaggcctaaaaagaaacagacttttagatcttatttacagaaagtagttttctgagtaggtcaataacccactttttaaggacctaaaataagataggactactgaaataagcatattatgttttagagcaactatttcaattttttttttattttctactgtataaaatcaaggagtggagaaggtgcaaaatccttcaattaccttgttatattagagactttactagattcatttaaaaagtgtaatatgagcaagaaacataaaaaatctcatcagtctaggtatcaatgttatgaaaatgtcactaacttatttaattttactgaaattataattttctttgcacaatcatatacagaaaatgattaagcacttttacaaaattgcattgctttggacaaagaaaaaattcatttcttaaagttaatgtaacttaaataagatataaactttagatctatgctgtatcccattaggagttgccttccctgtgaatcctaaatataacatatgatctcatctgctcatggcaaaataacatcctccttagaagcacatcttcagtgacagaatttctggaatgtattcctagctgaagtaaagcagcatctgcagtactacacaatcgtcctcagaagtattgctgtttggaagcagaatgacaatgaataatgttaagaaatagggcactgcccctgtgggaacacagcagcagaggtagcaaaatgctaaaactttcgactgcttttttccagagatttaaacactggcaaataaggccctgtaggcatataaaagataagagcaaatttaacccccttttcacctgttcagctgccacaggggtcatttctctatgtgtaatttaaaatttgttccatttctgccatactattatgcagttctgaggaatcagcaaaaagaggcatgcggagatagaagactcagagatgaatcctcaaagtagattaatctattaaatgcaatctattaaagcaccatagattgccaacttacacaaaggtagctctatagagctgcagaaaagaaacctacctgtccagaccatttcctgagaacccagaattctgctagccctgctctagggtagaattccaccctcagcacttttagactattgccatatgctgggatccttattaagatgcagttaccctcaggaaaggtaacaagcagagctactagcaggactactaacacattagtgttggtgaagaaactgacagagatgatgctgattgtggaaggtaaaatacaaagaactgagaaaattggaggaccaccagatgagggagatgcaaatagaaagactgaaggctacattggtaggtgtagcttggcaccaacactagcatacactgtccttttccccaccagacctcattcaaataaatctaaatgacaagtaattatccagaattttaaaaatcttgacaataatttattgcaaatggaaagaaaatttccaggaaattatttctttacctaatatgaatgtatttgtgaaaaagtctttgaatccctataacatgtaaacagttgaagagtttaatctaagagatcagtaaagaaagaacactgaattttaactgagaatacttgagttctaatctgagttctaacacaaatcaaatgtagtcattcattggatatttctgaattaaatttctcatctacacaaacagagggcagtaagagcaggtaatctctaggatataataaagctctaaagacacaaagctatagaaaataaaatgttttctggttgtgaattaaaaatacaaatgtgatattgcctctctgatacacttaggcatcagtttttataaaacctgcaatttatatgtaaaactagtatcttattagttaaataatcaaagtgaataaaatcacatgggtttgaaaggtagcatatccattgctttacttagagatcaaaatgatgcttgataaagaaagccattttcatattccaactataaagccctctctttaaatgtgatgttttatctatggggagtattgcagaaaacaaaggctggctattactcctggtaaaggagtaaaatcctatagcttagagatctttgccttctctcaatgaaactctatgggattcagaggtaaatttggagttcctatgagccttctaaaactgtctgtaaaattttgtgtgaggtgcatatgtacatttttctaagatgttttatagtttaggtccacaattcagagtgttttatgatgcaaaaaaggtgagatgatggttcacacctaaagatcaaaatgatataaagaaacaagaagaaatatgatgttgccaaggagacattctaggtaaggatgaagccactggtgctgcagaatcatcccttgattatttcatgtaggatctacctgcacacagctgcaaaattccaaagtctattttatctttagtaagataaatatccaaattagtgagtatacaaaatgacttgcagttccaaaacaagtattttgatcataagctgtgagaattgtgatttatattaactcttctattctgattactggctattttttattatttgtaacacagagacaaaagctcagaatttgtaacaaatatttagagccttcaagttccctttgtagagggtctaacatgagagagaggaggtctgtctcaggaatgtcatgaaagataccaggggaagttgtttcttgttcaacaccctggccatctactgttgaagacatctataattcactggaactgtgaatgtgtagaatggatattctccctataattgtgtttctgagtattttcaacatgagtaagagaataaggtctatgagtttttctctaaaataatactttctgattgaataatacagaggacataatagattatcatcaaattttagaggatataaattatgctactaaatttttctttatatttaaaaattgttcagcgatgaagcctttgttctgatttactgtgctggctctataccccaggataatatgttttcagatgtaaaaattggatcagacttagttgatagttatatttcttcataaaaagagaacaaacagaggtgttaaaatcattgctatctgaacaaatgtacaaagtagccacaaatacagggaatctagatttgagaattatcaaataatttgctctcatttttcatttctcagtgttctcaaacattatctcatttaattgtcgctagaaccatattagatcattaatatcatacacaatacacagactaagaaattaaagctcagggaggctgggaagttttctgaagttttcagagagagtaagtaatagagctgagactggaacccaaattaaaattgttattattataatcacacagcagcacaaaccttcagaagctatgggatagattttgcaacttcattggaatagacaagacatgattttagttatcatgggctcagtatccattacactgacattttgggacaattcaatattatctctccctttcactatcagtttatgagtcatttcaatgagagtcaactaataattacagttccagaatctctttcatattgcagcatatagaggctactctctatgctgttccagatggtatgcatagtcaatgcagaaattgctcactatgtattttgggaaagaacatttattcaagattcagaggtcaaaatgaggtctggtaatcatctatgaactaatttgctcatcctgtttttaaatttgaattattagcagacagttcagaaaatatctattttaacttttctttggccaaagtagtatccctttattaacaggcaaatttgttcagaagtttcttaaataaaaataatatttttttggaaaaacattttaacaattagcaaaacacttaaaatgggaaaataatgtttacatattagaacagtgacatagaactgaattcatataaattgaaagtcttgggacaagcaaattagcatctgtataaagtggctaccgtattttctatatctgtacttaatctgaatgaaaaatagccttgattatcaaggattgtttatattgcaactttaaaacaacaaatgtgacctcagaagtatccatctaaacaataagatattttttatattcactatctgcctttaggtgtatatgtttcagctatcattttgagaataatttctaggttatttggagtaaatgtaaaatggaatgaataaaatacatttagctaatatactcttaagatccacaaaaccatactgtatgataatcattcctattttaaatatatagcttatttgatataattccataatatataaagatgactacctcagataacatatctcataacaaagcaaacgtttgctacaaatgctttgccactagtctgtgctgttgtatcagaaacatttattttcatcaaatgatttttttaaaaggagctagctgcatttattctgtgttaagaatcacaattgtatgatacctcatgatgttttcaattttctataatattggggaaaatcgtcaattaaaactaaatataaatctatcaatggtcctttttgtttctaaatccaagaaagatggcatttttaatacttattgttaaactagaaaatatgaggcatgataagctacaaaataataccttcctttaatttgatatacagaaatattctagcagctggattttgctaatgatcaactactttgcacacattactaacaaatcatcattaagcggcttttccagatgacttcattagtgacaatagataaacacacaaaagtacaaagcattagagataatttcaatattatattctgctttatctaattattttctcagttatccatacaatttttaagatttccctgggtaaaacacaactgcatctttgaacttctaacattttatcttagaaaaatttcttatagttcactgaggaatttgagaaacttaaattatagccacaatattcaaagttgtttcagggatttagaaaaatatggacgtttaaaaccaaaactaatcctgtaatctttttttacctttaaaaaattatttttcaaaattccctacattgatttttctaggcacatgtcactctgaaaaacagaatgaaaaatattaaagattatcagaagttgcctcggatgcttcaatgtttctcacaaaacaaggcatatctaaatatagatgttatttacttgcaactatgcaatggtttgttttagagaaaaatacattcaattaaacatggaccacttacttgaaatgataagatggatgattgcactcagagagcaattaatattcctcactcaattaataaagattcacaagtatatgctgttattctgaataatatttctatagtgaagacaagttagtttaggcaaatgccttccttgtttaaaaatggaaataccacgaaaactgagctagtctcaaaacatcacgacacctgtcatataaaaatgtgttttgcacactcagtgaacaacaattacagacatccaaagtgaaatattttattgataataagtagatcaaatatgcatggaaattgtatattcaattttaaatgccaaggacattttgttcccatgagtgttttactacataaacatctttttctatcttgtatgacaaagaatgatttttaagagtcagctcacctatagtttgaatatttccacctatagcatacgtaagttaaaattattattttgtgaacataaaattacaatgtttgaagactacaatatgaaggagtggcactggtgtgcaaatctctgctccaaacctttaataaatatattgatctaggattgtatcctaatctatctatattttagtttcctcataggtaaaatgaagataaaatcaactaactgtgtgtgtgtgtgtgtgtgtgtgtgcgtgtgtgtgtgtgcttgtgtgataatgcctgtagatattttagcatatctggcatttgctgaacacacaatgattgttagatatatgttacaattatttatttcattttattagtttgaataaataaaattctgaagagcaaatcaggctctacaaaatgtagccaaggaaaatatcttccttgtgtttgcaatttagcatccctcaacttttgtttcaacactgcccacatacttttttgttcccacctctatggctccaacatttatacccctgccaaaatttgtgttgactctataactatgtaaacattgaaatttcattttttcttatggtgcatcactgcaataggaaaacactgggaaattaagttttattctcacagtgttaatttgtttacttccttgaaaaatcaggtgggtgaccataggcaattcatttaatttgactcagacataattatttcatctaccaaagacaactactaacttctcaaaattggtgcaagtgtggttaaatgggctaatagaggtaaaaagcctagcacagaaatattagctcctctcactacccaccttactctatttcttttcctgtctttccaacaggattaccaaataatcctcatttctgatagttcccattataacagagtgaactttccagtttcctaaataagcattagctgtctctgagttgtatgctagctctgctcttgaatccagccatctatttctcgctgcaaagcagaaaacatatacaaggtttcctacgtgagacagatatttgccacatttttattgcctggttttctagcatctagcagggactagttccttgatcttctgcattgctttattgcttgtcttaacctcagccctcatgtcctttgtactccttgttctgccttgctaaccttttcttcttaaattcttacttcgatctctgtttcagttctggtcaataagtactcaagactcactagcccccagtacttcaggtctgcttactgaccccttatattgtttatacccatgatttcatggtgaccttcaacttcggtgtaaatgctgggtactggcttcttatataatctttgacctgtgcttctgaccattgctatctggattcattccagctgtctacttgtttttatattcactgattcattttggtttccagttttattacatatctttaatccctactcttccagtgatagattcccatattttttactactaatttcattaatactctaaaaccactctagaaactgctgggggaaaaaaatcttcgaggaggtaggatttatgacctcagcatgcaaggcaaggaaagtagtttcctataacttttcattcatatatttaatcctcttagctccttatcaacccagaaaactaacgttgaccatcaactcccacccttccccaaaacaaatcctattatcaagtgtttctttcactaaaatgctaacaattcatagtaacttaaatggtaaactccccaaagatatctgaattttaacagagtcaaatttagcaagcagaaagagcagaaaggtggtggtaggatgattacgcaggattaggatgcctggaattataaggtatttgagtgattagggaggagccctgacactcgggtagttcaagagcaaaagagagctgcagtccttgaactggataaagatgaggtttgagaaaaaagatggagatgtttaaaatgtaagtggcataaaagaaatgagaaaagcagagcattagagaaaaaaagcagtgatgtcaattggcagctagagcagacactgataccacttcaatgtggcgtttgcggaaaaaggaggcatggagtgttcaggctggaagggatccctgcaatcatctagcgcagcctcctcatttttccaggacagacatttaacatacatcattattttcctgcttcttgtgggtccatacttagaaactggccctgcatcttcaatactttcagaaatagtagcttctttagaacatactgaactggattaaaaggagaagcagcttctctggttaaaaaaaaaaaagaaagaaagaaagaaagaaagaaagaaaagaaaaaaaaaaacccttctatatgtgtgtagaacacactttgccatctgttcctttttccacttcaagtcagtttcccttttttacatccagtgatgtaatgctgcaaaagatttgaggtcattgttaataaagttataagggaatcttttgaagagaaagttaatttgctatatatactatgtgagggatattcatagttttccaacagtaatgctctgcagtttataagaatcttcagtaaagaaagacgagtgtataccaagtagggctgattttatttcaaatatttttaaataaaacctttatagcagtgctacctgtaaatattctagtgacaacttcatgcttgatgagtagaaatgcttgtaggccaagtccttgtacttatctaaaatagcaaaacatttacacctgacaagggactttggtgtgagacagttagtcaagtttcattgtagggtagcatgacctgtctcagaatctagtcaattattttgtcatttatcacaatctaatcatagcacttatcacaaacttttttatgtgcttatttactttttcatcaggaagaaggttctgtgaagcctgagatctcatctgttagtgccattccctattaccagcacctggaataataggttcaaaataaatatctgtcgaattaaaggaccaatgggaattagagaagattgtggcatggggcctgagcagatccccaagaatgagggtgactaagaaaagaggaagacaaagcaattatgtttcaggggcagtaggtggggatgtgcttggccatacttgcaggctgatgcaatgaccttaaagaaattatgactcggccgggctcggtggctcaccctgtaatcctagcactttgggaggctgaggagggctgatcacaaggtcaggagttggagaccagcctggccaatatggtgaaacatcatctttactaaaaatacaaaaaaactagccaggcgtggtggcgcgcgtctgtagtcccagctacttgggaggctgaggcaggagaattgcttgaacccaggaggtggaggttgcagtgagccgaaatagtgccactgcactccagcctgggcaataaagagagagtctgtctcaaaaaaaaaaaaaaaaaaaaaaaaaaaaaaagactatgtcaatttaaaaactaactctaacttgatttggggcaataaaactaacaaaacttaaggaaatgttcaaaatatgtaaaattgtattttcagtaaatgattatctaataaaccaacaataagacaaatatccatggaactctcccaaatgtatatccttaccttattttattttatcgtatctttcattcttaaccctaaatttcctgtccaattttgggtgagttgtgggtctccatacatactggactccaaaaattaattctctatctaactatctattagaaaattacataaaatcaaatgttgattcactttcctgtttaaacattgtgaaaagggtaagcatatgtaatgcttatttttcataaatattaaaacttcctaaatagtgtaaaatatatattatcccatgctatgctaaatgtactttaagcataataaaagttgttatattctcacaacagatttgacacccacataaaaaagaaaaaaatgcagaagccactgaattctgggtacctaatatattactttctacaagcatagaatgaagtcatttttatttttaagcaaagggctcattttgtatgttagagaagaaaaagaaaagaatatccataattttgaagaaaagagttgtttcgggaaaacatgacttagctatcatttggtaattattgctcagtactattttttaaagtattagaaatagtaaccagtactcattcttctcctactgtgagccctcttgcagctagcacattttaattcctcttctcctgctgttagtcatctccagttttttcctccatgatatctgtgatattacaatcttttttttcagtttttttacattttattattattatactttaagttttagggttcatgtgcacaacatgcaggtttgttacatatgtatacgtgtgccatgttggtgtgctgcacccattaactcgtcatttagcattaggtatatctcctaatgctatccctccccactccccccaccccacaacagtccccggtgtgtgatgttccccttcctgtgtccatgtgttctcattgttcaattcccacctgtgagtgagaacattcttatgtcaaggaatggtgtattgcttcttctgtgccaggcaccctgtaccccttttctgtagtcaaaaaagaatattatcttcttcgacggacacaattactcttctctttcaaatatggttatgttttaattctctttttattcagataagaaatgctacacaaatttaattttcaaattcacatattagttaaaaatataccacagcaaccacatgttttacttaattaattatttaggctcctctctttttgtttttgtttttgagacaaggttttgctctgttacccaggctggagtacagtgttgtgatcacagctcattgcagtgtcaacctcctgggctcaagcaaacctcctgtctcaggcttccgagtagctgggaccacaggcaggtgccaccatgctcagctatttttctattttttgtagtgacagattttcaccatgtttcccaggctgatcacaaactgttattatttacattgtaatctgatcttcatatagcaccatcatatgcctcaagggctgcttcacctgcctttacaaatcaatactgcctactaacagaataaagtagagtacaagaaggaaactttctctaaggatgagctcattcaaacactgaggttaaaaaaggcgcctgcttagtggcaaactcccaaaagaagcagcacaggagggagatgtgctaagagttggaattgtgtcattccccaccttcaaatcatctgttcaactgtaacttgaaaatactgagaaacctgcctttaaggtaaaatcaggccaagctatgcaaaaaaggagaaactgacatttatggagcacctattatatttcaggtattgtaaaactgggtatttttcacacattctctgatttaattctgaaaacacatgagatggttattaccatctctatttatatttttttacaggtgtaaaactaaggctaaggtcacacagctaaaaaagatccaggctcaaacatgagtttctcattcaaagtctatgcttttcctcctgaaacatcacaaactttcttctttctatcgaaattctttctttcttcaaaatgtatccatctatccaactattcatctactctactcattctttctttttacctttccctctctatttcccatctcacctccattcctatggcaaagacatacttaacatttactctgtaccagttactacattaaatatcaggaactcactgtgaagagtatattttttatattatatttcaataattctttacatgtatttacttgtaaataactatctaagtggcattctaatgtaagatgtgcataatgcatataatgaacaaacatatatgtcatattaatacattttctcatgaggaaaatagataaggcaaatgttttgcccttgagatgctgatgtaagcaaaatatagagattaactacatgaaattccagaaagattgacttatgatccatgtatgcttaaaaggatgatttattgttaataaacaaagatgacctgacttttaagtgtacaataagcattgaaagctgtttgaagtttaatattttagctgcaacaattagaaaacacaaagaagcccaatgccttatttctgcaatcatattctcttttgttcttagtattccaagatgaggtagtctgagtttttgcccctcatggatatcagtaggttttacaagtgagggaacttgactgaggcatttggtcaggagtttaaatatttcatgaggaacgtgaaatgtgatgtattgtaactacagagagaagaaaaagctatggatcttctcagtgggtaaatactggaagcatatattcctatacctactatagataatgaatcccatcaagaaacaatgacctcataaatgaacagcagttgaaccctggcaactctttatagctcattgaggttttcaggcaatatcttgtatcttgtaatcatcacagaatgcttgatacattttaccattctaatttatgaagatactagaaagctatgatattagttctgtcttcattctgtataggacataggatgacttcgcaactttttttttggcaacagtctcactctgtagcccaggctggagttaagtggtatgatcttggctcactgcaacctccgcctcacgggttcaagagagtctcgtgcctcatcctactgagtagcggggattacaggtgtacgccaacacacccggctaatttttgtgtttttagtaaagacgaggtttcatcatgttggccaggctggttttgaactcctgacctcaagtgatacacccacctcagcatcccaaagcactgggattacaggcatgagccaccacaccctgcgactttaaaactttgattcaaatattttctttgtttattaaactttccaaatataaaaacttgtcacctgtctactctatttaaaactagtcagaatcataacaaaaaatccccaatggccaatgatggaaacaaaatatttgacagatatgtggtaatgacacaaatgatattgtgcttaataaactatagatactatttgtatttataatatctgtaatttgaagaggcaataacagataccagcagagaaattttatgcgtctctcattcatgaggactacataatctataaaatttgcaagatttgtttttaaagatgggattgctaggatattaatatttgcctagaaccaagatgcccttaaagtttcccttagttgactacactgtagaaaggcttccttctaactaattcccctgctgtccattttcttagagcacttactttagaaaacttgtaattgtaaatcctttcctggaccttttgagatgtgaatctcccacaacccagaaaggtctttttcaaggacgtgggagccattcctttgaaatggtatcaagatagggcccctgtttttctgtttcactgggagagtaggagtctaacttcaatatgcaggaattagcaaacacaggtggcctaatcacactgaccaggctttcactaatgtcagcaagcatttaaaaatcctcctaccttttgttttagtaaagttgaatacagtctttttcctactggaatagtcttaaagaaagtcatcctggcccttataaactgaatgtttttgtcccctcaaaatccatatgttgaagtcctcataccctgtgtgatggtatttgggggtggggtctttaggagataattaggtttagacgatgtcatgagtgctgggtcttcatcatgggattcgtgtccatattaaaagaaagaaaaaaagaaagaaagatcagtgttttctctctttccctctctttttctatctctctgccatgtgaggacccagcaagaaggtggccctctgcaagttgaagagggccttcaccaggaattgaatcttcctaatctttgatctttgactttccaccctccagaccctaagaaataaatgtctattgtttacgccacctagtacatggtattttgttatagaaatacatgctgaccaagacacttgcctgctttactggtctggtgcgacttttctttgacactcactatactaatgatcttctacttgtgtatttaaagtaatggagtttacaaagatcggcatgataaatatagttactatccattgaatacttacgaataggagacattttccatatactctttcacttaatttagtcctctcatctgtgttctaatggagtagttactatttttaagctcagtatatagataaggaaactgagacttggaaactcaaaatagctttcctgaggccacaaatctagcaaatggtcgatccaggatttaaacacaggaatctgactttagggtcctcactcttaatcacttcattatgatatatgggggcaattatcacaatatctgagatttcattcaactgtccaacatcattaaacacagttttattttgcagtatgtgtatatatactgaattatgaataaccataggaacaatacccatctttgcaaagagggctgcacccagaagaaaaagctagcatgttcccaagagaaattgtgattcagttaagtccagaggaacattatatataaatataatgtataatgtatacattatacattatgtatatacaaatgtatacattatgtgtgtgtatatatatataaatgtataatgtataaatgagtgtgtgtgtacttactgcaacatctgattaatgtgaaggaaagagaaataagataaagtagcatctaatgaagcacacttgtttctgcactgtagtctatgatttctgaaagtacttcttaagaatatgtcattaaagagccgggcgcagtggctcacacctgtaattctagcacttggggaggccgaggtgagcggaccatgaggtcaggagtttgagaccagcctgaccaacatggtaaagcactgtctctactaaaaatacaaaaattaggtagacatggtggcatgtgcctgttatcccagctagtcagcaggctgaggcaggataattgcttaaacctgggaggcggagattgcagtgagctgagatcacgccactgcattccaacctgggtgacagagagagactccatctcaaaaaaaaaaaaaagtgtctattaaaaaatctgactttctgaagatgcacctttcttcaggtgcaaaaagtatcaataaaagatacccacaggaggataacctcttttattagctgctggaaagaaaaaaaaaaactattgaataaagaagtcagtctttttattttgtatttaattaaaaaaacaaacattttactctgttctttgtttttaaatcgccttagtgtttttaatagtaagtcagtttgcttttaaaacagaattatgaataaccataggaacaatatccatctttgcaaagaggcccacatccaaaagtaaaagctagcatgttcccaagagtaactgtgattcagttaagtcaagaggggcataatattgatccaaaaacaaacttctctaccgggagtcattgaaaggaatttaatgagccacattctccctatgtatgggttatatcatgggaataaattaagctcttttgcaagctgtattaactcttacaggtcacttgagtattatttattgcacagaagcagggacttgcagacaatccatcttaaaatttataaattgttcaaccttgaaaattctgcctacatattcactttgggattgttatttttggttataaaaataggtgaatttgtatcaagtagagaattgtaaacataagcagaaatataatgttcataaatacaaggcaaagtagaaattaaaggataccaaattgcaagtcagcaaagctggttcctagtcccatcttattccccaaatatctaaccttggatggttctcctaaattttcctggatttaatttatcatttctgagatgctgtggctgtgaatcataaagttctggaaggctgtacaatatttataaagaatctgcacatttgcattgatatcaaacattatctacaaacatagtaaactactggtgcactactatcagtctgagtatagtcaggatcacaaaggccatgaaagataatttaacagaggaaatttaatgaaggaaatagtcacaaagatgttgaggaggtgaaaagccaccagggtatggaaagaagcccagagtttaacagcagcattagctgttttgtaccagcatcagttgaagtaaacttccaaacattcgcactctttctttcatagacctaaggacattaaagaagaaaaaaatcctccctaaacatttggagtattcttcgtaagttgcttaatatcagtaagattaaaaggtaagtagtgtggctcacgcctgtaatcccagcacttgggaggtcaaggcgggtggatcacgaggtcaggagttacagaccatcctgaccaacatggtgaaaccccatctctactaaaatacaaaaaaattagctgggcgtggtgcacgtgtctgtagtcccagctacttgggaatctgagggaggggagttgcttgaaccaggagacagaggttgcagtgagaggagatcatacaactgccctccagcctgggcaacagagtgagactccgtctcaaaaaaaaacaaaaaaaaaacaaaaaaaaagtgagtagtggaataattcaggacttgaagaagcacaccactggctcatgacagtgacatggatattaaataagaatgactttagtctgttttggaaagggagagtttattttgggtaacacgtaagatgattgcattttgttaaaggagagtattcttaaaatgccagtatacgggtatgtgtgtagtgctgagaagacaagagtggaaatgtaataaatgtttgattgttttggctactcaacaccctttctctcctgtgaaggtatctcttttccattaccttcgttctagtgattctcattgagaaaacaaaacaaaaactcatgtcttattctcccccttttgagttatgtattcacatcttaaaactgcttgatattaacacaagtaactataagttaacctagtaatgccacaccagacactgcaacccatatgttatagtttaacaatgtatagccaatcgatagctatgttattttaatgtaaattcttggtaaacaactcaagaattggccctcacttccctttaaaaaaaccacttgcaattgctacttatcaaaatgtatactccagacaatttaaatctatgctcccaggttacaatcttcaagttatcccaaataaactctctacttatgttaattttgcctcaatttctttctttaagattgataccatgaacctgaatatcatggatcctgctatcaactgagtcatgaggattagactaaggtggtagtgtttgatgcaatatgggccaattagattctctcttatgggaatttaaaacatttccagagacaatagcttctcatattgagttatttaatggaacattcaaaagaaggtccataagtttgcaatactgacatcccctgctcagtcacagcacctatatttcccaggcgctggataggcaccattgtttttttccaattttggagttatgcaccacattttagttgtaaatatttaacatgcctgttgctttgtttctatcgtttgaaataaaataaccttaactgagacagcacataggataatatctggttctctgaaataggtagaatttctttttttgtctcagtattggagcttttttaaaaccaacaaaataaaatatataaataaattcatttactttgaacatgtatgtacatgctaagttgaatttgacaaaattccatgaaagtggatcagtgagaatgtgtagaggcaactacttcagtctcgtctcccttgctaacagcattatgtgttggcctgaagcagtaagttcaaatttaagattattttagtgccagctgagtctcaagagtgagcctgaactggaaaaggggattagtttagacatgttcttcacatactcctgctcagcagttcagccaatatttacaacttccatgttgcgcaatactcatgggcttctcctcaaggatttgcatagcaacctcgggtaaatttaagagaaacatatggcaacctgtattcctgggaggccacagtcacaattgcagcatccattggaccattctattttacaaggcagttgctggtactaaccatttcttacagtaatatgcaaaggggtaaatcacttagggtgtagtttacttcttgccagcatactttggtatatattaaaggctcaagagaaagaggttttatttatggactatgaccttactttgaattagagaatttaggtgcttagcatttgaacagattgtaaaactcttgtcttttattattttctctatttctttttctcatattttagctatagatacaaaattagatatgaggattaacaaattactacatctcaaatcgtttttaatttgtaagcgtcataaacataaaaatatcttattggttgagaacaataataaaatatttaagaaattaaaaaaaaaacactaagctttacctgtggatattttaagagtatggaaaataaggttactttggaaaattcaaaataaatatgcttcattagcacataattggaatgacaatggcaaaaatgttattctcaaaatattgctgcattcagagataaaaatgtaagtaagattattatattgcacagatatttttactccttctaatattagtgttgactatcaaccaatgaaaaaatctttatgaatttctaggttagatgcttccgatattctatttccctgacaaccaatattcaaagaatataaggaggtacgactgcataatgtgtttgctaaaatagctttgtctaccaaagcaaaacctcctaaagtggccttaaacttgatgataataacacatttcatttctgtcctcagctttcaagtcccaatttcatatatgcgttataacgttaaattgaaggtttattggttaaaagaatatttttaaaaaatagaaggaaagagagggaaagaaaagaatggggagaaagaaaactactttctaaatgcaaattcactcagatacattgtcccatccacaaactctttcccgttaaaataacacaacgctttctacctactcaaagtgtcattactgccttcttatttgaattaaatataggtcagctcatgtgtgtaaaattacgaaaaccctacaaatatatgaggtataatttcatttgtccactagagggcactattgtaatctcatgaacatgacagaaatgtgtcaaagtatttttttaatgtacataaaagggaaatacagtgttaaaagcaaattgcatttttaattgccaccaacctctaaatacatgacaaattgcatgcaaattagatttaatttatcttatgttttataggttcacaaaaggctttttaaaaagtattatatttgaaagttcagtttctattttcccaccatcagcataccaatcacaggtcttgcttttctttctttctttctttctttcttcctttctttctttctttctttctttcttccttccttccttcctttcctttctttcttccttccttctttccttccttccttccttccttccttccttctttctttctttctttctttctttctttctttctttctttctttctttctttctctctcttcctttcttcctttctgtcttcttgctttctttctttcctctctttctgtctctctctctttcttttctctctgactatctctcagaacatgagaatacaaaagaaaaacaatggtcacattttggggtcaggtatatggtgttcagccaagggtatgatatattccttttgatttaaatagaaaagaaatacttgctcatttaagttactctccactgctaccctcctatgtaacaatgaaaatgcataacaagttcaacagccataatagggaaagacaatgcatatcctgcaacaggaaaggagaaagaagaaaaatatataacttgttccaatgagcaaatgaatcacagaaatagaatggaaaggacctattatgcattgaagactataacttagggaaaacacagttccacttatgtttatttcagattacattgcttagcatttatactgttcttccaacaacagctctctctttcgccttctcacatcacacacatctcataattgtctgtggtagcttttttctcagctcaaatgagattgctttgaagactaagttcacacactagagtaattaactacataattagtctagagtgaatcttatattgtcttctatgataccttcctattccccaccatgtcatttaataaaagctgccactatttctaatgcccaaattaggaaatttaagaggctgatttatccagccagaaagggaaaaatgaaaggacaagaaacattctttttcacagaggaatctgaaaatagtttagggctgcggaatagatgttagaatgaacatcttttcacttatgtaaaatgaaggtttttggggattgtaatgatcagcctaagtgactacaatttataccagtggttctaacagtatagtctctggacctgcagctttattatcacccggaactcgctagaaatgcagcaaattattaggccccacccacaaatactgaatcggaaactctggaaatggagtctggtgatctaagccttaacaagccctccaggggattataacgcacactagaattcgagaaccattgattgattgatactgttaaaagattgaataaaaaactaaaatcgtgactctcatacaattttcaacaatcgtatttcaatttactcaactcactaatgaggagggtggtaggatgttacaaccagctcaaaggagaactcaaataactacatatatctaggcattaaaagatgctgaaataaatttacataagatgtaagacttttctatccacagcgtgataagtaattgtattccaccaagcacaatccattagcctttctatggagcatttataaaattattggttttcagccaggtgcagtggctcgatgcctgtaatcccagcattttgggaggccaaggtgggaggattacctaaggtcaggagttcaaaaccagcctggccaacatggtgaaaccccgtctctactaaaaatacaaaaaatagctgggcgtggtggcagcagcctgtaatcacagctatttggtaggctgaggcaggagaatcacttaaacccgcaaggcagaggttgcagttagccaagatcactccatcgtattccagcctgggcgaaaagagtgaaactcagtctcaagaaaataaaagataaaagataaaaactggtcttctacaacagagttgttaagtagccgatagcacttagggagaggtaccctacttaggaaagtaatattttttttctctctcttgcccatttcaacatctttcacattttttttcccctgaaaatctatgtaactcatgcttcccaaaggctaattatggttaaacatctttcatcttggaatttctgagtcatgccagctcaacatactaattttaagcctgtgactcagtcttgctcccaatttacctctgttaatgaattagttgagacaacatgagaatgagagagatgaaatagtttgtcttattttgtaggtaccatgagaacattttattgccctaagaattaatatgttaagaaaagactgtggaaacagaacaccaatatattgaatttttagtatagccaataaattgatgtcatttgcagatcatgtgcatgggagtgaaattctgcttaattagcagtaggaatcgactgtaccaaatacagcaagtacactaatatgttattctatgtaacaaggtcaagttctgcaaagaagaattgtgtaaattcagcaaaattcaactgttccacttctgtcaacgttttaaccaattcatactgacatagctactcaagttataaaactgaatctgtcaataccagagaaaataaagcatttctcatcctttcttaagaaataaatgtcccactatacatatcagttgtcaatatcaaattgggttcaattatacatttaaagtatctattgataaaaaagagtaataacatatagtatagtaagaaaaaaagcgttatgaagagcaaaaagagaaatcttggggtttatgatctagatatctaaatacctagttggtaaaccttggaaatattttaacttccttcagtcttagctttcacatctttgaactgaacagatagctactctatggcagaataccgcatatgtaataaaagaatcatcagttctaatacaaaacacattagtgtcatatgtacttgattacaaatatacacaatttggtaaattacggtgtgaaagccctataatattcagatatagaatctgaggtatatgagggtaggtgaaaagtactccacatttcttgcaatgtagcaataccagctagttcagaggtaactggactgtgaaacatctattgcaggtagcagtactggggaaaaacaaaaacaaaaaacaaaaacaacacctcagaatctctagctcccagtggatagtcctcaaattacaaagttcaaagagcatgactattagccagtattatgactaaaaaccttccctcacagctattaatggaacacaatagtaaaaacacaccaaatgtgttccctaacccttcatatattttctgtttttttttcagagtacttttctcagcttgtaatgaatatccttcctttgttcttcatttatttaggtctttttttgtcttcaatgtgtaacttaaaagacaattttttttcactttttctgtcttatctttaccagaattattcctctttgtttctcttaaaaattctgtatacctcaagttagcttttatttaattctgcattacagtatggtgaattgttttgaggggcatgacaatgctgtattaacttaaaaccttaatgtccaacagagtactagaatcttaattagctgtacaacaaatgtttgctaaatttgaataatagatattctaatacccagattacctcaaaaaagatgaaaaacatgagaagactataaatcaaatctatataggcttcctattatttcatgtatctggaggcaggaaaatatatttatctctgatatctacttttctcttccagtgaaatcaaactcctttccatcaggggattgtggttaatggtctatcattttaagcaccatcatcacaaattctacaagcctgaacctctccaagaagctcagagtatgtttggtcttattatttcccaaacatcctccctcttacaaaaggggagatgtatttgagagacattaagcaattaacccacaaaaaccatatgaccaaagccatatgtcacccccaacctgagggacagaatcatttacaccctaaacctcagcataatgttataaacttgtataaaaaaaacttgcacatgtactccctgaatctaaaataaaagttgaaattataaaataaataaataattgtttgaattacttaaaagaaaactagagttgctattttatggccttggccagtgtcttacatattaaaggagaatgctgcactaaatttgactgctccacagtgactttcctaaaatttccagtctattcagtcaatagtgatttgaattttaacatttaattaagaaccagggaaatcgaactaggtataaaaagatgtttcaaagcatacatagtaatttgccttgcctagattgctacgctgtctctggaaattatcaaataaaatcttctgcctaatactttgttgtgacttggattagaaagaaagaaagaaagaaagaaagaaagaaagaaagaaagaaagaaagaaaaggatgctttgcagaggtccagaaacttatcatttccagtacatgtatttattgcctgagaagacaactctaacccaaggtagttggcgcagagttgcacgatgttagtcagtggatccatggttgctttctgttattagccaccagccccataaaagtcaaaatttttgacaaaaacaaaacaccatgcagctttgttgtggtcagatggctttacttttcatgctttgaagcaagaactccattaggctttttttttattttttttcttgggagaaggcctattttatttgcttgcaccactagaccatttgatttttgttatagtgctcaaccattttcagtacaaataaaatcaaatttttggtctgatacatttgtgttccctagggcctgaaaggaaatgttcttttaaaaaattttcttagctacagattgctttagttacaaaggcaaaccctaaatatcaaccaatatgtggaagagctggaaggttcagatagaaggactgcaaaatccagtcaagaaacaaagcaaggtagtagccctgttattgctccttaaatgttttcccaaagaaacggggaagaaaagtattttccggtgattaagaaaataaaggaaatcaatcatgaccagttatactggggggagtgggctgagacaactggtgtctatttccaaccaatttcttctttattagtatttctttgatgttactggtatcacaaagcaaattaagcaactgcaaaatttccttaagacatcattttgaagatagcacaaaagtagctaaattttatcattcacaaatgttcagattatttgatactaatatcttctagcaaaatgccatttcacatggaacttgaagtgaaatatttgtccctagtaaagtgaatggcttatttagtggatggttggtctttttgccaattctgcaggatactttttttttatttttaaggcaacaattttggcacaggcaaaataaagcatactttgttatgtttattgttatgaataaacaataaacaagtttatcattaccaataaagcttcacaattctgaactttaaccactatcctgaaaatatgtttatctatttgcattaaaaaaagcagtggcaaatttaacacccgtttcaatggattcctgatttacaaccatggttccttctcttgaggagaggccctttaaccacttcactaattgaagctattaattataattttatttataatttcattaccaggtttcaaaaaatgtatacataatcacacatatgactcatttcaacatgtatgacacttagtagctcttttcatggaataagctgaaatggagtagctcaaaagctgttatttttagcataaaatcatgcctccatggggggacttcctactgcatagcttattctccatgacattggcatgcaccacagcttcctttaaacttcttcaatgcaatatgcctgaaggaccaaaacgatgctagatttccctaagtctgagatactcagagcagtacacactctttgacactttcactaaacaaaagcattttttattattttattgttgtgtgcttgtttttgcttctggattgttgctggtttcaatactactatgtgtactcatatattctcacaatatttgtactgtctcgtgtttcttaagtctctgaatgctagagtaaaacatatcttacagaaatctcactccttgtctaaactgttgctttgatgtaagagttggttgtccttctggaaaaaaaaaaaataggctaggtttcagaagatgttctctagagtgcattcctctccaaacaggaaaaagaaacttgggcatttggccgtgcttatgagggtgatgttggtggcactattctctccaagtaagtactaatggatggtccaggataaaattgggattgcagtgcttggcattgtgaatcatataaaacaaaataatcaaaatcctatgttcctaccaatttataaatccacaggtcctttggaggagagcagtaccatttatctcctgttacttcagttcggcaaatgtagctctcccttagctggatttgatattttactgtattgtgtactaacagtaaatagctacaattataatggcacgtgtttccaaagggtcttacagattctaagaaatgtcatcagttttaaaactgtcatcagttttcaaagatattgtttttccaatgttatacatctttcacagagcactaacataattttcagtttactcatgtggaaacttagacacagaaggataaaaagcagtgagatatctaacaattctaatactagcatctaaaattgactgctttgcacttacatacatgattattaatcctgagactctgcgaggaggtattattatctcttattaacagctaagtattattatacttacgaaggattacaggcaaagaagggtaggtaatttggccaaggtcaccccattataatggtaaagctagagttcaaaccaaagtcttttttactctaaagaccatgctttttccattattcattactcatatccctatctcccaccccaacagcacaaacgagttagatgcagtgatgacctaataaatgtttaataactatctctctggatgaaaaagcctagattgtagcacttgccaatttttctggtgaaatactcccattatggtcaatttcaatctacccatgtgatgttactgaacctgaagttgggaagagatggctcttgggattttgtgctagctgactccagcgccacactgaatcacaatttaaacttttccttctatatttctgatacaatcctgagttccttcgctctaggtcttccagttctggtaaaaaaataatggattcaacaggtctattgaaattaccaacacatctaggaacactgagtttatagagttgtttttgctttacaagaaagacaactggttgcaggagaaagcatatcagacaaagagtaagaataattgatctgagcttacattccaaatctgccatttgctggataaccgaatgtggaaaaggtggtgaaaagcctttatctttcaggaacttggccttttcatcatgaaaatgaatataataacccctatatgaattgccttcaaggtgagtatcatataagataatccatcctgaagtattttatatataaaaatgtgaagaagatatagagtgtaaatgataccagtgatactctcctggtcctttggattggtctgctacacattccatgccctttcacacacaaactacttaatttcatctacgtaatatgggaatatgtcagaaataacatagactttgaagatgcgaggtatacaatagtggggactgtgttttcaaccaccaaaccatatttgtccctcttttttttttcagcttctctaagttaatacttagaaactggtgtaaccacaagagcttttgatgtacctttactctgtgcctattgcctctgctaggactgaatcagcatttctatttccaagttggagcaggtggaaggccactaacagtgaaaaaagagtggaatgccaagaagaatgagcacagaaatatactctccctttttttcactctgtttagtacacatgttgtctttgtatttttggcccttttaaatgcaccctacatatccataaagaataagcaatatttgaaataaaagccatcctgtgcattcgtagactgccttcagacttctttcaggttcagtttattcccaccatattaaacagtttgtttatcattataatctttgcccttcagcaaaattagttctttgtcctcttttggctgccagatcctattcagccttttggatctggcagcttggttttattgtgtcaacccatggtttcttcacaaaatggctttcatcattctgcctatccctgtggcattgtgcagcttccatctatctgacagggaagggagataagacatttcccccaatcttctgaatagacacaggctggagatggtaacccagactacaagaatcccagaatataagaaggcaacaaggtcaatgagtctcattactaagcagagtgcaaacaagaagttgttccctttgtgatactccattacagttccaggagtgtgagcacctgcaggaatcaggctgtgaacattagccccttgctggtttgtagtgctatactatgccaggctccctattggagctggattttctcctctacatacctttccaaactgcctgaccattttttaattgtgaatagctccagtggagttgctcccaggatttctctagagaaaataatgctttttctttctctcacaaaaccagatacagttattcagaattatggtgcacaagtctggtgtttgatcagttagcttaacactcaacataattagccactgagacttgactttgaccccaatacaaaaagatttcaattttaaaattaaaaagaagtagtgcatatgagtaatgactcatattcttagttttagggaaaaaacagagataattgtgaatcagaagtcatacactttgacaattatgacaattatgaaatgaacaaactgatatgtgttgacatgtttctgtatcttgcttcaatttttcctgctttttaaaataattaatatctactaaattatatatactataaaagaagagatcctatgtatttgctatttagcacacatagtataaatgatgctctaggatactatttcaaaatatgtgccatgaacacactgattattgttaaaacacatattcttggggtgaaaccaagacctactgattccaaatttttggtgtgaagcaggggaatgtcaaagattaataacaacaaaaaaggtaattcccttgctcagtagaagtggaaattaccaacataggactaatatatgggccagttgggcacagagaggaaattggtttttatgttggcttttctggcttaggcaataaactgtctgttttgtccacttttttgtccattgcaccatttttgaccctgcagcttttcaagctcttccattccctcattactgtttatcttaattacttaaacagtattcaaagaaatgacaaagtcaaagatagaggattataaagtttttctctaacctttgtatgtacctcttgttcaataaaattaattacagattgtaatttctttaagttgggttcagcatctttgtagcattgagagtaatatttagcacaataatttatgcatttctatgaaagattttcagctctttacataagaaatgctgcaacagaaagtaacactaggaataattaaaacatgcataaattaacaacattatatttgaataaaattaaaagagtcatttatggagatcataaaatcacattactatatacttctttgattacattttaattaataacagaagtatttaatcagaaaaaatattttgcttaggatttttcaaaaaattatgcagtcagtctttacatcaatgtttcttgttaaaatgaaattttcaatgactatttagtaagttttattatgtgtaagactctccaccggccactatcatatatattacagttaatttctaagctattctatcaggaagagattatgattaccttattttgtagattaaaaaaatagagtcatgagtccacaaaaatccctagaatgagcaagtgagtacagcaagtttcaggacaaatggtaattagggaaacatcaacttctttcttccatatgagaaatgaacaatttgaatttcaaatgtaagaaaagattatgatagtacaaaaatcaaatacgtggtataaatttaacaaatgatgtacagaatctgtatgtgaaaaactacaaaactctgatgaaagaaatcaaagaaaatctaaatacatggagagagatttcatgattacagattggaagactcaaacaatattgccaagatgtcaatttttccctacatgaatatagatctaacacaattttcattcaaatccaagcaagatattttgtatatatggataacctgattcttgattgtaaaatttatgtggaaagggagaaggcataggatatccagaacaatagtggacatgaggaacaaagttatatgactcactctacttgatttcaagacttaccgtagagctacagtaaccaagtcagtgggatattggtggaagaatacatgcatatcaatgaaacagaatacagagttcagaaatagacctacacaaatatagtcaacccatctttgaaaaaagagtaaagccacttcagtggagaaaatcattaccagaaatggtgctgaaatgtgtatgtctatatgcaaaaaaaggaaagaaactagacatagagctaataacttttataactcaaaactcaaaaattaactcaaacaaggattgtaggtctaaaaataagtctaaaactctaaaaattctagaataaaacatgagaaaaatttatgtgacttgatttggtgatgagtgtttaggtataacaccataagaatggtgcatatgagtaatgactcatattcttagtttcagggaaaaaaaacagagataatcaatgaccagaaatcatacaccttgacaattatgagaattataaaatgaacaagctgatatatgttgatatgtttctgtatcttgcttcaatttttttcgtttttttaaaataattattatctactaaattatatattctgtaaatgaagagatcctgtgtatttgctacttagcacacatagtataaatgatgaaaaaattggtaaggtttacttaattaaaattaattatactctgtaaaagagaagaaaaagattaaacatagactgggagaatatatttgcaaattacatatctaataatatacttgtatatgaaatatacaataattcttaaaactcatcaataagaaaataaagccattcaaaacataagcaaaagatataggtggcaagttaagtatatgaaaatatgctcaatatttcgcatcagaggaatgcaaattaaagcaacaatgagccatcactacatatctagcagagtagctaaaataaaataaaataaaaaactgatcatgtcaattgtcagtgagtatatagtgtgtccagagttggttccttccagtgggttcgtgatcttgccgacttcaagaatggagccatggaccttcgcagtgagcgttatagctcttcaagatggcacgaacccaaagagagagcagcaacaagatttattgtgaaggtcgaaagaacacagcttccacagcatggaaggggacatgagcgggttgccactgctggctggggtggccagcttttattaccttatttgtcccctcccatgttccatttttgtcctatcagagtgccctttttccaatcctccctgcaattgactgcttttaggatcgtgcttattgttgcattttacagagcactgattggtgcattttacaatcctcttgctagctacatagcgctgattggggcgtttttacagagcactgattggtgcactttggaagatagttgtgtagttttctgcaaagctacatgaagtcttatcatacgatccaattatcactttctagttatttactaaactgatttgaaaatatatagccacataaaatgtttatagcagttttattaataacttccttaaactggaagcaaccaagatgtccttcagtaggtgaatagacaagcaaattgtggtatatccatagagtagaatacttcaacttaaaatgaatgagctattaagccatacaaaatatcgattaatacattttgctaagtgagccaaaccagtccaaaatggtgacaggtaaaactatagagatagtaaagaaatcagtggttatatggggtttagtggagaggagaacgttgaatagatgaagcccacaaggttttagggcagtgaaactttaccttatgatactgtaatgggatatatatatagttgtgggataccaggatggaatgcaggctgtaacataagactctgtattacaaattcaggaaacaatctcattaaagggagtagggtgagcagaaggggctgccataagtaactttggaaatgaatgttgtctctaaaactaaaagcaaaggaaatttcacataaatactatactatagttgataaagttgtctgtcactgtcacagccaagaggagcctacagagacatgataatgaaaaacggtattctggatgtgatagtagaataaagaaataacattaggtaaaaattaaataaatcccagtaagcatgcactttagttaataaaagagaaagaaatatttgatttgctaaaaatcccaaagctgaaagatggcagttggaagatggttggtgactagttcccctgtctagttcctttgcctttgagtccagtggtcttcctactatgaggaaagaggtctcatcagcatgcattggacaatgactcatttctacatcgttgacatgtgccaatagttgaggaactaaaagcctcttattgacaagggccagattattcaactagattatgtcacatttatcctctactccctgttgtgagtgaactactatactgggttctgagaatttttgaaagatttttcaaaaagtgactaattttcttaaaatatacattaatagtttataaattgtatggactgacataacttttgaaaccagcatagctagaaaattgaattaaagagaaatttcaagtattcttgataagaggtaaagtgcacataaaatactgtgatgcttataatcaccaaataaatatgctccagggtgaaacattaccttgtgtaagctgtcacagaatttgcgtggaggtatttcagatacccaccacaatttcagttattcaaatggcctactcaattctgccgatgtttactggatagaatcatggcatcatacaatatttggctcctctcattggcctgcttatgtgccatttaagaccatgggccagttggctttatttctcatctctgcaggctcctatagtggcctgagaatgtttagataactataatatccacagcaatgcaaaatagcttgcagtttgtgagaccaaatccaaagccactgccatgtctagaaacacagaaataaaagaatatggctctattccagtccctcatcatgcatcaatgtactcagggtgttattggctcagtttggatctctggaacttctaaagctgacagaggagtagtatttattatttttaaaaggtgtgagaacattagaggatctgattaatgttttggatgctcttttcagaaaaaaataatgcacagacacattctattttcacttgatttcatgatgctttctctgatcccactaaagcccatggatagcagttaatgtcaccagtttttgaggttattcagaaattcctctgtaccagctctgatttagaggaaagagtgggctcctgtgaacttcctgcacatgttgtgcattcagcttatgtttccaaaccagagtagtgggaaggaaatgataagctctgctgaagcacacacagtatatatagcatcaatccgaagccatctgaaatgttgtaatatagccaccatttcaggcctctagtaatgatggaagcattgcttccctaaacctctttatgaaagatttttatttctccagaagtttttgagaaatattacttagtcaaacgatttaggtgtcctttcctttcaataagtgaggagataggggaagagagagaaaaataaaatttgaataaatcccaaatttataaattcattctgtgtggatttcatggagtaataagttattgatgcaaatattgatatgggcatcacatgaagattttcagtggattatattcatttctgtcaacgaataaaatacagtgaaataaggcttgtatcttttgctgagtacttgcaataacctacattcatttttattactgaaaacctacttgctaaaaatgagaccccccgaaggtgcataattattattaactacaaagcaaaaacttagtacattatttgacatctacttttttccacattttatttttatagtctccaggataattgtgaaaaaacagattcaaaacatatctaagccaactatgaaagtaatttacttactttatggcatgctcattcattttccacagtatttctcatcttgttattgatataactttttataacttatttgatttatatactttattattttatgaaataaataatattttatattaatccatcatgtatttattgttatgattatgggggattttaatcagttttgttcactgataaatcacaagtgtctagacagtactttgtgcatagaaggcactcagtatatatttgctcaatgaatacatcatttttttcatctttgtttctctcattttctgggggggagggggaaaattggttgtgctctggataaaagtgagttattatattagacatacaattccaggatctttgtaaaattgaagctttagagtctaccttaaattttaaacacactaatttttcaaataaccaagggctgaggttcttttcatttctagaagcatctatccaagatatctgcttcatcttctataacgatatgttatgaatatattttcttctacataaatgctttaaagaagtcttcacactcacagttttctttccatggagtagcaaaaatattctactcagagtacgccctgaatcagttaaactaataatctattttgagttcctgacaaaggttattaaattctggcctcagtacctccataatggttacctgatctattccctcttcccattttcactgccaacatcttcatattcccattatttgtcatttaaagtactgtatgtggccctctggcttcttgagtgcaggtttgagggtctacgtcttgcactgcctgccgcctctatctccctcatctccagttttatttccagtacttccacgtacatgctgcaagctatcttcttgaaccacggtactcatcatcctatactgctcaaaaaccagctggggagaaaggtttaagagcgggtgtaaaccttatctctgtgggaagattttctcagatttaccttcctcagctctgtttctttggaaatgtaggaaaaggaaactgtgttactaggcatcattgcttattaactctgactggaggactgcatctgtactgggaggaccctgaatggatatatagaccctgaaggtccatatgataaaactctataaaaacatgcagtaaatgagaagccttaacctcactgtttggtgcttcttggaaaaagcatggcccctgagcaggtctgtcagctcctctcacgggctgtcatatatgagccttgcctaggctgaagtgaccatcatgtactcatggggtcccaacccttaaaactgagcatgccccttgtgctgcctggggagcagtgccaagatggcagtaagaactccagaggaaaatgtatttgagaaaatcacgctgacatgctctctttccaatcttatatccttcctcacagctaaataaacctagcgcacattacagctaatggtgctctacgaacatgaaggtcaatttgaaaccaagaccattgctgtatttgtagagtagatgttgcagcaccaatgattctttcattgcttagccatatagcttggtacacactatgtacaacctgacttcaacattatttcccttttccttgcaaaacaaaatctgatgtccatagctgaaggtaaaacacattacatccggagacttactacagacaccaaacaaattgtggttcgaataaaacttcacgttcattttatttatttcccactccttatacatagtgcttgataaaatgttatgtaacaattatgtgaatgaattatcaacctagcaatacctgtagctttttttgtaatactttatcatcctttgcctgctcacccctttctcccattatccctaacatccacatctaaacatgttacttttctgtaaaatgtatcagagatttcacatatttccagtaattcatgcaaatgtactctagcttcctaacttgtggttctcaaaattcatttgcttaagattcacttgtgaagcttttagaaatgtacttttcaaatttacctctagagattctaaaattagagctagattagggctcagaatctgtatttaaacactgtgtttggagtatttattactttttttaacttttaggttcagaggtatatgtgcaggtttattatacagataagttgcatgtcactggggtttggtgtacagattattttgctatccaggtaataagcatagtatccaataggtaatttttcaatcttcaccgtcctccgttcctcctctctcaagtaggcacccatgtctgttgttcccttctttgtgtccatatgtactcaatatttagctcccacttaataagtaagaacctttggtatttgtttttctgttctcaagttagttcacttaggataatggccttcagctccaaccatgttgctgcaaaggacatgatctctctttttttttttttaaaaggttgcacagtggaatcggcatttttaaatagccttctctgttcattctggttttggtaatccacctaccataatgttagtattactatactctaagtaacttgtggacaccacattcatatttgtatctcctctacactttaaaaatagtaattgatatatgtaaattctcaattttgattggaatgaattatctacagacaagtggctggagatggaataattccaaggaccctgagaaatattagaaaataacttagtaactccaaaataagaaagaaaaaaaatctttaaacatacatacatttctaaatataatcaaatatcttataccaataattatgcaaaatcatagatctcagggttagaaagaacccacctagggccgggcacagtggcttacgcatgtaatcccagcactttgggaggctgaggtgggcagattgcgaggtcagaagttcgagaccagcctaaccaacatggtgaaaccccatctcttccaaaaaaaaaaaaaaaaaattagctgggtgtggtggtgtgcccctataatcccagctactcaggaggctgaggaaggagaattgcttgaacctgggaggtggagctcgtagtgagccaagatcatgccactgcactccagcctgggcgacagaccaagactccatctaaaaaaaaaaaaaaaaaaaaaaaagaaagaacccacccatataatcctatgtagccctctactcattgttggcatcattaaatatcccaatcagggggtgtttggtcatctagtctctccttcacttttcagacagtgagttaatcattatttaccaacttcataaaataacctgtataacaaatctccacagttctcttctgattgctgtttcaaaatgtgcctcctaggaatttatattcaatgtttcctattctttcttctgtgaaatgtctgcttcctctttcaggtgataattcttcaaatattttagagattgttttagtgttttccccctacacatttcctcctaacaacattaaatataagacatggttttcagactcctcaccatctggttgccttcttctgaaacttttctggttgaacattatccagcttaaatctactttcaatcgttaacatgagtagaacttttttttctttttcttttttttgggttgaaatttaaacaattatgtgcacataactttcagatctttgtcctttacacctgggtgtacctgtattttaaaacttaaaatgtcctcttaagagaccaaattcttttattgctatccctccctctaagctgatttcaaatacccattctgggaaggtaaaaatggtactggcaagcttccgaactccatgtttccaggttaaggttgtgcctgactgtctaatctaggctgatctgatccagacgggcgtgccattgcagctattctgatggctttactcttccagatggcaaattcactgttggccacgtatgcagggatttcattaaaagaaatggtaatacgctttttaaactaaaatatgtattggcaggaatgaaatcccgaggccacccctgggttgttgtgtttttgttgctgtatttttcccctcccctgaagcatccaggcaggaggcactccagaatcaagaccctttgtttttcacatggctctttttcaccatgccactgcactgccacatgtttgagtgtgggcatcaaggatagagatttggattttaattcaggccctgctgctaattctatgatattgaattaaatatggtaccttgaaactaaccctgatttctctcacttcagttgtttcatctgttaaaccccaagatctttcacagctgtaaatcttcgtgctagtcattctgcgagttggctttggatacattaaggttcgttttcctcacctttgtgatgtatactcagcaaatgcaaagtcattctgaaatctactgcaaaataggtctattgtcaccgaccctaaaggatatgaagtgcacatagttagatgtttgctatgaataattgtcagcaaatacatgaataaaacttcagagtatccaaggtaattaaatcttgcttttttttttttttttccagcttggtatgtacaaccccttcccaacacatgtcactgtcaaatgtgtggacagaataaacaaggaattttgtaacagcagagaacataacttaagagacaacaaacacaaatagagaagaaggggaaaattccactaatggtctaagtaaaacctaaatgcaaagagaacagcatacatttaaatgataagtgaaggaagctctctgtaacagcctgacagcatatcctctaaaggaaactagctacaaatcatcaccattatagctggtagcacagagtagcaaaacagttcacactaaaggaaaatcagacaggagcaggcaaacccaaaatagaaatagaaataatgacaatttcaccagaggacaaaatgctgtatctcctttattagactaaatgtgaaatgttaacactgtatgcagagtacatgtgatagggaggcattggtattcaaaccacttgtcattgctacactgtaatccaatcatgacacaaggagaaaagtagagaaattagaaatgcattagaagaaacaagaaaattgggaatgtgaagggtgacaagcttaaactgcttaaactcctagccctggcctcgcagaagactcatatttatttgaaaccattaagaaacatgttctacatgcaaataacagtacagttaacataaaaggctttgccttatctcaatataaaatgctagataaaatccattatcacacacattgtatatatttcaaaaaatgaaaataactccctttcttttctttatagggactcctactccttagctagggaggcaaagagaagtgataaaatactattttatgctcttgaccattaaaaagctaccattttgaaaattaaatttctggcaagctagacatactgagacatacagttattggtatgaatattctaaaaacattacgtaaatattggaacaaatacatctgataattaaaataaattatgaccatatatttgtttcttgcctactctcaggaacaattatctcttattttaagagactgtaggtacatcatttgagtaaattataatatttcttaatttataacacccaaataacttgtatggaatatctactaagaatatttctctttctcctttttttaaacctgctatttccatcttatagttaaggcataaggataaataagcatgcttctagataattctttgaaataaatattaattcttaaattcacagacattattttaaatattatgaagttaataactttcaaaataatactactgtaatatagcagtgtgcttgttcaagattctgatacacatcaataattagttacctagatattgaagactttgttttaaagattataatcaattataaagaaaaaggcaatgggggttacaattggactgaacgcttgtatcccctccaattttgtatgttgatatcctaacccctagtgtgatgatactaggaggtggagcgtttgggaggcaattaggtcatgaaggtggagcccacgtaactggaattagtgccctaataaaagagaccttcacagttctcttgctgtctttctacaaagtgagtagacagccttctgccagccaagagagggccctcaccgcaacctgaccatgctagggccctgatctgagactttcagccttcataactataagaaagaaatttctgttgtttatgaaccacccagtctatggtgctttgtgatagcaccccaagcaatgggtaaagtaagacaggggtgttattatatttttgatataaggaaatagcattggttttcacgttttggtgttgcaaatagatggagtttctaaatccaccaattttattcgggttttaaattttttcttagtcatgaaaatagctgagtgcttattaatcatttgattacggtatgatgcagtcatacacctctcatctgatcatttacagcataatacagtcataaccagtgttttgtaattaactaaaaaatttacacttaggccacagagagatttaggagaagctaagtttattctactttaattggactgaatataagggttatacctcattaaaatatcaacaataaatctgtgtgtaggtgacttggtttggaagatgcaaatgtgttggctccatacaaaatgaacctcttcattataatccaaaattcaatgatagcacagatcttctaagcaatttcacaaatctactttcctggaatcaattactgaattaagttagaataataaacgttaaaggatgcaaacatagtgtttgattgattagttggtacaggtttagaattatctctcatcacctttttcacacttatcaaatgaattgacacatttgacctgtgacttggggatgtcccaaacacggtcaagatgtacagcatatcataagagcaatcatcctacataagagttgctgctttgacattgacaaggcgtgtgcactgattatgctgtaggatgtggatgtactgatttatgtatatggctacaggatttgacagcaaacaattctatcaactggaaattagcaagtactgtgaattacaaattacaagacagaaaaagaaagagagggaaaggcagagaggtgaagttatgtagaaacttcatatgcatctcaagtttgagcatttgagaagttataaggccaaaaagtaactcaaaaatgatgcctgatccctagtagtgcacttaaatacatgaacttaagaacagctgacaaactaaatatgttgcttcatgtttattaaatgatgagagagagagtattttattaaagaagggaatctgtactaggaaggaaagcacacccctttcttctactcctcctacacacacacacacacacacacacacaaacacacacacacacacacacacaccctagatttattttggggttgtcaatggtaaaactccattatttgtttacattgatgattattcaaaaggaaactaaacgacagttcttactttaagaaaacaacagccacaacaaagactcaaaagtcaacattaaagactttctccctctttaattttcttatttgattttttgaacctatataaataaatcccatatctataatgcatttttccttcttctctctgcttctttatttatgatgatattctataccctataaaatataccctatccttaaagatttccctgaccctcttagtccccagaaattgttctcttattatttcttatgatagagcctatctaactcactcatacatgatatcttacagtaatagcttgtctttttacatcatattaaattcggtctccatttggattagaagtccttttataagcagttgcctagtcttataagtcttaagcattctcaatgcctatgtaggttttcatatacacagattagattttcaaaatgtggctgtatgaaaagggcatgacatgatacacaatgcttgttgtaaagagaaatagatatacttctgaatcatttgcttctcaaagcctggataaacagttagtgagctaatttttatcagcaaattcatgtctataaaacacattttaataaaagcataaagttttaatgagaacttaatatataaatgcaaattcaggttatttaacagtggaagatgacacaatagaagaagccctcacagccaacagtaatctacagtcatctagagcagtggttaccaatctttttggcaccagagatgagctttgtggaagataattttttctatggtaggagtcgggggtggatgaggatcatcaggctttagattctcataaggagcacgcgacctagatccctcacatgtgcagtttacaatagagttcatgcttccttgataatctaatgccacagctgatctgataggaggtggagctcaagcaataatgctcacctcttgctatttggcccagttcctaacagaccagtccctgtctgcactagtccacagcactggagttggggacacctgaatagagaactaggctcaaggtcatacttggtcacttaatgaccatgtgactttagatagatcatttaaacttcctaaaatctcctaagcctctatatcccaattttagaaacacagttaataataggcattgtaactatctcctaggttataagtactaagtgacataagttaaaatagtaatacattataatgttccacaatattttaagtgttgttttgttagaaaaaatgatgagtgattatatgagctataatatttgtatgcatagctatcttttctgaagtacagaaagcatattttaaaattttgtttctccaaagataatataaatccttctgtaatgttagttactatgttggaaatctatagctaactttcaaataatgaggtacgccaaactgtatatctgttaaattgtgagaagaactgaagaaaatataggaatctatactatgaataaaatgatagaagggaaaaaataaaatccatgattaaaccagtttttgtttatcatatattatttataactatgccagaattgtaacccactcacacattattctgcatgagtagctatggcagtgtttactggagttcttagatattgatattaatttccttataagtgtcactagttggaaagaacacttgattattgcatttgggagtcaacaaacactttctgtaaaagtttaaataatatttttttttaggttttacaagacacacaacttcgcaactctgccttgtggtgtgaaaatagccttagataatatgtaaaacatcagtcatggttgtgtttacatctttatttacaaaattcaatagtagaccaaatttagttcacaagctgtagtttcctggttcctatttagttcaacacagcatgcttagaacataatacataaatcttacagaaaccctagcatacatagaagatctcaataggagtctcaactctcgtagataaaaacacacaggatgatagcatgaaggtgcacagatataaaccatatcatgatttgaagtagtccagagaaataaatatcaatgtcttttaaagtaaaggatgtcctctgggtgtgtagtatggtgggctggtacatgaacattcattaggaatggttacaaaatatttgaatttctccttcattctcttttaatatttctatttgtgtaagtaaaataatgtaaaaaccatttagtacagtattatatgcataatatttgtgtaatttataaataagtatataccaattttgacaacacgccttctcaactgacgtggcgagaattttttaaaaaactacatcagtggggccaagataaccgattatttttaagttcctgattaacattgacatcatggtgaacctggccaaaataattttgaatataagaggtaataaatttatttataactgctggagatatttttaagcaataggaatagctttcaggatcctaaacctgtgacagaaagattgagttcttcactgagaaaccttgtttctgttggtcatttcatctttttgtgttgagaaataagactccagccagcacaatatgtcataagagatgtaagtggaaaagggaaagagatgctggtcataagctaaatctcaggaaatgagacacagagaagaaaagtgagagactcaggaagaatactggcgcctgcctgtgcatgcctcccatcaccatcacacacattcatagacacatacatgacacacacacacacgcacaaaggcaaagatggctatttgcttagcaacaactccccaggtgaaacacaagtaggtgaaaccatcattttgccatttatttttcaggtaaaacattctgcctcatcagtttccttagaggtcacctgtaacgttggtaaatgtttttcagtatatttcagggcagtgtgatgaactgccaaccctactctatgaaagtctctgatccatgaaatctaatatgatatgaggctaaatagataaaaacaacataaaatcctagcagtatattaagcaaccagtggtggtgcaatttaatgactatatgaccaattcaattcaatatatagaaattagttgcgaggataactgaaaaacactttaaaaatgatctgactataaatgtgtaagaattgataaaggttttagcatattgggggcacgtaatgagggctaaaaatgggtgtatttcatagtgaaaatgcaaagtctaatagtaaaaatcctaaatatatcatttgtgtaacagcgctgtagacttatttgcaattttagatgtgatcctccataaaaaatagtatacgactgatcccccatcagtactatgctgtctgggagtctgtttccttacagtgccgtaaaatttatcaacagtagaacaacccaactatcctctccttttcagccactgtgattgctactgaaggaaaatttcccataatatggagctcagtcccttaagtcctagttcaaactattgcctgtctcagtggtatgaagtggaaagcgaatctatttcacattagataggtctgtgcttgacttgaaatctctgtccctttctagctgttataaacttggacaaatacttttaatgctgtgatcctcattttaggcaagcaaagtgttccttcctgattgtgaggattaaggttaagttcaagtgtgcaggtcctatgtctaattatataggcaatgctgaaaggatcaactgcagccctaggaagagctccctaatccattcattattatatcttgtttaagataaatgaaacaaaaatgcaaacacaacttcgctgttgcaacttttctttcataatttgctttcatttcaggagatgagttcaaatctctgctccactatttacaatttaaatgccttttgtgtatatgtgcatccatctataaaactgatctatacaatttaatgaattaatacacataaaaagtttatagcagtctccacttttaggaaatattaagactgtgattttggacttccaaaaggactcaaacttaatttaggattcagcaatatcatttgctgacgattgaactaatctgctataagccttttacaaatttctgggataaatatttttaagaaaagaaaacaaaaaacaaagaatcaaacaatgcttgatttttctcaaatatgttttagagtttttttttttttagaaactgaaaagtagtatgtaatatgtataataaagacttcgcaaaaagttacacttttcttaaactaaactttatacatacacatatgcatattgcactcattttatatttaaaattcttctcccaaatggaaatgctcatcttcactttggcacaaagatagcattaggactcaattttaagccactaaaattttgaatttacataaaagtaatacctacaagtattattactagatgttccaataatgctaagtatgtttttacactatctattgaagatgtgggcaacttctgttctcaatattgatccttcagagtgtagtttatccattatatcactacaactacagcctcctatcaaacccgagcaaagtgttctcaggcagagtgggaccaggaagaaatctggtaacactaagagactaatattataataactgatcttccggagtgctatgagaactctccaaaacatcccttcacagagcacccaaaggaaattaagcattcatcttgctttgaaggtggaaccgggtgattcaatgttttataactgaatatactaatagaatatgagtgcttaatattgcaacaattattatgggaagcacttggcaccactatacaaacaaaaagacatttactgtgagggaaaatagaaagtatcacggtaacttctttatctaaaagtgtaaacttgtccttatggaaagtttatatgattcaatgtaatacttctcatgtaagcataatcattttgcagactactaatacagggtctagtttttggcaaagcataaatttttcccaagatgaaatcaagcatatttcatgtatgtgtcctaatatgcttgcaatacttagcatgaattactttatgacagtacaacttcaacttcttatttatgtattcatccattcacgaatttacttattcaactaatatttattgtctagtttgtagtaagaaaaaacattattagcaaacttgctgttagagacagccatctttttctattgcaatagcatcaggctagattatatcttcatgacaatccacaaaatgaactttatacctaccaaagtgtattgtaccagtaggaaatttcttctttacctaaacaccatggcttttcataggaaaatgtaattggaatttccagctgtgctgaaagaactgaatatgcctctattagaaacaattcttcaatatataagactttcatgtctatggaccccaagtacacatcttctgacttatgatcagataataggacaaatgatttagtgttaggatcctcttagaaaattcaagatatacactcttcaagtataaagatgaagaaaggcagatatgagtcctatagtttattagtctcttttctgtctatatggaagaaggtgatgctaggtccatttcatcttcaggaagataaaggaactggagttttactgaacacaaaatgtctgcaatgtgggggcagtagtcaagtattactgacgtttagcaaaactaatcagtctctctttattttagtttccttgtttataaaatagacagaaacatgtttcctatctacatctttggatgttatcagtctggtgtaatatacataagctggccagcataatagctaatcacaaaatatactcactaaagtttagctatgaatggatatcgtatttctttgttgggtgatggaaaaattctggaatttttggggtgatggaaatattctggtggtgatggctgcacagccttctgaatatactactaacaatagattgtatgttttaaagtggtgaatttaggggccaagagaaaaggaccaattgaggctaggaatcagagacaagcttgaacccatcagagacaagaccccatctctataaagatttaaaaaattagccaggcatcatggtgcccatgtagtcccagctacttaggaggctgaggtggaaggattgcttaagcctaggagtttgaggttgcagtgagctatgatagtgccaagcatcacagcctgggtgacagaatgagaatcagtctcaaaataaataaataaataaataaataaataaatagaaataaaatgatgaatttcattttatgcaaaattttgtttattatatcccaagtaaaaataaaaaatgtttagttatgatagtatttatgataatacaagttagtaatgcaaaagatcttgtatatggaatagacttattttgccttctttttgttttaaaaaagtatggcatgtaaaaaaatgttctgacacagtaatggctatcataagattgaattattgtagtaataccataaaatgtaataatggtgagtgggattagcaacaggaaggattagaagaatgtcataataatgttgaggtaaactgagttaaaaagatttgctgtgatttcatgatcatgatctaggtgattaagtatacctgcatattgctaaaagtaggcaatactgaagagtcatacaacagaataaggtataacttccaagccaattgaactactatttaaaaagtcaccattgagaagttagtaatttaaataattcccaatatctggaattcagattgtactctggccaaattctaacttctctacatatattaaatgaactaggtgacgggcatcggggcaaccagaaaacttgtaaaatcttttagttcaagggtagaaccatcagacacctgactgtgtgagctactaaccttctgattcaaatgtatgatgtaattaaaaatatcctgggaaagcatttagaatttaaggtgattaatgaaatagtctattatttagatctatttttcataaggcaagatattccaacacatgcagagagtgaaggacactatctacaagactgtataagaaattgcttgattgctttatctgggaattatggacagttcaaaatatacttctcactaaaactaagcatatccatatagcatagcaggaatttccatcccagtaactgttatttcactttttaaaatctgcttattactttccatatttaaaacattttagggttgttctaaacaacagtgtcaaaaatctaaatttgactgacttatgatttagtgtttattcattctactatcaagaacctgagacaatgtggaattagccagactagcttattcaccaagtaccttagtcattcagtagaatttgatcatcaaaatatagaattataattattcaggtctcaaacactgcagtgagggacgtatattgattcatggcaattcttaaagggcaaaatctgcaatggtaattctttaaaacctctgggaaaaataaagccattcaccatgattttaacaactttattttggttgattttagtcaaatattttcatttgatacatatttttaatgtattttaatgtattttatggtaaagggcaaaatactcacttgcagcccaaaagattaaagtatacataaataaaaaaaccaccaactaagaaccagaataaataaagtaaatgattttttttaatgtagaaagcaggatttatcatgctacatttagttgaatctagtatgcaaacttatttacatgttaactcagaaatagaatagcatattacaatcaatgacatattttgatcggcagcatttttcttagtgaactataaaatattagtgtatcaatcaccatgtaatatcttaaacggtaacttttgtcttacaaaaatctacaccaaaggacatttgtgtatataaatgaaatatacacacacacacacacacacacacacacacacacacacacatgcatgtggtagagtaactgtccagaggcaaatgttgcctcattttccatttctgacattagtcgctgctgtcatacatcatttccataattatacctggtatatgtaaaacaaataatggcagagcttgacttcttaacaggaaaaaattaatgagcaattttaaaaatgcatagattataaaatatgtaagatttgaactggaatttagaaattatcagaggtattcaagtactagtattaattatggcataatttgagataatcttttaactctcttctttcataaaataatcatttatgtctctctggcaagattgggatgtcccaatagtaaaaggagaattatttgaaaatgtatcattgagaagagttaattatttttgttactatatttaaaatacatccctctactgaccaattcattactgaactatccagtactgaaaactgatttttaaattgttctgaaaatattagcaagtagagttatatgtcaaaaatataaaaatatacatttcaaatgagattataaatactacttcctaaaatagaaattttaaatatttgttcctttggattggtatcacaaagtcttaagtctaaacattttcaagttagttcaaaataattgttgtttggaattgtcaactgcatgtcaattaaacgacaggaaatgtttccccaaataatacatttttagaatcttgatttggacattttcttgcaaaggttagaaagcagggtcatttattaataagactgttacagatcatgattgcaaatccatatattcttcataaataagaatatgtatctcatttttcttagaagcaaggcaggcatccagtttattaaaaaatagcatcatcattaagaaacaagttcaaaagaagttggttaccagaacctgtcctttttctctcccggaaattattaatggatcctttaaaggacgactccagatgacctcggcttcagagtagtagtacagtacaaggtgtgtatgagcatagataacttagggtttataatgagattgtacattttggcctacacttgactcctgtccacaagcttaaaaatgaaggaagtaatgattaaaggaagaaaccatataatgtattttctgccagagttccatgcaacgaggtaaaaagttgacagtagaacttaagggaatagctgtgtctaccaaaccacctatgcctcatgtaaatattgacctaagaaacactagcttgctgtgtgtcaagcaataaataagcacacatttctgagcaaaatgcccatttagatatataattgcagatatgcttctgttattccttaataaattttaggtatcatacatataagcactgaattcagaaaaggtgataatgcctaacttgacagaacattgtagaccaatccattaattatacagctgcccccaaacactcctctaaaagcatcactgatgtgatatttctgctgagaaaatttggaaatggtttaagtcatattatattatggtcaaaattacctgtaatcattatttgccaaaatgtgtcctacaaaaactgcaaattttaaattttgtataaaatattacattattcctttcaaaatacaatgccactttcaacagaaatagaaaaatgaaattattctaaaattcaaaaaagagcccaaatagccaagtcaatcctatgcaaaaagaacaaacccgaggcatcatattacctgattttacactatactataaagatatagtaaccaaaacagcatagtattggtacaaaagcacacatacagaccaacagaacagactagagagcccagcaataaagtcacatacctacaaccacctgatctgcaacaaagttgacaaaataagcaatgggaaaaagactccctattcaattaatggtgctgggataactggcccgccatatacagacgaatgaaactggactcctgccttttaccatgtacaaaaattaactcaagatagactgaagatttagatgtaaaacttcaaactgtaaaaattctagaagaaaacctaggacatacctgtctcaacattggctttggcaaataatttatgatcaagtccccaaaagcaattgcaacaaaaacaaaaattgaaaaataggatctaattaaactaaagcccttctgcacacgaaaagaaaaggaaaagagtaaacagaaaacctacaaaatgagagaaaatataagcaaactatgcatcaagaaaagtctaaaatctggaatctacaagaaacttaaatcaacaagcaaaattaaataatcaaattaaaaaatgagtaaaagacaggaacagacacatttcataagatgacatacaaatggccaacaaacatgaaaaaaatcctcatcatgatgaattatcagagaaatgcaaatcaaactcacaatgcgacagtttcttatactaccagtcagaatggcgattcctaaaaagtccaaaattgatagatcctggcatggcagcagaaaaacgggaatgcttatactctgttggtgggaatccaaattagttcagccactatggaaaactgtttggagatttcgcaaagaacttaaaagtactttttgacctagtaatcccattactgggtatatatccaaaggaaaatacattgttctatcaaaaagacatatgtattcataagttcattacaacaccatttacaataacaaacacatggaatcaacccaggtgcccatctatggtggatcggataaacaaaatttgatacatcttggaatactatgcagccataaaaagaacaaaatcgtgtcctttgcagtaacatggatgcagctggagaccattaccataagcaaattaatgcagcaacagaaaaataaatactgcatgttctcacttgtaaatgggagctaaacattgagtatgcatgaatataaagataggaacagtagacacgggggactactagagcagggagagagaagtggatgagtgggctaaaaaatccctatagggtactatgctcactacctgggtgataggatcatctgtaccccaaaacctcagcatcatgcaatatatccacataacaaatctgcacatgtacctgttgaatccaaaatcaacgttaaaaataaaataaaataaaatatatgtttaaagcttccagaattgtaggattagctgaccgctgtcttggttttaatattttactctgtctatcctcctatttatcctatttatttaaaataatttttccttctttctttatatataaatattcatagtaaattccaacccctaagagacctattatgatggctttaatgtaaaattactcacaagtcagagtcactggatgttgaatgagaagagaatgtccttaatataaatttgacatgattttccagattcatagagccacttgaagaaaaggcattgaaaatcaattccatgctccttctttcctaaacaatcatttatgtcttaattaatagatctaagaaaccagagcaacattaaaatcattagaaataaataaacaacagtatggttttttttttctttctttcttttttttttttttttctgaaatggggcagagtaactgttcagagaaacccgttatcttatttcccatttcggacattacccacatctgtcatatggagacatagcatatctataatcatgtttagtttatgtaaaacaagatgctgcagagcttgacttctcaacaggaattgaagtaaggaattaaaataatggctctcatggcaaaatactgctgtgatgacagtaagctaattttccaggcctaagaatttcaaaaaatgttttgacaaccaacagtgaaaagctttcatccttgtttcactcttacactaagtgccaggtttttatgcattagtaatcgtggactacttcaaaagcaagaatattagcattactgatttgttttccattctcacataaaggtttctcacactttaaaatgtcctatatgctgttttaggattcattacaataataataaacttctaagcggggtattacaaccttaaggtgtcagcatagaatttttttaaaaaatagaaaactatgcacaattttcaaagaggaaagaggcataggtgagatattttgtcattttgctgttcaaaaaaaaatcctgtatatatgaagtctcacaatgatacctcaaatagtagagaaattctttcactttaatggatttaactttatatattctctttcttttttcaatgctaaatctgaaaaacacagttaaatataaataagataaaagtacccaatatcccatagatggagcataatatagactacttcattactttttccaggagtctggaaatgcctgtcaggaatccatagttgttccatattttacttcagaatctatgaatgcattatccacaacatacctgcatgtcatctctgatactgacaatgcaacattacagaaaatagatcagccctactgacatgaatgcagtcttatcccttctgattactcataatcaacaactgcatttcaatacagaagactagacagtggtgccttctctatataccagacagcgtgaataacaaacatgatatttgataaaataatgaagactgagataatatgcatagattttattaacctaatgcacaaaacatatcaatattaatctgaaacagttaaacttcaaagtcattatgtgttacatgataattagccataattactctttacatgagttattatcaatggcattaatttatacaaccaaaatgcatcctacttcatggataaatacatgtatacataatagtttgaatgatttaaactgccattatctctatctacccagacctctgacattgaatatattaaagcacaagggtcatatgtactttttcctattaaaaagtcagtggttctcttgccattatatccaatctctcatgcttaggtgttgacattgctggggtgaactcatctgttcccattctatgtgaattctgtatattcctttgccctatatccacatctgaggagactttgaaacacaactaatattcagtaggcttaccgcattagagtttggattgaccattctgattacatacgagcgtaaacaccatcttgaacaatggaggaaatatcatacaggcaataatgttatttcttctacggtacactactagaattgggcactggtctgacatatagaacaggaaaagttactaagatataaattgagatacatatctgcaattctctttcatagctatcttttaaaactgaatctgtagaacaaccaaagtggtgtgaaacattctctatacatcaccccttttatctaactggctgacagaaactgtttaaaaaatgctacttctccacatcgtctccagcacctgttgtttcctgactttttaatgatcgccattctaactggcgtgagatggtatctcattgtggttttgatttgcatttctctgatggccagtgatgatgagcattttttcatgtgtcttttggctgcataaatgtcttcttttgagaagtgtctgttcatgtccaatgcccactttttgatggggttttttgtttttttcttgtaaatttgtttgaattcatggtagattctggatattagccctttgtcagatgagtaggttgcaaaaattctctcccattcggtaggttgcctgttcactctgatggtagtttcttttgctgtgcagaagctctttagtttaattagatcccatttatcaattttggcttttgttgccattgcttttggtgttttagacatgaagtccttgcccatgcctatgtcctgaatggtaatgcctaggttttcttctagggtttttatgcttttaggtctaacactgaagtctttaatccatcttgaattaatttttttaagatgtaaggaagggatccagtttcagctttctacatatggctagccaattttcccagcaccatttattaaatagggaatcctttcctcattgcttgttttggtcaggtttgtcaaagatcagatagttgtagatatgcagcattatttctgagggctctgttctgttccattgatctatatctctgttttggtaccagtaccatgctgttttggttactgtagccttgtagtatagtttgaagtcaggtaacaggatgcctccagctttgttcttttggcttaggattgacttggtaatgcgggctcttttttggttccatatgaactttaaagtagttttttccaattctgtgaagaaagtcattggtagcttgatgaggatggcattgaatctataaattacgttgggcagtatggccattttcacaacattgattcttcctacccatgagcatggaatgttcttccatttgtttgtatcctcttttatttccttgagcagtgttttgtagttctccttgaagaggtccttcacatcccttgtaagttgaattcctaggtattttattctctttgaagcaattgtgaatgggagttcactcatgatttggctctctgtttgtctgttattggtgtataagaacgcttgtgatttttgcacattgattttgtatcctgagactttgctgaagttgcttatcagcttaaggagattttgggctgagacgatggggttttctagatatacaatcatgtcgtctgcaaacagggacaatttgacttcctcttttcctaattgaatgccctttatttccttctcctgcctgattgccctggccagaacttccaacactatgttgaataggagtggtgagagagggcatccctgtgttgtgccagttttcaaagggaatgcttccagcttttgtccattcagtatgatattggctgtaggaacactttcacactgttggcgagactgcaaactagttcaaccattgtggaagtcggtgtagcgattcctcagggatctagaacttgaaataccatttgacccagccatcccattacggggtacatacccaaaggattataaatcatgctgctataaagacacatgcacacgtatgtttattgcggcactattcacaatagcaaagacttggaaccaatccaaatgtccaacaatgatagactggattaagaaaatgtggcatatatacaccatggaatactatggagccataaaaaatgatgagttcatgtcctttgtagggacatggatgaagctggaaaccgtcattctcagcaaactatcgcaaggacaaaaaaccaaacaccgcgtgttctcactcacaggtgggaattgaacaatgagaacacatggacacaggaaggggaacatcacacaccagggatggttgtggggttgggggaggggggagggatagcattaggagatatacctaatgctaaatgacgagttaatgtgtgcagcacaccaacatggcacatgtatacgtatgtaacaaacctgcacgttgtgcacatgtaccctaaaacttaaagtataataataataaaataaaataaaaataaaaataaaaaatgctacttctttcctacttgagcgcacactctcatatttcagtggaaagaggtagaggtatctttctgagccatatttttctcagactagcagagtaaaagagcagaacacagttttgtttttggagaaaaacattagttacttcaagtaactttcctacttcagtcagtttttaatgttctaaattcaagcctttagaatgtccaagagctgacctattatcctaactttatggatgaagaaactgcacataaaaccagttgaatggcaaagacatgcaggtggttaactgcggtactggaatttgaaatctgaactctgttcatatgattaaagatcactgcacttcaccatttcagttcccagtatacaatatttttctcatttctacaggttaaaaattggagcaagaagtcaaatagaatttcatagacagcaaaactgaccaaaatagaacaatgggtgtaccctcttttgacaatatcatcttttggaacattctaagctgcgctcagttacagaaatatgtggtagccctgtcataatttcattaataaatgacattgctcttgagttccatagaagctcattgagactagtagtttttgttatggttttaatttcaagattattttttgaaagtcagcataagtgtacttattaagagcctggggtctaaaatcagacttcatgggtacaaacccagaaaaactacattaagagcagtgtgtgaccttcagcaaattacctaacctctctatgattcagtttttttcacctgtaaaatcggaataaaataacatcctccaaaagggttggtgagaatcacatgagttaatataatagagtccattttcctaagcaaattaatgtaggaataaaaattaaatactgcactactatatgagttatagtaaattatacgagttaatatatgtaaattcccagcatatagtaaatacaatttaagtggttgatattattattttctattttgtgaaatttgcaattaactgaattatttgaggtttctgaccatgctatctagaaacaaataaaactttgatgtatttcatattaattattatgctcacttgaaaaggccatcctaagcaatgaggtagcaacaatgaaggccaagttaaaatgatctcacagcccatagagctttttcgctatcatcgtatgttgggtctgctttttttagtaataaaagagtgtggaagtggagcaaacttatcttaaagattcaagtttactaaatcctgattgttaaaagaagattgggtaagattagaaatttaaaaaaaagattcggagacattttatgaaagatagtttagaagaaaaaatggtatcacaactaaactagtataagacatactgcatcctctataatctatgaatgcacattaacattttaaaggatttgaaattcatccagcatatataaacatgtgtgattttataaattcaccttctcccaaatgtatatgtgttttcggtgtgagtatgcatatgggtaaaccttaatgagtaacattattaactgttcttccataggatatgttttgagaaatgcttgtcacctagtttacaccaagtattatttcttagtttagacttaattccacaattgaacagatgggtttttctgaggaatgaggtagaaaaatggtaacagcaacaaactgagaatgtttagtacatagcatttcactaagcactttccatccatctcatttaatagttagaacaatatgaagtctaaataccatattatcctcaatctatagagaaaatttaaatatccatcccaagttcaaatgggtagaaagaagtggaatttgaaccaaagcagtctagttgcaaagcctactctcttagactgatctctattatttctccaggtagagaaggcaattgcaagaatcaaaaatatctgacaaactagacactcggaaatacatttagaaaggaggatgatctcagagccactggaagtcatttacaaagaagtcagcaaccacagggaatatgcaacaatgagaatttcataggagttttattactgtaagactctttttgttattatttatagttttaatactaatggtaacagaaataaaaattttcaaatatatacatgttggagcgttacagattgggaagtaagaagaatgaatatatattgagcacctcgtaagtgtcatgttctgttcctcactgacatgcattgtcttactttacctattgatcctataagctggggacgatcctccttgttttgtagaagagaaaattgaagcttaaatctattaggaaacttgtcaatgaatcaaataataataaagaaacaaatactaaaagagcaggcagcatactgagataacgaaaaaggtcagtgagattattttaacttggtcttcattgttgcttcctcatttccttaggatgggcttttcaagttggcattataattaatattaaataaatattccaaagtttatttgtttctagacagcctggccagaaacctcaaataatttcacttaattgcaagttttacattcagatgggactgactgaaagtttctcctataacacaggtgagaaagtggggcatatgggaaactgcttggctcatgactgagaggaaccccaagaagcagaggaggtgttagcctagaaagcaagtaaaagtagatttactatgggactcgctgaaagtaaggaatgaaggtgtggaaattgatgtaggtgtgaaattttaaaaatgcctcctcaagcagataaaatgcaaaaagtcacccaatttgcagaagcataaattgcaatatgacagtcctttcactgctaatatagtgtcatcctaggatgtagtatcaggtaagtagagtatggctagtttctcaccttccatcctctgctagatacctttgaacagggcacaaacttagcaatgacaagagtgccactggacatgaggagccaacttaaaatttaaaggtgagcccactaaggcttttaccatagaaggatcaccttcaatgatagaaacagttcttacctccatttcagggcatatagtcagctttttccacagatgctttgcacaggtcctattactacacctatacggtatattttaagggtgaaacaaccacatacaaataaaagctaattttatattggaaggtgtattgtgcaatggaaaggtgacctcaactgtactcagtaagagtgatataaaatcataaatcctagccacagctgcggtatattagaggccacacattacatttgtaaacaattgcaaatccattctggggacagtgctgagtgacctggttttaggtgctgtaagggacagcattggaaacatgtatttaaggatacactgctaactccttagctacaagaagaaaagccatatgtcaattggccagccatacacatcccacgttttatagaaattctaaaaaggaggcacatttgtaatttatattttaatgttgattaatcacagatatgttaaatttttacccattttgttttaataaatacaaatgcatataataacatatttgagagcttttataaatcggttgttcccccacattgattacatgaccagttggcttttcatgccttataaaatcactactcattctctctcattttataatatgcattatcttttgagactcacattggatcaagatatttcatctaaaatttgccatagatccttcaatacattctgttgcctggggtattgaatttgatgaaacattcctcctgagtagaaaacaaaaacaactgtaaacaaaaatcaggtacagaaagctccagattattgctagaaggatgtcaatataaaaaaacccactaaacttattattaattttaaaactccctagaactaatgtcaatattattattttgcctattaatctcagataaacaaaacatgtcacaacatctaccatcccttgctggattattattatattacttatattaataaaatactcataaataaaatagtaaaacattcataagattctaatcaaatattgaatttatgcacaattttagcctctggatttcagatattcccctagatatttctcctgaggtgatattgttagtagcactgtctatcacttttgccaattcactctgatatatgtcttcagtttacccaagtgcttcaaaatgagtataaagaaaaattttctatttcataaaaagggttttcaaaattacctttacaaaatatcagaaacattacacttacattctagtcaaattcttacaatggaaaactgctcacaaaatgaaagctatatttttctgataattttcccaatgtatttcacattcattatcataataattacattcatttcttcattcattccttcaatatctcttcttcaaaacacacactttatgccgacttcaggaagaataagagtaggacttaatgtctagaaaccaattaaacatgttaaatttaataatgtaaacaacatgttaaagggattacgaagagctgagggagtcggtctatagacctagtatagctgagggagagaaaatggctgaacaaggagcacgcatcttggaatggttttcaaacaatttttacttacacagcactaatatctgcacatgcttttaattactttatatagcttgtcctttttaagtaaatctggagttcccttttcataactatctatatatttcttgattatcacaattttcttcctaaaaccaggaggtaagatagacattgacaagattattgccattgagttatgacattttaaactgcatattatatatatatatatatttatttaagagcattgcagtaagaaaactttaaaaatgaataaaaaccacattccactatggtttaattagcaaaaaatagtcacaaaagctcaccccaaatatctggagcaaaatggaaactacccaagagtctcattagagaaagggaattatacaatataagccccctaaagccctttgtggttttatggttgtgcttttgtcttaggtttcattttgagactcagtgtgaaggtctgagggttcattgtctctccttgatccctccccaccactgagttctattagatattttctatttcctcccaaatggagctctggagtcttagggatgcttatccttacaggcagcagagtcaggactggtccagacactcttccacaggccaatatatcatgttcttgcttggtgttctcaagaatttagaaaaattaaaagtggagttaaagaatttaatggcttgttgacagcaccattcttcacaatagccaagaagtggaagcaacccaagtgtctatcgatggatgaatggataaacaaaataaataaaatgtggtatatccatacaacggaaaatcattccaccttagaaaggaaggacattctgacacataccaccatgtgtaggaaacttaaggacattatgttaagtgaaataagccagtcacaaaaggacaaatactgttcgattccacttatatgaggtacccagagtagtcaaagtcatagagacagaaagtggaatggtgggtgccaggggctgggagaggagggaaggaggagtgattgtataatgggtacagaatttctgttttacaagacaaaaagagttctggagatggatggtggtgatagttgcacaagaatgtgaatgtacttaatgccacggaactgtatagttacaaatggttaaggtgataaattttatgttatatatatacattttataattaaaaaaagaatttaatggcttgatgaattctttaaaaatatctgttgaacttcctatatacacgaacacacatatgcacacacacataatgcaggtctataataatagaaatcataaattttatctggtatatgacaagttaaaattatatgcaatatgattatgtaactcatagccaaaattatgaaaataactataatgggattgttttgcatagcaattgtgtatattatgtcattacattagaatgcaatttgtaataatattttctttgattgctctcaggtatgctatttaaaagttattttatattaaaacgccagtacttataaaccagcttaatttgtggatttatctgaaaatcattattttaaactcaaagtcaatacagtaaaatggtcaaaattatttgttcaaaaatatttaaaatccaacatgtaggtggagtaatccaagtatttaagaagcaacagctttatactggtccttagcatagacgatgatttgctcctgccttagtctcctgtcgtgtttcctgctacatattccagctactctcatttcttggcagctgtattgtagttttcaacttttcaatgtctttgcacatgctaggctttcacaacacatttttctccctttgtatatctgggaaaagactccaaataatgctttacatttcagtccattaatgcctcctttgggacatctttcctgaactagcctttgtctcattctccataactctgaaatagcattatttacctttggaatgaggactctttgaggatgggaattattatcatttattattttactgattttttttctaatggctactaaagtactctccacattagaaattcaattagtcttgagggattaaaattagtcaacggcccatatttgaaaatcacattaattcatcttgaagtataagttaatatctattattgaagtaattgtctaaccacctagttccttttatggtactgtttttatgattgctgcaacataatttttaataagaatagttaggtagaaaagctacatttagagaggaatgttatttctgcagtggcagtgttttatggcaagtgcatgggattagaaggtaagaaagcatgattcttgcccctccacttttacctctactttctacgaatttctatttccttatctgtgagatgaagcagttcagttagatgacttctcaaatttttgcagctctgtgattctaacaattggtaatttgcccatctctcactccctctgccaacctgaattggaccagtttactattttctaaaaatccaggtttttaataccaaaagatgtctgaattactaacatgctacttgtgttcatattattgtatataagaagcttctgaaaaacctgttctatttttatttcaaaaacagtacaagtgaaagtgtagtctctctttcatgatgccaccatggaggcacagatttcaggacccctgcaatagggaaaggtagccaagggtcttacatgacattgaatatgctttttacttggaaacacaaaatcacctccactcacattttgttggccaaagcaagtcatatgatcaccaaggggatgaatgcccagaaagagacaaaacaagaacaagaatcctgatctatcacatattcaaaaaaaaaaaaaaaaaaaaaaaaggacattcttttgtaactactccttttcccctgacctaatttgtgcataatataccatggcactaaaaatattgcacttattgaattcaataagtttttgaattcaattttgtgaacagaccacagatcttttaacaagttctctcctctaccactactccatgcagaaaataaggttgattcctatttttctattctgcaatatattgttctaggacctcctagaaatgacattttgatgtcaaagataatccacatttaattttttgatcgattctttacatttggcctgcagaaagtctatcaatttaataatttattcattacaggctgaggtttatagtgtacctactgtatataaaacttaacctggaagttttggcttcaaggcagaatatgacatgcttattgaaatggtatgcataaagagggaaagtatagtaacacaaagaaagaaagaatttactgagctgtgaaagtgacggacacacagaaagttctaaacaaaatgaaacaaaacaaaagtggatttatctcagcctctaacaagaagtaaagtttaaaaggcattgggttatgagaggaccatctagatgatagaatcaacatcatcagaagaatagtgacaagaaatgttgagatgtatttagaaaaaaaaattgaccatttgaactaaaataaaaacgtgtctttctctttcttttttaaatagacatagaaaaaaagcaggaagaacatcaggctaaaatatacagaaaatttaaggtcagcttaaatatgtaaaatgtctatatgtttcattgaaacttttggcagtgacatacagaaaggaaagggagagtgaaagctactgccaaagtttggaattgatgccataaggggaaaaattttagtagggaggttggcagagaagaggaaaaggtaacagccactgtaaaggatgagatattaacaagctgaatgaagggatgaggaagaaatcgatgatgacactatgggcttgagcctggggaactagaaaatatgcagagcactaacttaaaatacaaatgaggggaatatgtgggtttcatggaagaacatataaatttacctttgaaacattaagactaatgggataacaaaaatgaaagtggacttggcagatggaaacggtaaatgaaataccggtcagagatggatatgcacacacactctcttagttgtggccagcaacattgtagaaatggatggaatctaagaaatctaatgaaggtccacatttgggagatgtgaggaagaggaggcgccaacaaaaatatgaaataatcaaatcagggtatggaatatcttagttataaagatcatgctgcataaacatgactcatttttttgttgtaaatagaattttacagaagcagccctggaattgccgttagaatgacccccagagtttattgattaactttgccacttaccggctgtgtaagcctaggcaagtttactacctgttcttaagcaatctcatctgtccagcatgaatgatgatgctaagtacacgtgtttgttatgaggatacacaacataatgcatgtaatagtacctggcaccattcctaacaagtgttcaataaatataagtttaatccagatacattgctttttagtctaattgtttccacagtatctggtaaatgacttatatgtagtatgtgctaaataaacatttgttgcattagggactgggaaaagatagacattagaactgcaatgtcaactgcaatatgattaaactcattgtccttcctggattattccctgaaaacattttctcagtggcctaaaggtattactaacttccttagttcaacatactcacaaacattatactttatatctggcattattaataatttctttagtgtaaaagtcattggttctgatcattcagatacgggtgattctctgcacttggaggcaaatggcagcattgtactttttggctgccatgtggttgaaagagggtgagtgactagcttaggatggatgttgtgggaataagtgacatctgtgggtgtccaatcaacctgattcttggagtcaagtcattgttgctgctttagaacactaggaatttgttatattgttttcttttcttttgtctttattttttaaattgaagaataaaaattgcatagttttatggtagacagcatgatgtctcgatatacatacattgtagactggctaaatcaagccaattaacatatacgtaacttcacaaacgtattttttttgtagcgagaacactttgaaatctactctctttgcaattttcaagtgtacagtatattgttattaactatagtcactgtgatgtatgatagatctcttgaactaattccttctgtctaactgaaattttgtatttttttttaccatctctctaatccccagcccaccccatcccagcttctggtacccaagatcctactctctgcttctataaatttgaacttctgaggtaccatatataaatgagcttctcaaaaaatcaaaaaatccaactgccatatgatcctgcaatcctactgctgggtatttatccaaaaaaatataaaatcaatatgttgaagagatttctgcactctcatatttactgcagcattattcacaatagtcaagctatggaatcaacttaagtgtatatcagtgaatgaatggaaaaaaatgtggtatttgcacacaaagggatactattcatccttaaaaaagaggaaagcctgtcctgtataagaacagataaacctggaggacattatgttaactgaattaagtcaggcacgtaaagagggtttttttttttgttacttcagcataacttattccataatataatactatactcagcctattgttgagaaagtcctttccagattccctcgcttgaaaacctcagcaccttcagtagcactaggactagcatatcatttgcacgttcacactttaagaatgaggtaaggcactaaaacaggctactgtatcagaaaccaactagcataaaaaaagaaacaatgtgaacatgttgccatatttttaagtagtcagcaaagttgattccttaaaaatctaaacaggaggctaaaaagaggttttctacaagcaagttctttctgttactgcatttttatttcttgcttctgtgaagttttgtttctgatagatgactactgtattctcatacggatgcagagaagaggactggtattaaagctgatgagtgatgttacagtcagtaaagaaacggttgatgttaaattggctggctagtagatattttggggaacaaagtaatttttcctaataaaagctgtcaagttgtttgctgtaagaagtaaaataaaatcgcatgtactacataattgccaaatcctattgtactcaaatatcctatcagatacctactactttaaataaatgccttctgaactaattctttaccaagtttgggaaccataaaccagggcaaatataataatcaacttttactcaggcaactctatttcagattttctactaaggtgctgactacctaactattattatgttcatcttctttgacccaagtcatatttaagtgaatgtgttcactgctgttattggtacctgacaacgggttgagtgatggggtgtctgatagtatttccatggcagtattactagtggttgataaagccagacctctagggtccaattttctgaaactcatggggaaaaataggagctagaaaatgaactatctggttatatatttttttcattgttgcaaggagactattttcaagaaagattgtgacaggaataaaaagacaaggacaagcagccccaaactgtcaaaatcctagcatttttcagctgtttcctgatatatgccaatgttttatgccaaaaagaaaaaaaaaaagcagaagaagaaaagtttcttttctcaaagatgatgtcaacatatctgatgcattgtgtgaggaaaaatgtagatgctataatttattgtttgttattaatttcaaggacagattaaatttcctcataatagggcagaacaccctgacacaaaccgtctgctaagtacttattgacacaaagttgaaaagcaattctttcatctagaaagacagctctctttcatctacagcactaaatcaaattatgaagtagctcctacattccaggctctgctctagttgcacaaacttggaatttcattctctaccatctccctgtgaagttgttattattgctgtcattctgtaggaagagaaaactgtgtcttaggttcggtcctttcttcaacatcgcatgactaagaagcagtgtcacagtgcttttacatttggttttctgtctgactctaaagggatgagctctccattatagcccagctgccttcctctcccaacaacaaacactaataaatgaaaaagtgaatcacagagagaaagaatttgaaaagaaaatgagatgagaaagggggaaacaaaaacatgagaaagtttggttgcctgagattgtttcaaaatggaggaaaagagcaattttgtctcaacttgccaaattaagcaaggtcagttaaaggctatatcttgccaaaagaaagcttactgactgggcattggcctatccaatccgtaaaaggttggcaaaaattattgtgggaaagtcacttaatacagaaatagctcctggctaattgagagaaaaaacagttagaaaggatatgacagcctccttttcttaaatattaggtagaatttattatgagacttaatttcataatatctaatgcagccgacttttaaactagctaaagcttaacaagaattttagtgaatttttttaaagagaccctcatgatctggactgctatttattttgtatttgatgtatgaggatttttgatttggggataaaattgtctttctggattcaacacatgagagagtgctgggttctagaactgtttactttctgtatggctttatatacattctttgagttcctgtgccacttttaacttatttgtaaaaaggggagaatacaatgctttaagattttattagaataaaattagataatgaatgccatgacattttccaaataattctatgcaaatgaaaatggtgtttataatctgtgtgcttccagtttagtttctttttttttttttttttttttttttttgagacggagtctcgctctgtcgcccaggctggagtgcagtggcgggatctcggctcactgcaagctccgcctcctgggttcatgccattctcctgcctcagcctcccaagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggccccagtttagtttcttataccaatagaaggttcagttgtattattataatattggccacttcagtgactcctctaagttttcttcctctttaaccactcctttcttaggtaattttgacaattgaatgagtaggagcttgtaggttttctacttttcattctaaatttgttgtaataaaaatatcatggattttataatcagacaggttataggttctagaatcaaataaacctgcaagtaaatttcactgctacttcttagctctgtgatggcagacacatttagcctccccaagctcatttcttcatttatatattggaagcacgagaatttggaaagattgcatacataaagacaatggtacactaagactagctgcagtgtatttttctttatttctatcagtttcgcatttcagctaagtccagcagatgtactttcttttcacatgattttgctatgtaggcctgattgactgattgactatggtggtttaaatcaattgtgaataaacaacaatgtgggtaggccaatgaatatccaggtacctgaagggaagaagcatgccagatttccccttttgccctaagtgcttttttgtgtttctggaattgacaagcaaattcgctttttggaatggtcagttgtgagggcttaacttgctttatgccaccagaagccgactagccaggaagacaaccagtcacagctgagctcccagggtttcttggagcatgtggttggcatagcagcctaattcttattatcttatccatggagttaataggaggctcattagtgacagatactctgtgtttgccttgccaaaaacaaatgggcatattatttttaaagatttgttcaatgatgtatcttccaactgacaattatctattttttttttgtcaagctttaatcttggcactgaggatttttaaaaatataagtaaatgaaggtcactgctttctatgaatatcaaatttgtaatgaaggaggtgcagacatgcaactgttttacaaccaggatgaatgctagatgtgtaacagcatatgattaaccctgcccaggccgtggaggaggcagacttctcagataaagttaatttgttggacccagattctaaaagtcacggtaagggaacagaaaatctaaaattaaacaaaatgcatacaggctaggtttcaattttctaacgagccagaagataattcatttgctaggaagaacgagaacaatgatttttatacatgtttccccttacctctctgtagattcctaaggatgacccaatgttcacgtcttgtcttaaaatataattccctacctatatgtgactagtatagaccagttctctggtattttagagcttgtctgttctaagccacatggcttatttttaaagctggaaggaaggtgtgagggatgcttgccaaaagtggcgattcatcctgcccagacacaggaaggcttgactctgccaacgccaaccatcatctgggttatagtgagactctttctgtgtcacactcaaagttcctttagtctcagcactcacttttatcaagccagctttgtcagcagcgttttgagaggatgcaagtataaaaatcatgggctcattacaaagagttttatgggggaggctatatattcataataactaaacaggaactgtttccagtgctttcataaaaaatttatttgttcttcacaaccaccctatgaattatatatgatgattgttttcattttacaaatggggaaactgagagacagggaagtgaagtacctttgctagtttcactctcaggccactgggctcacaatgaagtcaggtacttatcattcccacaccgtgcttcctctgcacagatacagatgagttgttaaaactgctgctcaataactcaaacaccaacctccaacttcagaagtcaaataaaatataccagagactttgtattagagataatggatgccatgtttttcaaacttatccaatgataatgatcacctagggagcttaataaacatacagattccagacacctctccagacctagagaaacaatctccagcgagagatgaagcaaagcgactgtttacaagtgcctccagaacatttttattatcagttaagtttggcaaacaccaaatggggtaatttataaaaaaatctttaagacaatgcttcgccactttaatgtggacaaagtcacctggagatcatattaaaatgcagcagtggggcctgtgattctgcatttctaacaagctcttaggttgtgccaatgctgctgatacatgggccacattttgattagcaagaatctgggaaaagactcagctgtctaggatacgggattcatttactgttagccataaccttggcctttttaatcctagaatgtttgtaaaaaatgaaaattccagtgtctactcttatagattctgatttgaaaggacaaggacagttatcaggaatctactttttaaataagtaatctcaagtgatttgattctgatgcagatggttctcagtcccactttccattgacaaacatggaacatgctgtggaaatcaaagcactgtaaaggtggaaagaacagcagtgtgccattatataagtcattcaatcccttggttttatcacccacaacctggcgagaatattatgtgcctttatagagttgttaggataaaatgagataagacatgaaagcaaataacagctgagccaccctattgaaggggtcaaaggaaataggatatggatcaagcaaagaaccactttcggccaaagcagcagaaaagctttcctatattttcttgattcttaggctataaaggcaatttacaaaatcactacattcactctgtccgcttactagctagacaggaccaatacctgtccattattataaaattatactctctcgctcgctctcactctctctctcattctctcttcatatatgtgaattttattctcataaacttatacatatatatgtgcatatatatgcttgtattatataggtgtatatatatatgcatgcatacatatatttgtgcatatatgtatgtttgcagatatgaaatataagtgcttatcaatatgaaatatgcccacatgcatatatagataaattgtatagcttccttgtgaatctaaagacacatgtaatatagctaacctttaaaacaatgctaatatagctcctacaatatgacattttagcaacatgtttttaataatacatgttcttaaatgttaagctgattcatgttatagtcccaacttttagatctcaagttctactttagaatatcaatagcaatatggaaagatacaggattttattgtaaaattttctaaggaattatagtggtctgctattaccactgtgccttaccctgcttgaaagtttattactttttaaagggaggggttcatcagcttctttcttggagcattacttattggataagaaaaaaaaacgagaaaaaaaaaaccttcaaagtgctatctctcacagcctgtggcaaggacaaggtttaggtcaatgcctattacagaagcagtaaaaatacgaggattaaaaagaaaagacacacactatattcctttgggtgtatctagaaatttaaaaatgtggattaggtacaaacagtgcaaatatgaaaattacaatcaagtgaataagctttccatatgtttaatgttgtatatttatcagagcctttctgattaagtatgatacatatttattgaattatagagagtcataatatggaatgtaaggtatagtgcattctggcacattctgagagtgaattgtttcaatgtagtctataaaattatgttgcctttaggtaattaggtgaccaaaataatttgagaactactagttacattatgaaatttaaaaatcagatctctttgcttctttacaatttggccaagggacactgaaagttaacccacaacttgccatgttttaatgtccagaactatactcactttcaaggttgatgtgttttaagacttacatgatggtatggcacttcaagtaaaattatatttgttaaaactttacaagtttttttttctttctgttccccactaagggaaagattcactgtaaatctgtgtagctgtatttccttttgtaaactaaaatagtttagtcttggattataactggaatagtgtgatataacagagttattgacatatttgaataagttacttttatccagatgcctcttaaatataggacaataaatctatatcaaaaacggggtactaaaatatgtatgtgtgtatcccaaataaatacattcctaagtaaaaacaaaatctcttttggcatgtatgacttagaatctgaataactggttgtttatggaaacatgcaatacataatttaagatagaaaaaaaggagagatgaatgacttagatataggcatattcatgttatggtttattagggaacaaaatctgcctgtcttcatgtttgtatttataattatatcaggcttaacaagcgggagtaaagttcaacataaacaaaaacataattgctttttttctttccaatatctgaacattaagaccataggaggtttgcagttgcacattgaaataaccacatcatcataaagactccttatttctaactggtaaatgtcagtctgaattagatcctatgctacatggattattagtgtttatgcttctattgctgactaagtacaatactaatatagacaaatggttattaactttgaattagttcagggggtcacttaattgattatgaatataggcaacaagccatagtcatattcacagtatctgttttggtcactaaaagaaatcatagatattttcgtatcaattaatattgccacagataccttaatataccatttatattcatcactatttcaaaattatagcattgaatacacacattgttaggttttttagtgaaacacatatactactgtatctcaaatttgtgatatagattactttgtactccctacacattttaattttatgtacattaaaacattatttcgaacagtccagactgctaaaggaattcacaaaagattaaatgcacctgtcttaagcaggagtcaggtcatgtcactgcactcctgaaaaccctccaaaggctccccattggcttgactcatagtgaagttctgtagccttttggattccaccaacattagccccagacacatcactctgtttctcaaacatattaagcatacccccaactgggagcctttgcacttgctcttccttctgcctggaattattttccccaatatatgcataatgtactcatctgcattcatctagacttttttcaaatgtcgccttctcttttagatctatgctaagtattttattcataatcacattcttccatacaatcttgcttcccttatgcttctaattatactacataatttactatgtttcttttacatctacccgctcgtagaatataaattcatcagagcaggaatttgtatcttcttttttttcctgttttgttcacaacagtatcataacacattttaggtgatcgataaacatttgtgcaacaaaagaatgatatgtaaaagtaaatggcactttcaacacggcaagaaaacagagtaaattgcctacataacagtaaattagcccatttttagaactgctaaatgtagaacctgagaagttagacagaaagttgatgttattcctttagcatacttgttaactgaaagtgtctatggacaatgtattaatttcctagtgctgccataaaacattaccaaatacttggtggcttacaaaaacaagaaaaatttattctgtcacagttctggaggctagaagtacaaaatcaaggcattagcagggacacactccctacaaaagctctaggggagaatacgtccttgcttccttcagtttttggttagttgcagcagtattaacttcaatctacctccttcttcacttggccttcttccctgtatggattaaatctccccgtttttttttttttcttataataatagcagtcattagatttagaacccactctaattccaggatgatttcaccttgagaaaagaccctattttcagttaagggcattttcacaggaactgggagttaggattggacatgttttttggtgaaacaattcatgtcagaagattaaaaaaaaatcttgaaatttctgactaaagaaactgaatatgtttatttacctttgtctccagagaagatttatgccttcccaatgctttcatggaattacatgctttatttttctggaggatcttctaattgattttaaggaaaacaaaatgatttgtagctagaggtaaactatctaccaacctggaactattacctgatactttcccccctggaaaaaatgtggtaggaaatgtctaatgaatgtatatcactttctttctataggtgcaatagttcacttgtaattagccacatggaggtaccagagctagtaaagtcatctacctgtgaggtttgcaatggccatgataagggaagcattaaattagagtgtaattgctcaatggctgaaggaaacttctcacatttattatctatctatctatctatctatctatctatctatctacatatatccattatcttatatctatctatagaaacatttattatctatatatctatagaaacatttattatctatataactgtctatatatttaatatattaatgtacatatctttttggcaatcatgccaaaagaaataatatatgcttaattacttgatctaagtgcataaaagcacctagtttaaagagttgtcctggtgttaaaaaataaaataacaagccccaaatacttcacatagtacctgacacataataaagattcaacatatactactcaatattataggctatcgttattatcagaagtgatacatgtaaatttttaatttttgattcaaaatcataaatgtgcaagtaaaaaagaattggagaataaaagaattaaagatgttagttggctatgagctcaaaataagataaaaatgtaatataatataaaaattaataagcctaatgcattcttgggttaaattattggaaaaatgtgccctaatcgttggtatctcaacactacattttaatccaatcacaactagaatttgatgttgagttctaggcacaatgttttgagaatgactttttcaaaccataggacaactagaaaggtaaagaagctgggaaatacaccaaaaataaataaataaataaataaataaataaataataataaaggagatgaaggaagagggcatatttagcttgaaagagatacatagaataaaaacagcagctgtctttaataatttgaataatggtcatttagaaaatagtaaaacaaatccaaacaaaataaaatagactaaccagggcattaaagttacaacaaacgtagagttccacttaagaaacacctcctaagtaatagtactgctgagcagtgaaatttactaccttgtcagaaactaaagttccataagaaggataactactattcattgaggtgattggcacagagctaacccccccttttttaactattacaatcaaacccaacaataatcctataaggcagagattattatctccataccctggaaaaggaaatataaattatttgctctggtcatccaaagacagattctaaagttattatcttaaccatctccatagtgtttgccttctatggtacactggattgatcacatctgttgagaatcttttaaaaggatatcatgcattctagagtgtagtacatctgacttctaatttagtacatgaaaaatgtttaaaacggttctagtagtaagagtagttaaaatgtaatatcgaatgtgtaaaaggataatttttataacagagtataatcataactctcatccatatataaaataaacgtgtcaaagattttattcaagtcattcattattgagggaaccggtaagatattggatgataaagctggttgtgataattcaagaccccccgcatggaaataataaaataatttaaaagtagatgcaaaactgatgtgttccacagcaagaagggaaatcatcgtcttctgttagaacaaaaatttattttcctgtctataaaagcagtcatgtgcattactattagttatctacaatgtacagagttgtaacatagctccgagataatgagaggtacagagacctatttgaatcagaaaacgtaggagggcatgcttagaaaatatctagttttccaacgaagacaggcattttggcccacttcaaagtctttcacgatgtttccttcaagtgtttattattatgattgtacaagctacataaattggaaatctcaggatagtgatagaaacttagctttatgtagcatgaaaggtaatggcaatctgcaataagccacccagtgtcctagtgatgtttgtatgctgcataagaaaacaaaataaaactgacatttggtgctaagaattttacacttcataataacaaagtataattacattttctgtatgtaaggctttgtgcaaatgaattacttgcattatttcatataatttttcccactagtcataataatacaacagcagtagcatcaataaaagaaataataataatattttcctttagttaaatggttactgaaactcaagtacttatttaagtattatctcttttaatctaaacaaccactgctctgatttaagtactttttatcctcacttcattggtgaggaaactgagaactaaagagttcaattaatttttcaagctcacacaaatcataagatctcagtctacgtcctctgaaaacagtctttcattgtaattattacaccattaaactaaattgtcaatcataatatcagtgcactttgaagtaagcttattataaaagtatttgtttatgatgttcttagacacttagagaaatattaaatatgttaggttttcaaaaagtttctatagttctatacatccatcaatattatataaattttgaaaaaaaatttgcttaaaaacataaaaatttaataagaatccataaccaaaaatgacatttcttcttcaataaatcctacttgaggagccaacgataatcccatgaaagcagagagctttctctgactcacttatcttaataattgcaggccaaatattcaaccctgctatcaatctcacctagcattccttgatgcccccttccatagtaataatttcaataggttcaaaaagaaaagaaaaaatagacaaagctcacgtagacattgaagaggggctcaaaatacattaccagcagtaaaaatttatttatctttgataaagtataattattattttttattgactaaatagggttgtagaattgtattatggtttgtaccaaagtagacaattctaagaggtcaagggtgtttttaaaatacctttaatatttcaatattctttaaacttgattattagcttgtatagtattgtgaataagagtattgattatcagagataatttaatccaatcactgctttaatgattaaatatgccaaatttatagagactgttttaaattgtctttctttagccatgtaattggagggaaatggtagcatggataatcctaaatactgaatgattccaaagttttttagagttggctttgggatacatttcaatttggaagcagatttatttcctaattacattttgcttaggctaaaattaaaataggcaaatagtattcaatatggaattgatgtggccaaaagtgttgtcattgataagggcaagccagattgggctgtagattctactactaacaacacataacaaaacacgagcaatataacgtcaacaaaaaagaaagatacataaggaggaaatttacagcctatccaagaatattcaattgatggcatcgttaagagttaagtctaacttatctttaattcttgctctgctgctgttgtctctgtctatgagaatcttccattttcacttatctctatctcatacaatagttcaaagtaggcttcatgtcttacatcatttgataagcaataactctgtaacttaaatattgagtctctctcagtatttacgcagaccctttgtaggtaccatcctgtttccagagtgaattccaagatttttttccctccaaccatgaggattgagggtgaagtgtgacattctctactgttacctcccaaagaatccccactctgactttgactacaatttcacctccttcctgcaataccaactcatgttacaaaatctcaagacaaatctcacactcagtgtatttctgagatgttcacaatagcttcgggcttttatgtacttaaacttaagttcttggcctggtgcggtggctcacgcctgtaatcccagcattgtgggaggtcaaggcaggtggatcacctgaggtcaggagttcaataccagcctggccaacatggtgaatccccatctctactaaaaatacaaaaattagctgggcatggtggtgcttgcctgtaatcccagctactcgggaggctgaggcaggagaatcacttgaacctgggaggtggaggctgcagtgagctgagattgtgtcactgcactccagccttggcaatggagcaaaactccatctcaaaaaaaattaatttcttgcaattatgcaattatcatatatgaaataccacatttagaaagtcaatgaaaataatttatccaacaaaaattattttatttcaaatagatctagaaattaacaggtatcaaagggctaccgtgggaaagtatggttctagatgtttaattaaggacaattggatgcagagaaagactggaaggttatgaagaataagaaaaaaaaacatccttttggttgatatcatgctgaaatggaagttatgtttgcctactgaacgtaagtatatcaataaaaacttgattatcataccacacattgggctcaattaaacattagtgagaatcttcagttttctaaatcatccttaaaatttatgcatctaaatcacagctctagtttgcatatagatattaatagacaggtatttacaaatatccttaggcctcactagccatactcacgaaagggacctaaaccatattgacaccttccaccctgacttaaccatcacctggcagctgactaaccacagtgattatacagcagttgtaaactggaacctgttggtgagaggaatttccttgacagaggcagcctggaaacagatataaaaagattgcggcagatataaagcaggcagagctgcctttaagcggcccgcttgttaacaactatgcttgcctgagttacacatctgctgatgaggctgtctgcatgttccctgaatcccaggaggagaactaaagtcaaacacctggctaaacaaagcatagtaaaaagctggacatttaatgcaacgaacagcaaaggcacgtcccacaggacattattgctgacagtagacgttccctgaagcaaaaaagatattgagaaaggggacacagtgaattgaagctacataggtgctccttcctatcctttaaatttgcctctgggatttggccacctttagacccaatagactttaattataaaaattatctatgtgactaataagtggtgtgttagtgtgtgaacttgtgaggtgaggaaacatttaagattttctagactgctattttaggtcttttgtattttgcagtcatctctatgaagtcttgaattacaaaagatagtatttgcttttatttgcctttccttttgatacaggaaaaccagtgaagaaatgtcttggaagttgaccctagattttctaaagcctctctcctaattattctctatgatctccagccctgtccttcatgaaccatcttgttatataactactgacaaaagtggcttgtgaaaaagaatccaccaacaattcagatggacttttaaaagatgagggaaaaacgtgggcagatcaataaaagaacaccgttattttggaaaacagaaataaagaaaaatgaccgcattagttctaccttggaatagtgaatacgtctttccccaaactgatgctcatggtgttaagttctgcattattgccagtactgtgttttagttacattatggcttacactgttaggtgagctggctggagagtaactttctgtggacacaatgtcacatccatagtgctaagtccatggcaagtatctggtgaatgtttgtggacttaatgatattgatattcatgttactagtaagcatgtgttctttacaacaatttgccaaacaatgtaggtgtgaagctatctaattttgtatatggagtggaaaccctggaaggaacatctgagttttattgctactataagttgaaatgcacccaagctgcatttagagaactggccagacttaacttgaaagccatttactcagttgaggaacctgacggtctcttttaaaaagagcacaggatgcagctatgatttgttatatcatttgttatactgtaaatagcatttttaatataattaaaacacaagttagaagaagttactcatttcatgcatattcatataataagaattagttcatatacatttagtgaataaaaaggtattactttattttacaattttcccaacacattaatactttgtgccaccaaatattgctcctgaaagtaaagtacactatgcagctaaatgcattaatctgtggaagaatataatacaacacaccatgcgtattcaccccacattttttctttcacctcagtttggccacatgctctgaaatacaagtgcttattgtggataaatagccaaggattttgaatatttatccgtcaaatccatagttcttaggtcttagcccttccttagacctctttcttatcaagccatatatatgtctcctgcactttttctatacattgtaattttttgtttattagggagttagcataactttttaagtatgttattaataccaatttgttaggattattattgtttaattattattgtttctgctaatgttgtaataataaagttgcatgggctttgagcactctgctcttaatgtatttttccaattaatcattttatttacatcatcatttcgcagaatacaaaatttttctgaaacttttgtgtgattttataacataaacagatctatttgtggatgttttaaaggaggagggataatctaaaggcaagaacgtcaaaagagcgcactagtctccagaagaccatcttcagaaatggtagaggacccttgcaaatggctgtgaagccacatagctcatgacagaaaagtaaaaatacatcaaagcaatgactgaatgatcatcactgtgaaagtgaaggtggttgtctgttagcctatctcaagaaatgtatttagggtcccatttgataaatatgctgatgattttctgaggcagaattgatttgaataaaagtaggagttgtacaaacttaaaggtgggagctctgtgcaagacaatataatcaattacctttattaagatactattatactatcttcatagtccctagctgttttctctatccacattattgcctcatactcccttctacttacatgttgtgctatttaaagtggttgtgaggaagaatgtggtgaaccaaaggaaaataaatcaatcatttcttttttcttttcgtttttatcttcttttttattttttatttttatttattttgttttattttattattattattattattattattattattattattattattattttgagacagcgtcttgctctgttccccaggttgtagtgcagtggcgcaatctcggctcactgcaagctctgcctcccaggttcaagcgattctcctgcctcagcctcctgagtagctgggattacaggcgtgcgctaccacgctcggctaattgtgtgtgtgtgtgtgtgtgtgtgtgtgtgtgtgtatttttagtagagacggggtttcaccatgttggtcaggctggtctcgaactcctttcctcgggatccgctcgcctcagcctcccaaagtgctgggattataggcgtgagccaccgcacccatcttctttttaaaaaatattttagtaaaactataagttagaaacaggaaaatcagaagttggtattgatatatggatataaatatggatatagaggtcaatatagatatagcatgtaaaatgtctaaagatatggtaatatattgtgtgaccaagaaaactaaaaatgcataaataattttactatcacaataagatggtaaaatagattattaattttaaacctataaaacacattttgggaagagaacagaaatagaaatttttaatttaggctttcaagcaatatacggaagttgtattttctttagcatttggcatgtatccaaacttagtgattcaaatatcaatccaacaattcaagaattagattgtgaaacaaaggtgggcatatactcatactgttattacagttgagaaatagtgagctcgattttcctgacccccttctctacttgctttacaattaccacctagttttatacgacatggcatttacgtattgtaccagttataatttcccattaatatttaatattccataatatcatcatacttgttttaattttttaataactcacagtcttttactcattttcaagggttcagtattgaaatttgattccttaaataatactgttttatatatacacacacacacacacacacacacacacacacacacattgatatatatatatataaaactctcctggccacctaaaactttagaatcaattcgttacgaattttgtatagatatttgaccacatcaatgttgttataactcaataactagtctatactcttctattttcccctttacaggtttctcatcacttaactttcatcagcaacaccagaacactagattctttcttttttcttttttataacatgttcaggaaaaagttaacatagctgtctagatatttagaagggcctgctgacagggatgggtattgactgtcatctagaaattttgcttgagaactgttccctccatcactaactgataaggttgttccactgttcaagcttgacgaaactgtacaaacaatgtgattcataatgcttttctcctggcagtctagaatttggtagtagtagatagaaattgccatgtaaccagctcccagaatgccttagactctgagtctcaaatggactttttttttttttttttggcagaaacactgcacatgtgctattacatttcatttctgggtaacaggatattcagtgtggcctcttcagggaaagcaagggaaacatacacataaattcattcaaacagtgcacgtatttctccatcactaatccagcagtgtatccttactgtgctgctgtaataaatatcatacatgaggacaactatatcctgagccccatgtgttcttctagcaaagcactgaacttcaggtagtagtgggaccactgacacaaacggtgccagagtactggcacacaagaccaatgtcctgagtatgattcctctgtctgtaatggcccacaagacatttcttgttagttgtctttccattatctcaaaataatgtggcaaaagaaaataatgccttttaattcaataaagcacttcataattctacaaattgaattaatattctttaggatagtcacttatattcaacatcttaggttgatcctagagagcaagacagacatataataaagaagagaggttttgaaatcaagcatatttctctctcagctttaaattcaaatcccaatgtattagtttaatgaacttggacaagtaggacacaacttggaatggaatggaaatttaatatactgtaattatttattaatgatattaatcatattgtttcttatccttctaccatcctgttattattcatcaaatattatataaaatatacaacctacactggtaaattcattaacctcttccattttcccacttgtgccaccccaatctggcctcattttctcatctctaaactactgcaataatctattttgatctccagttcctctctttctaacatatttctctagatcagtcttccgaagtggaagtttttaaattctgttacaggtagccttaaaattccccgtcactatcacagagatcagtggggtatatagggtgtggagaatggcaaatcacaaatcatatgatcaccagaaaaactctgctttttatccattttatattatgcttctgtttgacatcatgtttggagaaaggccttggtagctacaataagtctgtaaaggcactagttttagctgactcaggatgaagtcagatctcttgtcaactccaggttcttccctttctggccccaacttttattccaatgttctgtatcacttcccttccacatgagtcctttgcttgactcaaaataattggttctctgagctctgctataggttgaattgtgtaccccaaattaatatgttgaagcctaacacacaatggcttagaatgtgacataatttggaaataagattattgcagctgcaatagttaaaatgaggccatagtgatgggactcaaatccaatatgactggtgcccttataaaaaggtgacagttggacattggcatgcacacagggagcacaccattgaagatcaaggcagagatcaggatgatgcagcagaagtcaaggaacaccaacgactgacagcaaactaccagaagctatgactgaggcatgaaacagagccttccctcatggcccttagaagaagccaatcctgctgacattttgatctaggactttcagcctccagaactgcgagaccataaatttctgttgtttaagccacccatattgtggcattttgttatggcagttctggcaaactaatagaatccttaaacacactaagcacattgccatttcaatgcctgttttctctctgcgataccgtctttagggactccctcaccgttaagaactagtccaagtttcacaaccatcacaaactgtttttctgctgcctgagctcttggcaaacttcaattttttgaaacacttaatagtacttaataagtcacctgggagatattacatgtgactttattaattaattaaaaataaaagccagactcttaatatagtcttatatatttaaacacaaagctgaattagagtgtcatcatggctactatcatcaacataaaataactgtagtaaattagaatgtatatattggctttgggaatacacaaagattagttttacaaaatgataaaataatagctactattaacaagggtagagaagacattttccaatgtaacaaataatgtatttcaactcctgatatgaattaagaaagaaagcgattggaccttgctgcttcttgtttgtgtatgaatttaaaagcctgctatttggtgatattcatcttgctttgtttatagataatttttgttttactagcccgaaagtacctaattatcattgacagacttcacaaagtccatgcatactaatggcatgtacggattttcaagagcactttgagaatcttttctttaatcatcaaaatttgtttagtgtcctttttaagatccctagtggcctcttaatttcaaaacttaatattctgttttcactgctgttcctacttgaatctgaaaacctattgacatgattgaccactctctggatctcaaattgctttctcacttggattttattctcttttttctttcctttttttttttttttttctcacttatctcactcgtcttttcttggttccttctccattgtctaccatctcacctactatcaagaaatcagttgccaaataaatgctagtgacaaccaggtctgaacctctggctccaaattcattccagatatacttttcccatggtttcttggtcagtatgcaagctggtacattataattaccgttctgtcagtagcaaagtaaagtcttgtatgtaaatgtcatttgtgtgtctttccacctaaatattttactttgaatttgctaaattggctgacttttggtattgttaataaataataatcaataattattatctctagcttaaaacaccatcatcagagaaaacatctaaacaaaagcttatttgagaataaaaatggtagtttggtttagtggaaataaccaaatgtttttttttaaatattctttcccttcacagtatgacttttatgctgtagtcacttgcaaataatattgctgaaaattaatttaaaattggtgcactgaaaagtatagtttgatttgtttttttgattttgataaggatgtttacagacttcagacaccctcaatggctcccattcctcttgtataaatgtaaactttttagactagcactaacagttttacataatctgactcaaatctattttttttttttttggctctttcttatctactgggacataatattcacattccaattgagatagcttattcaacaaccatacaaatacgtgagcttcctacctcagtatctatgactgttttcaaagatattctatgtggaataacataccatttttttctgttccttctatcaaaaattgtgccaaattttagtacaaagcccactttgtcattgatctttccccattaacctatgtcatatttgccctctctttagagtgataatgatgccatatctatagttattgaaaatattttttctacttaactgtgggttttttgaggtcaaatatcaatgtctacctcatcttaccaaatacagggcataacacttagtcatcaaccaaatattggcagaactgaactgcattaaacacaaaggtctgtcttctgagcatacagttgcaaactttaaaatagaagaaagtatttagcgattataagtaaaaactaatctagtaaatcattactgaatgacagaaatagtacaagtaataacacttctgaacaagaaagggtattatgctaaagagaaaactgaaaaaaaataagctggaactatagtgtgcagatatgatcatttcctcagagccaaattgtactttacgttaggcagaggcactggaaatggaaattgaagtgacctgggaaacaaggctctcagaccttcctttacaaagaaatgtgcaaagtagttcagcacttcttagaatagaggagactgggagcacagaacattcagaaaagaaaggaaagaatagatccctaaagctctataagctaccatcaaatgcaagataaaagaagtataaggtgatactagtgtcaagcagcacaaaacaagaacaaaaagaattgcatttgttggaggctgggctgcagaggaggtcacagaaaactggctgtgctttctgggaggaataaagagagtgaggatggagcaaatctctaagaaaaacaattgctgtgttttaattttggccacctgatgttactgtctaacagcaattagagagtcaaagctctgagatgaaagactactgcgtgcatctctaagttctgtcccttagacactagataccatagtgtaacttttatgcatcagcatccttctccgtagaatgggaacaattgcagtagttcagtgcactatttcaacaaagtaagagagtattcaaccattccacataaagcctgtattgtcaagtgcttaacaaatattgtttattattttcagtctttgaagtatgtctaagatgccacattcagggttgaataaggaaaataaatgtaaaaatatagtaacaaaataacacatgtaatgtctcagaatcccaaatccgtgaccaacttacaaatacttagagtgccattatgtattaaatacctcccattattttataattatatatgaaggaagatgtaagctattaagcactttcttcataactcggtatctttcataattggatctaatatttaactcagaagtgtgtgtgtgtggaattgtgaagggcacagtaatggtagaaagtcatggaagatgtactacttcacaattttctaaagctacctttaggatgcagtaaaggtggatttgatcattgaccttacaattcacacctgtttggagattttcccatcgctttgtgacatcaaaatacgtgtaattacaaactgaaaatcaaaaaatatgctcaaacaatatagcacctttaataagttagaggtgatgaggaaaaaggttatgctgtattctgggttagcctctcttcaactacacaccattcggttagctatttctaataactacagtgataaaagtagacaatgatatagagtaaataaaaaatattgaggcaaaattcatcactgagatagtttctatgagtgatcagcagttactactggtaatgattattcttaagacattgggtaatttgtgatctttttgtagattatgaagttaaaaaaaaactgtacacagaaaaatgaaaatgatgtgagactttccagaaattataagtttccttgtaccaaatgttgcttacatcccaccacttcattctgatttatcattgtttaatatatcattgattattctaaggcaaatagattctcagacagaatgtaatttaaaaaaaacttcaactatatattacttgagattcactctcttgaaaataattattcactttaatttaacaaacacctgccatatgatgaggactacgttaaacatgggaatgaggagatccaaatatactgaaatgggaacaaattattttaatagatacagaatgcttcttaagaagatagctacctgtgttgagaaaaatttcagtacacatacttggagtggaaattattgacttagcatgtccaccataaggatagctctgctatgctaagaatatctggaccaatttgttggttgactccagaaaaaagtagagaacagaagataaatgagtaagagatcaggtaagtggaagcccattctgtacagaatattttagtaggtcatgcttctgctccttctaaccttagaatgaggtaaatataatctgcacatacaagtgatatattgaggcccagaggccagacaatgacagccaacatctaagatgacaccaaggagcccttccttctggtgtttatgcccttatgcaatcccctcccactttggcctgtatggccaataggatacaacagaagtgatgatatgtcacttccaagattgttattttgtagcttctgccttggcattgtctctctttcatgccctctcgttacttgttctagaggaagtcaacttccatggcatgagaacactcaggcagtccatgtagatatagaggcaaagaatttgaacttccagcacacagccaacgaggacattcactgaggctgtttaccatggttggtaaagttgataacctagaacatgtatggtgtgggcagattttggggatggagatcactaacggtgctgaagtatatgtccaggtgatacagaggagaactgaaacagcactcacagatactgaagagactaagcaaatgtcagaaagaaaataaagaaaaaaagctgatggggaattgcagaaagtacaccaaatatggactagattcctacagctaaaaaactagagttgtgtccaatgtttaactctgcaggtgacggtgttcccacctcacatctagtttcagaaaggacaaagcagatacatatatgaatataatacaagaataaaatataaaagcatatacctgtacgttatatataagtacataaatgtgtacgtgcacaaataacataaataacttaaaaggtctgtctaccagaatgtaaactaatatataatgtataatatgaaataactaatgactatatagtatgaaatataactataagtccaccataataaaagtaaataatatgtaaagtagaaaaacaagtaatatgttcaccaatagatagtaacaaagttaattagtatgtgcctgttttaaataatttttgaatgaagaatgcttgaatttcataaatgaatttaattaatgctatactaacatttatttgaaaaatacatgatctggaaagatagtacttgcataatcactgtgcttagtgcttgttatgtgattttttgttgttggtaaaatgtggtgagtttaactacttttttcatatatcacagtgacatataaatgaggggtgttgctatattacatactttttttcattcaagcaatgttttatcaaaactagtatgtaaaatgggaatattttgttgagggagcacaggttgggcagtctccacagccatctactgagcaaaatactccaggccatgggtgccatccctgctgcacactcacagcaacactaccctgcccagaggtctcccagccttgagctactgcatcagtacaccacccacagacatataccacaaccaactctgactctgccaagcaaagaggaccagtgggtctccagagagctgcaggtctcctggtgaccttatctttggctctggctgcccccaagggagaagggagcacagcctgacaggtccctcattggggttaaggaaatatgggtgtggcaccagtgatttgggagtccctaaggcccatgaatgaacttaataaggggttcatctatccccggctgaccaccaacttcccaatgactgaacactgctgcaaatgtgttaaaatacaaaacaggcaggcagctatgtaaatgcctaactgctggccattgttcttaagtgctgcctactgagttgcagcctgatttacaccaccaaaaccattttttttccagcacgcttcatctgtgaaatccaatgcaggaatctaaccacaaatatatatcccgtacagatactttgccctctgaaagcatccagaaatgaagctagtcgtgtatattcaacttacaccacagtcaaactcttaagataaataaaaattatattaaaaaaaagccccatctaaacaaaagcaactgcgaaaagataagggaacagcatccttctcagatgaggaagaattagtacattaactacggcaattcaaaaagtcagcatcttcttaccttcagacaatcaccatggctccctattatattagatccacagcagctcaaccactgaaatggctgaaatgacagacatataattcagaatctgggaggcaaggaagctcaataagattcaggagaaagttgaaacccaatcaaacgaatccaggaaaacggtccaacagctgaaagatgacatagcaattttttaaaagaaccaaattgaactcctggaattgaaaatttcactacaggaattccataatttggtttgaagaattaataatggaatagaccaacctgaggaaagaatctcagatcttgaagataagtcctttgaatcagcttagtcaggcaaaaataaagaagaaagaatgtttagaaataaacaaaacctttggaaattacaggattatgtatagaaatcaaacctaagacaaactggcattcttgagagagtagtagagagattaagcaacttggaaacagtatttgaggatacagtccatacaagttttcccaatctcattagagatgccaatatgcaaattcaaaaaatacacagaacccccatgagacactatataagatggccaaacccaagatacatagtcatcggattcgccaaggtcaatgtgatagaaaaaaatattaaagacagctaaaaagaagtgtcagatcacttacaaagaaaactccttcaggctaacagtggacctctcagcaggaacattacaagccaggaaagatgggggtctatatttagcatccttaaagaagcaaaatttcaaccaagaatttcatgttcaaccagactaagttccacaagtgaagaagaaataaaattcttttcagacaaccaaacaacacataaatttgttaccactagactagtattacaagaggtccttaagggaatactaataatagaaatgaaagaacagtgcctgctatcatgaaaacacacttaagtacatttcaggcagacactataaagcaactacacaattaagtctacaaaaacaaccagctaacaccacaatgacaggatcaaaactcacagatcaacattaatcttgatggaaatgatctaaaaacctgacttgaaaagcacagaattgtaagttgaattaaaaaaaaaaaaataaggcccaaccagctattgccttcaagagacccacgtcatatgtaatgacacccacaggctgaaagaaaagaaatggagaaagacctatcatgcaactgcaaaaccaaaaagagcacaggtcgatattcttatactagataaagcacactttaaaccaaaaacagtcaaaaaggacagagcaagacattacataacaataaaatattcaattcaacaagaacacctaattatcctaaatacatatgcaatgcaacattggcactcagattcataaaacaagtacttcttggactgcagtaagatttagacagctgcacaagaatagtgggggacttcaacgttccactaacagtgctagatagatcatcaaggcagaaaactaacagaaattttggacttaaactcgacacttgacgaattgttcctaatagatatttacagaatactcaacctaacaaccgcaaagtacacagtcttttaatctgcactcagaacatactctaagatcagtcacaggcttaatgataaagcaagtctaaataaattccaaaaaatagaaattataccaaacaaacttttcagaccaaagtatgataaaaattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagacatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggcgtcgggggaggggggagggatagcactgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaagaaatcataaccaagaatatctcaaactgcacaactacatgaaaattaaaccacttgcacctgaatggctttttggtaaacaacaaaattaagggagaaattgtaaaactctttgaaattaataaaaacagaaacacaacatatcaaaatctatgtgatgcagctaaagcaggattaagaggaaatgtatagtgctaaacacctacatcaagaacttagaaatataccaaattaataatctaacatcacacctagaggaattagaaaatcaagaccaaactaatcccaaagctagcagaagaaaagaaacaacaaaaatcagagaagcactgaagaaaattgatatgcaaaaattcatagaaaagaccaacaaattcaaaagtgtatttcaaaaaataaacaagatgtatagacctctagctagataaacaaagagaaaagagataagatctaagtaaccacaattagaaaagacaaagatgacattacaacctattccacagaaatacaaaagatcctcaaaggctactatgaacacccctatccatacaaagtaggaaatccagaggacatgaatacattcctagaaacacacaacctcccaagattgaaccatgaaaaaattaaaaacctaacagaccaataacgagttccaaaattaaatcagtaataaatactctagcaacaacaaaacaaaacaaacaaacaaacaaacaaaaaacaaaaagtccaggaccagatggattcacagccaaattctaacagatgtacatagagctggtaccaatcctactgaaaccattcaaaaaaatcaagggaggatgcactattctctaattctatgaagccaacatcatcctgaaaccaaaatctcacagagacacaatatcaggacaatattcctgataagcatagacaaaacaatccttgacaaaatactagcaaactgaatccagcagcacatcaaaaagttagttcacaatgaccaaataggctttcttcctgggatgcaaggttggttcaacacatgcaaatcagtaaatgtgatttaccacataagccaaattaaaaacagaaaccatatgacctcaatagattcagaaaaagcttttgataaaatccaacatcgcttcatgaagtaaccctcagcaaactaagcattgaaggaacatagctcaaaataataagagccatctatgacaaacctatagctaatatcacaccaaatgggcaaaactgcaaccaccccccttgagaacaaggcaaagatgcccactctcaccgctgctattcaacatagtattggaagtcctagccagagaaatcaagcaagagaaaaaaataaagaggcatccaaatagaaaaagaagaagtcaaactatctttcttcgctaatgatatgattctatacctggaaaaccaggaagattcccccaaaaggcacttagaactgatgaattacttcagtgcagcttcaggatacaagataaatgcataaaattcagtggaacataacagtcaagccgagagacaaattaagaatgcaaaccaatttataatagcaatgaaaaaaaaatgcccaggaatactgctaatcaaggagataaaaaaaactctacaagtagaattacaaaacactgctgaataaaatcagagatgatacaaataaatggaaaaacattccattctcatggatagaaaaatcaatattaaaatgcccatacttcccaaagcaatttaaagattcaatggtattcctaccaaactatcaacatcatttttcacagaatttgaaaaaaaaagctattataaaattcatatggaaccaaaataaaaacctgaatggcaaaaggtattcttaagcaaacaaacaaacaaacgaaatgagctggagatatgttatcctacttcaaactggactacaagggtacaggaaccaaaccatcacaaggctaggacaaaaaccagacacactggccagtggaacagaatagaaattacatgaataaagccctgtacctacaaccatctgatcttcaggaaagtgaacaaaaataaggaatggggcaaagattccctattcaataaatactgtgaggataactggctagccatatgcagaagaatgaaagtgaatccctatctatcaccatacataaaattaacttatgacagattaatgacttaaatgaaagaactataaatacaaaattctagaagaaaatccagaacatactttcttgatatcagccttggcaaataattaatggccaagtcctcaaaactagttgcaacaaaaacaaaaattaacaagtggggcctaactaaattaaagagcttcttctcagcaagagagtttctcttgatgtgaagaagctctgacaatctgtgctcagacaatctgtgaagacaaaccatctgcagaatgggagaaaatattcagaaactatgtcatatccagaatctataaaccccaatatccagaatctataagaaatgtaaattaatcaataagcaaaaaacaaataaccccatgaaaaagtggagaaaggacatggacagccacttctcaaaagaagacatacaagcagaaaacaatcattaataaaaaaaaattgatagaccgctagcaagactaataaagaaaaaaagagagaagaatcaaatagacgcaacaaaaaatgataaaggggatatcaccaccgatcccacagaaatacaaactaccatcagagaatagtataaacacctctacgcaaataaactagaaaatctagaagaaatggataaatttctcgacacatacactctcccaagactaaaccaggaaggagttgaatctctgaatagaccaagaacaggagctgaaattgtggcaataatcaatagcttaccaacgaaaaaagtccaggaccagatggattgacagccgaattctcccagaggtacaaggaggaactggtaccattccttctgaaactattccaatcaatagaaaaaaaagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcattatacgcaaatcaataaatgtaatccagcatataaacagaaccaaagacaaaaaccacatgattatctcaatagatgcagaaaaggcctttgacaaaattcaacaacccttcatgctaaaaattctcaataaattaggtattgatgggacgtatctcaaaataataagagctatctatgacaaacccacagccaatatcatactgaatgggcaaaaaactggaagcattccctttgaaaactggcacaagacagggatgccctctctcaccactcctattcaacatagtgttggaatttttggccagggcaattaggcaggagaaggaaataaagggcattcaattaggaaaagaggaagtcaaattgtccctttttgcagacgacatgattgtatatctagaaaaccccattgtctcagcccaaaatctccttaagctgataagcaacttcagcaaagtctcaggatacaaaatcaatgtacaaaaatcacaagcactcttatacaacaacaagagacaaacagagagccaaatcatgagtgaactcccattcacaattgcttcaaagagaataaaatacttaggaattcaacttacaagggatgtgaaggacctctccaaggagaactacaaaccactgctcaacgaaataaaagaggatacaaacaaatggaagaatattccatgctcatgggtaggaacaatcaatatcgtgaaaatggccatactgcccaaggtaatttacagattcaatgccatccccatcaagctaacaatgactttcttcacagaattggaaaaaactactttaaagttcatatggaaccaaaaaagagcccgcattgccaagtcaatcctaagccaaaagaacaaagctggaggcatcacactacctgacttcaaactatgctacaaggctacagtaaccaaaacagcatggtactggtaccaaaacagcatggtactggtaccaaaacagagatatagatcaatggaacagaacagagccctcagaaataaggccgcatatctacaactatctgatctttgacaaacctgaccaaaacaagcaatggggaaaggattccctatttaataaatggtgctgggaaaactggctagccatatgtagaaagctgaaactggatcccttccttacaccttatacaaaaatcaattcaagatggattaaagacttgaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacccacaaaatgggagaaaattttcgcaacctactcatctgacaaagggctaatatccagaatctacaatgaactcaaacaaatttacgagaaaaaaacaaacaactccatcaaaaagtgggcaaaggacatgaacagacacttctcaaaagaagacatttatgcatccaaaaaacacatgaaaaaatgctcaccatcactagccatcagagaaatgcaaatcaaaaccacaatgagataccatttcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctggaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattgaaatcatcattctcagtaaactatcacaaggacaaaaaaccaaacaccgcatattgtcactcataggtgggaattgaacaatgagaaaacatggacacaggaaggggaacatcacactctggggactgttgtgaggtggggggaggggagagggatagcattgggagatatacctaatgctagatgacgagttagtgggtgcagcgcaccggcatggcacatgtatacatatgtaactaatctgcacattgtgcacatgtatcctaaaacttaaagtataataataataaataaaataaaataaaataaaaaaataaatgctcattatcactaatcagagaaatgcaaatcaaaaccacaatgagatatcatcttacaccagttagaatggcttttgttaaacagtcagaaatataacagatgttgttaaggctctggagaaaatggaacacttgtacactgttggtggggatctaacttagttcaaccaccatggagagcagtctggaaatttctcaaagaactaagagttgaactgccattcaacccagcaattccattactgggtatatacataaagaaaaaaaattgtatcaaaaagtcatatccacttgtatgttcattgcagcaccattcacaatagcaaagacatggagttaactcaggtgtccatcaacagtgggttgcataaagaaaatgtggtacatatacaccatgggacactatgcagccataaaaaaatgaaattatgtcctttgcagcaacatggatgcaactggaggccattatcctaagcaaactaacacagaagcagaaagccaaataccacattttctcacttgtaggtgggaactaatcgttgagtacacatgaaagtaaagatggaaagagacactgggggatgcaagaggggagagggaggaagtagggcaagcattcagaaactacctattaggtacaatgctcactatctgggagatggatacttttatactccaagcctcagcatcatttaataaaactttgtaataaacctgtgattgtacactctgattctaaagttgaaaaaatgaattaataaaattaacatttccaattactaaagaaaaaaataaagtaattttaaaaataaatagagaataaatgaatgtattatattgtcaacattttcacaaattatctttttaacaattcttaagaaactctttgcaatgtttaacacaattagatcagtgcagtcattataaactatttcaaaaaattctttaatactcttctctccaaaaagtaacatctgttccccatttactgcccataaaatataggctggacttagtaaaataataaataaatatttttaaggtaagatgaagaattggtgacactcaggcggacttaggagctgatcaaatttgagctgctttcattcctgccttttctatttcagtacccaggaacttgctgtattccccctgctcttaggtaggatgaatataaaaggcaacccacattgtctaaaaatagacctcagtccactttgacaaagcactctatccagcaacactctgctgccacactctcattaaaacaatggagatgtcagcatcatctatttcatttctactggagagcacaagccttcttcaatattttgacctatctccactggagaggaagaatttgatttgtaaagacatgggactagcttcgttagatattaatgaatcagctaaggagcctctatatggctgctgaaacgatctgtcagcattcccattataaatctctctctctaatggattataatgttaacaaaaaaatcatttcagaatgaaatttggcatgtggtttatacatttctgggataatactgattttttttattagccaaaattaaaaataaaattagtattaaactacagcattgtactataactcaaccaacaagaaaagtaggtaagacttgccggcccacctctggaaaaactgaaaaaatataaagtctcctcctttatcaggaaaaaaaatatgaaaataaacacaccgatttttcaaaaaattaatttttatatatattcagtatccccccacgaaaatatctacagagttaccctgtgacaatgaatattagaaggtttagattacattttaataactattcaaagacattgtaaaaattgagatttctgtttccataaaaattcatttaggaccacatcaatttcttgatgaagccacatataatttcaggcagattaaaatgaatgcttgcatgtgtttgtttgtattgttgaccctttaacaacacagttttaaactgaatgggtccatcttcttctgcctccgccacccctgaaataccaggacccacctcccctcttcttcctcctcctcagcctaaacaatgtgaagacaaagagaaagaagacttttatgatgatccacttccacttaataaattgtaaacgtattttctcttacttatagttttcttaataacattttctgttctctaccttactttattggaagaatacagaatataatatatagaacatacaaaatatgagttaatcaactgtttatgttatcagtaaggcttctagtcaatagtaacccattattaagttttgggggagtaaaaacttatacatggatttttgactgtgcatgggattggtaccattaacctctgcattgtacaagagtctccagcatgtgtgtatgtgtataaacacatatactacacgtatatatacacacacagacatgtataacagaaaaaattcaaagtatgatatgatatgctttactttacataaaatatgatggtagaaaatctggaaaatggacataatggcaaaatgaaaattattcaaaatctcatccaaattaattatattttgttgaaaccaatataaaaatacaaatatagtgtatatgtatgcatgtttataaacagttaattaagataaattgatatgttctaaaacttcaatatcaaatattctattggatttattttaacatatttggaaataaaagtatgcagatgtaatatttttagactatgaaaactgtatcatttcattttttccttatgtcttattttcttagtttcctctcagcccaaagctaaaaattaagtgaaatcatccatatatatatatatatatgtatatgcctatacagtgatctatgcacacatatatacatacatactattctatccatccatccatccatccatgcatacatacatacatatatacatacatacataaatttattcaatgaacaatttagtgatactatctaggcagaaaaacactatcctaagtggtaaggatacatggttaataagaccaataaaacccctgtcctatataaattacagtttttcagggagagagacaagtaataaataaacaaatatataaaataatttcagatgatgatatttacacttaaagtggccgctccaggaatcggttgaaattatgacctcagggaataagaatgcaggttgtgccaagaagctaaagatcataggtaagttgtattaacatgtccctagaaaataaatagtcttgaaagctagaattttctgaggtggaaattttttctaaagccctttagcttgggctatttagagttaaacttatttggctctattcaactaggtagagaaaagtcaacacaagaagccgaccgagcactgtactttgctcctttttttgtttgtttgttttgttttttccagccttggtggaatgggagaagaaaaaaaagaggtttggggagagtggagatttgagatgctgaagttttagtcgtccatccacatcttggagcaataccttgagaagttcaggaagcctttacaaatatccaatatatttggggaagctcaatagggacatgaatgtgctgctgacagagacagttgataagccaagatcttagatccagacatgtaggtggcgacttcaagtctgaaaataaatgcctgggcacagccgatggaatattctaccccgtgccaaaatgagaccattaacattgtcacagaagctaataaaggagcaaactaaaccagttacttacaggggacactataagggatctagagtattttatatggagatgaacccttttctatccctctgacatgttgtccgtgcagtgcaaagtggactgcctatatactcaaaaggcactttaaagaggaacactgggggaggagaaaatgtgaaaaacaacatatagttctttttttttattattatactttaagttttagggtacatgtgcacgttgtgctggttagttacatatgtatacatgtgccatgctggtacccaaatgactataaatcatgctgctataaagacacatgcacacgtatgtttattgcggcattattcacaatagcaaagacttgaaacaacgtataattctaaaagcctgagttacgttttaaaaatgcctttgcttattaaataacactgagttttactccactagtcaaaatttaatttttcccagccagaagaaaggtctaaaaggaagaagagttatagagatgcaaaagctacatttgctggctgggcacagcggctcatgtctgtaatcccagcactttaggatgccaaggtgtgtggatcatctgaggtcaggagttcaagaccagcctggccaatatggtaaaaccccgtctctactaaaaatagaaaaattagccaggcattgcggcaggctcctgtaatcccagccacttaagaggctcaggcaagagaattgcttgaacccgggaggcggaggttgcagtgagtcaagatcacgccactgcactccagcctgggcaacaaagggagacttcatctcaaaataaataaatacataaaaacataaaagctatatttgttttgcacatgtgaatattgtggtagcaaggtctgagcccattagaaaagtgaaagtatatagttaagggctttgatccacgttttgtttctttggagatatccaaaagtcaagagaaatacgactttctaaatccagagattttctacctcatgcccaccaccacctttcactattttcaactatgaagaagggaatctacatggctatgagacagctatacagtgtgacaaacaagccaaagaaatcggtggagttgctggtgttcttgcttctgtacttctaattcttagtagctttccgggaaagaaggcaacactcacagattgtgtatgtctattcttaatctattttacttttttcatctatgagaaataaattgacctattaataatcatttattcaactgataatttttaaagtacataagtgtatctggcatgatgctaagtgttggaacaaagacacagttcctttcttcaaaaagattacagtctagaaaatgagtacaatgaaagaaatagaacttcatctcttcaatatgattaggcagctctctgattttaaaaaataatggcatcacagtatgctatgtatcatttctcaagaagatacaaggaaagcaaatactatggaatactgattcaaggaagaggtcaaaatactgttaataattatcaattatataaataggtgctattaactgaactgttattacacatcaaatattatgttgcaaaacatacattggacaagtcaatctcaattttggctgatagtagaatcacctagggccttttaccaactgtaatgcccaggttcacctaggccaattaaactaccatctctgggggtaagaaccatgtctatgtatactttaaagctccccaagtacttctagtgtgcagccaagtttgagccctactatctcagacacattttaaataagcattttttattggatatagacatttgaaaattgggtctatatttagcttttctatatactgctagagctgaatagtagcagagagtgtgatatgtgagaacagaaatgtggtttcagaataaattaatggcatttcagtgtgcttcctgcagctggctcagaaaagcagttcattcataatagaaggacatgagaatatatgattcacattcaaatgaagcagagctctctccatattatgaccatgtagaaactgcaagtaaggagcagtattcatattactcaaacaccaacatgaatgtagatattaatttattcccattaagttatatatcccatggcagtcatgttgcaacacaagttttgtcactttttcatccaatatttttactaaaacataacatcaacaactcaagatagcaaagtttgctactaggggcataaactgggagaatctgggccagatcttcccaagaggtgtttcttgttttgtgtgtacaaaaagtttttaaaacttgatgattttatgcatgaacaacatgaacaaatcctagtttccacctttttttagactagtctgtgtccttacatgacaagagttggctttaaatgaatagcagatggtacatttaggcaaggcactgccctccagcgtgcctccgtcctctacctggtgtacaccacttactcgtactcctgcctagtccccatgactgttggaattctagacctttggtatattcattatagacccaggccatgcagccagaatgaatagattataattccagctcattattgattatctataaaactgtggacaattcaaatgaatggtctggcacaataccttgtctttttttttctttttttttttttctgagatggagtcttgctctgtcgtccaggctggagtgcggtggtgcaatcttggctccttgcaacctttgcctcccgggttcaagcaattcttctgcctcagcctccccagtagctgggattacaggcacctgccacaacacccagctaatttttgtatttttagtagagatggggtttcaccatgttggccaggctggtcttgaactcttgacatcatgatccacctgcctcggcctcccaaagtgctgggattacaggcatgagccatggcgtctggccctatccattatttttataattaaaaattgtcaggaaaaaagctacctatatgttttaaacctgcacactaaattttagaaatctagacactagaaataatttcagaaattccgaatatttatgtttaaagatattttcaaagaattatttgtaatagtgaggaacaaaaaataatataaaggtttaccaataagaaatggtgaaatacaatggcaaagacttggaaccaacccaaatgtccatcaatgatagactggattaagaaagtgtggcacatacacaccacggaatactatgcagccataaaaaaggatgagttcatgtcctttgtagggacatggatgaagctggaaaccatcattctgagcaaaccattgcagaaacagaaaatcaaacactgaatgttctcactcataggtgggaattgaacaacgagaacacatggacacggggtggggaacatcacataccggggcctttcgtggggcaggaggaggggggagggatagcattaggagatatacctaatgtaactgaccagttaatgtgcagcacaccagcacagcacatgtatacatatgtaacaaacctgtaagttgtgcacatgtaccctagaacttaaagtaaaataaaaaaaaaacttaaaaatgaaaaaaataataatctttaaaaaaaaagaaacaaaaaaaaagaaatggtgaaataaatcctgatacatcagtggcatggagtacaaggttttaattagaaaacatgatgtagtttccctcagaacatttactgtgggtagtaagataacttgtttaaaagaacagtcagtccacaaatttggagttcaataaaaattttatagtatccccaaattctcttaaaaatttcaaatttgcttttgaacacaggaaatgattactttaaaagcttagccttgtcactcagccatcaatactgcattgtatgaggtgagttgtggatataaaataagtataatatttgggtgtatgagtgtatactttctagacttttttgttaactttttttttttttttttttgagacaagagtcttgctctgttaccaggctggagtacagtggtgcgatctcggctcactgtaacatttgcctctggagttcaagcgattctcctttctcagcctcccgagtagctgggattacaggcacatgccaccatgccctgctaatttttgtatttctagacttttttgttaacttttttttttttttttttttttttgagacaagagtcttgctctgttaccaggctagagtacagtggtgcgatctcggctcactgcaacctttgcctctcgagttcaagcgattctccttcctcagcctcccgagtagctgggattacaggcacatgccaccacgccctgctaatttttgtatttttagtagagactgggttttaccatgttgaccaggctgatctcgaactcctgacctggtgatccacccacctcggcctcccaaagtgctgggattacaggagtgagccaccgtgcccaatcttttttgctaacttttaaatcttttttaaaaattaaagtttaacttacatacagaaagtttactatttttagcataaaatactgtgagttttggtaaatgcatgtagctgaacgaccaccaccacaatcaagatattaaattgtcccaaaccctcaacccacaaaattgtctctgcagctatttgttgttaagacctttcttcacctctaagcccaggaaaccactgatctgttttctgtcgctgtggttttacttcttccagaatcctacaatagctaggcttctttcatttagcataatgcatttgaaatctatgttgtgtgtatcaataatttgtactatcctatgctatggatataccacagtttattcagtcatgaactgaaggatatttaggctgttttcaatttggggcaagtatgattgaagctgctataaacacctacgtataggttttagggaatatgtttgtattttacattcataaatacctagggttgggattactggatattgtagtaagattctgttcaactgtgcaataaactgctaaactgtttccaaagggactatactattttttgcattcccacaagcaaagtatgagacttactgttggcatcatttagcataagtgttttaaaagttttagtcgttctagtaactatgtgtagctctctcatggtttcaatctgtatttgcctagtgaaaaataattttgaatatcttttttatgtggttatatattatctgtatgtttttagtttctatacaaaatattttgctcatttttagtggatgatttgtttttattattgttttgagagttcttcatatattttgattacaaatcattcatcagatatgtgattcacaaatattttctcttagttttatcgtcatattctcttaaaacgtctttgaaaaattttgcatgtatacatagtggaatattattgagccttaaagaagaaggaaatcaggccaggtgtggtggctcacgcttgtaatcccagcactttgggaggccgaggtgggcggatcacctgaggtcaggagtttgagaccagcctgaccaacatggagaaacctcacctctactaaaaatacaaaattagctgggcgtggtggcacacgcctgtaatcccagctactcaagaggctgaggcaggagaatagcttgaacctggaaggcggaggttgtggtgagccaagatcgcaccattgcactccagcctgggcaacaagagtgaactccccccctaccctcccccaaaaagaaggaaattctgacatttgtgacagcatggatgaagctggagaacattttatttactaagtgatatatgccagtcagagaaagacaaatactacatgagctcacatatctgtggaatataaaacattgaactaattgaagtagagaatagaattgcagttatcaggggctgatgggtgaggaatggggagacgttggtcaaagagtaaaagtttccattagacagaagaaataagttctggacatctattttacatcatggaaactatagttaataataatacattgtatgtatgaaagttgttgagagtagattttaaataatctcatctccaaaaatgataataagcatgtgaggtgatagatatgttaatttgatttaattatactgtaatgtgtacatacatcacaatatcacattgtaccccataaatatatacaatttttgtcattaaaaataaattaaatatttttaaaaatgtattttaaatagcagaaatttttattttgataaagaaaaatttatgattttgtgggtcttgcttttcatattgtttctaaaaattatttgcttaacccaaagattaaatgattttatctttccagacatttacactttgggcatttacttttaggtctataatctatatttatacaatttttatatattatatatatatatgttgctaatatgatgaatcacaattttttaaactttaagttcaggatacatgtgcaggtttgttatataggtgaactactgtcactgaggtttcttgtacagattattttgtcactcaactattaagcctagtattcattagttatttttcctaattctttctctcccacccttcaccctctgggaggtaacagtgtcttttgttctcctttatgtgttctcatcatttagctcccacttataaattagaacatgtggtatttggttttctgttcctgcaaatgacatgatcttgttctttttagtggctgcgtagaattccatggtatatattgtaccacattttttttagccagtctaccattgatgggcatgtaagttgattctatgtctttgatattgtgaatagtgttgcaatgaacagacacatgcatgtatttttatgatagaatgatttataatgttgagggtatacccagtaaaggagttgctgggtggaatggtagttctgttttgagaaattaccacactgctttctacaatggttgaattaatttacactccctacaacagtgtataagcacttttttactgcaacttcactagcatctgtaattttttgactttttaactatagccattctgactggtgtgagatggtatctcattgtggttttaatttgcatttcactaataatcagtgatgctgagctttttttatatggttgttggctgcatgtatgtcttcttttgaaaaatgcctgttatgttctttgcccactttttaatggggttgttttctacttgtaaatttgtttaagttctttataaatgctgtatattagacctttgtcaaatgtacaatttgaacaaaaattctgccattctgtaggttatctgtttatgaatagtttcttttgttgtgcagaagttatttagtttaattagctctcatttgtcaatttttgcattggttgcagttgcttttgatgcttacttcatgaaatctgtacccattcctaaacccagaatgttattgcctaggttgtcttccagagtttttataattttgggttttacatttaaatttttaatccatcttgaattgacttttctatatggggtccagtttcagtcttctgcatatagctagctagctatcccagtaccatttattgaatagggatccctttccccattgcttttatcagctttattgaagatcagatggctgtagcagggtggcctatttctaggatctctatactgtttcattggtctatatgcctgtttttgtaccagtaccatgctgttttgtttactgtagccctgtaacataatttgaagtcaggtagcatgctgcctctagctttgttctttttgcttaggattgtcttggttattcagcctcttttttggtcccatatgaatttactttttgtttttctaggtctgtgaagtacataattggtagtttcataataatagtattgaatctttgaattgttttgggaagtatggccattttaacaatattgatttttcctatccatgagcatagaatgtttctccatttgtttctgtcatccctgatttctttgagcagtgttttattgttctcattctagagctctttcacctacatggttagctgtaatcctaggtattttactctttttgtggcaattttgaatgagatagcattcctgatttggttctcagtttgacggttattggcatattggaatgctggtgatttttttttatgttggttttatatcatgagactttgctgaagttgtttaccagctgaaggagcttttggaacaagactatagggcttcctagatatggagtcatgttgtctgccaacaggatagtttgacttcctctcttcctatttagatgtgctttatttctttctcttgcctgtttgttctcgccaggacttccaataacatgttgaatagaagagatgagagagggactccttgtcttgtgacagttttcaaggggaatgctttaagcttttgcccattaagtacaacgttggctgtgtgtttgtcataaacgacttattattttgaggtatgtttcttcaatactacatgtttgagagtttttaacatgaagtggtgttgaattttatcaaaagcttcctctccatctattgagataagtatgtggttttgtctttagttatgtttatttgataaatcacattcattgatttgcctatattgaaccaatcttgcatcccagagataaagcctacttggttgtggtggataagcttttttaatgtgctgctggacttagtttgcaagtatatccttgaggatttttgtatcaatgttcatcaaggatggtggccttaagttgtctttttgtgttgtgtctctggcatgtttggatatcaggatgatgctggcttcatagaatgagttagggaagagtcatttctcctcaattttttttggaatagtttcagtaggaaactcttctattatgtttttccaaaaaacaactcatggattttttgctcttttgaatgtttgtgtgtgtgtgtgtgtgtgtgtgtgtgtgtgtgtgtgtgtgtgtgcctgtctcctttggttcagctctaattttggttatttcttgtcttctgccagctttggcattggtttactcttggttctctagctcttttagttgtgatgttaggttgttaatttgagattgttctaactttttaatgtgaggatttagtgctctaaatttccttcttaacactgccctagctatgtgccagagattctggtgtgttgtatcttttctctcatgagtttcaaagaacttcttgatttctcccttaattttattatttactcaaaagtcattcaggaaaagtcatttaatttctatgtaactatgaggttttcagtgatttctttagtcttgatttctaattttattgtgtgtgctgtggtccaagagagttgttatgggttcatttatttcgcatttgctgatgattgttttatatatgattgtttggtctattttagagtatatgccctgtggcaatgagaacagtgtgtattcttgttttggggtagagagttgtgtagatgtctatcagatccatttgtttcagtgctgagttcaggtcctcaatatctttgttaattttctgcctcagtgttctgtctaatactgtcagtggtgttgtgaaatctccccctattgttgcatgggagtctaagtctcttggaaagtttttaagaacttgctttatgaatctgagtgctcgtatgttgagtgcatatatatttaggatagttaggtcttctcttgaattgaaccttctaccattacctaacacccttctttgtcttttttctttgttggcttaaagtctgttttgtctgaaactaggattgcaacttctgcttttttctgttttccatttgcctggcagatttttctctatccttttattttgagactatgagtgtcactggctttgagaagggtctcttgaagaaagaataccattgcatcttggttctatacccagtttgtcactctgtgccttttgattgggggcatttagcccatctacattcaagtttagtattgatacatgtggatttgattctgtcatcatgacatcagctggctgttatgcagacattttttgggggttgctttttatagtcagtggtttgtgtacttcagtgtgtttttgtgacaattgataaaggtctttcctttccatatttagcgcttccttcaggagctcttgtaaggctggtctggtttttacaaattccttcttcatttgcttgtctaaaagggatcttatttctcctttgcttataaagctgagtttggcaagacatgaagttctggatttgaatttcttttccttaagaatgttgaatattggccttcagtctcttctggatagtagtgtctctgctgagaggtctggtgttagtctcacgggcttccctttgtaggtaactggacctttctctcttactgcctttaacattttttttcctttcattttgcccttggggaatctgataattatgtgacttggaaatgatcttcttgtgaagtatcttactgggtttctcgacatttttaaatgtaaatgttggcctttctagttaggttggggaaattctcatggatgatatccgaaaatatgttttcaagttggttccattccattatcctcatctctttcagggacaaaaatgaatcatagatttgacctccatacataacctcatgcttttcattagttttatttattattttttattcttttttctctattcttctttgactatctattttagaaagccagtcttcaagctctgagattcttcctttggcttgttctattgtgctactaataccggtgattgcattgtgaaattattgtagtatgtttttcaaccctatcaagttgtttatggttttttgtttgtttgtttgtttgtttttgacagagtctcaccctgttgcccaggctggagtgcaatggcgcgataacagctcactacaacctcctcctcctgagttcaaacaattcttctgtctcagacccccgcttaactgggattacaggtgcccccaccacacccaactaattttttgtgtttttagtagagatggggtttcaccatgttggccaggctgttctcgaactcctgacctcatgatctgcccacttcggccccctgaagttgttggggttacaggcgtgagccactgcacccagccatttatgttcttttctatactgggtattttatctgtcagctcttgtatagttttaccatgtttaatttttaaacatttaatcagccatgcattttagtgataacccccattttgtaataatgaattgctctgttaatacactgttggatttggtttgctaaaattctgttaggaatttctgttctagtaccaaaatagcagcctagaagcaagctagcttcactgccactcataggaaaccagaaacaaatacataatgctgtggttattaccatcaacatctcaggatttaaaaccagggaggaaacagttccctgggctgcagataaatagaagcattctgagcatatggtaaaagaaccaaatattcatatccacgatgcctcctccaaatttgcctgccaccaactgcatggaaaatttccccctgacttattgtctctacaccgttaaaaatgagattgagatgggcaaccagcctcctcagtacctcaggtccactggcaggatatttgtattttcctcaatccacaagaagcatcaggagtgcctaaagggcaaaatatccctaaggatatccagagacaatatggggaggtggaactgccatcctcagtcttggaaactctgctctataactctttcaaaggagaccccaagtcagagtggctgttcagcagcaccatgttgtaggaggtttgttccactggtccccctgggcatgaacacctaggaagccttctcacactaattggaaattgtctttggaatatcccccattccagacagactgtattctaattatttactagaactcaggtaaatatgggcttaaggtaccatctactctcaaaaaaggcaaaaatgtggggagaaaaaggaaaaaaagaaataataaatgaatgaaaatacaaagaaagaaagaaagaaaatcaacaggtaagttaaaaagaatctaagcaaatatagtctaattttctaagcaaatatatctaagcaaatatagtcaggaaaatattgcaaatatatctaagcaaatatagtcaggaaaaaatattgcaaatatatctaagcaaatatagtcaggaaaaaaaaagccaggcagagaagtctggaataaacaactaatcttggaagcactttaatagatgtgcatgcacaaaaaataacagcaaatagaaaaccacgacctccacagacaaagcaataaacctgtgactgaccttcacaagacagtaatatatgaactccttgataaataatttaaaatatcaattttaaggaaactcagtgatctcccagataacatagaaaaataattcagaaatttatcagataaattataagaaaaaaataatttttaaaatcaaacagaaatcttggaagtgagaaatatatttgctgagcaaaaaaaaattattagaggctcttagtaacagaatggatcaagcagaggaaataattactgagctcgaagaatggctatttgaaaatacacagctagagggaaaaaaaagattgaaaattaaggaaagtaagctaccagatatagaaaataacctcaacaggcagaatccgagaattattggtgttcaaaagggatttgagcaagaatgaggagaaggaaacttcccttcattcacaaaaacaataatacaaaacattctaaaacttggcaaaatgacaaatatctgggtacagaaaggactcaattcttccattgaaagtcatagagtggctgaatggataaagaaacaagatctaaatatttaatgccaaaaagaaacccacttcaccaataaaggcacatgtagactgaaaatgaatgggtagagaatgatattccatacaactggaaaccaaaaaaagaggaggagcagctctacttatatcagaataaaatagactattacaaacaggtatacaccaataaattggaaaacttattgaatacattcctgggcacatataatctgacaagtttgaagcatgaggatattgagaacctcaacaaaccaataacaagtaatgagattgaagtcataacaaaaaggtttcataaaagaaaagcccagaatctgttggcttcactgctgaattttacccaacctttcaagaagaatgaataccaattcttctcaaagatcatagcagaaccaagaacaaaaaccatatggttattttaatagataccaaaaaagcattcaatacaatataatattcctttatggtaaaaatcctcaaaaactggatatagaaaaaacatacctcatgaaaataaaggctatgtaagccaagcccacagctaaccattatactaaataggaaaataatgaaatcctcttttatgtctagaacaaaacaaggatactcattttcaccacttttatttaacacagtactggaagccctagccacagaaattagtcaagagaaagaaacaaagggcatccaaattgggaagaaaaactaaaattagtcttgtttgcacatgcatgatcttatacctagaaaaacctgaagacaacataaaacaaagttagaactgataaattcagtacagttggaagatacggaatcaacatccaaaaatcagtagcagttatataattcttcagttaacaatatgaaatagaaatcaataaaacaatcccatttgcagtagctacaaagaatataaaatgcctagaaatcaatttaaccaaagatataaaaatcctgtaggagaaaactacaaaatactgatgaaagaaattgaagagaacacacagaaatgaaaagatatttcatgttcatgaacttgaagaatattgttaaaatgacaatactactcaaagcagtttacaaatttaatgcaatcccaatgaaaacaccaataacattattcacacaaattttaaaatttctacactgtccatggaatcacaaaaagatcctgaatagccaaagcaatcctaaacaaaaagaacaaagcatcacactacctgacttcaaaatatactaggaagctatagtaaattgtacctgcataaaaccagacacatacatcaatggagcagaatagagagaactcagatataaacctaggcatttaccaccaattcatttttttcacaaaggtaccaagaacttacaggggaaatgacaatcttttcaatagatggttctgagaaaactggataaacataggtacaggaattaaactagaccctatctctcaccatatataacaataaaatcaaaatgatttgcaaatcttaatcgaagacttgaaaccctgaaactattataagaaaatttaaggatatgcttcagggcaatggtttgggcaaagaattttcgtgtaagaccacaaaagcaaggcattgcaagccataatagctgaatgggattatatcaagctaaaaaccttttgcacaaaaaaggaaacagtcaataaaataaagacataacttaaatgggagaaaatgtttccaaactatccatctgacaaaagattaataaccagaatatataagaagctgaaatggctcaatagcaaaaagataataatctaattgcaaaatgggcaaaagatcctaaatgacatttctcaaaagaaaacatacaaatgaccaaaagtatattttttaaaaaaatgcttaacatcactaatcatcagaaaaatgcaaatcaaaactacaatgaaatgttttaccctagttaaaatggtatttataaaaaaataaagaatattgatgctagtgaggatgtggagaaaggggaacccttgcacactattggtgcaggtacaaattagtatagccactgtggataactgtatgaaggttcctcaataaatgaaaaaatcacaactaccttaggatccagcaattccactgctgggtataaagccaagagaaaaaataatgagtaaatcaaagaaatatgtacattcctcatttactgtagcaccctttacaaaaaaaataaaaattgaatcaacctaattgcctgtcaatgtatgaatggataaaggaaatgtgatatatatacacaatgaaataatattcagccataaaaagaacaaaattctgtcatttgcagcaatattaatgaaactgtatatcattatattaagtgagataagccaagcagagcaagacatatatcacatattctcactcctatgtgggagctaaaaaaggagatcttatgaagacagacagtaaattggtgttttccaaaggccagaaagggtagagagtagaaggggttgaagaaagtttgatgaatgggtacgaactaacagttttatacgtacgtatatacacatatatacatgtatataaacatatatatacacatatatacatgtatatgtatatacatgtatatatgtgtatatatatacatatacacgtatatatatacatatacatgtacatatatatatacatatacatatatataaatatatatggagctgggggccttgatcacccctcaatattgtatagctttactttattaagctatgttacacacaaacattttttggtttttgattttgtcacatgcatattattattcttttcttctttagccagtacttcagggaaaaaatgtaagcaagatgtattacttaatgtcaacaactagattggctccaaaaggaatatataatggaaatctatatctgtatctatctactacctatctaaatgtctatctctctatatagagagaaagagaaaaacacacaaagagggggaaagaaataagaaaaggaatcatgaaataaactttaaatgtgattattttttattttttaaataacccttattctactgagtgtcattgtttttaaattttgattatcctaattaaaaaatgattttgaattatattctctaattgatcaaatatataaatttctcatggaggccagtttttactttttgctatctttttcctggaccctaaatccacccttcatttcaacttgattttaattactgtctttgaaaatgtaccacatataacttagaaatacttttgccatcatttgaaataaatgtaaacaaaaaccatcctttaactgttataacattttaaaatatttgcattagaacttattcttatgtgactatactcacttttataaagtgagagtgaatttctaagctgactagaataaatatgactcaatcaaccacaattccattaaagttgctgttatttttacatactaaaacatattttaatctcataattcatttccaaattcatgctatcagtttattttctatatatagatcaaagacaagattgaaaaccaactcagtatattttaaatggtaggcaagttagaacaacaatttttacttgagctgaccaaggtcaacagctcaaagcacaatatattctcaaagaatattcttcttagtaatcctcttcaaaaatatattgaaaatcaagtgtacctggatattgctattttcatgcaggttaatgccaaatatccaagtcatatgttcaacaataagacaaaaatctattaacattctttttgaagggtcatttagagtattaccattttcataacttgaatagtcctttttatttcatattttgccatttattttcacaatattaacataaagtaaatgtgtattgtagtctatatggcaatgaactatttttaacacacacacctagacccagaattcaaaaagatcacttggcctgaagcacaggatagaagaatatcatcactattctttcaagtgggaaatgcaatttaaaaaccaatgttcaactgatatctggatatcagtgcataaaaatacctgcactaatatttaataaccttgagggattataaaatacagaacagagaacacatataataatatcttcaggttttcatttccacaaaacctacaaatctattttagcactcaagttaaatggcttctagagggccataagattacacactttcaaaatacaaatgacaacaatttattgaatcaattaattagctatttattatttcagtaactgaattgaactgtttctagtcatgagttttccagattcactgttttttctcccattatactaagtttgccatcgatgcattacagccaatgtctttccattgagtttgtttgatgttacctgaaaaaaaaaatctccttttacaaggggcagtatggaagatctaattgagtgtgctctaggacactaacttcatattacagttttgaggatgttcatatggtgtgactaaaatacaaaagaaaattatatgtgatttgcatcgtccttataaatctagaattaattgttaagtgggcagttcataagtaaaatatcaaagatttatttgaaagttggtattcaaatagaagtacacaaaagagtatattttattcaaatatatatacacacatacatccaggtttgatgagttaacaactaatgaagctgactctagattattcctgaaggtttaaaggttttagaaatataaaggatgacagaaaatctaatgagatatgctgagcttggaaggggacatggaagtaatttgaacaagaaaaaaaaaaaaagacaatagcatacatctgattcatctgaacttagagcactagacctacactttaacctgaactatccaaaagtcattaaggataagaaaaggggaagaaaattgcctcatctttgatggcctgaatcacatgtttaattagaagatgtaggaaatacctcagaactaaagaaattctcagggcctggtgccctacagaaacaaaagcacagttcagcaatctcgatggaatagctcacagtcctaacctataggctttatttatacagctcaaaagattaccaccctgtaacaggctattatgtcttatatttgcttggaagtaacatcaagttaatctttttacatctaacatttgatttttatttgccaagagtaattttcaaagcatgtgactcatattttgtccttggtgagagtctgaagtcatgaattttaataaacatgaagccacagctaagaatcaccaaaacttgttaacttgcaggatttctaagttaaaacagaatgaaatatatgcaataaaaggtagaataacatgctgaaaaaatttaatagtgtcaaacgtagaaaaaatatttagctctgtgtagaaaataaatagcttctttgtataacaatggcattcttatatatgacaatacggctagtaaaatgttttgtttagttgccaaatagtaaaatattaatgttttaaaagactcaatgctttcaaattaagaataaatcatggccaaaatgagcattgcaataataagacctagaatagttgatgaatgaattaaaataatggaggacaaatttaaatgtttattacagagccaaacatttctgaaatatttaaaacatttatcgaagtattttctcttaaaaaaaaccatactgtaaataattacacccatctgaatataatatcatgtttatgtatttgtagaaatctgaaaattttaaaggcatgagttctgtaaaattaaagaacatttaaatatataaatacacatgtcaatatatagatctatgcagacataatctatgttttatgtaaacataacctatgtattatgtaaacatataaagctatatattaaaatacaaaagtatttatatataatacatatcatatatattatgcattatatatacatgtatgcatatttaaataatgcataatatataaatacataaacctgtgtattaaaatatatgtacatatatacatacataaacctatgttttaaaatacgtatccataatatacatctctaatagagaagatactgtttaaatttttaattttgattgttagagatacctagtaataaagggactgaaaaattgaaaaaaaaaaaaaacaaaacactcacactgtgagaaaaaaaaattgtttgaaagcctgcatctgtctaacatcctatcagcaggcatattaactgaacaaagcacttgcttttttctgatgccaatgctgatttttttttgtttgtttacttaaaacatcattttcatagatattcaaaaagaagctttggtgtctgtctagttcattaatagttttattaattcagctagtcatcaggtgcaattcatcaaccgcacaaccctttgtgttctatttttgctaaatgcttcttctctggaatttaaattatgaagaaaaagtggctgactaatgtgaatttctcaatttattcatgttcaatgaaaagctattcatcagcataaactctgctgtgagttcaaatcaaatttgaaccacctgggagtaaacaaaattgttcttcttccctagcacttggaagtggataataataacacattttcaagaaagtcaggatactaatatatttaactgaaataaaataaagatgataaggcatcaagtttttccactatatcagatgttttgcccatgcaataagagcttctgaaatattttggtagttttatttccatcattaatgctaatttcttttatatcttgtaggtatacaataatcagctattctccataccctatagcatgtgcaaattctgtaagactattattctaccaactttcctttaaaacatttgaactatttatggaattgatggttaaaacaaagtattcactttcagaattgttattaagcattcaaaatcaacattcctataaacctaaaatacagaatttatctacttgagtttacaggtgcttagacttataaaagtagaccttttttttttttcataacaaatctaaggctaacagaagcttatggagtagtatggagcctgatgtgtatttcagagagaattaagaaataatcttgtagagagtcttctctagtaatagtggagctaattctcacctatttttgagcactcatggcaatacaagattaaagctggtgctggagatttttgggctcatgcgtgcacgtctaaataaattatcagtaggttaaaaacaaaggaacagaatgaaatggtaaagtgcacattccctttcacttattcttcttgaggactcaaagatacttggattcagcatataaaaacccatatatgtattacaaagtacaggagatccacagtcctcttcaggaaagagaattccattatctatttatctattaggaaatggaatactcttttctgaactgtaatttttaggaaagtattatgcatacatatatggaatatcttattagaagtggatgtacggagttttaaaataggatgatttatgaagttttctgtttaatacttattcttagcatacttccaaagcctctgaggctatccattttgtttcccaggaagctagataaagcccaaattcaccttctcccaatatagctgtaagagttgatactgtgtgatagaagataaaggccaaattcaccttctcccaatatagctgtaagagttgatactgtgtgatagaagataaagcccaaattcaccttctccctatatagctgtaagagttcatactgtgtgatagaagagaccaaaatgtgcaaagagctacagccctgtgaggagcctgcagtgcattgcaacttgagtttcaatctgaactgtatggacagagctcattgtacctcagtgaccattatccttggaagtgagggtaggaagtgaaaggaggcaattcacgtgtttttccttgaagctatattttaagactgtgtagaacatcttgaagtttggaaacatatttgcttttgcaggtgatggcattttctaaaatattattacaaaatatatgaaaattgcattgtagttgtcacaataaatcaaacatcttacataataatgtaataaaatctagtttaacattataattttattcaattatttcatccacattgagatatttactaagtcatgaagtttatatagatcatgagatgtaaaagatctgctattactaatttgatttaaaaatcccatgttcattataataggtagtgctgcttaaaatgtctgtgtaatgatctacactattatctgcagcacaatgatgttttcacagctgctgtttgcctggaatcagccatgtcctttgtgaaaccttgcctcggcatgggctcttattcctaacatttgccttttaaaatctctatagagatctaacagaaaattcacaagaacagcatcttttgtgcttctctttctctgaaaataccaaagcagcagtgtatcttcccatatttaaaaaagaaagaaaatgttttaatctttcattttccaatataaagtttttagccaaaaaagtatttattaaaagaaaatagatctgtcactcactaattcaatgactaactacataagtttaaatttactttttctttgagtatcagacaaaagtaaaacaaactaggaatttcagttctctttctgaaaaatgaagtatatattacataatgaaatatacatatatatacacacacacggcgctagcaattaaatctaaaatgtttactttatctagaagtagggcaaacagaatttaattctttgtttgtttccctctaatatttgtcatgtcttatggactggaggagccaatccacctgtcaggagtttattgcagaaaaatggtaacttctgggaaataattcatcctaaaaattgtcagaaaccagcttggttcaatatacagatatctttcagaatggagagataatcctgaaaacagcaatgttactaataatagttaaccccttactcccatccccattaatgtattgatgtccaaatcctatgaaaggaagaaaaaacctatgaataaaagcaggccgggcgcggtggctcacgcctgtaatcccagcactttgggaggccgaggcaggcggatcacgaggtcaggagatcgagaccatcctggctaacacagtgaaaccccgtctctactgaaaatacaaaaaattagccgggcgtggtggcgggcacctgtaatcccagctacctgggaggctgaggcaggagaatggcgtgaaccccggaggcggagcttgcagtgagcagagatcgcgccactgcactccagcctgggcgaaagagcgagactctgtctcaaaaaaaaaaaaaaaaaaaagcaatgagtaggaccacatttcttgtaatgacagagaactgaggtggctgtaccttccacaaataacaattctaaagtgaaaaaattataaaataggtcaactatttaaaggtactgtaaaaaacccaatgtagagagaatccaaaggaaattctaatcttgagtgtggctttttgaccaacttctacaacttcttctatagctgcaggaaataccagaacaaaactctacatccttgccagtaaaaggtgctgtagatgagtgtttaggcagaaaatctccaaattgtatcatctataattcccagttttcaaccaaaaattagtagacatgcaaagaaataagaaagtaaaatccatgctagtatgctcaatagaaggtgattccaagtgggtcaaaatattagatttagtttataaagtctttaaagcagctataataaatatattcaaataagaaaagataaatacactcaaatgattaaggaaaaatatgttctcaatatgatactctcttatcacaaaatgcaagtgagacattcttcaactttgacatgcagcacagaaaacagaagggacttttgcatatcaagaatttcaaagaatgatagagaaactttggtacatcaaatatgccaatgcatttatcacatgcaggcagcactggacaaaacttctggaagcagtagctcagaatctgatcctgagctgctgtagggagcattattgagaatatagacaactacctctttttgcacaggcctcattcttctcaaagtggccattgaaagaactggcaaggtcccttctgatgggcatattttactgagaaagctttttatattagaggactctcaaataaaattaaattattctttgaaagaaaaaataaaatcgtgttttagaaatcattttttggccaggcgtgcaggctcacacctgtaatcccagcactttgggaggccgaggcaggcagatcacgaggtcaggagatcggctcctggctaacacggtgaaaccccgtctctactaaaaacacaaaaaattaaccaggcgtggtggcaggcgcctgtagtcccagctactctggaggctgaggcaggagaatgatgtgaacccgggaggcggagcttgcagtgagtcgagatcgcaccactgcactccagcctgggcgacagagcaagactccgtctcaaagaaaacaaaaaggaatcattttctaaacaatacagttagtcacaacctgtattattccaaatacaaatattatcatttttgacaacacagtatcttccagttgcttttctatgtttctttttgattagcaattgtatatcatcacactaatagacattatggatgggtaaacattcataacaacattttttaaatactaggactgaacactgattcaagaacacaccctcattactcttctccacccggtataattttcaccaagtccttttccttgatttcactaagatgcaatcattacttctgcagtctagcaccattacaatttggtgcttggcacatattaggcaaaccatatatatttgttgaaatacatgagacaaatgccccaaacagcaacaatgtacatttataaagccccatttactgcagaagtgaattaagtatttagagagttatatctatacctgggagatctactgttcaacttcttaaatactcattttacccattgatatggtttggctgtgtccccacccaaatctcatcctgagttgtagctctcataattcccacatgttgtgggagggacctggtggagacaatttaatcacgggggtggtttcctccatacggttcttgatatggttcctgatacgagatctgatggttttataaggagaaaccctttcgcttggctctcattctctcttgccacggacatgtaggaagttcctttcaccttctgacatgatttgaggcgtccccagccacgtagaactgtggcttaaacctctttttctttataaattactcagtctctggtatatctttatttttatttttattttttgagacagactctcgctctgtctcccagcctggagtgcagcggcgcaatctcggctcactgcgagctccgcctcccgggttcacgccattctcctgcctcagcctcctgagtagctgggaccacaggcgcccgctaccacgcccggctaatttttgtatttttagtagagacggggtttcactgtgttaaccaggatggtctcgatctcctgaccttgtgatccacccgccgtggcctcccaaagtgctgggattacaggcatgagccaccgcgcctggcctggtatatctttattagcagtgtgaaaatggattaataacccccatcatgctgtttttttccaaacccaggaatagtaggcagtagaaaggacagaatcactctattatttaggtatgaaaagacatggtgttatattttccttggtcaatatttcaaggagccaaatgataccattccagcctcataagaatttatttcaagttccaaagattggttggtaaatttatttcaatgatggagcaatgaaaatatgtttacactgaataccaaatacacatatgatggttcttaaggagtcaaaatctaaagacgaccaactgaaaaagttacttggttctagtggcagatttttgtttataggcagtggtataaattatcgtctgttttttgttagactgccagtgctaaaatctcacctgaaggacaagtcaaaatctcttgcagcctataatatatttataagctacctcttataaatgttcatctactaatatcaccaccccatatgcagagatcctgtaagaataatattgtattttgatcttattaaagacagttaacaaaatattacaattatattattaataatacaaatttattttgttaacaaatcaagtagttgaaatcttacctactgaattacttgaaagtgatattatttgaatctgttctaacatctaaccactttctatccataattctccatgtgagccactacatcatgccttgttgggacctgccattctagctccttcacatttgatgcggctggttaacctattcatagctgactcttcttcaacctcatttaatgctgaactgaattaggagaacaggagcacaaagtggctatgacagaagttgggaacgtttccaagaaagtttataatacagagagcaattgtgttttgctatctgctgattaaatccaatcacaggcctgctagtgatacccaggccacttagcattcagtgttgggttatggtatatatgtgaagaggaataaactgaaatgtatatggaatcaaagataaaccttatcagctgactagatggatgaaccttacagaggagatacccatgcatacttataaataaaaatgttaacttaaataaaactaatagtgaaaaggacaaggttctattgtcacataaatatgactggagtctcctttttcctttgtaaaagtgaagccattgattggtgagtattaattacctaacaaataattcatattacagaatagaatgtggccattttttatctctatttggaatataacattagcgtatgattacagatggcagaatcatatatcaacattttattgtgattagatacacttgtgaaggggggatttattttgaagtgttggagaatgctctttagcgtattctagtagtgttttaaaattttgttaggtataaaaactttaagatcctttgaaaagaaattagaaaacaaaatattataaataatggagtgttacaggacacttattaaattggctaaggtattatttttactattataaagtacaaaaaatgagttaaggaaagtttaagtgatttgcccgtagtgactcacagctagtaagatgtagggtcagaattcccccatagattatcacatactgttatgatctcatcaaaactgaagtcattcatgttccagaaggataatgtccccaaatttccacacattcccagattgaccaatgttgttatttacataggaatattctcctttatcttaccatttccaaataacaattggccctaaaatcttttcagaacatttttttttaacacacagaagagattttagtactttacaagaggatatctcacacctaaggataaacagaaaataacaaagactcatagggatgcatgtgcttgtgcagctgtcagtcctcattcttgaggtaaacgcctttgtgtctgatgctctcacagcacactagattgaaaggtgaatctcaggacaattacaagtaataacaagccttgagccttgtagtctcacacaaatagttaaaccttgaatgttaaattttagatagccaaggtttgacttagtgctataataatgttggtcatacttatgtactgaattttgaggaaaattctttcctaccatgtgcagaaataaatgccagccatatgtgtatgcatatacaattaagtaatctatttagaactctatgtctgagcagtaatgagcttttgtttggcatcacttactaaattaagacaatttgcctaatgtggtagaggtgagggttaaaaatttcactcccagaaatattttgaatttttggttattgctatggtttgaatgtttgtcctgctaaacctcaggttgaaatttgatcccaatgttggaggtggaatcttatgggagatgtttgggtcctgggggaggataactcatgtccttccttggaactgagtgagttctcacccaattaattccagtgatagctgactgttaaaaacagcctggaaattcatccatttctctcttgcttcctctctcaccaagtgacctctgcacaggctggctccctttcaccttccaccatgagtggaaggaaaatgaggccctcaacagaaataggggcccaatttttaacttttggagacatcagaattgtgagccaaagaaacttttaaatttataaatcacccagcttcaggtatttctttttagcaacaccaaatgtactatgccaactatcatacatcaacgaaagatttttttttcctagctttctttccaaagatttggaatttaaatttttttacattttgaagtagtctgtgtatgtatttccccaaaaaaagtgaaatcaactaatcataagtgcatatatatacatatatatgtacagatgcctacggtaatttcaacaaatgtttatagaaaaaccataaaagaggcataatttattaagaactaataataaaaaagtaaccccatagtaaattaaactctatgcttaatgttaaagttagtctactttcttttgtttcaggaattggacattgttacagcttttctcaaatacagaaatccttaatggtaatcagtaaaattagtaaaaatgaatgcttgaaattacttgagaaaatagctagcttgagattgtctattattaaatacatttcttaaaataacccattagtagtgaggattagactcatttgctaagttagtgatgaaaaatgattcttctttatttgacaataaagccttaggtattgccctttgggttaagagagataagaactactcaatggaagaagctggatcaatccaaaaattatcaggatgctgtgcctgcaatagtactgctacttactagctctcttaaatctgataaggtcacttagcctcaccaaaatttcagtctcttcccttgaaaaactaatatactactattatttattgtcagaaagaaaatatgaggattagaagtcatgttaagaaaaagcatctggcttacccatggttcttaatgaatgatagctcttattatttgagtctcatcctatcaacaagcaaatcaattatttatctaaatttaaaaacataagaaaaatggaatatacataatataacattaaatatggttaccttaagatataatgattaagaataccaaatacttttctgcagtaactatctgaacagaaagtgatggcctaagattttttatgtgttaactttgaatgtaatggaaaaccttgcaatcccttaacatacagatcataggttcattagcaaactaatgttaccctgtggtacagattgttatatttaaatattaaagtatgttgaaatattctttccatttgatttaatttctaattttcaaaaatctttctttaaagcaaatcattaaattagtcaaagtatgtggaatagtatgaccatatatagccttgacgtatgaggttgtcataagtaatgttatactcaacacagtaacacaactttgtctggaattagaaagaaaaagagaacaaaactaaaattaaaataaatctccacatggatacaataagacataaaggaaggttattcttaatagcattttccaacatctttttgtacttttggctgcaaagtagagtaacaatagacataaaactaaactgcaaatggcttgttattgttcctttgaaatgcaatgtattgtgaacaatatttgtttgggatattttcatttatttggtggaaaatggtcataaaagcaaaggttttttttctttgaggagcataaattgttacattactttaaatacttcttactcaatatagcacaatgctttgtattaaccttttaatattacatgtaaatccagtattttatttgaacatcatttatttgtacaagtaactatttttatataaattttttttcaactcaaggtttttaatgtgtttttttttccctattccaaatttggtagacgtctaaatcatcttttaggaatgtaaaaagctaggcattttaaaaacagaaaattctaggcagtttacctttcaacaatctaaaccaaatcactcagattatccataaaattgtccagaaccaatacaaggaaaaaagcaacattttgacctatgtatcagaaatcaaatcaattatcagacctgtaagtaaaccaaaagaggatccatgcaggcagagataaatcctaaatctcagggtactttgacagtcacatagtaaaagtgattggaaaaggttatcttgaacaaaggttcttttcaagcacataaatcatacaaataattatctctctgaggtgacaggggcctaggaagtgaactactttaggagtagcctccagagatcctcaaccatgtttatgagccgcacagtcatctctataaaagacaagctccagttgagtaaaccatgttaagtactacattccaaagaagaaaaactgtgaatagaaaagttaacataatgcaccattgatatggaataaacacttaatgtctagtttttttatcaataaagtgagtgggatcagtttttcttatttattcactgaagcacattcttataaaagacaaacagcaagcacagcatatttattgcatggtagctctcttatacagtgttgttgatgtttgtttcatttttttgctcatccatgtaacctacacatgttacaaccagcatgctaggtacatgggatataataagattgagtcccttcacaaatcttatacattaaaaaagaattgagaaaaataaatggaaatgaaagttgcttcacattgtgattaatattctagaggggtagtatacttggtttcatcgtggagtgcttcctgcatttaaactcagtccaaggatgagtaggaaattgccaggaaaggtgagtaaggagccaatgttgaaagagaagaatataaatgtggaagttcagggaagagaatgataaattgaagatgcctaataaatccagagtggcacagatgaagaggacaagggcaggtagaagaggtagaaaaccaaggggctataacaaatggcattgtatgctagaataatgagtttgtgcttcagaacaaaggaaagttgttaaaatgttgtaaaaaaaaaaaaaaagactgacactatgaaagttgcatattggaaagaacacactggtggcagtatagaaaacaaatggaaagataggcgggacaggaagaccagaggaaaaacagatgaattaggaggctttcttgtatttgtggtgaactatgataggggctcaaatcaggctgctgtcaacgggaatgaaattatgtgaatgaattggagatatagtttaaagggtagaattagcaggacttaataattaattgttaactctttttgaattggggtatgttcttttgaccattattctttcttctcttagctctgcctatgttctggaggggtcatatttaaatactgactcatctgtaaatttcaagtcagtagttctctttattgcacattttcaaagtggttgttatctactatccacttccttttataattaaaaaaagattatctacatcaaatataaggtaccagaaatagccaattgcaaaccaaaatgggagcagtccagagataggtggctagtaagagctaaactagaggagcactttctagttgttaattttttccttcttccacttagtgaatcattacttgcactgctttccttgtacttctcttatttaccctctagactgcattagtgagcaattatagtaaggactggttgtccaccagaatgactggaatggagagactgtaagtttctaagttgtaaaagatatttacttcccttggaatgggattggggcacaaggaaggattgtgccaatggaaagctagagttttccctaagtttccatactcacttagaggtataaaatctagggcccgggatattgtttctttccaccttccctaccaacatgtcactggaccagacagttgatattgttaaggaaataaaagatggaatcacatgaaaaaaacacaaagcttctgagggatatgagcacttcaattaatttgttttaaaagaagagaggagccaaattagaggagccaaaatttgtaggaaaggataaaaatatttgaacgccttccaggtgataaaagagaaaactggatatgaaaaatataattgaggaaatacggatttcaacagatgaacagtatagcaaaatgtacgtagaaaaagaacaaactattaagttggaagatcaaattgctggcctcctacacaatgaaatttaaaaagaaataataagtgaagagttcagatacatcaggatttctcagaattggtactattgatattctaggccatataatattgtgttgtgaggggctttcctgtgcattataggatgtttagcaacatcctggtcttactcactagatgtgaggagtacccccaagttgggacaaccaaagatgttttcagacatttacaaatgcacactgggggataaaatgtcccggttgaaactacaatatatagataagtaaaaatgtatttctatgagtcacaaaaaagtaataaatacaggtgaggaaatacaggaatggggaacaatacttttctagaattaaaaaataaatgaaatatgataaaatagttcatgaacaatcaaataagagagattaaaaataatatctaagtatgctatagataaaatgctaaatattaaaccaaaattttaatggtcataattttcaaaaagcaaaagtaggtcacctaaaatatagaatgagttagacatcattcatatcaacagcagtggatgcagcaagacactaaagtaacatttaaatattgaagaaaaagaactttgagccaggaatgcttttttcagcttaaaagaaaacaattaaatttgagctgaaagcagatgtatctggtataaaaagttatagaaagcacaaatatcaaaagtctttttgaataactcttagaagatattgccaacatagaaagcagtcaatctagaaaacttcagtaagatatggaaacaaggtgaataaagaagttagtaaatttacttttgtctaaatgaacaatagtaatgataaaatatagtcctaaatgtccagaataataatttcaagttttactaatatagtatttatatattgcttggaaataagagtattttgaggaaaaggggtcagacagggaagtaagtgcatattaaaattgttactttgggatatgataacttacatttattataggtttattgcatgcaatgcaattttcaagatgtgttacctatattcacccattcaatcctcactaaaacacaataaggtaaataaccattattattatttaatttaaaatgaagtactgaagcggagactaacttgcccagggttagtattcaacctagccagtctggctaaacagcctaccctcttcagcagtaagcctacagttgactagaagatgatactattatttaggtttagacaataactgcaaaactaagcatactattttatttagctagcaaaattaaatttgataatctagaatatttcattgaaaggaagtcttaaaaagggaaaatatgtcataaataaaaagttgaaataagatatgacaacatatgatagcaattagaataaatattagtaggctaatcagaagatagagacttacaatttttaacttattaaaacagaatcacaggttaaccttacatcatctataatacacacatacagttccaaaagatatacaatatttgaaaatttaaaacatatgtttaaaaaatatcagaaaatatttcaatcaaattatatataggatagacattttatttcacataaagggaaattcaaggcaacaggaagacctaaagcacaaagatgtttcttatacactggtaaaagaaacaatatgtccacaggataaaagccaaagttctaaaagtaaaaacagcccacatgatctgcaacttcctccctttcatcactgacctcctttcctactactcttccccttgttcagttgggttgagacacaccagctcaaataaatgtgaaaacttaaataaaatattatatttctggtggatcatttcactgatgaacactaacaaacttctcaagagagtccatctaattttccagaaatttttaagatgaaaattgcctattttaaattaatgatagtaatttaactttgataccaaaaccagataaagtacaaaaaaaaaaaaaaaaaactcatgggctaatttactttatgaactatacttaaaaatactaaaaaaatagattagcttaccaaatcaacagtatattattaaaatgtcatcataatgatgtatgatttatcccagaaatgcaaaggtgactcaacctttgattatttataaatgtaaatatttacatgtatcagtcaaaggatagaaatcacatgatcatctcatttatgcaggagaaaaatgattttatgaagttaaaaatattaatgatggaaaagaaaatcagaaaattggattagaattaaatttccataaccctataaaaataccctaaaaatccaagtaaatatcatattcaatgaataaactttagaatttattaagattaagaatagcatcaggattgtcttctaccactcctactgtgtagcacagaactgaagttcctaggtaatgctgtaagtcaagaaaaacaaatgcatcatataggcttgaaattaagagataaaataacaaatatttgttaatgaatgattatgatttttatatagacaattcaggatagtcatctaatctttagagctaaaaataggagtttgtttaccataatataattttatatgagcaattttcaaccagaaaatgtaagatatcatttgcaataaaaagagaaactacaacaaagctttttaaaaattctaacataataaaggctacgactagcgtatatggaatttcaaaactctatcagaagacataaaactactccccaaatttagagaaattctgtgttcacagttgaagtgacttgacattgtggatatctgtttttctaaattcatttatctcttagtgcaattcacttctaaacctgttttaagagacttcaccaacactaactttttttttaagagacttcacaaacactaactttttttttcagttaaagatcatcagttggtaaaacaattttgagatataagagcaaaaatagagaactgattctgtcagatactaaggtatattataaaacatagtaattaagatatcattgtacttctgcagttactatcaaatggagtagcataagtgatggcctaaaaacataatctatggcaaggtgaactgttagtaaatggtgtttgaaaattttctcattacatggaggaaaaaaaaaactgacctcatgccatatatgaaaattaacttcaaatggataaaatactaaaatgggaaagaaaaatctacattgacaacaaaaaaaatagtataagatactatgtttggaactctgagacagaaaagctttcttaaatatgactatgtatcataaatactaaaaaaaaaaaaaaaaaaaaaaaaaaggaatggctgggtgcagtggctcacgcctgtaatcccagcactttgtgaggccaaggcaggcagatcacaaggtcaggagatcgagaccatcctggctaatacggtgaaacctgtctctactaaaaatacaaaaaaaaaaaaaaatccgggtgtggtggtgtgtgcctgtagtcccagctattcgggaggctgaggcaggagaatcgcttgaactagggaggcagaggttgcagtgagctgagatcatgccatcttgttccagtctgggcagcacagtgagactctgcctcaaaaaaaaaaaaaaaaaaaagaaaagaaaaaagaaaggaatgcatttactgcatcaaaatgatagatttttaaccaaagtgcatcacagacaaaaataaatgtatggataaaagcatcagagaatatacttggaatgtctaaattatagggaattaatgactcttccacattctctggaaaataggggagatcaaattgaaaaatatgataagtataacaatcataataacaacaacagatgcagagctcttactatttatcagtaatatctctaagtgtttaacatctatttacttatttaatattattaatacaaaaattcacagagggggaaaccaaaatgacaagtaagtattttgaagatatattctaacatactaggaaataaataaatggacagtaaaacacttgatttcactttataaacagtagtttggcaaaaaatgtaaaggaagaaaatattaagttataaatagagaggcagttgggactcatgtacttcaagtgggtgtataaattagtgcaatcatcctagaaataatctggcaatactttatgacagtatgcatgtatgtatatcacccaacaattccattcctacaggctcttatgcactaaaatatgaagacagcagttaaatgacaccatgtacttgatcagaaacaggctctcaaccaaattacttggctcatttaatgtatttttctatatattggcttctaatcttggctaagttatttaatctcttgctgtctacattttaaaaaggtaagtggggataataatgattttaataagaataagaataatgctattttcttgttagagttgttatggattttaactacgacaacttcttagatcagatcctagcacatagtaaagtgttcaattttttaaaggaagtgtttgccatttttttaaagaaacaatacacattttatcatccatgaatggagaggagatatactaaatatattagaatgggtacctcagaaaaacagaggactatgattgggaacaaggcaggagaaaagaagacaataataataagagttgtattgcatggatggatgatgactgtttcatgaactaggattatgatcaatttatatttataatcctttgcgcaaaggaagtgcttaaggaatgtatatctctgaaggactacagtgttgagtaactgcagagactgttaatgttttttaaatgtgttcatgtaactattgtttaagatcaaataactagatcagcatgaggaattatttaaaagagacagagagaatatgagaagaagaaatgctgttgcaggtgtttgatttatttaatttctttcttttttttcaccttttctcaaggacttggatctagacagcatctaaggctggaatttaaaaagtaaaggaaaagaggagagatgaaaaatgaaaaagtaagtgaaggggacaaagagaggacacaagaaacaattgtaaagttacttttttcagataaaataaaacgtcaaagaaaaagctccaagaaaatcaaagcctttttagtgatgaataaactagtaggcaaacaatgaaatgccaatgcatattaaaaagtaaagacagaaccacaaaggagagataactattataattgtgttctgattgaatgctcataaggaaatagaatcattttcccctcacatacaataatgttgagaatcttcaagcattttaaattcatacattaaaattttaacacatctggtcacatgcacgtatacatctcttagatctaaaggtatttttccactatttaaggaaagaatcataaggtaggataggaataattccaaaacctttcaataatgagatgatgcactggtttcaataaaaaagaaattttaggccgggtgcagtgggtcttgcctgttaacccagtattttgggaggccgaggtgggcagattacttgatgtcaggggttcgagaccagcctggccaacatggcgaaaccacatctctaccaaaaatagaaaaattagccagacgtggtggcatgcgcctgtaatcccagctgctcgggaggctgaggcatgagaatcacttgaacccgggaggcagaggttgcaatgagccaagatggcaccacggcactccagcctggaaaacagagcgaggctccattaaaaaatataaataaataaataaataataaattttagaattcaataacctagacactaaaactctgagacaagaattagggtacatggatctgtgaatccccagccctagcacaatgcatagaatatagtatgtgtttggtaaacgtttgttatactttgatagcaattcgttatttaaataaaggttttggtgaatagtggaattatgcccacctctttccctggtaagaaccatcatactcttagttccttcccccagtttctttgctgctttcacctctcttcttctggtttataaaataattaatatgtgggggcagaataagcaatatctcttgagtcagtcaaagtgataaatgcgaggtttcctgaggatcaaataagagaaggcatgtaaaacccttggtgtcctgtttgacatagagaaaactctgtaattggcagtgagtttttttattcctttttacacatcacacctgaagggcaggaagacttaaagcacatgtaataaaggtctataaccacagcagtgtttgtgaaagtgaaaatcattgccacattcataaccttttgtgtaaaaaatcagacactctatttcccaagtcaaggagattaatgcagtataaacaaacaacatcatgaaagtgtaaaaatatatatttaaaaaaaatctaccagctcttttgtaacactattatcagaacagcattaaagatgatctcactgttaatctttacagaatttgaaactcttttctatatgaggtcccagctgtttgtgaactctgatttactaagatttactacatttaatgagagtacaaaagcgggttttcaactaccaggatatatttgaggccaagagaagaaaataaaagccactgagcatgtgaagcaataatttcgatgatactttccaatttcgaatgatgcataaacttccattacaatgagaaatttgctgtttgctttgagaagtcttgtcactactcttgaagaaaagggagaaagaaaattagcatttatatctttcctcctttgtggtaaactgtattctaggcacttcacatatattaattaactcagttaatcctcacataatccttagggaatggctgttatctgcgttttacaaacaccccagggagaattggtaacttgtctaatgttatacggctaatatgtgcaagacaacggttagaacacaggctaatttgactctaagacctgtgctttttaaatgtcagttatcttctgtttatatctgtattgcagattataattaatgtgttaacatacattcactgtagaaccagcggttttttttttccctgttgttgttacttgtggaatctacatatgagggttgtgacctaacttgtttcctgggaagcatcataacattctatcataatatgatgcaggagtagataataaaacctgccatgtctatttcttgtggagagggcaagtgtttaataaaaagccttcagcataaataatgagaggttccagagtgatttctagcagagccttttgtttgtcaacatttgaacattattctccaaaataatggctcaggtttgagaggtagtattgacaatttcacttgtataccagaacatgcacagtggtagaagataattatgctagaaataaacaatattttttttttttattgagggcagtatgaaagtagaggactcatcctcaacaaacttttgatacaatccagactattggatcaacgtttttgattggaacttggaaaagttaaatataattaaactcaacctgagagtcaattattctcccacagttgacctatatgcaacgtagcatcaatattatctgcataatttgtaaatttaaatttatatgatcaatcttttgcttttaatttattgttgtatagattaaatattttgcaatcttgtttacttgggaccaattttctcatttgatttcagttcttaaatgactaaaatataaagtaagaaaaaagcattttatcacattaatgcaacacttgcaatttgatttaacaatatgatagatgaaagcatgaggctattataacacaatgcatttatcatctttacgaatcctcccctaaacagaattaacactgaaccatttccagtgaggtttctaaaatgactagccttgccaagataggtttttggctcataaataacatagtagaaaaaaataaaatcactgaatgctataaaaatgcagtatcgggaattactaaagtgtgaaacattaagtacactactcaaaatggcattctcaaatgtataaattatttatctgtatgacagagcctagactactgtcacaagatacagaaaactgagttttcagattattttaacatctggggaagactactgaaaaacaaaaaaaactctaagatactagcatccatattaaataactccacaattaggaaacctattgacttcatgttgttgatatatttagaaacccccatgattaatgttcttgagagcagtaacagtcctattactcactcatcataccaggagagaaaaggaattttgctttaatatttacagagcataacaggagagaaaaggtattttgctttttaagaaatcaacataagaaaaattctaacatgttttattcaatttatacaactttcttcttgctaataatccataaatgctcttttaaaaacttcttaatttgattgcctgattttttatatctttcatggttaaaatgctgtgttttttttaacctttctgtctcttacagcatgcaacacagcatcgtgtgtgaaataggatgaatagatgaatcagctctctcaccctttttaaaactagaatatagcacagcatttgacttacatgcagtttaccaaaaactgagaggtagccaatatcatctacattgcctagatatatttaggatcctgacttttattatattaggagcttccaaattatcatcatttaggcatttgcacaaagacctctcaacaaaaatttactttacagtttgctggagtttagtgattctttctttggaatcccaactggtcccatctatttactgagagctttgaacttggcctttcgaattccttccagttctaacttgcagtgagtatctgtaaggttactaacaccatatttctaaaataaagacagtaggtacatcgctctccaatactgaaacttttctcccttcagccgtgaaggaaaatctgccctggggggcggaaccaggtgcaacggaggttttctgctttagaaagatgctcctctgctttcatgggttattctgccacatctgtagaaataactatttgtagctgaccccaggacttcatcacctctcactagaattgtggcaaaggtcccccacctggtctaacctagctctcctattcatactttacaatctggctagaattatctttcctaaatgtagtttggagtttggtcactttattccacttgtcaaaaattggcagttttcagttttctctttgtttatggaatccatattaaattatttagtttgacattgagaagtctctacaattgaggtccaatgcatctttctggcaacactttaatacaccatttcttctcatgttttaatatctctgctaacattatttaacattatttcgaaaacccatggtatttcatgctaaagtcatttcatttatgcggtttgtcccaatgagtaatgctattcacccttttcctgccaattctacttattttcattcattttatggatatgcattcagtaagtcaaatatcctagatgacactgtaattgattaattggaaattagtattaaagtataactcatgaaagcatggtaatggcatgccttaatactctgtttaatcttaaataatatataaattattaggagtgagaaattacttgtaaagtaatctgaatgaaaattccttcatcagtttttgaattccacttgaatcctttatagttgtctttcctagacttaatttataacatcttagaaacttgttaactttttttgactttccaaatcattcaacttagtcttcttggaaataactagctttttcaatatttttttttcattttgtataacacttagataaatagtatcttttttttttttacaaataaaactgtcattctcaactctaggaatggcaagatattttggaaagcatgtatctcaataggcactagtagaagtcatgggtgtgcatgagcattcacatgtcattggcactgcatggtaggttttatttagagaatgaagacataagattcaccagaagcaaataggttgattaatttgtatactacaatgtaccaggtactgtgactacaaaagacactatgagtacaacaattgtatcagttatttatgaggcaaaactaacaaccccacaacttggagcttaacacaataattgtatgattctgggggttgggaatttaactggctttgcctggggtcactcagtctgctgtaaccatttgaaggctcaactgtggctaggtagtcttacatgtagggtattccagtttccattactttttttttttctgtcctgactgagaaatagaaagtgtcttcgccaactctcttacctgtccaggcagcacatctgatgtccattgtgaggatgtgctgcagcctccctctgtatgtaagttctatgaataaatgctttggactggtcgccctggagtttagtgcttctttctttggaatcctaactggtcccatctaggaaaggtctggggaatttcactgtgggaattgccctgctgccacttttagggtgactccagctgctggctgcaggaggaaacatgttctcataaacatatgtggagttggtgctggctgagttccatacgcatgggtctttcatcctcaaggaagctagcccagaattccttacacggggctatcagagtagaaagagttgggattaaatgtgataacaccactaaaggcccaaccttatcatctctgctgcattttataagttaaattaagtcacaaatccagctcagattcaatgggatggagaatatattccacccttggaagagagctattataatatcacttttaaaaggaagtgtgcatgcgaggaatttgtagcatgttttgcaatgttccacaacatgcagcaggacaaacaggaatcctgccctcacagaaagcagtaatgaagaaaggcaagcaaagaaacaacggctgtaaaaaaaaatattttaaaagggcaattacaaggcactataagaaaatacagaagtatatcactaaattttctgagaaatcaaaacattctttctagaaaaatcatatataaaccaagactcaaagaaggagtaggagttagtttggcaaggaatgagggaatgggagagagagttttctgaattaaaggtacagcagggtatgcataaaggcctggaaacaaaacagagcacggaagagaaagcaagaggatgttcactgcaaggaggatcagaaaatggaggtaagagataaaaagaggacaccagaatccaaagaccaacgacattctgttaaagagttgagctctgagaattaggagaagctgccaacagattagaaaagtcaaagtggggccaggcgcggtgggtcacgcccgtaatcccagcattttgggaggctgaggggggtggatcacctgaggtcaggagttcgagatcagcctgaccaatatggtgaaacctcgtctctactaaaaatacaaaaattagcagggtgtggtgcagtggtcctgaatcccagctacttgggtggctgagacaggacaattgcttgaaccaggaggtggaggttgcagtgaattgagatccaagatcatgcaatcatgacactgcactccagcactgcagcctgggcgtcagagactctatctccagaaaaaaaaaaaaaaaaaaaaaaaaaaaaaaaaaacaaaaagtcaaagtgggccaggcgctgtggcttatgcctgtaatcccagtactttgtgaggccgaggcaggtggatcacctgaggtcaggagttcaagactagcctggccaacatggcgaaaccccatctctactaaaaatacaaaaactacccatgtgtgatggtgggcgcctgtaattccaactgctcgggaggctgaggcaggataattgcttgaacctggaaggcagaaagtacagtaagccaagatcatgccattgcactccagcctgggcaacaagagcaaaactctgtctcaaaaaaaaaaaaaaaaaaaaaaaaagtcaaagtggtgttcagatcagcattttagaaaaacaactcaagatgcagttgtacaacgtgaggtttatgagtctagcaacaaaataagtaggctgctgaagtaatacacagggtatggggtttacctgtggccagcagcctctctaagtaaatgtgaatctaactaaggcaccagttaactattgttactgggaataagaaaaagcaataaaatagtatgatatccctttatttagtcaatgtaagacaagttgccagaggagattggaccacttcactaataattggcctctcaactttttggatgccagtaattacaaaataaataaataaataaataaaaatcaggactcaagactgttaataacatcaggctgaaaatttatgtgacactttttcataagatatgctcatttgaataagaaagaaatgatgttttactcatttggagaattaacacaaaaagttaggggtaaattaaaatataatttttacctctgagaaatatattaatatcagtgaatcaatttccttaaaaacaaaaaatatatattctattttatttttctttcttataaaaccaatttataaaactaatacaaatgacagacattgctttaagtattaattactgctacagctactactaataatatagaaattaaagggttcctggagaggctaatgctattttatgcatttacaaattgaaagaaggaattgtaagggtaattgagctcaggagaagggaaaaaatgcctgcaatttccagtcttctatatattcctgcaacacattccaaactttagttttctaaaaatggaaaaccatcccacacacaaactaagtttttagatatccctatactttgtttgtattgctctctttcccccaaatgtccatcaaaatatacttgatcagagggttgcttagtgaccctctcgttccacttcctctgataatctttctatgatttccccaggctctcagtgacttcctcagtgttctcatagtattttttaaatgtacaattgcagtagcagtagtaggaagcatttatgacattgttcttagctatttgcttatttttcttttcttctctatatgacttcgtcaaaactacttagatgttttcttttcattagtttctagtagaaatatcaaagtataagttcccaagactcactgaacggtgtgtctgcaaagctgatgatggtggttagcaaatcacaggtactggttgaattattagaaattgttttgttggtaatcaaatgaatacttgaagaaagatggatgaaacaactaagagtaggaccttagccaaggcctgtgatacatattttatcataactgaaccttttgtgaattccagaagaaactttgtgaaaagtatcaagagtaatgacccttaggttgaatgagctgctgccatttttgtttttaaataggcagatacctacagcactgtgaaaggaagtgaagatttttggagtgtcactgaataaacggagctcacttaattgcctgagatgttatgtaaaaactctgtagttgtttcatatggctgctgtaagaaaattgccacacacttggtagcttaatacaacagaaatttattctttcacagttctggaggccagaacccaaatgagtatcactgggtagaagtcaaagtattggcaaggtcacgatccaggaaaaaaaaaaaaaaaaaaaaaaaaagctgttacattttatcactacattccttcctttaaaaaatcttatagacacagaccaacaacttagtggtttcaataggaggacagtgatggtacttagatcaaaatgttttctgcactattcaaatgactgtgctctcaaattgggtaagatttacataggaagaccagagacattgaacctggtcttttatatccctcactagcttccaaatcctaaccttgctctcagattatgaaaacacatgcttggaaaggaatagctcaactagagagagataaccactttctatggatctcagtagacaaaaataagcttagcctgaaaccaatgttaatgaggatttcagaatcacaagagcaaaacggtacaatagggacgtgtgagtctacacttatgattctaagaaggataacagcctaaagcttcctaagcagggagacatctaccttatttcccaagagctctatgaattgagttccaaaatcatcatgaaaatccttttctagtatttaagtattttcccttttccttgtataaaatccaaatttcccttattacagtataggccaattttgtttcttcttcagcaggtatgttcagccaaaaatagctttgtcaatttccagatttttcaatttcccattccctcctttatcaacccccttccccgttaaatgatctctggtctttagagactctattattgtcattttatctttttttttcctttttaaacttttatgtagtttatgtaaggttttacataagttacatttccaggttcttttcctgaaaatttttactttatttatgactttttaaacttgacctggggaaaaaaattctactcagacatcccacctagactgtgtttaaaacctaaagcctctgtgtgcggttgggctgggatgaaggagatagagtaggatctagtaaagaagtacagacttgcagattacccatgagaggtcgagagttaaataaagtactagcatgggaacagagtaattgtcaaaaggcaaacaaatgtaaaagcgggggtgggagggaaccaacacctttgagtattggcagtattttgtgaacggatacaggaatgagggttgttcccagttttaaaatgtcaagatacagtgtttctgaatgcattcaaaaagattcttttcaggatgccaataacctgttacagaatttctttgtaagattctattagcacttcttcttgtagcaaaggttctcctattttgggtaacacgtatggtatctggaaagagttttaggaaagcaattgaatatttcagatacaaaaagtaatatatctttaaactactttaaataataaataacttggcactcatatgggcactgacgaagaaaaaatgcaaaattttaaaaattaaattaaggaaacatagaatcacatgctttgttagatgctccgaaacacgttccattataactgttaaagtgatcaactattgctgtgctcaaagttagaacaaagaacaataaactgaaaattctcccgttcacctatttatgttcacctctttctccaaagtacttctaaaataaatgataacacccaaatacgtactcagtattcaaagcaacgttcagccaaaatacaattttggaggaataaaatcagtcaccaatgtaatttttcaatacttagcttatcattgatgcctcttcccatcgtgcttctcactttatcctctttattctggactgtcccttatcagaatttaccctagttactctcattttagaaaatatcaaatacattaatccacaggaagcaaattaactaccatttgctgagcatcatatagctattcatatatatatatatatatatatatatatagagagagagagagagagagagagagagagagagagagagagagagagagagagctattcacattcatattttgtaattggcagaatggctgttagagattatataattataaagtgagaattgtttattgatcaggaatctgaggttgaaagatgttaaattctttgcaagatcatacaaccgttatatgtttgaattactcctattctggttcagtctgttaacacatgaacctacctcatacccacttcagccatatcacatatgctaatagaagcactataaattatttctcctatgtaaaactaaatctaaaaatacttcccacacaattacatacattggttacaatgttcaaagaacgtgaacattaaagagaatatgaaaatatttttctatatcttaataatttttctagttccattgattacaacagctgacatttattaaaggcttacagtatttcaaacactcttctatactttttaaggatcatttcctttcacagccacaactctaatgagatgttatattagttagacttaagtttggcagtgactgacagaagaaaaaaataacaaggattttcatttaatttttttttttttttttgagacagagtcttgttcaggctggagttcagtggtatggtcccggctcactgtaacctctgcctcctgggttcaagcaattctcctgcctcagccttccaagtagctggcactacaggcacccgtgaccatacccggctatttttttttttttttttttttttgtatttttagtagagacagggtttcactatgttggccaggctggtcttgacctttcaacaagcatttgtaacaggatgaataaaaacggaagggaatattgtacaatgccaggcatgagccttaacatctctatgtctcactttcctcatttggaaaaggaaggtaatgattgagcctacatatttagagactgcagttagtttttctcaaaatcctttgccctcttctgttttgttagagaccccaattttagatggttaaatggcctttcataatcaagattgcatttcctagcctgtttgctgttacctgtccatgtgactgttttctggccaatgagatgtgagaaatatcatgtaccagtttctgggagccaaggtctttcacatcagactattctcagaccacctacccagatatttacttaaaagggaaataggccagacgccgtggctcacgcctgtgatcccaggtcaactttagtataaggtataatttatccctctgtcatccaaccatctatttcttacctgcaccaaaaataattcaaggttatttgcaaagatagatatggtaccaaataagataaaaaaataaataaagcagtaaagaagccatggggaagggtggaggagatgaagcctgaaataatttaattatcaaattaagctagattccatacaagattctagtcacaaataaaaagagacaaacttgatgtatctaccaacacggatgaattacaaaacactatgttaagtaaaagtagccagacatgaaaaaactataacttgtatgattccatttgtactactttgttgaaaaggcaaatcagtgataaaaatgaaatcagtggtttccaaggactggactggaagtggaggagggggattgactatagaaaggcaagaaagaactctacgggggatgaaaatatttcataactagattgtggtagttctttctatacacttatagaaatatgagactatatacacttatcaaaaatcattgaactttaatgcatggactttattgtacataaataatggtttaataatatgacataaagtacaatatcttgctacactgtttagctgaggatcaccatttctctctgagttttgtaaacccagtgtaaagattgacatacaatcagttacaagatctttgatgtcactaataagaggacctcactcataacattttcacttgaataataaatttgtcaatatatgtaaagtgctttgaaaacatctggcacaaattaagtgccagaagtattagttcccactaccatgactcttaaattacattcttaggtcacctgaacatccgtcgaaagacaaaatgttatgtaacacccctctgcatagactctgggtactcttttaatgccttatcatttcctataagaaaagacagcaaatgctaattcattatagtaaggtgacaaattagtattaaaattgtactatatttaaaggaattgccttcaagggaaaattcatatgaaaaaagtgagaataattcaaccctacagtctgaatataatacatcatggtaggcatagttacctcagggttaaaatatacataaaacaaacaaacatagtgcagtggactgaatgtttgcatacccccagaatttacatgtcagcatcctaacctgtaaagtgatagtgttcagaagtggggctcttaggaagtgattaggccacatgggcacctccactatgaataggactagtgtttttataaatgaaaagcattttcacttgcccttctgctaagtgaggttacagtgaagaagatggtcctctatgaacaaagaagatggccctcatcggaacctgaccatgctggcacgctgatctcagattttcaggccccagaactctgagaaataaatttctgttctttataagccccctagtttatgctgttttgttataggcaccttaatgaactaagatgcacaggagtagaaataaaactgtgtcgtgttgccaaacagtcaagagtttgaagttgaaagactgccactctgcacccccaccccaccactcccttttggctctagcctgacctttcctcttttgatgcattctgtttatgataacttacttttactttggataagacagagaatctaattataaatttagtcaatgagaaaactgggtaggaattaaactgagtttaaaatatgacagcagccatgtataccgaggatgtgaatggattccaacagaatagaaatgtgagatcattccctttaatagaattgctttcctttctcttacaagacattaaaaactttgcttggacaatgcaacaggaggcattactccctatataattttatcatatttttcctcttagcaaattcatgctttacttattacagggaactatatctctgtaagaaataagaggtacgttttgactgtctttacattgaacaaatcagccctttgaaagggtcagtggtcttatataacacagttaggcacagagagatacaagaatcaaagaatgtatttcaccagtaggtagtgttagaagcttcaggaaaagcagagtcctgaatgctgataggggaaggctgagatatgcagtttatagagaagaatttttattcagagtcctggtaggccatgggagggatgggtctgtaaggcagttatagaggagaaagagaacagagaagtaagtagagcaagaacaagcactcagatctgtaagcaaagacccaaaaatagctttcagataaggttgatggcatctcagaatgttaatgaaatataacttaatacttctatgaagtataagccatgcttcctacttgaaaatttttttaaacattgaaattattttcaacctagagataatttaatcttttaaaattgtttcttctattcatatagtttttaaaagcttctctattaaatagaagaataaatctttcttctaatacatatctaacactaaaattagtactttcatattgtatatataatgatacccattgttttccttaaaaagagaaatagttggaaggatgaacctcatgcaaattaaagctataagaagaactaacaacaagaatgaatctcacagaaatgcatcactatatagttgaggggaaagaataggtacagtatgataatttctagtgtagcaacactgacaggtcagagtatatgctgtgaaaaacaggagtagtggtcaggcatgaatgatagtgcctgaaaggaagatggagttaggcagcatcttacaaccattggccaagtatgagcagcagtaacaaatggagtacagtaatagaagctgaaagttgtaatgattgcctgaagaggcgggtcaaaaaaagattcacaggacatttgatgcctgaaggcattagcattatgggcataattggaaaaaatgagaagcaggatccattacaggactgttagaggcaaggacaaaggtaacattgaaaggataaaatgaaatttcatttttactgatggtggttaatcaaaaccttggaagcagataaacaactgaaaaggtttacttaatatcatacctattctgcagcagattaataagcctttttagttctccaagatagaaaaatgaatccattattcccagtgataatttattttatcatatgtttctttacaaaattggcttaaatattaccgttgtaaatgtatgagatgagatttatatttaattgctcattgtatacaagttgacaataaaaagacacatgttaaagaggcttaggggtcacttttttcagaattgtccttttaaactttgaatggttcaaattttgctaagtgatgttcacagagttatgagaagacaatcccttatgttggcataagatacctacacagaattttctttttcctaattctttccaaattctttttttttttcttcaggctttcaaatcctctttcatggtatagaagagagatcacattctggcacttcttaggagtggatgcagtactcacaatatgctctattcgaactgattcttatttattttataatgtatatttcctcgtatatttgttaaaaaacaatatatggtctaaggcattctatttcttaccgtaattacttagtgtatagttagttctttctaatatatgacaattctcactgagaaatcagattttgactattcgtactcctacaaatgacctacgtataatgataggagaaacttgtccacaatcagtattaacagatcaatgtttatgggaagtttgacagtactcacatgatacctgcccacctctgttctttattctgtcgtgaaaactttaggcatcaggcactcttgctttatcttctaatcaaaacagagaccaggaattagaaacagtgagaaccccctgtgtttcaagaaatgggtgagggctctgtacaggtcatcttatatatttctcttaatcacctaggaagttaaatattatattattctcatttctcagatgtggataatataatatttattacttaagaatagataccacatagcttcccttaagacacaaaaccaggaaggagcaaatctgaatttccaacccacccaagtctgattccaaagcccggatccaccagatcattttgcacattggttcatgtttttgatctcctatctttccaacaaaactataaacattgatatcattaaagtaaaaagatggaggcaataccaacataactaccacttaacacaagtacatgggcactcgcgcgcacacacgcacacacacacacacacacacacatccttcatactgaggaaataacaaatatatttcaaagattattttaagttagaattaaaatacaattatttatcctagcatactaaggttttttactgtttttcttctatacagatgtgtaaaaattttatatcatgtaatattagtgatcaacacattttgtgacgtgcaatatgtacttctgaacccttgaaagactcatgctttcttttacctccctcttgtttcagtaattcacctctttgacataatgctaattaacaaagagaccaagaaaaattgtctttctaagtatctatccatctattttttaaatctgtttcccatagactgataagctgactggtataacatatagatcagtggttttcaactgggaaatttttttccacccagggcaaatttggtaatatgtgcagactttttttattgtcacaactatggaggagagaaggaagatgctattgacagttaatagaggccaggaatgctgctaaacattaaacaaggcataagacagtccccaagaagaaagaattatctaggccaaaatattaatagtgcagttgaaaaacgaaatgctagatgtttacatcatttaagaaagagaagaccatatgactgactacctttcatggctatccagttacattacaacaaaggaaacacattaacagagtttctcaaggaggcaaataaacagaatcacaaagacatattctcaaggggagttattgcagaaaggacttagaagtaaacagttacaatcatgcagaggaaggggatgaaaaacatttgcagaatgttatagctaagatgctacttatttgttcaatttattggtagaattttacctgaggaaaaatataaacataaattgatgtcaattgaaagcatctagcatatttgcaaaggatggttgtaaaatactaagaagaaccaggaaactaagtaaacttcctttttaatttttggtaaataaaaacaagtttgcatttattaatcatgagtcattggcacctagaaataaaagacacagcttatatactcacacagctaactggatagagagggagaaatcacaattattctaaagcataatgaataattatatccaatgatcatagccttggagttacaaaatgtttggagttataaaaatggtacggaaaatggcacatctgactcttgcttggaaaagacagtgcaatggtgaaagaaaacaatacatactccaatgcttctgtgaaggaaaccatttcaacatggaacattttgaatgaacatagtataaaaagccataaaggtgtgaaacattgatttagaaaatctgataagataaagtcacttaaaagaaatatgtacaaatgtgttagttatggcattagttataatgataaaaaggtggttttcaaaatttgaaaaaaatctatccaaatgtaaattggcatacttaaagtccttcaacattggcaaatgtttaaagcatagatcttgctagatgaataaaacaagttacaaatgattttataatataatgtcattttaggataaagtgtaatgtgctatgtatgcataggagtatatttaattgtcatctttttaaaggctgaataatattccattaaataagtgtgcatatatatgtgtgtgtgtgcatgtgtgtgtgtatatgaattttctttatctgttttatttcttgatagacaattattttgcttccatatcttaggtattgtgaataatgcaaggtgctggatatgttaattagcttgattgaatcattcaacaaagcaaacatatatgtaagcatcacattgtatcccatgaatgtatgcgattatgatttgtcaaccataaataacattttaagaacaaatacattgaaaatacatcaaaatctgatttttgaaataagaaatcttaacagttgttaaatttgagaggtacaattttcagtaaacttttttttttccagtgtgtttttctacgttctccaagttttctacacagatcaggccacgtctgaattattgttttcaattatttggcaacatgttttccaatatattttgaacagttgatcattcagatgaaagaaataagaacagtgagaaaactgtatgtgttttcaaatagaggctgtttaggctgagaaagagaagctcaatgaagtaaatggtagctgccctcaaatttctacagtgcttttatattcaaaggaatttagtaaaatatatgctgctcttgagaacaaaaccttagcctccaaaagagagcttacataaagagagtttgggcttattacaaaaataacattctaataatacagtcatagcatcctcagatttcttggaaagcaggagcccccccacaaccaggagtttcaaacagaggctactgaccttctgcctgtcatgttattgaacagattccagcttttggtgggaattgcatcgagataaccttagtctaaggtgcttttcccacttccaaatgctgttgtaagtacagggctggcattagaaaggatactaaataaaatgaaaaaaaaaaactttgcatctttttatttagctgtcatgattgtttgcatttcttttttcaacatgtgcatttcttcaaattatcctatgtttcatgatttaaatagtcatttaggaagttaaaagggctgacttgaggggtgcttcaaatgccatagcacctggatgcctacttataaaaattatatggatatatatatatatatatatatatatatgcaccagtgaatagttaatatgtgttaattatatgtcaatgtatgatgcagtttgatctttcacaagtggcctaacctaaaacttaaaagagatagaaggagcttgatctccatcctcctcgctgctctctgccaatgtgaggatacaaggaaaagatggccaaagtattaggtgctaaccaggaagcaggcccttaccagacactgaatctgtgggtaccttgatcttggaccacctaacctccagaactatgagaaataatttctgtcatttaagccacccagacaacggtattctgttatagaaatttaaactaaggtatatagcatagatacagacagagataaagattatagttagatatacgtgtacttctcttgatgtatcagagtggagggacactgtggatttcaatccaagtgagttcctgagaaatcagttcctgtttactgtcttctccctctctctcttttttttttttttttttaatgtgaattgtgagtttctggaaggaagtattcatgtgttattggtttttacctgacggcttggtggctagcacacaggaagcactcaataaatcattggtgtataaattgaaagttgcttaaaattaactagttttcctggagttcagaagaaaataaacctagccctagttaacaccagctgttagaggtattttatactacagtttgtcagctttggctaccccccaggacatttggtaggtttggcaaagtatcattgatgaaaaggccacacccacattttgaagcagaaacttgaatgttgagggtaaggcatctatattttaaaagatttatcagtaattctggtaattttgtggttttacaatgacttctgttcatagccatctgctcacagacaaggggctagataagctctatggatccaggattccatcatttattccactattccaagaaataaagatccttaattgggacaattctgcttctccctactaagaattatctttagtgcatgcacatacctaaaatggaaaaaaattgcttttgtgtatgcctgtgacagatacacaaccattctgtattacaaacttctcagtcgagtctggtaataacatataattaaaataaatgagttcatcttaagttattagatcacaccatgattttcctaacctataaattataaagattagagaaaacaaatttgcaagggcaaagttgaagctaaatcctatcatcatttctatccctgcctcaattttgttaggatttgatggcagaatctgtgaatcagatgcatgttttccctcccccactccccaatagtgaaaaaagaaaatagcttctaatttttgttttccaatctaccagcttgtgccattgctgctaaatctctggctttctaggtgctctcctggtaacctctccatgctttaattttgaaggcattgacctctatgagatttgaatgttcttccttgcctttcccaattactccatttttcagtgtgtacagcaagctgtcagatttcctcctccacgtgaaaatctctttgggtttgcttgcttctatgtgttctgaaaaaaaacaactcagttttggtcaactctgtctcagagtatctgttccacaccatgacagtttataatactagagaatagctttactgattttgaaaaatcctctaaatacataaaaggccagatgtttccacactaagttttatcactcccatctgatggggaaggacctcattcatggctgtttccagtgaatggaatttccgtcatctagttggctagcattaaatatttgttgaacaagcagataaattgagatgatagtttgggtacaataaatacaaagaacatatcatttgttctgatttataaatttagactcaattttttcaagcttagtaatgtgtataactatgacaaaggcagtattgatgttgatataaaaaatatgactggtcaaaactctcttactagaggaagatttgattggaaaaagtgtctgcaatctgagaataaagcgtatattcagcaaaattaatatctaatacatgtaattttatcagaaaatacattttaaaattagaagcaatctctagttgtcaaatctgtaaacaatttttagaacccaaagtaacaaatacatccaggtacacaacaagtctaggacttgtctctaaaattattacttactaaggctatagtctgtgaagtgccaaatcaaatataattcctttattctatgattttttataaggaacatttgagtacaaattaatactttgaatgctataattctatttttaacaagctctgcaaaactttgcattattttgagaagctttgtacttgttttaaagtggctgccagccatatgccttatctatgtatatgtgtatttatttataaattctcaggagaattaactacaagttttatcaagtttataatatgttagtattgaatttttctcatctttcttgtaggatttatctttaaagttttatttcagaattttttttcaactgcaaaaaatacaacaaaaactttaaatttatgtaacataaatgaacagaaaatttgaaaaggtgagatatattaatttaataaagttgtgaaagattcctttttgtggccacaattcttcttcttctttattttattttattttattttattttattttattttattttactctattttcctgagacagagtcttactctgttgcccaggctggagtgcagtggcctgatcttggctcactgcaacctccacctcccagattcaagtgattctcctgccacagcctctgaagtagctgagattacaggtgtaagccaccacaccagcctaattttttatgtgtttagtaaagacagtgtttccctatgttgttcaggctggtcttgaactccagacctcaaatgatccgcctgccttggccccaaagtgctgggattacaggcatgagccaccatgcccggcctgcttcatcagcctaaataatagcaatacagtcattggtaattgatttgaaataatatatatctagaattttaaagtaattcaactattttataataattttaaatgaaatgtgatactataactttaaaaatagggttaactgcattattcactttgggttcaatttttcatttattgcaaagatgttgattgaatggcatgtgccttttctatcttaagcactgggaaagcaaagacgaatcagatacagccctgctcacaatgagcttttaatctagtagaggagtctgatatgtaaatcaacaattccaataatagctttatgtaaaaaaaaaaaaaagtattagaaactcagaggtatcagggagggcatcacagagcgcgtgaagctttaattgtatctcaaaaaaaaaaaaaattaggagtttgcaagtagataagaccagaacagcattcttgtaaggagaaatagcacgcatgaaatcaaaaggaatgaaataccacagcatgtctgggaaactcaaagaggcttagtttttatgaaagccaagtagtagtaaagggtgctgtggatgtatgtaaatgctaaaccataaagggttagtgccatatctcataccaaagaatctctgctttcttttccgagggcactaggtagtcatctggagtaatcaagcaaagccaactccctcccaatagacatacatttgataaaaccccactactgacattatatatcaggctattgaaacagtcctcatgagagtcaacccaattagaataggaagaaaagaattaagactatctgtttttgatggtaataactttgaaaaactactggatgtatcagataaggaaagtgaaatacaggaacagttctaaatattcttattggaagccatggagaattatatctcaactaaggtggagacaaggaaaaagttttgtaaagcaaagataataacctcggttttaaatatagtttgaattatatttgtgatatctagatggtgttatccattcacagtttggtatatataggtcctgatcatagcagaaagttaaagaatggacacacagacttataaatcattagtagctacatagattttgaaaaagtaacaggaatagaaaaattggtgagactgagtgtaactcagactagaaaccaagaaaacacataccaataaatactggagcatatcatcacaatgtaaaaattatcagatttgcatattgttcagttatgaacaacattataaaaattcattttgtaaaactgaggtcaaatgtatacagagggaaataatgcaccaaacttaagtatatgagctgatgagttttattgtattcatcatctatctatatctctatatgtgtataattatcacttcaaacaagatatagaatatacccagcatcccaaacagttcttttatgctccttcctggacaaagaccacttcttttcctcactccataagaaattacacatctaatttttcccactttagatttgttttcttttcttgaacttttacagttatagataatgcatttttttgtctgatctctttaattcagcataacatttttgagctttatggttttgtatatatcaacagttaattctttctctgcatttatgttcatgagagacattggtctgtaatttcattttcttctaatgttatttatcaggtattaattggtattagggttatgctggcatcataaaaataactagaaagggttcactctttccccactattttctaaaaatattttgtgtagaactggtattaattctttctaaaatatataatgcactaataaaaatattattatgtaactaaatagtaattgtattctaatgaaaatattagccccattaaaacactacttgactcagaatgtatgtttgtagttttttaaatattctattacaaattaatattttgataaagagcaagaaacttgtcatttatatcttgttctctttcatagtgttacaaaaattatatatatatttaataattctcaaccccttgaataattgtgtaaaagtgagtataaatgtcaaaaaaaatcctggaagtaggaaacactattaaaaagtgttatatcttctcgtatggaagcaaaacaacaacaacaacagaaaaaaaataaaaactaatttttaaaaaggaaaaaagtaatttacctatgttgctacatttagcagtgcatcaattcccacacattcagagttgtttccttggagaagctttgtattattaacattttccccactagacctgcacatacacaacataaatagagcatcagaagttgtcgatcataaacctaaatatagctctaggctgtcaagtttctggttcccaggagtaacaacaacaaaacctatgtaatgaggactttgctgttaaagtcttctctgggaaacacttgtgttacctcgtaatttatcataaactctatttgatattctgcatctggtagtgaggtataagactgaaaccgcggcggggcgcggtggctcaggcccgtaatcccagcactttgggtggccgaggagggcggatcacgaggtcaggagatcgacgccatcctggctaacacggtgaaaccccgtctctactaaaaatacaaaaaattagccgggcgtggtggcgggcgcctgtagtcccagctactcgggaggctgaggcaggagaagggcgtgaacccgggaggcggagcttgcagtgaacggagatcgcgccactgcactccagcctgggcgacagagcgagactgcgtctcaaaaaataaaaagactaaaaccgcttgaacaggaacagaaactctgaacacataaaatgcaactaaattcactgcagttttatccagaagttatttcatcttttaatttctacaactctaaatccttgggagtctgctcccccattttgttttaacaaacatgccctgaatttttgtcaatataagctgtttgggaaggaatagaaaagagaaaatatccatttattgctagaaataagtagaaaaacaggaatataaaattaagccactatcttgagtaaatataaaaatgaaacagatgcttattaattaagtgtgggcaggtagatgacaaggcaccgaggcatattgcaccagctgtgaagaatttagacagcttttatcctaccggaccatttattcattacgtaacagacaccttaaggagtagaaaaggtgacaaaacaaaatgatataaagagctaagagttcagttttctaaactttgaacactacttggtttggttttatctgcttttctaaggaataatctggcttccatgtttaagttttatgaatgctgcagttcgtgattttttttccactggaaactgtgtgactacaatattatttatgaaattgtattgcatacaatatgccaagaagatagacagcactgctttaagtatagaatcaacttttccaaggagtccataatagcaaggatttggaaagaagtaaaatatctaggcagagaaaaacccatgaaaacacaaatccactaatccatggtttatagcaaatctatataacagtaaatttttgaaaatgaaaaataaaatttaaatggcttcttataagacactctgatgaccaatcaatctcattttttaaattatacttctgctcagattagtggcaatcgaatttcttcatttagaacatttgataatgggccattagggaagggaagtccaatcaattcaaacttgtttccctcctcccagccccccactgccccttgctcccatgttctcgcatagaactggattccagtaacattgacagttgatccttagtccctaaggttttttttaagttgttataacttttctacctgactttattttttatactatatgattttctttggattttattgtgcattggtacacagggcctttgatctcgtatttttcaatattctacttatctcaaaaggaaaaataaaaaacagacaaaagtcctttaaagacaatgaacaaaaatacataatgcagagatggaattagaactaaatgagaaaaaacattttctacatcaaaaaagggaaattttaaaaaatgatctacaagtttattccttccatatatgagaacattaaaggccagaaataatgtaaatctggtgcttttgttttgattaggacaaataagtacaatatttctagaaaacaatgtaacaatcagtaccaagaatcaatgtaacattcagatcttcagtttattatattctcttcctgtaaatttatactaaagaaataattttaaaaggtgaaaaagtttatttctgaaaacatgtagtaaaaaataaggaaaactattcatttctacaaattaaaaaaatttcaactgaattaccaattcatgtgacctttatgccagctattaaaatacaattgtgaaaaatataaagtaccatgtgcaacttacattattgagattcaccaattacatttaagagagtaatacccatttgtgaattccatctctatatattgcttcttaaagccatacagaggagagaaaaaaatgtcagagagctcagacaaaagtgagaagatggagagataatagtatgaaaacacaattgaggcattttcataggtatccagaaaatatggaaacaattaccaattatccatggatcaataactaaggtagcatcttgtagacactgcattgaccacttagaagacaacaccaatattttgtagctcttggggtatgggaaagaatgccaaggagggggggcttcttgcacatttgtcatcaatttccactagttataagtcctcaataaagtgactcatgtcatgatatgaggatatttagaaactctcaatgttaacatgtaatctgtatatatacatatatatacacacatatgtttatatatgtatatgtttatatatatttccatatacataatacaagaagttgtttgattttatatatataaaatgcttatatatatttaaaatgtttatatataatgtttatatatataaaatcaaaaaacttcatatatatatatatatatatatatatgtatgtatgtatgtatgtataatcaaaccacttcttactctgcttgaacagctgtgatgtttctttccaggtttgcaagttcagagctgatgctaaacaaagtaagtcattccataaaattcacctatacacaatggcaaacagataaatgagaaaaagggtacacatttttgtgtaaataaataaatgacaaaataaacttgaaaaacacagtatatgatttttaaattactgtatgaaacaattaccttaatatttaatatatcttgggaaaaagggggagattggtaaaaataaaaaatgaaaacagctgatgctttggggtaagcaattaatttctttatttcctttagttttattgtaatgccatctgtggacgaaatagaagttcatagcaacagaaataaaagccattgatttaagtgcctgaagagcactttgaaaggaaaaaactagaattctaaaacaaggaaaaataatgcatcttcaagggcaaatgcgtctgaagacaaatctatgaaaaatttcaggtatgacttgggctaaactagtgtttcaaagataattgtctaaattctgaatatttagatggtcaccttgcactaatctgggagctgtagttcttgagtagaggaccatggatgaagctgtgaggcataacatgatcacatcagcatgtgtcactcaataaatgtactgaatggtaaatgcccaccagatcttctgctgctccatctctgccaacagaggtgctccggaacacagcagaggaactcgttaaagatacaatgagccctaaatagaaattacataatgtcttttgccccaacatggatggaattgtggctactaccttaagggaaacaactcaggaactgaaggtcaaaaaccatatattcttacttagaagtgagagctaaacagtgtgcaaacatggacatagagcacagaataataggcattgggaaatcggaagagtaagaagaagagaggggggtgagggatgagaaattacttaacaggtacaatgtacattattcaggtgatggttgcactaaaagcccagactttaccactatgcaatatgctcatgtaacaaaactgcacttgtactccttaaatgtatacaacattttttaaaacaagatacagcaggtcaattttgtccatacgattgaatgttggataaaatttgagtagatgttgtttaggaagactaaatatgacttggagaacagtaaccagtggaatgacctttccaattctatctagcagacattgttcaatttacactataccattctctcagtgacaacttcagaggttttctcacagccctgacactcacttaatatgaccataagccgtaaatcaagtagccttcttagatgaatataaacataatgtttgtgcaagcaaaagaaagagtaggatggaagaaggagaccataaaaaatggaactcatagaaattgatatcaaggcatcttaatttatcatttggtagcagctaagcataaacgtgtagctaaaagtcttatataataagtaaattatgaagaaaagaatgctgttagaccaaaagagcagaatatgtatgttccatatgattaagtcagtttgaagacaatattaaagatgaaatttcaattgattgcattattcattttcatagtgagtcctttattccaacaggagtgttttacactgatcataataagaatgacatcctatagtttaaaagctccaaatatttactcaaaagcatagttagatatattatcattcagtatctgtgtaaaaataagtatttgtcatccctaatcattctctggatgtgtgatttaatcttttccccataaaccaggtcaccattgagagcctctgttcaaaaaattttacaatcttgttactgtattgtcaagaggaagacagtgatttcacagctgaacttgctggagtcctacaaggtttcacccacagaatcaaggagcctacttttgtaacctactctttctttcccacaaggcttgagtgattgcacgtctgagactattaaggaattccggcagatgtgcatgacagtgctatttatctcagacagttctttcagaaatgcaatgaagttattactagaattttgcacaacgtaaccttaatctaccattttctaatagttacccttgtatcattgtttggcttttaaaaagctattaaatgtataacaaaaaatataggttaaagctacacaagttttcaagtgttgataaacctttggcaccatagagatgtaagtttattgtatcatgaaaaatgtacttttatttttaacaaaacagttttcttttcacttctacttcatttttttaacaatacagatttgtttttacttatatttctgtattgtattcactagatggcagagtaagcaagtcaaaacattataaaatagagttataacaatctactcctgaaatcctgagagaataaggattgttgtggcccaggataatcagggaatgtttcagagaggaagcaaactttgtgtacaagtggcatgtgtcctttccagaccaaggcttataagaagcatctctgcctccttcatgttctgtctttcactatctgtcaggtggatgcagaggacttcaggtcctaagagatggaataaccaagaatggggaagtttggatcacacatctgaggaaatccacctgctaagagagcaagatatagtatttcattacgttaaaccactaaagtgttggaggttattcactaaaccagtttgcatatttctaacaaaaatgcttaatgctgattttctttatttcatttgaaaagaatatatgtttatttccccttattttagatgttacattatttattgaagtaagatctgccttggaataatgagtcctggacaaaacaaataacacttttgttgttaccaaaatacaagggtgtaacttctctttccatatacataagacttcctatattatcacccttagttttcttattcatttataatttatgaaatacttactgagattatacaagcttcagaacctgttttcattcctgtcttgatggttaagatttacagcatattgctgggaagaaaaaattctggctgctggatccctccttccctatttcaatccctttaaccccacaattatctatcaacagctgtaaaggcatatcttcatcaaatccttcaataagcccctcatatatgtaaaagaaggacattttacacgtgaattcttatgtttaaatttgaaggaattttactagtatgctttgctttaatttttacatcacatgcaatcattctatttaaatgtggaaattatactgttaaaggctagaaaaatatggaaattcccatctacaagtatcagtgacaaccactaccttcttcatttgcaattaattctttttgtttgtttgtttgtttgtttttgagacagactttcactcttgtcgcccaggctggagtataatgatgttgtgttggctcactgcaacctctacctcctgggttcaagtgattctcctgcctctgcctccagagtagctgggattaccaagcccaactatttttttttttttttttttgcattttaatatagatggggtttcaccatgttggccaggttgatctcgaacttctgacctcagatgatccacctgcctcagcctcccaaagtgctaagaatacacacccgagctattgcacccagccaactattaattcttactggaaattttgcttgcatatagggaaattggctgtaggtgttgctgtataaaaacatgtttatcacctaacacaaggcctgcctctatgcaatccttcagtccagcattttatgaagaatcacaattcagatagagatgccagaatgcaaaatttctgtgcaaagattttctccattatcctttttgtattggtctctttgccaacatgtagctaatatattaaactgagtcttttactcttgggacaagactggtctgggtgctctcacattgtacatgaatgggccctgaatcctctaaggggattcatacatcttggttattttactctaggaatgtctgttgaagcttgagttttggacatctctggggaaatggacaagtgctgaatgagatatttcggacaggtggaatcttacattggacaatgaagtagaagctgattccatactctagtcttaaaatgtatcctgtgctcttcccaaaatgttatcttgcctccaagcacaatcttttctttctcaaaattttaagatactattatcgacaaaaattatgaaacagatgagaaaataaggtaccataaataaaagtcagaaaaataaaacattaaggagtcagacctacacagactgaagatattcaatgaaacaagaggctctaagaattgactgatggatttggagaaaaaaaaaagcaaagctcttctaggaataaagaatataattaaatgataaactgaatgaatgggttaaacaatatattagacattttacaaaagaagaaacaaagataggtactaaaatatgaagagctattcagtattcttagatatcaggggaatgtaaatttaacctcgtgagacacattttaatatgtatcaggcctacataattttgtagtcaggcaacattaagttaattaatacagaacaataagtgatcctccaacataccagtgagaatgaaaactgtcaacttgggaaaataatttgatattatctagttatttgctacatggacacaccatattacccaggaatgaaacacctggatatatgccagaggggagttttgcatatgcatatcaataaatatgtgagaatgttcaaaatagtgttatttgtaacaaacactggaaacaatccagttgtctgtcaaaactggaattattaattaaattgaggtatacttgtttaatacaatgtatatcaacatccttaaaattaaaaagtataatttgaagtaaaaagaaaattaaataaaaacatatattatgatgctatttataagattcaaaaacaaaatagaggctggggatgctgctagacaacatataaatcagaggacagaccttcacaccacgttttaggcctgaatatcaatagtggcaagactgagaaactttttctaaggaaaagtgagagcataattaataccaattttaggaaaaattttaaaatatggaattagcattattgattttccctttagatttttccttttactaacactgtctttatttaaaatgttgatatctttttcattattgatttctaagttgatttgaattattttaacatactgcattaaaatattatttattctgattcctgaggtttttggcacccccttaaggtttggggcctgagagtgagcctccctggcctcactgcagtttcagtcttagagaaggagtgcaggtagaaggacggaaggggttagagagcttcaaaaatattgatattctatttcttaatctagggtatagatacaggtgggggttcactttattatttttattaaactatccatatagcttatatacagtctttatatacaccattaaaactaaaatgaatttaaaagatcaattaactatggttaacttatatgctctaaatttatattttgtatcaactattagacatctgctgtctattattaaatagtatacacatatcacctatgatttttgtttgggtcaatattaagagaatactaaaaatgcatacaatgatgtttctcctataaatccacaaatgttatagatgcttataaaacttattctaacacctaacttacctctgttcacaatagagctctcttgaattttttgatagtgttggaagtatacggaataaattcacttcaactgtggtttatttcctgaatcccgaaaagcagtgatttgacatgcaagtgcaacacttctatctctttctaattcaatagcaaaattctgcaatgattctgttcgttagagggataggagtctttcatatattcaatttctgtcttccatggggatgttcactctagtggtagctttctgttcattcctccactagtcaaaaaatgaaaatccagaacatattcattatatggttatttcctttttattgttattggcctgcaactataatcctgcaattaggacaataatgattacaatacagtgtagaaaattgtattctcatttacttgactcttctgttccttatttcaattaagtgctcaagtggcattgaaactagcttcccactagattttactttgctttacctcaaatttctaaagaagttgtatttacttgtgaaacatgtttaaatgatttagatttaagttatactttgttattggcacatctagtatcagcattacattttattggcctcttccaggccaacacagacacgcaggtacaaacacatacaaacacacacactacacaaagattagcctctgagacctgaaagaaaattagaaacccaactcagcctccccctcctccatatctcaaagcaagttaatgagtggtttgtactcccaaagctgagatcttgaaagagggatgtgaacagaaggcaagtatatttctgttaaccttttctcagcatagtacacatttaaaattgatcacagcattctttctatttagccatgaaaggagtatcaaaatattctactgtaggaggccaccaccagtatatctcagttagtacttgagatgagcttaatgccttctctgtccaagaggaaaaaatgaaatttaattcaactaaaccatctaaagctccttgtcagagtaaggtcacatcatcatagtagtcatgatgtaagaaattcaactacatgtatataataatggcctatcatgtgcccaggccattgggagttaaccaacatagatctccatttaggaaggagatgcaaggagaataatgattgtggaaaaacctatgcttaagaaagtggagcagcttaaggagctttcaagatgctccattggcccttagaatgttatttagcaggcaacgggtttgaaaacctgactcttcccatagaagcttatgtttaaaggcctatgacatgacacacacaaaacctgtggtaatcttttttcggggtaggggggttaattctatttttctgttaatataacataaatttagtgattgaggtgacacatttattaagtagattctattctggccagaaactattagatttttattagtaaagaagaaaaacagagagccactgcttttggaaacagcctttgcataggcttctggatgttctttcttacgaatagcgtcttagtaaaggcagacttaaaaatacaaataatgtaacagatattaaaaacaagcaagcacacaaacaaatgaaaaatccaaacagtaaactaagttttctctgtatctatctcacctgtacctacattttcttaatttttaccacccaagaggtttgaaagaaattgttcagttacctttaattttaaaatatagtttttagaataaaatattttaaagtgcaatatgtatcttatgggggcagcattacttttgtcacttcaaaatttttagcctttagtattttaattaggcagtgaatttgataaaccttactcaacataaatgtcacgttctagtggtttttatgagcaaagtcacctacttacctttacctctaagagatacagtgtatacgaccttggattggagtgaattagaaattagaataagaaaagataccataatatgtagtctgaatccatttacaaaataattggagagtatactccattaatagacataaagaaatgtctggtataaagttcaccaaatgcactggatatttataaatagggagccttggtcttggtgatttataacattctacgtgttgttactatgttgcttgaattgttcataattgtcatatatttattataaaaacagttaaggttattattatgaaacaaaataaaatgttcatagaacacaagtcttgaagttaaacaatatggtaagaatactgcatatgacatatttaactatatacagagagaaaattaaaagtaagaagaaaaaattgttactgcattttgtttacccactaacattgagctaaaaacaaaccgaggcaccacttgaaagttaaaaacccaaattcaaagctgtgccacaagctgtaactacttaatcaaagatatatccaaaaaataataaattagaaaggactgacgggggatctgatagacatcttcatttatctctcaggtgtaagaaaacctatatatatattctccaaaagaacactccaataaatcaaaccctcaatagcatgtaaaggtttatagttaaggtaattgaaggaaagaggtatttcaaaccatttatccaaattttgctgcaaattctctaagcattagattatgaattcttataagtaaatactgctccacacctgctcttacagaaattttccttgggaatgagtctgtcaagattctttttccagcctgagatttgggagttaatttctattcatgctgaaatcactggcattaattgggtttacccccttctgatttacgagcaaaggaatgtaatttaaattctaggagggatgagaggcccatttgtgtagagttaactccttcagggtaaaaagttggggggaaaggtcccagtaatttggatagcaaagcttttgataaaggtttccttaaattggttccggatttcctattaatcaaataaattttttaaaaaatttattttttaaactttaatcttctagtttttccatacataaaaatcactagtaatatcaaatctctttttaactagtaagaacttaatatccttaccacattgtttaaatatgttgctaaattgactttaaaaattatatttcactacccttgttttactattttgtggctgttagccacacagaagtaacaaaataatgaacaaagccagaaagattcatttcataaatacaaaaatgaataacttgaatgtagcaaaagagctacattgttatatacaatctggataggagtatgatctatgatttctataatttaataaaatgaagaaattaaaaatataaaaatcaaaattataacaagaaggtttacacacacagaataactggttggaaaataattttacatattttatacctattaacgtgtttatcttaaatagtatctcaatttacataaaaagactagcattaaaattttttttagtatcacttttaaggtcattttcatttataaatgtagtgaataataaattgcagtataacacaaaagaatattaacataatctgtttttaaaatgatgaaaaattactaatatttatacttactatgttgcaggcactattattagtcttacttatgttaattatacgagctttcactgcaaccctagaaactatttggtgaaattatgcccatttcatagattcagaaactgagaaccaaatactttaaactactcacgtaactttacatagtagttggtggaaccaaaaagaatacccaggcaagtatatctctagagtccagttcttttccattgtgctatactcatgaaagttaaatggtgaaaacattttgcatcaaatgattaataaatcacaagctgtcattacaaatttaaaaagttaattgacagctgtcctgttacaattatttttaaatttatattaaaataatacatcttgcacctgcctaagagacataaaatatcctaaaacttcataggagcaagaatggtgcattgtaaaaagtatacgtttttatattattataagatatatattgcatatgctatcattcataatatctattatatgtgtttgtatatatgcacatgctattatctgatatgagttttccttttgctaaacttataaattttataaatggcattaaatttatgcaattttgaagtatgagactcaggcttgggaaatagaagagaagagagaaagctaaagggcacaaggaagaaatggacaaaaaataaataaataaaacaaagaaataaatatattaagaaataaaaacgaaatggtacacagaaggtcactgtgaacagcaggaagaatcccccgaggaagaaaagttttactagtggtttgagatgctgttttcttttcctccatacagtttcaagcctatgttatcagagagtccatgctcactgggaaaagaagttggtgaaatatttccctatcaatgtcttcctataaagaacataaacatggaaggttgaaaagtattttccctttgttattgtctccagtcgttggtgtgcagaaataaattacagaatttgggtactgaacgggagctcagatacaaacatattcatgctcacgtgcgcgtgcacacacacatatacgcaaacacagacacacacctctgcatactcgatatcatttttatatgatatggaaaaaattagactaaaaatctaaaaaacatggattctagaactatcctttttcctaagggattttttaagcttccaactttcatttgtattgtcaataaaaatgtatatattgaacacaacagtttttaaggttctctgcagttgtgaaatagtaatataaaatttattatttatccgctattccttagagtccctgagccaataggaatgcatttatttttatgaatacattaaaaataatactacatacaatgtctttatattagagttgagggatttctcccttctggtgtgtataaatagatgtatttttaagaagcattaagtacatccacaattttttaccaatgttgtttctcacttttacaaagcaatgtatagcaactaaattattaaactagtgttcatggctaaaaaactgttttttttttccatttcacttcttacctgctatatcattataatacaagcacttgtgaaagcaaacattgagtagtagaccataaatgctttgtattatcttgatctaaaaatggtatttttacaattattaaacttgaaacaaatcttataacaaacacaattagataggctaacaacattgctcttcaacagaacaaacttgttacttatatcagaaatagaaaactgtgagaaaaaaaatgccagctaaactttcaggttacagaagtgtaaattacccatgatcacaatgtataaaatcacagtttgcaaaattgtctagttttctcttattactgaaactgaaagttttcagaattgaatagatgaaaatatatttgtataaaattatttttaactcagactttttcctctcatctgtgacaacttttcctgctatgagagttcatatttcatgcaagaatagtcttacatagaggtatttactacagttgtttgttctgttcatctgttgcttttttaggaaaatacaataaccataaatctgtgtaaaagagaaaataaatagaaattggccactgtttctaaaacaaaaacaaataaaacaatactttgggtcaactttacctcagttatctaaacacccttaatagcatcctatgtctttattgtcagttctcatttttaattccaacaaagctggctgtcaagccatattatgcagtgacttaatatgagtggacatttgaaaacatcttacaatgtagaatatatttttcctactcactattacgtatcatccttaccaatattgtataaatatccttaacttgttctggagtagcccaaggaacagaaatcgtaaatgctcatagaggtaaaccatcagtggctcatcgaggtaaatacagacatgagtttaaaaagccatggtcaaatgactatgcaattcctaatgggtattgttcttcagtatatgaaaataggtagtaattttgtgatctgaaatgacaataaaacaatttcagaaagaaagaaaaggaaggaaacttactccatcccactagattcttattaaccaaagctctggaaaatctcaaagaaagataaaaatgtgttgtgtttctctatttgtgtttggtggagggcagtggtagtggggtcagaagaggtgttgaggttctataccaagccagagggaaagaagtgaaagacagagaatgaagagtaaaaattagcaacaattttagaaaataaagaggcttattttcttaatattgttcatcctctcttttcattgtttctgctctattcaattactttgtttctttttgttttgttccttcttttcctcatgcattttcctaatgtgtctcttctcttgctagtctctttcccctccttccccttctcttaccctctcccccttctccccttcctcttcctccttttcttacttctgtttcttctgtaccttttaccctattttccattgcctttgtccattttatgcccatgtcctggcactaaactaagactagattgaaagtcagaacctcctggtttgcttaagtagttattaaagtagttaacccagcaggacgtggtggctcacacctgtaatctcagcagtttgggattctgaggcgggcagatcacttgaggccaggagttaggaccagcctggccaatgtggcaaaaccctgtctttactaaaaataggagaagtatctgggtgtggtgatgtgggcctgtcatcccagctactcaagaagctgaggtgagagaattgtttgaacttgggagacggaggttgcattgagccaagatcacaatcatgccactgcactccagcttgggtgacagaatgagattctgtctcaaataataataataataataataataataataataataataataaagtagagtagttaaaccactgtattccattaaaacaaacaataaaacctctgggtaacagaagcaaaagaaaattgtaatttatttctaataatagcttccatatacacaaaacatgcttttgcaaatcctggaaaagtgctataagaaaaaaataaacaacttaatctatacacactattcttcatcacagtaaatgcatacttgtttagactttccaatggctttatgtaggccaaaaacttcttactgcagagttctatataatatagcatatgattacgttgatttgaaaattatttcaggttaaataatatattctaaaataaaacaacaataagtgacaaatcttcatataatattaagtctatgaagataatttcagttgcctcttgagaataataacaccaatacaaatattaagaaggataatcatagaatccattctgtttgttgaatgcttacattatgtaaaccactatataaattatcttatttaaaataagatagtatataccttaataacatctaccatatgaggtatatattacacatgcgcagattagtcaaataaagagtttataaaatgtgcacaaatttgtatggattagaattatgtcagattaattctagaacttactattgtctattcttttcttattatatttaagttttagggtacatgagcacaatgtgcaggttagttacatatgcatacatgtgccatctctattcttaaatggtagaaaaaatgttaatttttaaaactctttacagtagtgcttatttaaattatcgtatgatttttctctacttaaacacttaaggtattgttgaaattctgccatgcctatccttttgtgatattttaaaatctgaagtcatttaaccattttttaagtataatattgatagtttcttgttagaaaaaaataatgtgccattgacccttgaacatcatgagtttgaaatgcgctggtccactgacacacacattttcttccactttcacttccactgagacaggaagaccaactctcctcttcctcctccgccttagccaactcagtatgaacacaatgaggatgaagacctttatgatgatccacctctacttaacagctagtaaatacattttctattccttatgattttcttaataacattttcttttctctggtgtaacttattgtaagaatacagtacataatacaaattacatacaacatatgtgttaattaactgtttatgttatcagtaaggctttcagtcaaaagtaggctgttaatagttaagcttttggggagccaaaagttatacatagatttctgactgtgtgagggtcagcacttctaacctccacattgttcagaggtcagctgtgtggctataacattaatctatagctccatgtcataaaactttaacttaaaatttatatttttattatcaaaagagatgaatacagtcttatataaatgaattttagtagtttatagtaaaaagatattttattttaaaaaatagaataatatttagatcttatggttactataatcacaaatgttaagtatattcataaagcaaaacaaactactttatacaagtctgaagtgctatacaccgtaatttgtttcctaagtttaatgtatgtagccttcttaagcaagataaaagagctgatattaacagtccgcttattttactttcagagacattaaactaatgacaagttagctcgtgtttttaatgtaagatcatagagggtgatatgaggatgaaaagttggcactgcttttattggctagacaatggatcatgagaaaatgaaatattaccatgaacagaagctgctgtggtgtgctgcctgcttatttggttggttgtgctgagacttgattcaactccttgcttttctcttttgcaaaagtgttggaatatgccagtctaggaacaagaaaagtctactcttattcattaactgtcgtattcatactgtggatacatgcctcaactgcaagagcattacttaaaaattaaatgaatcccataaataatgctatttccttttgaagaactaatgttcatggttctcaatgagaatgtgttaaggtgtattggaataagacatctttatccatcaacatagatcaatctaatttagccaatgagagcaaacaagtaaagaaatggggcttgagaagaataacaactttattgagaacttattttaccttatgccagaccttatgctatgtccagtacatgtatcttatttaagtcctactgcagtttaaggtttgcataatttccattcaaggcctgctacataatgtatagattccagagcaaaattaagacataggatcccagctggaatgcacaagtcaatatccattgtccagtggtcagccgccccaatgcatgatggatggatgatccccccaaaattgtacctcctgttgggatgcacttagtacctggataagggtgggtaagaggcttctgccaactcacctactgaatgtacagtgtggctaccagccaatggattagatggccacagctttgctctgttccaaaacactgtggagctcatgtccatgcctccttgccctgtgaccatgagagtggagaacagcaatggaatatagtcctccctccagtttcctctccaggtggagggtgacaacagccacagaaaggtacagagaaaaagaggctgagtatgagggaggcagctgagaaactctcctagatccagagacagagaggctgcatgaggtgaagcagtgcaggaatgaggctccaagcactcaaaatatactccatttccccaaaagctcaacttgctaaacaagaatttaaagataaaaccaatatggatttcaagatgcgaaccaaaccgcattaaatctcaagtactaagctctggatcctatgtaaccatactgttcacttgcccatgaagctagcccttttcccattttacaaatgataacattgcccaaagtctgtttgtcagcatgagataaaatctgtgtgtatgtgttgtagggactcatcagggaacagggatagatcaatagtttaaactctaacttatgttttttccactacgtctaattgcctgtatatatttaccactcattaaattaatggaaaatgttttataatatactccttatttttcaactatttggggggtaaatatagaattagaacaagaaatagatacaaggaatataatgtttttgtagaggactgatgaaatataaacgacgttggcaaaattatcaaaactctgccccatcaacaaataggtgatgacaacatctatacataatttcatgttctcaacctcaatattgactatcacacgaaaaattaatagaaaaagttataaaatggaagctaatattgtagcttgtcaaagctgcaggtatttttcacgtggccatgatttgttcagacttgtttactattactgtcatctccggtctagtgtgagaggatgtgaaattgcatgttgaaaattactctatagaaaaatggtatgggaagtcatgaattataacttctacaaagccattaaaataatgaaaagtcaagaatgaagttggattaaaaatatgttgtaagggattacaaaaatacacaaatcaatggtcaggtgttcttcagagaagcgtggcagaaataatttaaataacttctattacctaattcaacataaaaatattactctttcgcgtgaaaactttacagtctctctgtggttcagctatccaaggtttggctcaaaaatcacttcccttaactgcattgcccgtttgtctctacttccaggctagataaggtgatcctcctcaatgatgccttgagtcctgggtgcatttttcatccatccttagaaagtgatgctgtaattgtttataatgttctgttacttctgattctcagcgacttcaggaaaaacagagacctatgtattttgtttatttgcttgcttgtttgttttgtatcatctgtgtttatcagtgtgtccagaaaatagaaaacattccttcaacactgaatgaatgagagagtgaatgagagaatgggcctatgttttctacctgaggccagagttattatttgctttgtccggccctacttggctgaggactcgcaagacatttccctacacatcgtcaaatcttcataatctctaactactcaaaactctttccagtcattcagaaaggcctagaaatttttcttgttaatataactacagaaaggctaaagtaaaaattctggctgtaatataggtggtcatttgttacacattttaggcccattatgattaaaagagattttggatacctcaaaatttagctacttaaaactttaaaaaaagagagagaaaatatccaaagttctagatacttcatttccaataaaatcttggaacacaactcgtttagaaggaagggaagagatatgtgcctctatagaaatgactgtacaagtaatgggcttatttccaacattgaacctcaaggaagctttcctgttaatgtttgaatagtttgttttcacattttgtttgcttaagtcaactagaaaaggcacttttaagattgagaaggtgtggtcccacatccacaggatatttctgtatattaaacacttagcattagccagccttcaggttaatattgattgttatctggataatattggacattagcctattgcttgtcatagaactctaagaactataattagctctaaccataaagcatgtgttaggtagaaaatgacttttcgaatataagaaaatccactggagctacccctagagcacagtaaatatttgccatcagctacctattcctcatgattcttgtaaaggtatatttttttcacctgctctatctgtatttctttatgattaaaagagggtaatttttaaaaaaagtaaaagtaaataaagctattgatagaatatattatatgtataaattacatatatgttatataatatataacatcatttcatatatgtataaatatgtgatataaaattatatattatttatatgtaactttatatagatataaaagtttatctctgcttatagatatttccaaattaaaatgctgctagctttatgttaacctcagaatattttcaaactgtaattgcaaaatagtgtctactatgggagtgtaaaaacactaaataaggcattgcttcttaattcctcagttgttgacatttcagaagcactaagatcaaagcctgatgttttgccggtatatgagatcaacaacaaccagttgtaagcaatgactgtgatataagacatttatgcagccaaaagacacatgacaaaatgctcatcatcactggccatcagagaaatgcaaatcaaaaccacaatgagatactatctcacaccaattagaatggcgatcattaaaaaatcaggaaacaacaggtgctggagaggatgtggagaaataggaacacttttacactgttggcgggactgtaaactagttcaatcattgtggaagtcactgtggcaattcctcagggatctagaactagcaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaatgtggcacataaacaccacggaatactatgcagccacaaaaaatgatgagttcatgtcctttgtagggacatggatgaagctggaagctatcagtctcagcacactatcacaaggacaaaaaaccaaacaccgcatgttctcactcataggtgggaattgaacaatgagaacacatggacatagattggggaacatcacactccggggatggttgtggggtggggggaggtgggagggatagcatcaggagatatacctaatgctaaatgacgagttaatgggtgcagcacaccaacatagcacacgtatacatatgtaacaaacctgcacgttatgcacatgtaccctaaaacttaaagtataataataaaaaaagataaaaacaaaacaagaaaaaaagaaataagacaaagatcctttttaattccacttcacaagcttatattaaagaacaattattacatgtataattaatacactcgtatatattttgggatggcaaactgttgtgggcatgtgtagcacatttcaattctcaagttaggctcttgatattaatacctttcatgtataagctggtgcattagtcagagacctcatggataatacttttaaggtgaggatagtcagtatattcagcatcagctgaatgtcaaagactgccagtcaatcatcaaaagataggagaaaaggttggaacaaatccctcccttgcagtccttggaaggaatcaatcctaccaacatcttcatctttcacttccagattccaggactcagacaatacattgcgttgtgttaagccattcgatttatgggactttgttgtggaagctgtaacaaactaatataatgtgtatccttgatatctccctgatcttcttagtcttttcttaccaaaacagctatctatctctctatgtatctatctatgtatctatgtatctatgtatctatctatctatctatctatctatctatctatctatctgtctatctacctatccatctattatctatgtatctatctatcaagcactgagatcagggaaatgtatttgtggttccttggaccctgagatttatacctgttttccttctgcctaatatgccctaaacactaagtgaagccacttagtcatttcagctttgaaacccaaattaaaattttgtggttgttcttaaagtttcatccaagttttttgcttgttcatctttgcttttgcttttgagttaaggcacaggatataaaactatgttcattatgtgtaccaacctataacagaaggtttcagttctctaccattgttacttatatgcatttatttacttaagttgttacttatttgcatcggttgtggaaggagcactgtccagcccagagtgcttctagcgtttaaagtttgttttacatatttatgctaataactctaggctatcacgtacattggtagattattgagaatcttatctacttgaagttcctttgggtctgtaagatgcttatgaggaggacttggggctgctagtcatctacctgacaaaataacctcctggactggtcaaaaggaagacacagaagcttgcctgaaatggaaaagcttcaaaagccaaatctggtaagtcttagggattcctataaagataaattataaaccagaagtaacagttgactccaattaagcgttcaagttttaatcaagtgtgacatacaaatgtatgctttcatgtatgatgaagatggaagaatatatgaaataatgaaaaagagaaaggaggcaaagaaacaaaactgatagcacatggaatagagagaggctgtgaggggggaaaacactcagagaacaaagaaaaaaaaaatggaagggtttgcaggaagggataatataggtcacttaagtggaaaaaaagtgcaattacctaaaaaccagtcaagctaagtataaaaggacaaactatcatcactctggtggtaaatttatggaaattattgtatagtctctgctgattaattggtgagttcttggacagaagaatatttgggatgggggtggagatggaggtggggtagggaggaggtggtgcacatacacatgcatgcgtgaacctgtgtgttacttcctctctgtacccttaacacttaggcaatttgcctggcaaatagtaagtgcttaataaatgcttgttgaatgagtgatttttggctagccatttacatttattaactttgtgataatttgaaaattattgaaagaaatgttctgctgtggtttggatatggtttgtccccaccaaagctcatgtttaaatgtgattcccaatgtggtggtattgggaagcagggccctgtggaggtatttggcagcaccctgtagaggtggatctctcatgaatatcttagtgacattctcttggtagtgaattatcttgcactctcccaagactgtattagttctcttgggaatgaattagagagagagagagagagagagagagagagagagtgtgtgtgtgtgtgtgtgtgtgtgtgtgtgtgtgtgtgaggtgcactctggctgttataaagcgaggttcctcctcctgtctggtccctcttcccgtgtgtctgcttcccctttgaccttctatcatattttgccctagcaccaaagccctcaccagaagctgaggagatgacagtgccatgccccttgaacttcccagcctgcaggaccttgagctaaatacaccttttttcctttataagtttctccggttcaggtattctgttacagccacacaaaacagactatgacaggttcttaatgagataactgaaatgatccactaatccagaaattatactctcctctaaaacattagtaaaaaaagaatatgacagtagggtttggatgaagtcaaatatctggatgtttcccacttccctttgagtttcctagaaacagagctcttgagatacctaaggaaagtctggcactggagtaaaggaagagtacaacaaagcatcacttctactaaatcgatttgtatcatattcaggccctgcaggtttgcaaaatgtgcttccagcagatggcgttttgcatagataataaagatgtttgcatctccagagtcttgtaattaccttaagaattaggagaaggaaaatagaaaagaagaggggtaaattccttctgcttcccctccttttaagctccattatcataatctgtatcccatttcaattttcatcactctcagaagaatacaacaaactgatagggaatgagagtagtctggattgaaaagacaatttaattgctctgctgaaaaagaaactcaactcacacaaaacagggccaaccttttccatttgatcttacagctcaaatgtcaactatgccatacgttttatgtgacttgaaagaacaaaaatggaaacaaagattttaaacattccattcttcctcactatcattttatccactgaaaaagggaaaaaccctcactggcattcaacaaacttaaaacaagcatcaggaatgtgtcaaggtcgccacaaactacagtagcatatgtgaagctccttgactgtatttagtgaaatttgttgatggtgttgtgtattaaattactgaaacctttcagaattctggcttgcaaagcacatggaaaataaatagtgtggctactgttggtgcattcatttgcatatcaatgaagataattctgctagtttcatagaaatgatagtgactaaggtctaagaaggaaagtgaggggcttggatgtacacagaggttgctaaaattcttcctgcttgcatgccaacatttcaaataattttcccagtaagataagctagatccttcattgttttgtgttctctgagacagcattatggaagcctgaatagggctaaagaggcggatgttttgaattctcatccaacaatttttttcataaaaaataattctctgccaaaatttcaaagtccaacagcttgagatctctgtctcttttcctttttagtttcatccatttgaaaaaaaatcagattaaataaaatatgaacattttatttcaagaaagccaagttatgagcaataccaagaaatgaacagatttttttcattatattttacttgccaattgcaatcatgctacttgtaaaatctacagttcagtatatagacattattagttctgtcaaaaatgtgaaggaacattgggaaagcttaagctaacttttcagataatgaaagataaattttcatattcagcttgggaattcgtataacagacaacataacgcctggactatttttaaatatctaaatatttaagaagaccatgatttgaatcaatatatcatagcaaaaatgagtagccctagtaagaggactcaggggcaaatcaaaagttttacctttaattggaatcactgacatagtgcccatgtgcattcttctaatttccctttattcttaataaccacccagaatgaaagcaagatgatcacgcctgtaatcccagcacttttggaggccgaggcgggtggttcaccttaggtcaggaattcgagaccagcctggccaacatggtgaaaccctgtgtctactaataatacaaaaaattagccaagcatgatggcatacacctgtaatcacagctactcaggaggctgatgcaggagaattgcttgaacccgggaggcagagagctccatctcaaaaattaattaattaataaataattaataaaaaataaataaaatatgaagatccccttcaatcttaaaataaccatcttacaaaatcatgtttttaaatagacctattaagaagactaacagagatctgcggaacacatattttgtaaattgatggcttttactggccctaaaacacccaaaagttaatattgtttttccttaacatacatatttccctaaactatcgcatgacatataattctattttagttcattaactagagaattaaacccttagaggataggaaatgtttacctgtatacctaaaattggtatatggaattatcaaagcagtaagaaatttaacaaccaaaaatataaaacaaggaacaattaagaattattcaagaaattcgagtaaagaaatgaaaacttctggaaatgcattgctaaatttcaaagctataaaagttgttaaataatactttaaaaagtgtttaacttatttaaataaataagtgatcaaactctttaattttgcttctaatatcaagatgaggttcggtagagaatgaagtgaatcctgtttatctcacaacaataataagagccaaactgaaatatattttacttaccacaacagatttctaaatatacttcgggagattaacttactactgaactgagtctgcaattcttcttatatattacccttaatacatgtttctaatttatgaaacaagattataatagttatagttagatcattaaaatattttagtgcaacatacaattattatgtgtgtgtttatatataaggatatatatatataaacacttagccttaatcattacacaatattagaagcttatctttcgtattaagatcatcaatcattttaattttctagacagcccttactttttaccctttctacaccctctattttgttttaacaattaacttacttcaatggtagaatgtttaaatattgtgaatgttaatttaatcaattacacattattagtgaaggatttagctaaacggattacatttttaagaagtctctgaatttccataaccttattttagcaatgccatataaaagacaatgatacacccagtgtgaaatcatgtaggtatgccaaaatgtaccaggacttcttaaaaacaatcatcactgtgttccatttactaaggaaaattccctcgtcgcgcatcagaaagactcaggacgctaaagagtatagctagctgctcatgtcagaaagggtggaaccaggaaggctatggtatcccacttaaccattagccagcacatattgtggacagatttaaattagaagacacttggtgatatcacttaagcctatttctggactcctgcaggaaaacaaatgctggcacaaaagaaaactgccaaacaccagctggtctggtagtcaacatttatgagctcttggcatttcataatgtgtcttacatgtgagaaaatccattgtcattaaactcttttatccattcgtgatctcactttatagattatgtaagaaaacatcccagcaagtggacacatgcttaagtatctaatgagcgattaaaatgaaattttaaaatgaaaatgacctacaataggaccacttaaaacataacttgggcaattctagtattagtagactgtctcgcatgtcttctttgtgtgagacataacctttggggtgtgaattattttagtgcattccagaacctcagggtctatagttattctcaaatacagtggttctgggaactagcctgcttggaactgggcgaggaaagctgtgatgtaatgtggatttacactagaaaacaggataattttctgacccttgaaaatgaccttaaagtcatttttcaaaaagggccttttcaaaactctagggttttttactataactaatttcacgtcctaacctctgactgtccgagacacagatatacctgcactctacagagaattctagccaggaagctaagtcattgccaaggccatttaagagactgaattggctcaagtttgatacagatttaattggcaaatggatctgaatttattctggttcttgttctgtcttttgagcctgttaagtcatttagaccagggaaagattctggcgtactaagaatgtttagaaaaggctcctatcttgacagttaggcttaaaatggatgacttctgacaggaatgcttggaagataatcattcacttctttccatcaattccatgttatcccaagggtttgttcaacagatggacataatttgcatacttgactaccgcagttttcttaattgcattttcccagcacattctattatatttgcagtattagatttcccttataatttcactttgaaaaatatacacaatatataataagttattatattttctatatggtggatcattctgcaaaacctaacacctggaaactgtaggcatttaggatatattgaaaatctattaccacactctaagctcaactatgacatctctcaaacttatttaatacctctattttgaaataagccttcatgttttagttcaaaatacttcacaatatatttgtatgttaggatattgcataatccagtaactatgtacaatattttaatattttaaggttaatttttgtttataactgaccattaacctgtaaaaaatacttacaccattaagtattaaaaatattattctttggtgggggggctgaaaagatgaataggtgactcacagataatttttagagcagtgagaatattctgtatgatacaataatgttaatacatgtcattatacatttgtccaaatccacacaaagtacaataccaagagtcaaccctaatgtaaactatggtatttggatgatcatgatgtattgatgcatcagctatgacaaatatgccgctctggtgggggatgttgataatgggtgaggctatgcatgggttggtgtaggaagtattgggaatctttgtaccatcctctcaattttgatgtgaatttaaaggtgctccaaaaagaaaaaaatagtctcaaaaaaggccacaattatttttaaacatagaactccagactgctgtttaccatttttatttttaatgttatatcattgttatgctgaattaatatctttattcttcatgataagtgtgcatttttcaagtctggtagttcttcattaaccctagggaagttcctgaaattgtcactgaaaatttcttaagggatacataccaatagggagaaggaagactgttgacaatttattcagcaacatttactgcttatttgtttaaaaatttaagcaagccttctaattaagatttctcactactcaaaagacacatgacatgaacaaaaattctccaaatgtttaattgctttaagtactatagtgcctaaggccaacatctctttccttgaccctcctcttcctaggtctgcaaatctgtttcagcatctcatttctgcccctgacatggaacatgttaaatgaaaaacaaaatccagaagatagtgaagagaaataacactgtcattaaggggaacatgatgcaacatagcatcaccatcattatgagtatagtgtccatgttggaccagatttcatcatgcaaattagcacctattacaaagacttccaaatagataaaatcttatattagaagtgatatttctgaagagcttctgagagttcaacatattttttaacaaatgatttgatttttaaaatatattcaaaagtaggcatttgcaacattgttacctattaattgcagctacagggccgagttcccatttgcttttttttttaaaaatcctttctctgattctcaagtgaaaacaacgaaatagagccattttgtattacttcacatgagagaaagagttgttttaatgttagtgtgaaagctgaccatacaaattggggtcattttgtcatacctgctctaaaggacaggaagaaaaagcactcagggcacataacgttgcttcaataatgtaattctctccaagtctggctgctgaaactgcctgttgtaacctgaaaccaatctaatagctactgagacaacctactaggactctaagactagtttcccccaccaccatctcttaccaatcagaacttgccagttcctgaaaaactttactagtgctactgaattttctttcagaacaatatgtaacatttctccatgttatcaaacttccaaccttctccttgttctttggacataccaaagatcatccagcctgtgtatacgctccagaatgcaattcttgcttccaaaataaaacacttaaaatttaaagatttgtctctatattttgatgttgactttagctatcgaaagcatatacttttccttaaatgtatacaatttcatcaggattcccaaagaggctaattaacctatattcatgggattaatatgcagatatgaaaatcctatctaaaaattgtagacaataatatatagcaaactatgttatgcctagaaataatattctccaagctaattttgttaattatgagttttgaagaaacaaaagttgggataattgaataatgtttaaggtgaaatggaatttttatttaaacttttgttctggtgactgttcacagaagcagtactacttcctaggggagattttgaaaacctgggaggcagtatgttttgtttgtcagatcgatttatgacaacatgggaattttagcaggtaaggtcaggacagtcctgcacatcgaagaaggcttccatgtccaatatggttttgaatatcctattgggcaacaaggggaaaaagaatctgtttggagtaatctgagtcttaatcctaatcctgttttacataaaacacaaaggattctgatacattttaagttatagactaagtttccataaagcaatctctatctaaatttaaaaaagattaatcttagagagactttcctttaaatcaatagttgttttccatcaggcaaagtcacattacctccataggaatactgctgatgatgtttgatagaattatacaatgaatgtgactaaaatggtataataaatgtgataaagtaaatctgtatttatagctgactcattaaagacattctatgtataggtgcaaaaaaagcatatgattacttcattaggtcttcatagtaagatttcccaagcaagcattaataaaataaaagaaatttaactatttcattgtaaattactcaccctttatttctgcttttcattttaagtgggggatttgtactaatagggttgaacttacacttcatttccaggtagtgaaagggaatttgcaaaatatatgttaaaataaaatgcatcaagtctaatagggttgataacagctgtgatagcagaataataataatgaacgttttattatgcatatcattgctgagagcttagtggtgtgacactataggaaatatgataactactgaatccagaaaaaaatgacaataatgataatgttatgaatatgtggagtctcacaaaatgataacgcaatctgaaggcctaagaagcagcctcagaagcagtttctctctgatcttctcccgccctcctgcctcttgcccctcagtctcccctgaggtaagccatacaatctcttttccccaaggttggtctagaaccctttttccccaaagccagctgtaaaacctaaaaatattactctaacctctctccacctcttcctgagtcacgattggccattaagagattaagaccttcattccagagggtcctaccccatactgaggagggaaaagtgtcgcacagagggatcaagaaacatctaaacagacaggccttgctgagttgtcccacccaatctattagcattagattatatactttttgtataatcgtatttctatgtggtggttcatataacctaaataaaatatacttcatataacctaaataaaaatatacttcatataacctaaataaaaacagatcgttttctctgtacctttgattcttccttctgaaggctcccatgctatgtaaaactatcaaatacacttgctatgcctttatcttgttaacctgtcttttgataaaggggtttcagccatgacccttatgatagagaggaaagggaacttccctttttcactcctagagaaacagaaggtccagggcagaaaggtgaggaaaaacgccttaagtacaggaaaagagaatgaaagctgggactgaggaatgcatcataaaagatcacatttatactatgatgtaaagtgggtaagaaatcagcttctttatcttacaggaaaagtaaaccacagacctatatcactcatgaacatagatataaacttagtaacacaattttaagaagtgtataaaaatatataaaacaatatgtacagaaggataatacaaaatgacaaaatgttaattttttaaattgattattaatgcctaataaagatataataggtcaataacccctaacaaataacagctaaaatgataaatctgcatgaagaaaatatggattaaatcctagtggcatttaatttgttaatggtctcttagacaggatttttgaatcatgaactacaaaattaaattagaatccatcaaaattaaaataattagactttttcaaaacctaaaccttttgctcattaaaagatacattacttcaattcaatatacaaattaggagaaggcatttgtaaaacacatacaacaaaggcctcatatattacaatttgaaagaaagatataaataccagagtagaaaaaaaaaaatgacaaaagatttgaacagacatttcaccaaaaatatctatatggattacaaataagctcataaaaagatgctcaacatcattaactattaaagaaattcaaaattaaaccatgatgagatactactctgtactgattacatttgttaaaattaaaataactgattatatcaagtgttagtgaggatacagaggaactggaactgtcatatgctactagtgggaatgtaaaatggtgcagaaattttgtaaaatatttcaacagttttacaaaaatttaaaaatgcacttatcatatgacccaatcatttcattcctagagatttacccacaagaaacgaaagaatgtgtccattcaaagacttgtaaataaacgttcatagaagctttgtctgtaatagccaagaactgacaagagtagacggccttcaacaagtcaatggaaaaccaaattatagtatagccatgcaatgaactactacttcacaacaaaaagtaacaaactattgataaatataacaacacgggtaattcaaataatgataactactgaaagaaaaatacaaagcacattgcatgatttcaatcatataaaattctattaagtgcaactactttacagtgagaaaaagtagatcggtgtttttcctgaaaaccagggttggtggaggaacggttattataaaggggcaccaagaaacttttggggatgatggatctgtttattattttcatgtgggtataatttcataaataaatacatatgtcaaacatatccaactgtacactttaaatagggacaatttattgtgttgtcaatgatactgcaataaagctgtaaagttgatattctatgaaggtaagttgttaagaagtcagctatttaaaataactaacggcacataaaaccaaagctatatttcttatttacaaatggactgaccttgttaaaagttaatttaaacaacacgctgttttcatgtcagcactggagtaaaaggctaaagaaactcagacaagaggaaaaaggtgccatgaattaaagactatatgacctgtgaagaggaaaacctgaaaacaaaagactataaaaggtatgtgatcaatttagcataaatattttctgtaccattagctttctaactgcattttttccagaaccctatgactggctgcactggaataagggcaagagacaggatcattttcagttctctaaactgtttgcaataacataatttctgctttttctttgttttatttctttaagctcccatataaatttcatctgagcaaataactttaggctgaaatgttgaagccacttcactgcagtaggccaaaagagagattagaatagggcagcgccaaaactcattttaaacacatttttgtataatcactcagctctcataatagatttggatactatgattcatatgaattagatcacaggtaccaacgttcagtgttcaggcaacagaaatatgtaagtccctactgtgtaccaggctttctgctagatccagggatagagtgatatgttgctttacttgagtgttagaggcaggcattgaatacatttttttttttttgcatttttgactaacatggtgtatcttcagtgccatgtaaaatcaatcagcttaagggcttacttaattaaaaaaaaatctccgtctagggcttagattagatcaataggtttttatttttatttttctttctagtggtggaggaaacagcacaattttccactaattaagtgagccaatggctgattattttacaaccttgctacttctttctgggtgtgaccaagaaatttgatgtaacgtatcattgttccagcagaaaatgaaaattgctggagtttgagagaaaaaggaagggaagagagggagggagggagggagagagagagagagagccaaagacaaagatatggttatgtttcaaaaatgaaaagttttaacagttcatacacatttctggttttgtaactgcctctaaactataactttgatttacacagcctgaggcaatttagttccattgtccctttgcactttatggacaatttaactgatccctgtcaaaaatccaaggatattcactcttgaggagggagttattcagagacttcattactgtcttgcttatttctatctgaagttgctgctttgagactaaatttccttttattatgaaaactgaatggttcccacatttatatgctatcttttgtaagcatttggccacagctaaagtggctattgcttttgagacctgtttaattttcttttcatattaaatgttaatgttttatgtttatcactttgtctaccttgtgtattgcaaaatttcttgctggttgtggaggtttaatcataagatcattttattagtcaaaacttacatttctataacactacagatttatatttatggtttgagtcgtcatcaatgtccttccacctatacaattgcataggtcctcttaactgatttccaatcaacattctatattctatttcctgtaagatccacccttcacactgctaccacaattttcttctgaaatcccattgggatacttaaaaaaagagatatgtatattttcttcattgttggagatatacatagtaacaatagtaactacaaacacctggtatataatcctactcacaatcttgctccaacctctaattactatcttgctccaacctctaattcaagcctcctatttcaccagtcatatttacaagtcatccaacctttgaacctttatcctcccaaacctaaagacatatatgtattcatattttatgtcctggattaatcatttttttttctgtccagaatcaggtccctgcaccgaactgctagatttacatcaaagtttgatcatttgttgtataacactaggtaaattaacctcttaacagcttgttcatctctaaagtaggatcataattatgctttctcacaggtttgggaggattaaatgtaatatacgtaaagtgcatagaatgagactatagagagcctacaatcactgtttactactaatcactttttttttcattgtagtaatctaatggtatcccactcaaactttgagctctggattaaaatcaacctgcctgtgaatcactacttggcctcccttacagtgttagtcattgtattcttttacatcaaacatacatcttcattatctcttcattgtgctctaatatttgtttcaatgcatcctcattaaattgtaatctccccaaaagcagagatattgatttatgcagtctgcctctcttgtgcccaccacaatgcactgtacatggtagatggttgataaaggtctgttagaccctggctgctgaatgcatctttacaagtatgttgatatgtgtggcatgaggtccaactgaccacatttctgtggacactgaagagatacaggtagagagatctgagtttatagtcaaaacaaatttcattttttacaacaaaagtagtttattaggttaagcaggaggaaaaaaattcctcttgaattttggatatgagccagggaatcatcctaccattcctaagatgaaaataaaacattatttcataccagttcaaatctcatagagcccctcttgaaaatataatggcccatatggaaaaaaattggctaaaggaactgaagttcaaacaatatttaaaacagggagagaagtaggtttgcaccttctttaatggaacagtgattttagaatgcatgcccttcttatcagggctctacttttaaagcatgctgttttctagctgcttctatattgacttttctaagcccaaggcataatcttttggactccagacatgagtctacttgagagcttattacacaatttattttgattatcagtatactggaaaactcttctcattttcccatttcttaatcattaataataaaaatgaaacaataatgaaagcattttagaacattcacacaatgtatctaatttctcaaacagaaatattatttctaatgatgacataaagtttgacattttacatattattgacagacattttaccctaaacatagtgaaaaatgaaattaaatttcatcatcactcagctgagcaaaatgtagattccaacataccctggaccagttttcctccaaggatagattagtcatatgttatagaaacctgtgtaaagcagagacagcattaaatataatcaacatatattcctttacatacagagtaacctgaggttataaggtaaagccatatagtgcgtaggtaatctgataatcaaagtattgaataattaagagtatttaatcacaccattttatctatgatttccaaaataaaattatactagtattttcaacaaaatgactccgtacacaatgcatacctatctgttcaattaatactcactgatggcctactatgtacaaaatgtgcaaggtggccccacaagcactacatgataaatattggtgcactcgctcttttcattcattagacaatgcacactttgaaagacaaagaagtgacttgcttcttgtgtgttgttaatacaggtatgttagatgtatgaataaattaatgagtgaataatgaaatgaataaacaaactatgaaaaaagaaactgtccttctactgaaggcatttaatctatgtgtatatgtgtgtgtattgggacagggggaagacagatgtggcagggagagagattgataaagtaggtgaggcaatatatgaagggtgcaagctaagtaagctcaaataaggaagagatagtatcaagtaagggattttcttaaagcttcaagaatgaggtggcatgtgagatattttgaagaattaaattttgacacatactataagccaaatcagtgatagaacactttctatccaaaagcaagaattgaacatgaaataagttaaaccacattaggaaataaaaatttcctattttgtatttcctttggcctcccaagaatgtttttttcttctcctgctttttaaaccctctagcaatcacatacttcacaataatggttaaaagaataatccaactcttaaatacagctatgcaactactagatataaaagctttggaaatgtatttaagtttttaaagtatgagtctctgtattcataaagtgaaacattagtaccaactcgattggctatttttgttttgttttgttttgagatggagtttcgctcttgttgccccggctggagtgcaatagctcggtcttggctcactgcaacctccacctctcagattcaagtaattctcctgcctcagcctcccaagtaggtgggattacaggtgcccaccatcatgcccagataatttttgtatttgtagtagagatgggttttcaccatgttggccagtctgctctccaactcttgacctcaggtgatccatcccccttggggtaccaaagtcctgggggtgcggtgtgagccaccgcacctggccaagatacatgttttaaaatagttctaattcctgcagagttcaaataaacaactacttagggcaggaagattgttagatgatgatgcctatgacgacagtgatgaagaaagaaaaggaaacctaagtacactttttgaggttttagtttgtgcctggtactctttacgtatttttaaaataatccttaaagcaaaatttccaaagcttatgtatctagtagttgcatacctgtatttaactactcgagaggctgaggcaggagaatcgcttgaacctgggaggctgaggttgcagtgagccgagatcacaccattgcactccagtctgggcaacaagagcaaaactctgtctcaataaataaataaataaacaataaatataaaataaataaataataaaacaaataaaataaaatgtcttaaggcagttaatactggtagatttactgtgagcacaaactaaatactcactaactttgtttaaaaatacagaattgctatagggtcaaagagaaaaaatcttcacatgcataaaatgtaaggcaactttactagaaaatcaaacctttttaatctttgactacaaggtgttacacaaagtaaaactagtttgattagtcataattgttaatagttcatattaatgagaaacctacatacctagagagacaatagtatctcaaattcccatgcctaaatggtacttccaaagtcagacttcatgacattgcaacttgaacttaatcaaaaatgattaagatccatgtttcagaaaatagaaggaaagctatgtgcattttcctcctagaggtattaaaataagaagatccctattaaagctttattaattacgtaaaaaattaatccctaaacaataagttagagacaaaatgtagttttatacagtaacttttaaacatgttttagtggggtttttattttcataatttacacacacattaccatattctctaaatactttatgatccaacactttataaattcagcgttatttccagttatagttgctgtcacatttgtgtcatttccacagatatttccccctgaatgtcccaacattatttttgcacttaatgttggtttatgggattgtagaaataaaagaaaattcatacatctcactgtttttcatgtttatttgcttttcattttggctgacttccctgggagccagaggagagaaagaagtggcaagggagataagaggattatgtccctgatggtagagaaagaaagaaagaagacaaataaatacaacgaggtggcaatgggaagtaacgcagtgatatggtttgtctctgtgtccccacccaaacctcatcttgtagctcccataattcctatgtgttatgggagggacccagtgatagacgattgaattatgggggcaggtttttcccatgctgttctcatgatagtgaataggtctcacaagacctgatggctttaaaatgggaggtgccctgtgcaagccctctctcttgcctgctgccatgtgaaatgtgcctttcactttctgccatgattaggagacctccccagccatgtggaactgtaagtccaataaacctctttctttcttaaattgcccattctcaggtatgtctttatcagcagcgtggaaacggactaatacatacagagtggaggcaagcagtaagggttaaagtgtcaagaggaggctctcagtcaacgttttttggggtgatcctaagaaatttgtaaacaattatgcctcatacttaagaacatacataaaaattacgaattattaccattctacaacctctaagttaggaagttttggcagcacttattgaagaaaaacttggaaaagaaacttagggaatgggcgaaaatgagctattcaccaaaacaagaaatgttacttttccaacatggatcgtgttaaacattagttctacagaatgtcaaagggtacatatagcaaaaaaaaaaaaaaataaaaaaaataaagcgagaaaccaaaatgatagattatctgaccaaattaatttggagattgtaggttaagcaaaataaaagtttccgtaccagacaaattatgagaaccatgaaaaagagagtcattctaaatgtccatcatgaggttgcttgagagatgtgagttctttagaatacacttttggacgtgccttctttaaactaatggcatgctcttctctcatgaggtgagaaattgtttggaagagtttgggtagctcaaaaatcttgtgtcatccactgggaataaaaagatgactaaaatatgacccctgtacataagcttcttatgcacagaggtgatattttatcttttttttagcaatattgatactagatttccactcaaatgcagttttatagtctgttatagggaattcatatttacctaaggggtcagtaatacgtagtagcctagaagtttgatcccctaaatcagacagtgaaggcctactgcttctctgctccttcaatttcaagcaaagatgtttcttctgcagatcttatatatcttaagtcagcaaatttgacctgcatttcaaaatcttcaacaccaggtaagtgactaaaagtgattttgagacatctatgcttttatctcccatcctatacttgcactgggaaggagatagaaaaaaaaggttacagccattaatcactaaagacaagatccagtgattgttcaccttgtgaaaagtaaacttagttctcttttgtgttgtggtcagcatgctctccataacataaaaagacatcattgtacttgatttttttccatgagtaacaggtatgttagttctcagcgtctcttcttgtttcaagatctataggaaccacgagaaagagtttaaattttgacccggtaatagccaagatcggacctcaaaatgtcccttccttgaagctggtttgataccattaggcaaaagcacactgcctgagtaattactctgtctgacaggagcaaaggatggtcactggccaactataagttaggtaaagaaacttatctgaaattttatttatgacacagatttagaaatcatttcttttaaaattttattgcattttttccaacacattttcctattggtttgtcttatgagaagcactaatgttaaggaatttctttcttgttcctacaattagacaatatattaattttcctaccataaatgcagttgtcttgcattttaaggtctggtaacaaatatcatacagagctacctatgaattcaagtacatttaggtgacggcatcacagtctatagatggcagggcctgcaataagctagaaaatgactgctacatttgaaaaaaataaaataaataaataaagcgcttaaatattttcctctaaacacaattagagacacatgcatacatctgccaattaataaaaatgttgattttgatgttaatgtacaaaaatcaccacacctaaatctgtcataaatttgtctaaaatgaatattaagatgggacctcagctttcattctagttactgtacttttcatattctatttaaatcaaagtacttagtatgtattatctgaggattatgatacctttagcacagcataaagtgaacatttattgttttaaagcattaactttaggaggcgggaaatgaagaatctgataaaagtgactataaaaaagtaaaaaagcaagtgacttccttcaagattcagtttagggtaatgaaatatatgccatgtatgttctctgaccctttactcatctatataaccaaattttaaattaaccacaataattttataagacagctgaacagtttctacacttttgaactcctgccaagacaagatgtactggaaccaaatttcgcaatgtcagaaagcctagaaagtctttataaagcttagattaacatcagatcaaatttggactcttaaaaggggcttggctattttcaagcttttcccaaaatgatatttagcaagagacaagcaataatccctctttaagcttaatctcagatttaaaatcctttgatcaatcaacaaacacttattgaacacaaaatattttagttacacaggagaaaataaaatctaagtcaaaggaaaaaatagataattttttatcacttcaattctggaactataggctatatgttggttcacttccccaagtatatgctccaagaagcacaaaggttcagggaagaaactgtttatatgttttactatatatataaaataatatgtggaataagatatatgcataagtatacatatttatatgtgtataatcatatgtaaataggtataaatatatataattatgaggtaaaaatgtttgtatactggcatccacatcttttctaaaaaatatttgattataaaacaatatgccataccaaaattcagtgctacaaaagtttttcatttgtcagaaatgtaattgtttatgttatcatttgtaatacctaccaactaattgaattagagggctacataggggtctttgaacaagatgaagtttagtattgtccatatagcaatatcaaattacttaaaattaacagaaaaacaaaacatcctattaattaaataacatgttcaattgattaaataacatgctcaaaacagtctattttggacaacccttatgtgaccagcactatgctaggcactttcatgtgaacattataaattagccttcacaatcacactaaaagtccactatcactattcaaatttttagacatgaatctctacctttcacagataaaaattaagtaaatcaaggtcatatggctaaatagtaggtcctctaaaataagagactaaactctttccattcttttttttttttaatttttttcctagtgagtaggattatcagatcgaggttaagagttgggctctgtatcttcatttcgagttatgtgatttacaacaagttgcttagctctgttttctaatcttcacaatggataatacaataaaatccacattatatgaatgagcttgtgtaatgtgaatgacagtacctgtataataaatcacacagaacatcacagagcacatggcaaccacccaataaaagttagctaatattactacaagttcactctgtgatccttagtgagtcactttgaacagattatagtttcctaatatggccttagcagtagtccacttgctcatatcgcaatgtgaccttgcaacttctccataatatgatctcttatttgtggaatctgaaaaagttgaactcatagaaatagtagaatgatggttaccagaggctgagagggtgggttagggaaaggggaaatgttggtttcagggttagaatttctggtgatccattgcagagtaaggtggctataattaataataatgtattgtatatttcaaagtttctaaaagagtagtttgtaaacatacgcaccacaaaaaatagtaagtgtgtgaattgatgggtatgttaattagcctgatttgctcattctaccaatgtatacatgtattcaaacatcattttgtaccccacagatatatacaattactatttgtcaattaagaataaaaataattttttaaactaaaaaagagagagagagagaacctatgtcttctttctttgaagctgcatgaaactttgtgacagcctcaatcaatacagcacgatggacatgaaatggtgtgttctgcaaagttagatcacaaaatgcaatagtgtctgtgtgccactccttcatctccatctctatctcttcttgctgttggaatccagtcaccatgctgtgagtaatcacaggccacaagtagaggttatgtgtacactttcaagccaacaactccagataggcttccagccagctgccatcatcaactgccaagctaaagcctttgaagtaacaccagcctcctccattgtctcccccattttcatgagaaaccctgagggaaagccaccgagcccaacccagtcactcccagagtaataagagatattattattctgatattatatattatgtattaatgatattatatattaatgagtgatcagtattgttttaagaaactgtttggggatgatttgttacatagcgatagataaattagcataatcaccaagatttctttttcattattttttacttaaaaaagccaaattaaatatatttcagaattagtttgatttacaaatacatacacagtcacagagccgaagtgtattttttttcttttttgagacaaacactcactctgtcgcccaggctggagtacagtggcatgatctcgactcactgcaacctccgcctcccgggttcaagagatttttctgcctcagcctcccgagtagctgggattacaggtgtgcgccaccacacccggctcatttttatatttttagtagagatgaggtttcaacatattggccagagtggtctcaaactcttgacctcaggtgatccgtctgccttggcctcccaaatgctgggattagaggtatgagccactgtgcctggccacgtattttattttattttttctaaatgaatagaccttttaaggatacagagcttcacagttaaatttgatgattaaaaaaatttctgatatgtagaaataaagggggtgacccatcactactctgatgtctggcatacgattatgaacaaaagtgacaaatatgtatcttaagggactgtgggtcttcacagaatggaatccttcttcctaaggccaagagaagagtatttccatcagtaattgccatagtaccagcaattttatgctcttcctcttatggggccagctgaagaaagttctgactcttttaataaagaagacaaggcatgcagtagctaaattgcccagaaactttgatggtaaacatccactcagcggctcagctgctcaggaatatgtaaccaaacaactcttttaacgcataaaactaaaagccaattctcctccaattaaaacatagtacatgtctgaattcaagatgctaattataattgagtttcatcgctcagctttatttataagggctggaggctttcaactgtttcaagaaaaatctgttggacgaaggaagaaaaatctctcagagtggcatttgcttgggtagtatcagcccattctataaagagaagtttactgcattaaatacattgatgaaaaaaatgattttttaaaatatagagctatatgtatattgcaataggcaaactctaattttcacagggaatgaaatgcttttattcattggctatatggaactgtagttcttcatcaggaaagaagcccatgataactctgtgaagtagaatgatgtagaatatcactcttgccagcaatgcagcttttttaaaaagaaaaatatccaaaaacaaaattttaaataagattaaacaaccctaattctatagcaatacatatgtaattatgttgaaaataataacacatttccccgtaatcttaaagaaagcacgttttctgagcaaattttgcaaaaggagctatctagctaatcatcatactgtccgcagagaacaagtcaactcataatcacatactttctcttcctccagttttaaatttttgtttatttaccttttatcatttataagtggatatttattgtaagttggcaaatcatctgtgggtgcatgcatataaaagtaagtaactgaatgtataagttatttaaaatccaaaagtaataactgtaaggctttgatttaccaagattgcttaatagtgttttggatttttcccctggtaataaacaatatgaattacataataaaatatatttgtttaatatttgggccaactttttattattcacagtgcatgtcctagtttgtcaaataggcaagactttatctattttttcttgttgccaggctgatggccatctcggtgtgcatgatgtaacatcttcagtagatggcaaaggaataaagcataaaaacgatttagccccatcagctatttagaggaaggctgtgctcagtgacaatcgagatgactgaagacttttaattatctttgcagtcctcacattacaaatagagtaaaagattcccaaaaggaaggggatccttttgactgccagatgtgggaaggaaagaatgagattagaggatatccttctaaacacataccctgacatgattttctgtcctgctcaggggtcacaaagactcaaatgtggacagaatttctataagctatgcttatcatctgtatttactctggcgggtgcctgtctcccaggagactcatgataagcagcaataattgcagtgtcttgtagacaaaaggatcaaatctctgttctctgatgacttttaagaaatccaaatatatattacaattttttcacttgcttcttatgtgctgtataaaatctcttgctttttgaaatcctggtagcttcaatatatgtttagaaaacatggctttgtagatatgatgcaaagaaaaggaagaggacaataacaacaacaattagcaagaatgtttaatttgccaagtatagtacagagtgttttacatctggctctgctaacctcaaagagttgctctttcacatgaggtgatttaaaatagggtcaagtgttgcttaaggagggggatacattctgagaaatgcattattaggcaatttattctctatgtgaacatcatagagtgcttttacacaaacctagacggtacagcctactacacacctaggctatacagtatagcctacctattgctccgaggctacaaacctgtatagcatgttaatactgaatgccataagcaattataacacaatagtaagtgtttgtgcatctaaacatatttaaacacagaaaaggtacaatataaatacagtataaaagataaaagtgatacacctgcataaggcacttagcatgaatggaggctataggactggaagttgatctaggtgagaggtgcgcgaatataaaggcctaggacattacactactatagattttataaacactgtatgcttaggctacagaaaatgtatacaaaaatatttttatttcttcaataataaacttagcttactataactttttgactttataaacttttaagttttttaaactttttagtttttagattagcactaagcttaaaacataaacacattgtgcagctgtacaaaaatttctttttaaatatccttattctatacagtttaagaattttttagtcattattactattatttacttttaaaactgttttgaaaaactaagacacaaacacacatcgtagcctagaccagggattcataacccccaggcccggactggtactgctctagtacctgtccttggcgtgttaggaaccaggttgcacagaaggaggtgagcagcaggtgagcgagcactactgcctgagctccacctcctgtcagttcagcagcagcattagattatcacaggagtgcaaacactactgtaaactgcatatgtgaggagtctaggtgtgtgctctttataagaatttaatgcctgatgatctgtggtggaacagtttcatcctgaaaccaacccaccctctcccattgccctcagtttgtggaaaaattgtattccacaaaaccagtccctggtgccaaaaaggttgggggctgctggcctagacctctacagggtcagtatcatcaatatctttgtcttccatctccacatcttgtcccactggaaggtcttcgggggtaataacacacatgcagctgtcactttgataacaatgcctttctctggaataactcctgagggacctgcttgaattacagctttttttttttttaataagtaggagtacactctaacataataaaaatacagtatactatataaaaagtgatggaaaattttagctccattataatcttatgggaccattggggtatatgtggtccatcactgagtgaaacgtcattatgtggcacttaactgtaattttgtcaagtggttttttattatttcctttgagctatccttgccttacactttgtgtcaatgatttgagaaattcaactaatcagttatcagataactgaccaagtctccgtcccattaaagtcttaagtgactgcctttgccactaacgtgtaggataaaattttatctgttctacctgcttctctaggctcagtattcatcatgtgtcttttgaaaatggcaggtttcctcctgccacatcatctttgcacatggtgtttcccctgcaaggaattctagccctatcccacccacttcttataaatactctatttacttaactcctgttggttcttcacatcttagttccatcacttcctctaccattctttcttcataatgttcaaattatgataaatatcccattatatactctatatatcaatacatttcaggccatggagcacatatatctgattgaattttggttagaatctgtttcctcctcaagactgaaggctccctaagtacagacaaaaaatgttaatttttcttcactgagttgagtggctggcataatgctcagtaaatgttaataagataagaagataaattaatgactgaagaacttaacatatactggttttagacacgtttttgcttctcaattaactgcctgtgatacaaggagaaaaggttgcctatatctggtcctaaacaatttgcctatatctgctccacagcataacattactttgcttgctccactcaaatctttatgtaattatgtacttgacctctaactggagaggaggtactggtagagaaaggctcccaggggctatggcaaaccaggggcatccttctgagcaaaattgctaggcaaagagtcaaaatcaccatcagagagaaaaattcatagccaggaggtaaacagtatgcatcatatccaattgattaggcaagcacagaaataaaagagtaatgataagaatatcacagaatattacaaagggtacaatttgggctgacttcctaaatcaaaatgatttatatggtgccatatacatttcatcctttgcttcctctctgttagaatagctgtaatatctgagaggagagacatctgaccccacctggaccagtcaggcgctcaacccactaaccacctcaactggtctatgcatgggcatagaccaacgtaggccaagctgaatcctcctctgaaaatttaaaaactcagaataaggtaaatgggctaaataatacaaggccaactaaaatgttaagatgctaatggtcatatgcattcatcatattagaaaaactaaaataaaacaaaataacaccctttctgtggcagaaaataatgaaacaagcattcatagagagaagaaagcgggtgtgtgttatgtgcaaaaacaaaataaaggaagggaaggagaaggtaggtggcaggggcaggaagcttgtggggagaagggggcaggaaggtggtggagagaaagtgagtcagtcggtagatttcaattttccttaattctagccatccttcagccaattccactcctggtcttccaaagattggatgtattatcccaacagatatcctttctcgtctaaactagttgtagttgggttaagagagtacagaaagactgggtagaattcaaacattaattgaggtagtgattcagaactcaggtttgacacatttctgcttaggcagccctctacttccccgtgcatggtcatgggagctgagggcttttgggagggtgaaaaatgttgcattaatgtggtctcaccaggttgcaccatgagaagggatgaaggtagaatattataacataagagaacagaggaacataggcttataagaggctatcttgccataatatctcggagtgctgactactaataatgtgtttagatcataatgaaacttgattaaatttatgtaagcaattgaggtatttttacatgtacactttcatttagcaattcttgtaaaaatcaatgaaaagtaataattttatccacaatagtggcaagccaacaatcatctgaatactcactgctgtatctttatctgtacctacatcttttttggtattgcctatagaaataccaaatttgtatggagtatacatataggcactagagtgtggtttcaggtttcagtcaggtatcgttttgtatctctctctctttctctctctttctttcaaatcctaaggaaaaacaagtggttaaaaattcagagtaggggaaacaactgaatacactatcgtttttattttttatacttaatttataattcaatacaaccatttactgtatggtggagaatggatttgtgcaaataaaatatgataaattcaactttaaaacagtattgttgaacttatttgtttataattttaaaggtatctgtttctgttgttgttgttgtttgtttcttttgttttgttttgttttttgttttttttgtttttgagacggagtctcactctgtcgcccaggctggagtgcagtggcgccatctcagctcactgcaagctccacctcccgggttcacactattcttctgcctcagcctccggagtagctgggaatacaggtgcctgccaccacgcccggctaattttttttgtatttttagtagagaaggggtttcaccgtgttagtcaggatggtctctatctcctgacctcgtgatcagcccgcctcggcctcccaaagtgctgggattacaggcgtgagccaccgcgcccggccggtatctgtttcttatgtgtagtgattgacgttctttttcttcctcaccaatatgtggtcatcatttgattgctgacttccccttcatatggaagccagggataatgacattgcttatacaaaggccccaaaggcctctactcctattcttgaccctctagacttaagaaatcctccaaataggagtcgctgctgttttacacctttaggatcagcccaagacagttcctgacgcaatatgaaccaagtggaaaaagtgtcagtggtgatgatttttttttcaatcgattaattcacacagtttttctataattttcctttaaactgtcatcattttggcctagttaataaaaagtgggtatcaactttagttcctcaacaaatactcctgtttattgaattataaaacagtccagaagctcagcttttgtagcataggccctgatgatctgcctggttcctgttagctccgttttgcacacactcaggtcttgatttccaaagtcccaggcagagaatctactgtgtgacgtcacacttttgaagatggcctcctgcatgaactccctctgtcatactgaccccaccagagtggatatgcacaagcatcaggcccgtttcaaccacactccctttcacagtggagctgagttcatctcaggttctgagacagtccacaccactctctgcctccggctagtcctttgtggtggttgtatctgcaggcctcattttgaagctccctactacactaaaacaatcttaggatatatttatactaaaaaaaattgtttatctgaaatcaacatttaaccatgttccctgtggtattatgtgttaaatgtggaaaccgtaaatgtgactagactgtttcttagaccctatatcatccccagggaagtcatgtccagaatgtgggtcagtaccaaatacacagaaccccttgggcagtttcagaaccttacccggcccaagaaaacacagagatataatgttaaatttcacagtcttgtcctaattatatccttttatcagtaactcacactcaagttttacagaagacttttgtgtactccaggtctcagttttttttgtcaacagatacagagtttcccataggtaatctcaaaagggtcttccaagtcaacattttacgcattccaactaagatgtatttctccctcaaacctcagcatttctgaatagaaaacttgattttatcttgtgatcctaaatccttagatcccatatttccatgtcctcaagaattgagctccttaagaatgtctaaatctgtagtcatgcagtagtgtggtagtgaatgtcactacagggtgatacttatcctgatgacatgagaatattctacattcctcaagtttttttgacagagaaagagcatgcaagttcccattaacataattaacaaaagggagattgtacttacacttgtaaatttccttttagggcaacattgttctgcacatgattacaagtccctactaatagccttgtttgtcccttgccagcagtttagaatagaaactaaaaatttaagcgtgattttcttgctgctctttctaattcttgtatagtcaagggaattatattatttagggcatatatacatgtgtgtgtgtatatatatatgtgtgtatatatatgtatatatatgtgtatatatgtatatatgtgtgtatatatattatatatgtgtatatatattatatatgtgtatatatattatatatatgtgtgtatatatatatatatagagagagagtcacttttctgaataaactacaagcctttgttatttaaatgaaactaacttttaaagactggatccaaaagatcaaaacaacttggagaaaacaaaacaaaacaaaaacctagaggatcatagaaactagacacctgctatcaaatgaatcttagaattcacgtgacacatgctttttcaaatggaaaaaaaagaaatgctctatgtcatttgaaataatatatgagttaagtgtaatatctcaatgactggcattgctaatgttatgaacatttgaaattgagctaccctggtggagttcaattgaaattaggacattaaaatcagacatagatacagacaaagaaagatacattataactttgtaaaagtaaaacaatataaatgctcagtaaaataatgagaacaaagtcaaagaatgttgtgtgtgtgtatatatacatatgtatagagagagttggcatttaatttgatccaatctaagcttctaagaaagactgtactagtatatttatatagtcttcagagaaaacaatgatgcagtataatttctagtgtttaaaaatccaaatcagttaatctaaaataattatgctaataacatggtttaacagagtaagaaacgaatggaatcattccttgaactcagctctcttataaaaagtgataatggcataaggcaatagtaaatatataggagcaagaaaactgaattttttctataccaggtatcaaagtagatgggaagccttaaggtatactagtctgctgggaataaagaaacaagcttcaccttctagaatacagtaaatttggcagccactcttagattgttttgaggagaaatatatagattcagggaattaatatgtccaacaaataatgtctcccctagaatatttgattgccccacaatcaaagagagaagataatcaaaggccgaagatgctacttaatatgaccaggtcacctattacatgcatattaaaccatttaattgacaaatgaagctgtaaggattaagactgaaattatttaaaaatcagtggtctaaaaaggtgaaattaaaagaaaaattaaaaaaaaattaatttgtgcttttcaagaaatggtgaaaatgttaaagaataaacaatattttgaaaaagggactacaaactataaaataggataattacactaatgctatttaccatttttgagcatatattttagtttgatactatcacaataccttacagagtgcatctcatttactcatcaggcatgtttatgaggtagactctgtcatcggtatgtgacaggggagaaatatgttcagaagatttgagccatttgttcaaaatcacctaagaaatagtgaagccatgaataaaactgaggtctgaaatccaagttcatgttgttaactactatcctataccatccatgtaggatacataattgttcactgatgataagctcaagtgtattgacaaatagcaaaaacagagacattggtactgcaaagcagaagattctggatcaaatacaggcttagatgctgaccagctatatgagcatgaataagtcactttacctctctgggacttatttttcttattggtaaaattaggaagccaaaggtgatagattttcacagtgagagtccacagttttttcatgcctccctgtatccacacatttgcacagaccctttgcacactgatgcttgatgtgtgatatggtttggctgtctcctcaccaaatctcatcttgaattgtagctcccataattcccacatgttgtgggagggacctgaggggagataattgaataaagggggcagtttcccacatactgttctcgtggtagtgaatacatctcaagagatctgatggttttaaaaggggtttcccctttcacttggctctcatgatctcttgcctgccaccatgtaaggtgtgcctttcaccttccaccattattgtgaggcctccccagccatgtggaactgtgagtccatgaaacctatttttctttataaattactcagtctcaggtatgtctttatcagcagcatagcaacaaaccaatacagtaaattggtaccagtagaatagggtgttgctgtaaagttacctgaaaatgtggaactgactttggaactgagtaacaggcagaggttgaaacagtttggaaggctcagaagaagacaggagtatgtgggaaagtttggaacttcctagagacttggagggctcagaagacaggaaaatgtggcgaagtttggaatttcctagagacttgttggatggctttgaccaaaatcctgatagtgatatcaaaaatgaggtccaggctaaggtggtctcagatggagatgaggaacttgttgggaactggagtaaaggtcactcttgctaggcaaaaagactggtgacattttgtccctgccctagagatctgtggaattttgaacttgagagagatgatttaaggtatctggcggaagaaatttctaggcaacaaagtgttcaagaggaagcaaaaaataagagtttggaaaatttgcagcctgacaatgcaatagacaagcaaaatccattttctggggagaaattcaagcgtgctgcagaaatttgcagaatttgcataaataacaaggagcccaatgttaatcaccaagacaatggtgaaaacgtccctagggcatgtcagagacctttgcagcagcccctcttatcacaggcctggaggcataggaggaaaaatggtttcgtaggccaggccagggaccctcctgctgtttgctgcctagggacttggtgttctgcatctcaaaggctccatccatggcgaaaatgggccaaggtacagctcagggcatggcttcagagggtgcaagccccaaggcttggcagcttccacagggtgctgagcctgcgagtgcacagaagtcaagaattgaggtttgggaacttccgcctagttttcagaggatatatgggaacacctggaagtccaggcagaagtttgcttcaggagtggagtcctcatggagaacctctgctaggacagtgtggaagggaaatgtggggttgaagcccccacatagagtccccactggggcgctgcctagtggagctgtaagaagagggctgccatcatccagaccccagaattgtagatccattgacagcttgcaccatgttcctggaaaggtcacagacactcaatggcagtccacaaaggcagccaggagaggggctgtaccctgcacagccacagggttggagctgcccaagaccatgggaacccacctcttgcatcagcattacttggatgtgagacatggagtcaaaggagatcattttggagctttaagatttgactgccctgctggattttggacttgcatggggcctttagtccctttgttttggccattctctcccatttggaacagctgtatttacccaatgcctgtacccccattgtatctaggaagtagctaacttgcttttgattttacagcctcataggccaaagggacttgccttgtttcagatgagactttggactgttgagttaatgccgaaattagttaagactttcgggatctcttgggaagccatgattaattttgaaatctgaggacacgagatttgggagggaccaggggcggaatgatatggttttgctgtgttcccacccaagtctcatcttgaattatagctcccataatccccacgtgttgtgggagggacccagggggagataattgaatcatgggggcagttcccccatactgttctcatggtagtgaataagtctcatgagatctgatggttttataaggggtttcccctttcacatagctttcattctctcttgcctgacaccatgtttgacatggccttcaccttccaccatgactgtgaggccttcccagtcatggggaactgagtccatgaggcctatttttctttataaattactcagtctggggtatgtctttgtcagcagcacgaaaacagactaatacagtatgacaccgtgactccctttagtcaatgagaaaatagcaaatatgatacaatcagaggcttgaaaacttcctgcctcctggagcttactctcccttgctgcttttggaagtcctacaacagcatctatttgaataagtctgggctagcctgtacaaaacatatgactcagtcttcctgaccacatcagctaacagccagtaacaaccatcagacataaaaatgaggccctctatgacaaacaaacttggcccacccgccagctgaccgtagccacatgagtgagtccaggaaaagccattatagaataactgctctgctgagttgaatcctaactgctgacagaattatgagctaacaaatgcttgttgttttaagccagggatgcaaaaacttactctgtaaagggccagatagtaaacattttaagctctgtgggccatgtggtctctatcacaactactcaactctgtcattgtagcacaaaggcagccacagacaacaagtaaataaatgagcaaggctgtgttccaataaaatgtcatttacaaaaacaggcagcaaaaataaataaggaaacaaataggcagcatccggacctgatccataggcaacagtttgctgacacttgttttaagccagtaaggtctgggagtgtttgttatatatcaaaacctaactgatactttgatcaagatgagcttattaaaattctgtcattagaagttgcattataagtgaaatcagcattacagtaatctagtttatgtcccgcaaaaatataaagctttcatcactgaatagaataagaaatgcttgcatttctccaaatttattttcaatgcaagtgatcatgtaaaactttgaatatattactaaacttatattaactagaaaaaatataaatataactaaaacttcacgcaatacctttttcatggccctatggagacccacaccatcacacatgcacacatgtgcttacacatgtggacagacacacacatacacacacacagacccaagttagaacacaatttttaaaagcactagttaagtgtgccttaaaatgcattacagttgctaagcaaaattataaaccaagcaatgtaaggagtgttaagaattaaaatagcccttgaaaatgaaaaaaaaaattgcaagtatcttagtatgtgtattattatttaatacaaatttttaaatgtagcccttcataagatatgccagatgtaaatgtagttctaatatgtaagaaggaagagaaagcaataagagaatggatgaggctaaggaacatggtagctctaaagacctggatgtcactggaagctgaatgagactaattttgattcaaatatgtcacttataatttatgcagaatatatcttgaaagaaatccggttaatgttattaactaatggtattatttttactgtaaaattgcactgataacatcaagtgtatttgtgcggcatggggtatggaaagtggataggagagaatgtaaagagaatacttagcaaggactacaatttgaattgagcttgagaggaaactatagtttcaggaaaagcgagaatagcactgcattgcaggctaattttagaaaaaaaaaatctataacctagataagttactgttgcaacccacctaggttaaaaaatttagcgtgtaaagcccattaagaacattctggaagttgtcaaactattgtcagaaaacttcatgaagaaaccagggaataatttctgcctttaaaagtagtcagggggttgggcatggtggctcacatctgtaatcccagcactttgggaggccgaggcgggcgaatcaccaggtcaggagttcgagaccagcctggctaacatggtgaaaccccgtctctactaaaaacacaaaaaaaattaactgggagtggtagcggtcccctgtaatgcagttactcgggaggctgaggcaggagagtcgcctgaactcggggggcagaggttgcagtgagccgacatcacactactgcactccagcccgggcgacagagtgagactccgtctcaaaaaaaaaaaaaaaaaggaaaaaacaaaaaagtagtcagggatggagcagatggagttacaccaacacttttggaagtaggttgaatgatgtaaataaaaaatagatatacaaattataggcacttagtatctcaggaacactagcgtcttgacactaagtgttaagaacaaatttatataggaagcaactatggtttaagcaatgaaaaaaatgtacgttaatgtattattagagtcgtggtttatgaataaaaagatgaattcataatttttttaatggttaagtttttcagtcactgatagcaaatgattgacacctactagcaagatatgagaaagaaagaaaattcttgcccaaggcatttcttggttaagaattaccttacattttaagaataactagagtttatttttggactggaatataaattggtacaatgtttcttaaaacattttggcatgtcttaccaggagtcttaaatgcttatgcatttgatcagactctcttcataatagtaaatataaatgttatgcacaaaaatgttcattaaagtcttatttttttaattgataacaacaggaagaccaacaataagaaaatgctgtatacatttaataaactatctggccattaaaattttggaatagtttctatgctctgagaaacttattattaggtgaatacagtaaaagtgaaataaaaatcacacatatctaatgatcttgtttatgtaaaagatttacttgtagagaaaattttgtcaaaatttatgctaaaaaaatatgctaaaaaaatagtgattaacagccaggtgtggtagctcatccctataatcccagtactttgggatgctgtggcagaattgttggaggctaggagttcaagaccaacctaagcaacatagcaaacccccatctccatctttttttttttttttttttaaataattggctgagtgtggtagtgtgcttgtttagtcttagctactcaggaggctgatgctggagaatcgcttgaacccaggagttgcaggctgcagtaagctacgatcatgccactgcacaccagcctgggcagcagagcaagactctgttgctataaataataataataataataataataacgataataataataatagtggttataacagaggggcagcattttttatttgttatttttaaatgttctaaatttgtaactatgtattatactaatagttttcttagggatttaaatatatagtttcagagaatacgattcctttgacctcaaaaactctaaagtgctccttagtttggcattcaaggctaacaatctgttaccaagtaacttttgatccttctgacactcttcctttccacctaacacagatagattgatctttctatttcatcataagtttgtatttctccagttcagggcttttgctgagttccatttgtacaaaacacctcatctgttactcacattgtctccttcctgtttttaaatcccctttctagtactatatcctctcatcccagaatccctatttaaccacaatgttgaacaactctctcaacggctaccgtctgttttatgctaccttttcaacgctaagtgatagaaacaaacttaaactggcctttacaaaaggggtgaagagggttggctaaatatattcgcccatctagggcagggattttcagtctcagcaacattggcattatttgttgtcctgtgcgttgtagaatgcctggcagtatccctggcctctagccatcgaatgtcagtagcgccctccagtgtcacaatcaaaaatatctccagccactgccaaatatcccctgggacaaaatctctagctgagaaccactgctttaagaggaaactaaaagttcacatgctcaaaccttttgctcctccatccaaaagattttcactccacaagcttactgctgccagccccataccttgaacataccagattaaacactccaggaaaaaaaatgcattgtttaaaataacaactcttgtaagaagtctaatgcaatttctaattgccctaactatgaattaatctatttgatccacgtaagaggacaagcaagggcttgtgtatgtgtatatgctacaatggtgctacatacttagctgataatgagataaacatgtggttcctattgagtaatatttttgtttgtttgtatgtatgcatgtatatatgtgcatgtgtaagttttaaacagtaagaagtgtcaacaaatatacatatttgccctgttctgagggttgctttcatcattatacaaccacctgaggaaagaaaaccctttgatttctaagaaaagagagggtgctctactgttgcttacacttttttctctgcctagtaagactgtaagctgcttaaaggcaagcaatgtgtttttaacattggtgaaggtgggtaccttccagagtgctgtcttgtagaaagttcaagatatagtcctttattaactgtaactttaaaaattacaacataacttactggaactttttaagtcaccgagaataaaatgttctcataatttgtgttttacaaaaatatctacaattctataaaaatcttctgaaaaaagaaaaattatgttctgtaaaacataattctaaaaagtaaacttcaaaaaaattaaaaactgctttaatacttttattaatttttttccttagtaaacgttaaatttgacatctaaacccaagtatgtataatatgacagaaattataagattcaaatagggaaatacagaataaaatactaaatgtaagcttcttgagaggaggaaatacatgttacaatggcgctacataattagctgataatgagattaaaagttgagtcctgttcagtagtatttttgtttgtatgcatgtatatatgtgcatgtgtaagttttaaacagtaagaagtgtcaacaagtatacataaacttatggaaatataattacatacatatatttttaaaatctttaattcatcttccttaatcaaattattaaaaaagattattatatcataaatgttttttaagaatggtagcaatagtttttttgaaaataaaagtttattatgctgatatagcattcatattacaacatatttgtaaaataggatgttataaggcaatgcatctctagttaagggcaatagtctcaagttaagaaaatataatttcaagttgaatttcaaagagtttgaaagcaaactaatgagacttgttgtatatatttttgcttcctataattttacaaagcaatttttatctgtcagagagggctgtgccagatattgagaaagcctaatttgaataagatgttaaatgcagaactgccatacaaaaatcaaaataaaaacctgacttccataccagattttttgatcttcaactccttggaaaacacttcaggctcaataatgacaattaaatttaaatggaagttttcttcagcataaaaaattgtggtattggatgcatgtggagtatatcttgacttgaatgcattatttctttcaaatatacaactagaatatagactattttctgatcctataagaaatgatctgaaatatacattgtacagtttttcctaacattatgtaaattctttgtcataatattttattttacttatttttttatgtttcttttgtagtctggagtgcagtggtgcaatcatagctcactgcagtcttgaactcctgagctcaagtgattctccttcctcagcctcccaggactagaagagtgccccaccatgtgcagctaatagaaaagaaaaaaatgtagagatagggtcttgctatgttgcccaggttggtcttgaacttctggcctcaagtgatcttttgtttcggcctcccaaagtactgaaattacagacctgaaccatggtgcctggcctggacctaacattttaatagataatactaagtgtagagataaaaagtgagccatattttcccatacttgcatttaaaatattttaatatttactattttaaattccttaaaatgttattttataaataattgatatgtttttggaacagaagacaatctatgtacatttgcatttttaggtgttacaaatactatttaacaccagcagatacatcaaatctactgcttatttttgagtaattaaaatttaaagagtaactcagagtctctttatgacttctaagaatctaatggttcaaagaacattgaacttcacaaaaattgcaatgaaaaaatattcttaattatctcaagtgttttcttataaattaataagcatcactaaccaatactgataaattcaattgtttcttttcttttcttttctttttttttttgagacggaatcttgctctgtcgcccagaccagagtgcggtggaataatctcggctcactgcaacctccgcctcccaggttcaagcaatcctcctgcctcagcctcctgagtagctggcattatcggcgtctgccaccacacccggctaatttttgtgtttttagtagagatgaggtttcaccatgttggccaggctggtctcgaactcctgacctcaggtgatccacccacctcggcctcccaaatttctgggattacaggtgtgagacactgcacctggccctcaattgtttcttatatcattggaattcttctttgatttttttttaaattttatttgtctgtatgtgaattctcttccagtctattttctaagcattgttcagtaacaacttcatgaagatgaaatttttgtaccatatcattcatccatttaaaatatgaattttgttatattcacagagttttgaaattatagaacattttcatcccttagaaagaaaccccatactctttaacagtcactcatcatttccccctaatcccttcccagcagtagccaatcataaacgtgctttctctatgtatctctctatatctactggcctattttggatatttcacataaacgaaatcatataatatgtggtctcctttgtgactggcttctttcgcttaacataatgttttcaagatacattcatcttgtaacatgtatcagcacttcgctttttattgccaataatattccattttatagacaaaatattttatttttacatttatgtgttgatggatatttgagttatttctactttttgactactgtaaagagtgcatctgtgaacatttacgtacaaattttggggtggacatatgtgttcatttttcttggatatataaccaggcatggattgctttgttttttgaaaacaggataactcactgttaaacacatagttcttgtatcctattttcttcatgtaattttcattcccttaatagctgataaaaaacctatatattttgttaagagacagcactatgtttcatgcctgtgaaatttgtaaaacataatttaatatgacaattttctctttccatttcacaaatccccctagtgtttgaactcacataagtaatagtttatccactattttcatttgagaacctgtttagggagtcagtaaattaagctgtattcaacttgacatttttctataaacagaaatgtttgcctttttaaaattctaatatatggttaagagaactgagagaataccacacatgtgtgaatttttgaagacttttatcttaacttttaataaatgtctttcttctgtggggtgagcaattgaaatgttgtccatcagtattctgtctcaattcagtagagatgaaaaatgcctgatgtcactgtcaaacatagaaagatttgatgagcaaacccacaggaaaaattggcttttcccagaaatgctctgatgattggcacaatgtgtatgcagctgttttcctctaatttccagttctgatattcagagaagaacttaccttttgcagatgatgtacctgtaatgtgacaatacataatcccacaagggaatatcactaaggatttatgatacacatgagagcttggaaatgcccttttagaccaaatatagttctagcatctgtgtccctctttggctcctcagtttatagatctctgatttcatattgccacaccatggggtacatattagattgtaaatattaattgagtaaataaatgaaggaatattgtgaagaatatatttttccaagcctataagaaaattgttttaataccataatagaaatagggtctttttcagtggccaactacattagatatggtatattagagttagataaaaatttaaagaaagaaaaaagtagtcaagtaccaactaatgtttaacctgactgaagtccaagccaaaaattctgaggcagtagaaatgcatttattttgttaaaaatatcttagggtgattcctaagtgtatatcagaatttctccaaggacatatgcaatccacagtacagaaattgatagaaatagagaatgacttctttattcaaagaaccactaagaagggaatggtgcactaagctgtcagaaaaatacttctgatttctggtgtgtagtcaagtttgtataatcagtattaaatgtcacagtgtagactatggttatcaggtagtagcataccataaaggttaaaacacaatggccttgcttatatcttgatgtactttattgagataatagagcatttttggagctacaaatatttatttaacaatacactgtgcttctttttgaaaacaaaagtttttagctaactcagtgtaacaatagctatgtaatgtagtttttaaaatcctcatgctttgtgtcacaagatggacatactacttctgtttgtatcctcctaacagaatttcattcttgagaaattcatttaatggctgtgggtttctgtttcttcaggtgtaaatgaaagctctgcccaccagttaacctccaaagttctgtccaactctgatatttaatgctcccattacagggaaaacatggaacaaaattagacggcaggtaagccatatgaaaactggatcatttcagacagaaatccaatttgaactgtttattaataacttttgtatgtgacattggggagaaatgaaaacagattgacttgctaggaattccttctgaggacaagggttatagctaacaagtgactgaatcctttggcagttggacactaaccagaagtgctatgacaacaggaggctgtctctaaatatagtgcctcaaaaacgacattctccaaatagtttcctgcaaccattagtgcatataaattcttcgagttaaaaaaggagaatttggtttgcgctagtatgatctaaattgatatttaaattagaagacaagtatggctttggccaaaatgcagacaattttaaaaagacaccaaatgtcctgaatattgggcttgcattcaccacctttcacaaactttgtctttagatattgctcatagttacaaatgtctagtagcttaaggaataatggaacttaattttctttttcattcctcctattgtgtggtgagttttgaaataaagaaaagctattccatttaaatattttaaaataacttagaagctacatttacatttttctgtaactccatttattttctgacacctctccttctaaaatcccttttgtccttaggacattcaggatctagacagcagcaatggaaatgtgccctcaggaataatgacggtggaatagatggtatgggtgtattgtagtgactagggatggagccacaaagcattgaacagttctacctagaaaatttacatatatcatgtaactaggtattgcatacatatttctgagtttatggtacagttaagtaaaagggcttggaaatcagggcactagttttcacatttcaatagggctgctatgtatgtttgtgcaaactcttgtcttcacaaggatagcacatctaaaaggacactgtattacagtgattatagattcccaaattacagcaaaaccttcctgtaggtggcagcgaagtatcttttttctttttacaaaaaaactttaaattctgataatttttctgaaagaagtttcttaagtaaaggaaacttgttcttttcttatttataaaaagataccatatggggtagagaggtccagcatctgagatgtgctattttcaagatctaaacctttagatagtttaacttctttgaaacttaatttcagccttggtcaataagtaaataaattgagagggatgagagagagaaaaagagagagagagaattgatgtacttataaatttatttgaagattaaatcatactacctacacacatttagtactccataactggtattataatcaggtgttgatcatagatagtgttatatttagtatcattttggggaaatgaagggaagttcgattccattattgggatagactaccaaaaaaggggccagtatccattccctctctttcaaggtcaaatagaggtagaaattgctagaaactaggttaagttcacctgtcccagaattgcaggagagaattcttagaagcatttaactaaatggtcacgttaacaaatcagagagatgcagcatagaggcaggaaatggtggagccaaaagtgaagcatgcctcagaaatacatttgtgatgccccaagtggagaaaaatccctgagggacatgaaatgaaagaagagaaactcaaaatcaatatggcacaaggggtttgagagccagtgtaacttgggataattctgaatgagtgactcatttcctctttcaggctacagtgttaaatacatttataagcatttgacaaattttcaggtatcttgtccctttcagttggaccttagtgaccctgtactaatgtttagcacaggattgctggagacacctaatcttctgagaaagtttttacaacaatgccatctggacagatagtaaccatagaaaatgaatattacaaaacagtcatttcaaaaaataatttttgtagaggatctcaggttaaacatatgaacaggccttaatccagccattgctttcatttgcatatttagttttatttgggaaatgtcacatgttcagctcattaacaaatgcatgacacagctacacaatcctgcacattccttcctttctttgatgcccctattatttgcccccaaggacaatgcaagagaaaagtagccaatttgctcattaaaagagaactcagttgaaaatgacaactaatttcagccatttgagaaatgactggatctcagtatgtatagtatcttggtaaatcaagacaaagccattaaaattattgtataaaattaatttgagcaacaagtctttagacaaattcattgcattagcctctaggtacttctataatctaatatcgaaagtcatagtagataaagatatgagttttaaagcctataaaattcactcttgtatatcatacacctacctaattgattaaaagatacatatattgcacctggcatatgcctagaaagtaaattattcttatggctggcaataataggactaatcatgtcagaacagaaggccaggtagtagagaaagtaaagtactcttattgttaaaaaattataggtctaatacttttagaggtgagaaaagccaacccaaattagagttgttggccagatcaccatgactttctctgctcttctttgagtacacaaactatacaaagtttggtacaatcagaatctaaatgtaatgcgagaacatatcagtgggatatggtaaagaataatccaattattttgccctggatacctccctcatggcatgtccaaaggccaggcatagaaggagagtgagagaaaggaagtagcagagggctacccctccaccaggtggcaaagacccctgattcatcatgtttatagcctagttatagctgatctggaggttaatgtctcatgcagtatcatctttaagtcttataaacttgatcttttggtttagtaaaaaaacaacataaacataaaacataaacataaacatacaacataaacataaacataaaacataaacataaaaaaaaaacaacaaaccctgagttgagttataaacaaactgaacaatatataccatctggtgcctttatcccaaatccattttccttacttatttttccaaaataatcttccatcaaaatttggaattttagaagaacaaaaacgacaatgatccagggccagccctgactctcggcaccactagtttagttgtgtaacttaaataaatttctttgcttctctatgtacaagtttcctcatttgtagatgggaataatcatagagcctaacatatgatctaagtttaagataagcatataaactgattagctgagtgtctgatatagaaaattcaataaatactggctaatgtcatgattgtattcgagggttaactttcctgattcttgtataactactgctatctgagttctatccctacagtaaagaaatcctcatgattcaattaatatatgctcttttgtgatatttctgtactctatgtagatcttacctcaagtgtcaaagaatcacctacatagtggagttacatgaaaactaaatccttccccaaggagattctgaggagattctggcaactggcccacaggctgagtgcattagggatactttaaaagagtgctttgaggccgggctcggtggctcatgcctgtaatctcagcactttgggagggtgaggcgggcggatcatgaggtcgggagatcgagaccatcgtggctaacgagggagaaaaccctgtctctactaaaaatacaaaaaattggccgggtgtggtggcggacgcctgtagtcccagctactcgggaggctgaggcaggagaatggcgtgaacttgggaggtggagcgaagagccgagatagcgccactgcactccagcctgggcgacagagcgagactctgtctcaaaaaacaaaacaaaacaaaagggtgctttgatcaacttgtggcctctaggaacaaatatgaagaaagttattaaaaaataatgtttgagaaaataattataacatacttttcatcttccagattttgtttcattagtatagggtagacatatgatagtctatgcctgtccttaataagaaaatacaggcttccacagctttctgggagactgctgtacaaacaaagtggttcaggaggtcctggaggtgagcttgaggtcagtagagggagaggctcagatttgctgcattgcctccctccaaaatcagacaacttctggcttcatctaatttgcacatagtaataagattctaagtaagattccactgcagaacaggaaagaaagaactcatgtgtgtgcctatgtgtgtgtgtgttgctgctccaaaaagttctatctcctgatctaggttttacattttcctcacttagaatataaacacaacaccataaattttcaaatcacattaaactttactactgattcgaagataatgatttttatgccaatccgtaagtttgaatatatataaacttacatcttatcttcatgtgtggtaaaaggttttttttttgttttgttttgttttgtttttcagatggagtctcgctctgttgcccaggctggagtgcagtagcgcgatctcggctcactgcaagctccgtctccttggttcaagccattctcctgcctcagcctcccgagtagctgggactacaggcacacaccaccacgccaggctaattttttgtatttttagtagagacggggcttcaccgtgttagccaggatgatctcgatctcctggcctcgtgatctgcccgccttggcctcccaaagtgctgggctcacaggcctgagccaccgcgcctggccccatgtatggtaaaagtttttaacggaactctgcctcaatcctcacttctctttggataatcaatcataattcttactgttctccaattcatccctccactcttgtcagtagtaagaacatattaacaagtgtagttcaagggcatatgatcatccacatatagcagagcttaactgaaaaaatattgaatgtagaaaatgaggaaaaaatcagatatcaccttcattaaaacagacatgctttttaattacgttagacataacagtttggtgatttaggaaacagaacagaaatgcatgaccctttaggccctagacctgctactagctcataagacttggtcaactgtaatagtcattcatccctgaatgatttcttggtctttcttctttacctactgtaatctttcttcctactagatctgcatgttcacagtatcacttttatcatttcactgataaaactttcggaatactatttaaactcctttgctggaggttggtcatttatatcttactcaagctactttcacgtgtctactcaaccttcattatgtgttcaaaactatttattaggtacctaggtactatatgctagacactatgctagcttatgagcatacagtgcaaaacagaaaaaaaaaaaaaagcctttcctctgagcgacagttaaaatgtcaagctttcagaacactataagggatctaagtggcgtagtcactaagtgtgggtaatctgccatgagtagtcctgaattgatactttcatcattaataccagtgcccttttctagaaatatttgttatcctcatttatataaattcttatcttttaactagtaagaattccaccctattcacagtcctcgtactgacatatagttcatcctaaatcttcagtttttaaaatcctggatctcagtcccttatgatgctatggtaatactatgagaatgatactacattctgtacttaatataatttttattgttaaatatatgtttagtacaataaaccattatatatacataactgctgaaagattcaaataaatcaggagatctagcttgaaaagcctagattttttttgattgtttttgtttaccattgtctccagtagaagtttccttccaaaattacctaaggagttttaacaataaagagtaatgtagttaaatttactagtaatcaattacctgaggttgaaatttttctagattctcagaaacacagttgacaggatgagaagtagatgaagtaggagaaaaatatttaaatacataaacaccacacacacacacacacacacacacacacatgtgagacatatattctaagatgcctaaaagcatagaccatctccaccaaattcagaatgattagagtaataaagatgagttcagaataattaaacaatataaataaatgtttgtgattctcaaagtctattgtgtgtaagaaacacacgaagatcctgttactgggctccactcccagagtctctgattcagtaagtctaggataaaacctcaaatttgcatatttttttgagacaggctcttactctgtcacataggctggagtgctgtggcacaatcagatcatatagcttgctgctgccccaacctcctagattcaagtgttcccccatctcagcctcctgagtagctaggactacaggcatgcaccacaacacatggcaatttttttttttttattttctgtagagatgaggttccactttgttgtccaggctggtcttgaactcctgggctcaagctgtcctctctcctaggcctcccaaggtgctaagattacaagtgtgagccacatgcaccaggccaaatttgaatttttaaaaagttcccaggtgtgctaatgccagtggttcaggaatcacatttgagaaccactggtctagaaagaaacaaattctatatgtaaaccagcacattcatctagcagttttgcttcatttatgatactctaattttcccaagcaaatctgtaaactccttgaagtcttcgtatctccaagaacagcaatctctccttacactaagtgaatattctaatgagtaaataacaaatgaaaagaaacatctgaaaatgagtaaaaacaagtcaacaataatgattaaagttttccagggacttaaataaatatttgagtgggaaatggtggttagtttagatgttaactctaagcataatgtagataccaaaaattatttttcagttgtatcatttgctacatattgaaatcatgatatttagaaaaataaggctggctctcacctttcacagttaatggatgagatgaggtgaaaggcagccagcattctattcatgctttgctttatggaaatgtccaaatctcacctaatatccaaaagctacagttgctcttgtgaagccagaaagtggctgagaagagaatggagtctcaaactatggttcatttaagactaggcattttaatttttttactttgctacttaaacaaaaagttggatgtaatcccaattgaattttagactccatagatgtgcaaaatttagactgagctagtaatagaccatacatatgtaacaagttctgctattttatactaaaattgttgaatcctttgtaatactctgaagtaaaatgactatcatatgaaaactcatcctcattaaattttgaaaaaacctgtttaacacgtactgaaggtcaggactacaattttaaaaatgactcgaaaggttttttaagtgaacatcttgaaattttctagaacaaggattagcattctattgcatttatcatgtaatacaaactattttagaactattttatcatctgaaattcctgagcttatctttcatgattataaaattccaaaaatattgggggcctaagtagttaaaataataaaaaaaaaaaaggtgcaaagtaagcctttgatgaaagcctgtaggaatcagctaattttccaatagataattttaggcttatgaagaaatgctagatgaaacaatgaaagcagtcatggaaagatcatgactttctactctggtagaactgggtttgaatccagactctgccacctaatagctccatgatatagagaatttacttaatatcctttgctctctaaaatgggaatgataacaataaccttataggattaggcagtaacttaattgacatagcacagtgtctgactcataacggatatggaaatgctttttgagaatgaatgttaattgttcaatacagaactttgtatgtggactatgactaaaataggtttgtctgaaaagaaacaaggatactttttcactccagataagtcacttagacaagataagccttcagtcttctaatctataaaatgtcgaggttgagttagatgatttcccagggtacttattttattattctattatattctaaactgctgctctaagaaatttccaatttaaatgatattaagattatgtagcagataaattaccctaatgttagctatgaaatatctgaaggctgtggctctcaaccctggctgtacattagaatcaactgagcagctttaaaaaatactcacatcccccaacttacatagaatattaaagaagtacagctttcacactgattttttttaagttgcatggtgattctgattgtagttaggatttagaaccatcagcttcaaagacagccataaatatgccagctgtaagagaagttaagatcagaagtagcaagaatcccattctgtttcccaggcaaagcataccctgatacacgtgtacctcaaagaaaccttccttgaagtccctcaccaaaactctattctctcatttctatctgtctatcacatagcaccttcaaactcaatttgttcataatcaaattcattttttcattaatatctgttcttttgcatgattttcatttctgttaagaaaacctccattttccaatttttcaagttctattattctccagcttgaaatttaagactttctcttctaccataattcctcaaaacctgcctgcatatgtacacacacacacacacacacacaaacacaactactcaaccaattaatttatattttacatttaaaattatttttctggtaaagcttcctctgaatttcccaaaactaggacacatgtcctgatgtatgtgcttatagctcctggtcctttcatccataagaaatatgaattcagtgttaggtttatttctatgatctattgtttaacatatatcttcaccattagaatgtgaagtccataaaggcaaagacaatgtttttgctatttatccctagaaataagacgaggtcctcaacacgataagaattcaataaatatttgttgagtaagttaactaaagattaaattgtctctttgttattgttatttgcacttatttagttattggtaagtctgagcatcttttattatgtctattggtcttgtgcatttcttctgcgaattagtttcactatggtataatcatccagactcattcaagtccagtaatctattcatcagtaaacagagatcaggtctccattgatataggtgaaattctaactgtctctttggtatcaaaatttacagttcatcatcaagaactgccatataggataaaaactttcatctgattgacctaatatctttaggtttgtgtattttctgaagtaaagtcctttcaatccttatgctttgcaacactacagaattttatgtgtgcagatcttttagttatctgccattctgaaactggttagggtcagtgtgactagaattcacaagtcctatatgttgcaccatgaggaaattgggtctggttctagggcacaggatggactcctattccagttccttctctcatggtttgtgagaccctggcaagctcttagtcttttttctgctcttatttcttaattgaaaaagaaataatttagactagatgcactctctgctcggcttatctctgacattctgtgattattagaattacttacaatttattgttgagattggatttttcctacaaattctgtggagttaggtgtcctagtcttgcatgtacatgtgcacatatttggcactccagcctgtgtgacagagaccccatctcaaaataaaaacattaaaaaattaacaaaaaaataaaaatctctgatgcaaatggttcttagccttaaatattcaggaaaggtgcataagattaaacactattgaagccaatagtattcatatactcaaactactataaaagtttgtttttaatgttaggatcaacctataaacaaaaactgatgtctcaagcatagtagaaaaaccatgtatgtgcatatgatataaaattatcaaagttggaaaatgcttttatttgggaaacattctatcttttttctgtaagagatcacttaatagttttctattgctgtagaaaattactacaaacttagcagcttaaaataatactatgttattatctcatagttcttgtgggtcagaaatataggcatggcttagttggtttctttgttcaggttctcaaaaggcttcaaccaagtgttggctaggcttagtctcttatgaggctcagggtcttccaagctcatttggttgtcaccaggattcatttccttgcagttgtacaactcatgaaaccttgattctgcaaggccaggaggagagagagagagagagcatctgctgcttctagtctcttctctttggaatccttttaaggattccccctgataaggtcacttaaggagacagggaatgtaaggaattgagattcatcttagaattctgcatagcacattcacacatagtctataacataatctgaatgagtcttctatatcagcacttcattttggacactattccaaatggtatgaatgtttaattttaactgctattttgaacattttatgaaagttatgaatatttaattttaactgcttactggaactaaaaatttacttttaattggtctaataactgtaataaatatttttatcagttattaactctaagaatctcttgaaacttagggtcctaagttaaaatgtaaaataacccagtcctccaatatacctgcttttatcacttgcatacgatactgtaagaatacactttttgtaaaacttagcaaagagactacttgttttcacgtgagaaaataaaagtgcagaaagaatatctacaaaacgactgcattttttatttatttttcttttatgttatgaactttaaaaagcattttgtcggggttcagaacatcaaaatgttgcatattcccaagtgcaatttcattctttgtggcaaaacacccataagtaatattttaacatgtgtctaaagttaattattcttatagaaacattacatgatttttaaaaagcacacacagcctttgaagcaaggctgcttgggttgaaccccagtgccatcactaaccagttacatgacactggacatgtttcatattattttggggtctcatctttttttttttttttttttttttgaaacagagtctcgctctgtcgcccaggctggagggcggtggtgccatctaggctcactgcaagctccgcctcccaggttcacgccattctcctgcctcagcctcccgagtagctgggattacaggcgcctgccaccatgcctggctaactttttgtatttttagtagagaccggtttcaccgtgttagccaggatggtttcgatctcctgacctcgcgatccgcccgcctcggcctcccaaagtgctgggatacaggcgtgagctactgtgcccggccggggtctcatttttcttagcaataaagtaagccataataggtaccagactcaataggattatgtagaagattaactttttagttatatttgtttctatacactgagaaagggcctaatagttagcattaataagggtatatatgtgtatgtatatgcatgtatgtttgtgttaaatatatatttatgtatttttaaatccatacataacaattatgcctttcaattctagacttgtccttttgtatgcatgtaccaaataaggaaatcagtaactagctattaaagcacaaagacaaaaataatagcaatattgctttaaaaaatatctgatgtcccagcctgtgcaacatagcaaaaccccgtctctacaaaaaaattcaaaaattagccaggcatagtgatatgtgcctgcagcgacagttactcaggaagttgaggcaggaggattgcttgagcccagaaggcagagattgcagtgagccataattgtgtcatggcactccagcctgtgtgacagagtgagacctcattagaaaataaatacatttaaaaaaattaaaaattaaaaaaaaattaaatctctgatgcaaaaggttcttagccttaaatctgcaggaaagggtgcataagattaaacactattgaagccaatggtatttatatactcaaactactataaatgtttttttgtttgtttgcttgcttttgagacagagtattgcactctctcccgggctggagtgcagtggcaggatcttggctcactgcagcctctgcctcccatgttcaagcaattctccttgctacagcatcccaagtagctggtattacaggcgcccaagaccaagcccgactaatttttttgtatttttactagagacggggtttcactatgttggccaggctggtcttgaactcctgacctcatgatccacccgcctcagcctcccaaagtgctgagattacaggcataacccaccgtgcacagcctacatgtttgttgttaatgttggtatcaacccatacacaaaaactgatgtcttaagcatggtagagaaactagaatgtaaggttagcgaacttgaaaatgcaaaagtaaagttagagctagtaggaaacagctcagcaaataagaaagagaagatagaaaacattgccaataaaaaagatgttttactcaggcgactaacttactggtgaagccaaggagctcattaattatacaaaaaagatggtttctatagtttagactattaaaattccacttttggaccaaaggtaaaaattgacaagggtagcgtcacaattagcatgtggagtgtttgtgctaactgtgatacttttagataaagatttctcaagatctaggcagacagaggcctgggacctgtagctgggtgagtagggccaaaccggcttaaaaccactagcgtatgcaacaggatgcctctacatagcaaaaacctgtacactcatagcaaaaatgaaatgtcttatagcatgtcatattcttcctgcattcagtccccgcatggagactgtttctggttaaatgaccccatgcaccctatgaatctgagtgccatgaaaagtatctacataatgatgccgccattgctactgcatgtatcctaaaaccaggcctctcccctgggagagtagcaaggtgtcaggtggtgccatgagaaatgcaataacacaagctcaaccaggaagcctcatagttccaggtggagtctgttctctcttctactgggcaggattttcttgcttatcctttctgtttaggcttcaggttctgccatattgctatgcactctctctcccacctttgatctcctttcctttcttctttaatacattaactagcaactatcccaatttagaagcattccttaggcaggaaagaaattattgtccaatcgttccagagcgattcttcagccaaaatgaccaacatagtgttttgccagacagagggggttttctctcctaagagacattctgactccaacccctaatttttatttctcctatacatatgttgcatgatttatgttttaagaagtttgaataacttgcaaagcctcaaattcaataatgactagagcaatcctagtcttaagattgggagatgaatatgaatcaattaagaattcaaaaattttttctaaaatactttaaaaattttgaccacaaacctttgttggaagacttggaaacacagaatcaactgcagaaaaaattgggggtggggggtgggtgagggtggggatggtggttaattttgtcttaatcctcttaagaatggaaaaactttaaaaaattaacttaaagcttccataaccaccaagaaaagcaaaatttgttcatattatccagttaaaacgatcatagatttttttaaaaattccatttgttgtacctaattctttgatcaccagctggatcattaatttaaaaacaattataccattgcccattctcaaatataagatgataaacatcagtttattaacttaatgacccaagtaaagaaacaatacaacttagcttttgttttcagaaatgcagaagtagaactcacttataggtcaagtatagcatgaaagaacaaaaatctgcaatatctaaaagtccactacaaataaaatatgatgcacgcaaatgcaggatcctctagaggccaggaaagaacagcaggagaatttgcttaagacatgcagttcttatcctatctaattaaagaattagaagaaaaatgaagcaccgcagtaatgacatgcttttggtatttaaaagcatctctggcatgaaagctttatctctgcctcatttactttacaaattctaaaatatagacatggcaagagcccagattagaattggaaaattaaaaactttttttctgctttttgaagggtttatttcagagatgctaaaattggattatatgaaaatatagcataaattagagaggagtctaaccttgctatcatctgtacttaaaaaaactgactatataatcggcatcaataaggcactcagttgggagtataagatgtagaataaccaagacaaagctccctaacttactccaaattaagatggagagttttttttttttttatttctttttgtttctcttttatattctctggaaaaccaaaggccagtttcaaatttaatgaaaagccttccaggatgggatgagtataagagtctatgctataaagttgaaaggctctagaaatgaggtaggttatacaaagtttgggtagatttattcacaaccttcttatttatggacttattcatatactatgtattattttatgtatttattaacaggatctatgtgtcatttcccccaatttaagaaagcaaggcagcaacttttacacttttgtttcttatgtgtttttcagtgaacatctactgagtgtaaactacagagcaagctccagctgaggtgttggagatgtgcaggggagcacagaggaaaaccctgcttaggttgatgtgactgcctaacatcaaagacaatactgaggcaaaggaggtcccccaaacacctacaatcactatgacgagaaatttgtcttgaaatctgaaagatgagtgaaaataacctggtaggttgcttcccctaccgccccgccatttgtgctaatattccaactggtctttaattaggaaaaagaagagaaaaagaaaaagaaaatgacttctaatatcggaaggttctttattcaacacagcactctaggacattgtaaacaaagggctaaataggaaatcttgccatataatttggcactaaacatttattcaacatgtattttaaagtacttgttatgcatatgaggtttaaaatatagtaaggtacataggatatgtatacaagaaattgtaataaagaatagaataaaatgtatggaaagagaggtacagatagaatcttaagcagtgttcagagaaaaacagatcccttatgtgcagctgctgaggagcggtagggtaaaaagggttatagttaaattttcatatattcatttgtttcagtgaaatttaaaagttggcattttggtcaatttggatttttcctaaatgcttatcatgaattaaaataacaaagaaaatctgacaggatgaccataatacattactgaaattttaatactcaaatcattatccaggagcttccccaaaggtgtgtaaaaataactacattaaatggtgattgtgagtgggtggttgctgctatccacaaactgcatatcagaaggtacccaaaatactgttcatttattcaatagtagtcaatgtatttcttccctcagtactcttctatcctgttccctttgtatgacaggctgattattatttcccagaactgttgacaaagacaatcttaagctgcttcttttactctttttcatactgcaacgatctaaaggaggcattgatgcacatgtaaacccataaatcaggttccgactgaagaaaaagaatgtcagacatttgctttcaggattatggtactacatgagaaagctgtagttgtatcacagtgcagcttaattctggaaagcttctcttttactttcctccatatgtttaaaaattacagattccaatgacatacattataatatatgcatagagtaagaaattaaggaattatattattgactcctgcaataggttaattttccttacattatttttatttttggttttaattaaggagagcaaaggagatgtgttatttaaaaatgcatttatagctgacatgcattatgtttaggagacaaaaagacaacagaagcattctccagataataaagtataataaataagtgtcaaggtcatgaagtgtcattgttatttgggaggaattattgttaattagcatcataattaaataaaaatatttcaacaaaggaagtacacatgcaaaatcctacagatactgttgaatataaaataaaccctcttgatctagaaatgctaggctaaagctagagaactgtttgttgtttagctaatattgacccatctaacagtctgaccttcctttttttaaaaacaaattccattgtttagagaatctacacttttttttttttttttgctccttactggtaatttctttaagaatgagcatatagtgagattcctcttgagatatgaagaaaaacttcctaaggggcttctgagaaaggtttcttcagtgataaatagagactcacagacagatggggccttttctcttccactgaacactagagtctccctgggtttcctaaaaagagcagccatcatgcagtcaccaggagtggcagctgaggacaaagtcaaccagatgcagaggcaaagtagaaagaatatgtagtagatggaatgatggtctcaaaacatggtcaacatcctaatccttgacatcctaatccttgaatgtttgaatgttgccttatagggcaaaagaaacttttcagagatgattaagggaagatattgagatgggaagatgagcggagattatttgggtggaccctacatataatcacaagtgtttttaataaacagtggagcaaaggtagattttaccatagagaggagaatttaatgtgatagaagcagagagagagacttgaagatgctacactgctggctttgaaaatggaggaagaggccctaagccaagaaacgcaggtctagattctgggaacagaaaaggaaccaaattctcctctacagtctcagaagggaaagcagccctgaagataccttcacttcacacagtgaaacttatttcagacttctggactccaggactgtacaaaaataattttgtgctgttttaaggtattaggtttgtggaaatttgttgcagaagccagaggaaactaatggagacgtaaagaaaatttgaaagagccactgaattaatgcaccttggagccactcatttatagtactgataagtgcaccggggaattatctgagtggcagtgatggctgttttctacagtaaagatctggttaatgggtttacatttttgctgaagttactggaccttctaaatttccatgcactaagtagccttagagtaagctctccattattttaagtaattttggtccctatattatgaaaagttctaaggcgttaatcctaacccaggaaaaatgtaaatcattcatcgtaattttattataattaatcctgaaagctatcctcataaaagacagcacattttcaattgcccaagtaaaagatactgaggagacatgttgaatctatttttctctcacacttcacctataatctgtcagcacatccttcagctccgccttcaatgtctctgaaatcagactacttgtctctcccctttcttaatgccactatcctagtccaaaccaccttatagtgttagccttcagctgttcttcctgacatcacccttataaaaatatatacaatggatcatgttattctgctcaaaaccttccaataccttctcatttctcttggaataaaagcaaaagtctcaaaaattgtctacaaagatcatatgatctgtacagcctagatatcagagtgaagaagacacaagctaagttcagaagactgacccaaaatagcccacagaaaacatgtaacataagagaggaaccaactgttatttttgggcaatcttagggttggttgctacccaacaaaatctagtgaaatcaaatgaaatatgtcaaaaacatcccttttttgttcttttttttaaccacctgaaatcatacactaattaatttatttaactttccggcactctcctgatgaatgactgtaggatttttctgtttttttttccactattttattaagcccccaacacataaaatacagtttcttccatttaatgttactgaatgaggaacacttaatgagtgttataatgtgtgtatataaattaatgttacattagttagtaagttacataaaagaataagtcactacaaataatggccaatactacccacttttgtattccagatgatcgtttacagtaaaatgttcattcaatatttgttgaatgaataatttctcataaactggacatataaagcaaagaataggaacactgtgaaggaagttttattgatgtcactttaaatattataatttcagtagtataaccaggatcatgcagataatggctaatacagaatttcattcttgaaatctctggccttgaattctttatttactgcttccacatcaaaattaagtacacaactagaaagttcaagaaaaaatattggggttttcctgaaagaggtatagaaaaaaaattggaaaaatctgtacttcattatcttgtaaataatgattctttttccttagactaatatgcagttttttctctgtatatcaatttaaaaacagacacacacattagaaatggacattgtttcaagttatacagaattaacaatgttttagaggaggagatccagcatttgatattatttactgtagattcttcagaaacaaacaaacaaacaaaaaggctaaaaaagtaaaacacgtaggatattaaatcatgttagaaaaactttattcacacttgctccatcattaagtttaggatactccttgggagtttatacagtctaacagtaagataaaaggaagtactccattataaagtgggcagtaactttatgaatcccctttctccccatgatggcaaaagcttaaattatacatccattttccaaagtttgggaaaattcactgttaagttatactccttggggatgttttgagatgtaattctagccttcattggtggaaagaacagccacttgtctccagagtgactgctgatgacttttgcaaagacaccaaggtgagacatggagttagataggtcttactactgatttgttgaaatgttcttaagaacagcaaggaataaatattgtgggcaaaatgttttctgcatttcttactgtggttgctcagtaatatgccttctgcaaacccacaatttaaatgtgtgacagattttcactgattttccattacttatggcatattctgtaataaacattgagcatgacaagtgtccaggaatctacaaagttctatcgacattattgcaaaatatatgaaacatttggctgaattggtgtcttgattggaaattggcaatatctcatttttatattggttgtttcagtaaacactgcccaaaaacctttttcccccaatttcccaagtttattgataaagagtaagagagataccagccaggctaaacctcaaatgagttgataatgttcagtggttctgagtacaatgagatgttcatctattgaaaatacaggaagaaaaaaattccattaagataaaatatctaatttggaaaaggcaaaaagatggggaaaagagtcacattattgggtggttacaagctaaagcataaaaaccattaaaaacaattattttatgtggtgctttccacaatttggacaatgactgtaaatcaagtcaactcaaaagccttatttttttcccagaaaacatttgcatttttaactgaaaacagtcaaactcctaaaaaatgactgatgtatccatttgttttgattttatgcatacatttctctggacattttcttatctcattagaaaattctaaatatttatagttggaaaagacctcagagactgtttaatctaacctctactttacagagataagcaaataggctcagaatttctaagaggtaaattatgtagctagaatgtatcagaaattaggtggattgtaatttctgtcctttcacttcaggccagtgctattttctcttcactttaccaactatctttgatatctgtaacctaaatgacaaattaaatgtttatttactgatactaaatggagtagcaataatggaaaataggttttggaacgccacgtttgtttattgtatggtttgacatccatttgttttccttaagaataaatataatatcaatttaccatagtaagttcttctagtcagatggatttttctcaatacagttatggtgatttaatacgacatactgataaaagaggaaaacttaatcgttgaacatctttacaaaaacagttttggtctttaatcattgttgaaaatctctaaaggatattgtatacatggattgccttaatgtctatttttgctttactttagcacacacacaccctttaatgttttgtgctatgtgctcctttttcctaaaaacaaagaccatcaaacaattctggatattttaagatttcggttaacaccaattaaagacataaaattagtttcattgctaaaagagcaagagccataacacctaagcttcagtttcacccaaactataggtgattttcaaatttattaaaacctgaggtgattgcttttagcacatggagaaattaccaagaatatcaactaccatcattgttagagaagtagttgttcaagtatttgtgataagccaaaaacaacaaaactaaatcagtcccagctccaccagtttgagtaagacctgctttctcttaggttctccgattactcccttctctgtgattacacagcattcacatacttttattaaatatcttatttgtttacatcactctctgtttccttagtatggtaggcagaatggtccttcaatatatccatattctatttcctgggtcttgtaaatatgctactttacatggcaaaaggaattcttcagatgtaattaaagtatgaactttatgatattgacatcatcctacgttacccttacccgggtgggtccaatctattcacatgagccttgaaagcagagaactttccctggctggagcagaagagatgtggcagaagaagtcaaatttgaattgtgtgtggggctttctgtacctttgctactttgaagatggaagggagagcaattaacggcttcctcagatctcagactaactgtccacattgaccaagagaataatcttcattttctcagtgtaaggttccttacagacagtgattctaaaggacagacagaaccacatggcaacataattacacaagtacacaactatttatcaccactaaacatgaaccacagatgggagaaagcacaagattatgcccataaagatgattcaaagtatacacaatcagctaatttaatattagataaagtattttctattcaattgcattcttgttctgtgtaaaaataacgtctggattctttaaatttctatttactgcattaagtaatattgaaaccaacccaatagtcacataagtagttcttttggataaaaatagaaattgacccttctggtatcaaagcctgaaacttatattcgttttatctgagttccttcttcaggaaaggacccccctcacccagccatgcctctcaaaaagcatccaagaactgagactcaccagatcactcacttagacatctcattttgtttccttaccccaacctaatttgtattttctaacacatggttaaatttcttctctgctatataaacccctaactcgagtcagttatggatctggagttgagactgatctcccatatccttggctgcagcacccgattaaagccttctttcttgtcaatactctactccttgcctcagtcattggctgtctgtgcagtgagctgcaagacctagattgaaccatcagtgtttcaataacaatgtcattggcacaggaagggacacctcaggtatctgggagtgagatataagtagctcagcctctgcacaatcctcagtttactgtagtgaaattccaggcatggttttcactgtcattgcttctgaggtagcaaaaataaatataatgacgattgacctctcttagattgtttcttttttcttaaggttttgttgaccacttcaggttctcctgaattcactagatttattgattttatttctgtaattaaggttacaatatttcccattcttcattagaaaagaagagtttgacaatgcccatccacttcaaacagtgctactcatactttttgattgataagcccctaataacacagtatggtaaatctgagtttccagggaacatagagcacaaatggagaaagtctgcatcagaaattttatatatatatatatataaaatatatatatatttttattatactttaatttctagggtacatgtgcaccatgtgcaggtttgttacatatgtatacatgtgccatgttgtgtgctgcaactgcatgagaaaactgaattttatttttaatttaatttgtggcaccatctataacattatttttttaagtatttgaatcatataaataaaaataaattacaagaaactgtaccattttgtccttcaattttgtatatccctttgcacaccaagtgtgggaggcatagacttagactatcttctttcacttgcctcatgattctaagaaaaagcagaggttaggcaaacatactctgtttggcctgggtttttcttccagcaagtatttcttccagtagggaaagtgaattcccagggtgagcctgagtaacagtgatgcttagagtttagagatggcacatctctgtaatgagttgtgtttttttttttttccctaaaaatatgcaagttgctggtgtacactctaggataaaataatgtgtgaatacagaaatgaatcaataatcactcaatttacaaatcatattcatatggagtaatgtgactaattcttggctctgtactaaaagtaaaactatgagtttcaactctagctctttaattacagctactggaaaatgacaggaattttggtacagtaagtatctgcttgaatgtttacttcggattatgtcagctctagtccaaccacttgcaaacatttcagacatagaaataaggcatttccaaggcacccttcatattaaaaagctctgctactatggtggctatttcctatggcatttctaaagcaacacgtctaaggaatatgggcatttctacctgtaatgatccaaaatatcagacagaaaaagatggttcccaagagtaacaaaatatatgcaaaacatagaaattggcagtccaaggttatcctttaatttggaggcgcttgcattaaagagaaaaacataaaataataaaaacatatatcatgaattttctttttcatcactactaaatcaaacaacaatcttctttattttctgcaatagttcttaataggtttttaccctggcagggaatgtaactgcttgttccctaaaatagaaatcaggttgcctcgcctgaaaagttaaaattaggaatgcattacaggttccaataataatatattgtaaaagatccattactcaacaaaggaacctatttgccaaattagagttccattggttccaattatagtacgatatgatccttgccaagccatgcattcaatttccaataacgataaaagaatatgttagagttaagttcaaagagaattcttgcagactgaattttaaaatgcatcttttcattctgctgatgcacactcatttgtttaatacttttcacttaattgccatcattctcagacaaaaatatttagtttttgttatcacacaataaataaaatgtgaagatatagacaaaatacaaggtagacccatttcccatgattgtgatgccttctttcaaagaaatgaaaatttacatatatacatatataatatatacacaggtatgtatatatttagcacagtctgaaagacataccatatctaacaaatataataataattattattgtcactgaaaggcattctctactagttccatgacatttaatttctaacttgctttataaggctttgtatatttaagcactgaaaatagagaccagctgtttcttgaaggcactgagatatttttaattatattttgcccatctagttcattgattagaaagtacctagaaactttctcaatgcttagtttcttcatccgtaaactaagctgaaatagaagctacctcactgtcactacattattaagctaattaatgaatacatgcattgccattgtagagtgtctgataatgtagtaaatgttcaattaagtgttggtcactaacttttctgggattactattttacatttgtaaatgtaatatacatttatattttttaatattcacattttaaaatctatttttacatagtaatttcacactcaatattgggtagaactactattatcatcatcaacaatggataatcattgagaacttattaactgcagaatattttggactattgtctatttttctaacttatgagttataattgtcagaaatctgtaatgtgtgtgctttcaatgccagaatgaatatgacaaagaacttccctggaaggcaagggactgagatgttaatttcagctaccctataaactagctgcatgattatgaaaaagatgttaacatctgtagaatttataatccttagatgtaaatggagaccttgaatgtgcagatctttctagaaatgtgtgtaggaggtttttgtcaggtcaaggtccttataagggaagaatactcacttcctgaaggtaaattttacattataattgctaagcagaccttacattggccaaggcagtgctctctcaccctgtagaccatcaaccccattaggcaattcatcagaagattggtaggcctggagtcactacaggtcataacagctggtttttatagctggaagcagatacatttagaactgataatacagtcaagcaaactaaatatttgcatatgaatggtaaggcaaatactcgtggaaatagtttgtatctttacattgctataatttatctctatcactgatgctttttcccattaaatatattaatgcataaagtaactcacaatcaaatattgccagcccagtgtcattgctctcatatagaaaacttggtgtactaatctgactcactatgtattcattttataatatatctctgaaaggccaatcttatattcattgcactaataaatcctatacattgttaaaaatctctaaaataattcccattttaaaagtttacaattctaaatgttaccattccatcctgatagtctgtatcaacagctgattaattgtttgataaacataagtagtaagaaaacaacaacaacaaaaaagtaaaattcacgtagtatagtttatagttaaaattctaatgggaagatttgctggcaagatggccgaatagggacagctccggtcttcacaacccgcagaacaggagattccctctggtgcctatgccaccagggccctgggtttcaagcagaaaactgggcagccatttgggcagacactgagctagctgcaggagtttagttttcataccccagtggcacctggaatgccagcaagacagaaccattccctcccctggaaagggggctgaagccagagacacaagtggtctggctctgtgggtcccccctccaccacccggagcccagcaagctaagatcctggcttgaaattctcactgccagcacagaagtctgaggttgacctgggacactcaagcttggtgagggaaggggcgtctgccattgctgaggcttgagtaagtggttttaccctcacagtgtaaacaaagccaccaggaagtttgaaatgggctgagcctactgcagctcagcaaggctgctgcagccagactgcctctctagattcctcctctctaggcagggtatctctgaaaaaaaggcagcagcccaggtgagggacttatagataagacccccatctccctgagaccgagcacctgggggaaggggcggctgtgggtgcagcttcagcagacttaaacattcctgcctgatagctctgaagagagccatggctctcccagcacagtgttcgagctctgataagggtcagactgcctcctcaagtggatcattgacccccatgtatcctgactggaagacatctcccagtaggggctgacagacacctcatacaggaaagctctggctggcgtctggcaattgcccctctgggatgaagcttccagaggaaggaacaggaagcaatctttgctgttctgcagtctctgctggtgatacccaggcaaagagggactggagtggacctccagcaaactccagcagacctacagcagaggggggtgactgttaggaggaaaactaacaaacagaaaggaagagcatcaacatcaacaaaagggacgtccactcagagaccccatccgaaggtcaccaacatcaaagaccaaaggtagataaatccacaaagatggggagaaaccagcacaaaaaggctgaaaactccaaaaaccagaactcttcttctcctacaagagattacagctcctcaccagcaagggaacaaaactggacggagaatgaatttgatgaattgacagaagtaagcctcagaaggtgggtaataacaaactcctccgagctaaagaggcatgttctaacccttcgcaaggaagctaagaactttgacaaaaggttagacaaattgctaactagaataaccagtatagagaagaacataaataaactgatagagctgaaaaacacagcacaagaactttgtgaagcatacacaagtatcaatagccaaactgatcaaggggaaaaaaaggatatcagagattgaagatcaacttaatgaaataaagcgagaagacaagatcagagaaaaaggaatgaaaagaaatgaacaaagactccaggaaatatgggactatgtgaaaagaccaaatctacatttgattggtgtacctgaaagtgatgaggagaaagtaaacaagttggaaaacactcttcagggtattatccaggaaaacttcaccaacgtagcaagacaggccaacattcaaattcaggaaatacagagaacaccacaaagatactccttgagaagagcaaccccaagacacataatcgtcagattcaccaaggttgaaatgaaggaaaaaatgttaagggcagccagagggaaagcttgggttacccacaaagggaagcccatcaaactaacagcggatctcttggcagaaaccctacaagccagaagagagtgggggccaatattcaacattcttaaagaattttcaacccagaatttcttatccagccaaacaaagcttcataagtgaaggagaaataaaatcctttataggcaagcaaatgctgagagattttgtcaccaccaggcttgccttacaagagctcctgaaggaagcactaaacatggaagggaacaactggtaccagccactgcaaaaacataccaaattgtaaagaccatcgacactatgaagaaactacatcaactaatgggcaaaataaccagctagaatcataaagacaggatcaaattcacacataacaatattaaccgtaaatgtaaatgggctatgccccaatttaaagacacagactggcaaactggataaagagtcaactcccattggtgtgctgtattcgggagacccatctcacgtgcaaagacacacatatgctcaaaatagagggatggagaaatatttaccaagcaaatagaaagcaaaaatagcacgggttacaatcgtagtctctgataaaacagactttaaaacaacaaagatcaaaagagacaaagaagggcattacataatggtaaagggatcaatgcaacaagaagagctaactgtcccaaatatatatgcacccaatacaggagcacccagattcacgaaaccatttcttagatacctgcaaagagacttagacgcccacacaataatagtgggaaactgtaacaccccactgtcaatattagacagatcaagacagaaaattaacaaggatattcaagacttaaactcagctctgaaccaagtggacctaatagacatcaatagaactctccaccccaaatcaacagaatatacattcttctcagcaccacatcacacttattctaaaattaaccacataagtggaagtaaaacactcctcagggaatgcaaaacaatagcaatcataacaaacagtctctcagaccacagtgcaatcaagttagaactcaggattaataaactcactcaaaactgcacaactacatataagctgaacaatgtgctcctgaatgactactgagtaaacaatgaaattaagacagaaataaagatgttatttgaaaccaatgagaacaaagtcacgatgtaccagaatctctgggacacatttaaagcagtgtttaggggaaatttatagcactaaatacccacaggagaaagcagaaaacatctaaattcgataccctaacatcacaattaaaagaacgagtgaagcaagagcaaacaaattcaaaagctagcagaagacaagaaataactaagatcagagcagaactgaaggagatagaaacacaaaaaaaaaccttcaaaaaataaattaatccaggagctgttttttataaaagatcaacaaaatagatagaccactagacagactaataaagaagaaaagagagaaggatcaaatagatgcaataaaaaataataaaggggatatcaccactgatcctacagtaatacaaactaccatcagagaatactataatcatctgtaggcaaataaactagaaaatctagaagaaatggataaattcatggacacatacaccctcccaagactaaaccaagaagaagtccaatctctgaatagaccaatacaaagttctgaaattgaggcagttattaatagtctaccaaccaaaaaatgtccaggaccagatggattcacagccaaattctaccagaggttcaaagaggagctggtacctttctttctgaaactattccaagcaacaaaaaaagatggaatcctccctaacttattttatgaggccagcatcatcctgatgctgaaacccggaagagacacaacaaaaaaagataatttcaggctaatatccctgatgaacattgatgcaaaaatccttaataaaatactggcaaagtgattccagcagcacatcaaaacgctcatccaccacaatcaaggtggcttcatccctgggatgcaaggctggttcaacatatgcaaatcaatatatgtaatccatcacataaacagaaccaatgacaaaaaacacatgattatctcaataaatgcagaaaaggcttccaacaaaattcaacagcccttcatgcaaaaactctcaatacgctaggtactgacggaatgtatctcaaaatagtaagagctatttatgacaaacccacagtcaatatcatacagaatggggaaaaaccagaagcatttcctttgaaaaccggcacaagacaaggatgccctctctctccactcctattcaacatagtattggaagttctggccggtgaatcaggcaggagaaagaaataaacagtattcaaatgggaagagaggaagtcaaattgtctctgtttgcagatgacatgattgtatatttaggaaaccccatcgtctcagccctatatctccttaagctgataagcaacttcagcaaagtctcaggatacaaaaccaatgtgcaaaaatcacaaggatccctatatacaaataatagacagagattcaaatcatgagtgaactcccattcacaatttttacaaagagaaaaaaatacctaggaatctaacttacaaggtatgtgaaaaacctcttcaaggagacctataagccactgctcaagcaaataagagaggacacaaacaattggaaaaacattccattcttatagataggaagaatcaattcatgaaaatggccatactgcccaaagtaatttatagattcaatgctatttccgtcaagctaccattgactttcttcacagaattggaaaaaaactactttaaagttcatatggaaccaaaaaagatcctgcattgccgagacaatcctaagcaaagagaacaaagctggaggcatcacactacctgacttcaaactatactacaaggctacatcaaaacagcatggtactagtaccaaaacagatatatacacccatggaacagaacagagacttcagaaataacaccacacatctacaaccatctgatctttgacaaacctgacaaaaacaagcaatggggaaaggattccctatttaataaatggtgttgggaaaactgaataggcatatgcagaaaaaactgaaactggatcccttgcttacaccttatagcaaaattaactcaagatggattaaagacttaaacgtaagacctaaaaccataaaaaccctagaagaaaacctaggcaataccattcaggacataggcatgggcaaagacttcatgactaaaacaccaaaagcaatggcaaaaaaaaaaaaaaaaaaaagccaaaattgacaaatgggatctgattaaactaaagagcttctgcacagcaaaagaaactatcatcagagtgaacaggcaacctacagaatgggagaaaattttggcagtctatccatctgacaaagggctaatatccagaatctacaaagagcttaaacaaatttaaaagaaagaaaacaaacaaccccatcaaaaagtgggtgaaggatatgaacacacacttctgaaaagaagacatttatgcagccaacaaacataagaaaagaagctcatcatcactggtcattagagaaatacaaatcaaaactacaatgagataccttctcacttcagttacaatggcaataattaaaaagtcaggaaacaacagatgccggagaggatgtggagaaataggaacacttttacactgttggtgggagtttaaattagtacaaccattgtggaagagagtgtggcgattcctcaaggatctagaactagaaataccatttgacccagcaatcccactactgggtatatacccaaaggattataaattattctactataaagacatatacacatatatgtttattgcagtgctgttcctagtagcaaagacttggaatcaacccaaatgcccatcaatgatagactggataaagaaaatgtggcacatatacaccagggaatcctatgcatccacaaaaaaggacgagttcatgtcctttgcagggacatggatgaagctggaaaccatcattttcagcaaacgaacacaaaaacagaaaaccaaacaccgcatgttcccactcataagtgggagttgaacaatgagaacacatggacacagggaggggaacatcacatgctggggcctgtcgtggggtggggggggctaggggagggatagcattaggagaaacacctaatgtagattgcgggttgattggtgttgcaaaccaccatggcatgtgtatacctatgtaacaaacctgcatgttctgcacatgtaccccaaaacttaaagtataataataataacaataataaaattctaatgggaaaaatggctagtaaactttctaaatagttctcattatttttcctgtcaccacacagagcaaagtttttcaaatatgcgatacaatatatagaaactaaggtaataatgagagtttaacctaatcaatcgagtttaagttccccaagcagtttctcaataaaagttagtaataattaaaattaagagcctttaattgcccagttttccataagtatatgtgttgctctttatatccaaccagagtctcaaaattctatgttgtcttgaattcacttgcttcaagtatcaacagctcctcattgagctaatttgtgatacaatgtgtgtattctaaatgaactcagctgtactgtttctgtgagttctagtattatctcattggcatcctaattataaatctgctattattcatttttctcttatcaaactatgtttatacaaaaataataaaaccctacggtagaaacacaagcaattcattttgtattgattcatactatttgaaagtgtttatggggtacatgtgatattttgttagatgcatagaatatgtaataatcaagtctggatatttaggatatctgtcactttgaacatttatcatttatatttgttggaaacatttccagttctttattctatctaatttgaaacatataatgcattgttgttaactatagttaccctactttattataaacatgagcacttattccttctatcgaaatgtatgtttttaccaattaaataacctgttttcatccaccaccaaacatctccacacacacaaatccttcccgggatgtaactatcatgctacctccatgaaataaacatttttagctctcacatatgagtaagaacatatgacatctgtctttctgtgcctggcttatttcacttaacataatgacccacatttccatccatgttgctataaatgacaggactgtgttctttcttatggctgaatagtattccatcatgttttctttatccattcattcattgatgggtacttaggttgatttcatagctttactattgtaaatagagctacaatatacatggaggtgaagatatctctttaatatatggctttcttttccttcagtagtgggattgctgcatcatatggtagttctatttttagttattgtttgagaaatatccatactgttttccataatggatgtactaatttacattctcaccaacagtgtataacagttcccttaaatactggatgtaaaagatacatccttgccagcatctcttattttttgtcctttgataatagccattctaactggggtagaatgatatatcattgtggtttgggttggcatttttttaatgtttggtgatgctaaacgcttttttcatttaattttgtgccatttgtatgtcttattttgaaaaatatctattcatatcatttgccctgtttttattgggattatttgatttttgttgttgaattgtttgagttccttgtattctggatcttagttccttacaggatgaatagtttgcaaatattttttctcattcaacaggttgtctcttcactttcttgattttttttcccttgctgtgcagagtttttagtttaatatagttttatttgtctatttttgtttatattgcctgtacttttcaggtgttagccataaaatctttgcctacatcaatgtcctgaagtgtttttcctgttttcttatagtagttttgtaatttcacctcttgcatttaagaccttaatctattttgagttgacttttgtatatagtgagagatagcatctggcttcattattctgcatatggatgtccaatgttcccagcatcatttattaaagagaatgtcattttcctaatatatattctcagtatctttgctaaaaatatttggctataaatacataaatttaattcttggttatattttccattccattagtctatgtgtctgtttttacaccaacaccatgctgtcttgtttactgtagctttgtagtatattttgaagttaaatagtgtgatgtcgccagctttgttctttgtgttcaagattgctttggctatttggggtcttttgtggtttcataaaaatttaaagattttattctatttctgtgaataataccattagtattttgatacagtttgcattgaatatttgcattattttgggaggtatagtcatgttaacaatattacattgtctgattcattatcatgggatgtcttttcatttgtaatctttccaatttctttgattactggtatgcagttttccttgcagaggtttttcacctcctcaagcagttcgtttctatcattctttttatagctgcattatatttcactgcacagaaatatcagaattgtgttaaccggttttgtctgtcactgggcggttagactgcttccaactgtttactattataaaaatgttgcaataaatatccttatgattaaaattattacatacttgtgtgaatatattatggggcaaaatcctaaaagtggaattgttgggtctaagatatatactttattttgatatataaagccaaatttttctcagtgtattttatcacctcactctcctatcaagagtatatatgggtactagttttaacaaatcctaagcaactcagcatccttttcaaatgtactcagagatgacggatttcatctccatattgatccttcaaacttctaaacaattgaagagaactaaggatgaaaaaatatgtccttttaatttttccacttactttctttctccttttcttattttcttcttcacttaaaaaatggcttattaatttcataaatactattcctttgaaacccaactgatttctttcttccttttgtttttttgttttgttgtgttgtgttttttgaagacagagtctcactctgttgcctaggctgaagtgtaatggcacaatctcgactcacttcaacctccccttcccgggttcaatcgattctcctgcctcagcctcctgagtagctcggactacaggcatgcaccaccacatccagctatttcttttttttttttttgtatttttagtagagaaggggtttcaccatgttggtcaggctggtttcaaactcctgacctcaaatgatctgcccacctcagcctaccaaagtgctgggattaaaggcatgaaccaccacacctggcgccaactaatttctttctgacaacagtttcttcatctttttcacaatcaacactatcctctctttatattttataaatatagatatatacatatgtgtctgctacgataaatttgacgtcaatttaaacaaaaaaattagaactatttttaaacgaagaaactttaagaagggcacaattttgcaggctacgcagtatttgacaacatttttggacaacatttgtgttagcaccttatcacttggtatcactgattctgtcacttttcttttgttccaaaatgtgcagcatgtcataaaacttttaatgaaataatatgttcagagtttattactttttgagataactggagatcccctgaggtatcatacaatcaaagctgggaactcttcctcacaattggtaaaatggtgttttattaaccaattactctctttttggacacacgaacaagaagcctttatggagacttaaaatcatgtaagaatagtgtaaagcaataaaatccatgtccaactcttctcatttgtttcagggacaaactgaagattctaaaaatggtatgaggagaaatgtatgtagcatttaagagaaaagccagtaaaagaaaaagattgttcattaatgtacatagcaaaagaaatatcaaggcaaaatataccttctcttgccccctgccaactgatacaaaaatggaaaacatgatttcagaagtacagaggcttatcaaaagaaaaaaaattcaacgttatcattattagtcatgcctattttaataaagaagcacaaaatctagtcaagttcaatataaacctcatgcagataaatggaaggtttaggaaagaggttgatgaggaatgtaatgtttctgtgacaaaagaaagggaagaaacatattcactgagagttagaaaaaaaaatgtaattttaaagggaaaggaataatggaaatttggatctttcccaggttcttggggaaagtgtttacacgaatcccaatggacattaaagcttttggctgaaactctattgtctccttttgttgataagcctttggtatatgtatgcattcctgaatagacacacttacgtgtaacactgtcttctaataacagacagctgtagtgaaattttgacaagtctgaatagttgttaaacgcaaaaggctgcaaagatgatttttttcattaatatgttgttactctgggcagaggacagctgagtccaaaagaactttgagaacaagctgcttgttccagtaacctgctgtacctatgcattcaaactttctttgccacagaagaagcatgtgtggtaaatgggaaccaatttgattgcaaacttcatttggccagtttcctataaatgtggatgcaagatccaactttgcatattcaaattgggaatatttatataccgattttttttttactttttattttacttatgctttacatgtggtatgcaatcagcagtcttcccttcctttttctctagtactagggaaaaaacctaggaaggtgctggttttacttatactgtcttaactttgtctttcttaatattgctaacccataggagaaaaatttagtcttcacaatgcctttttctaaacttaaagttaacctttatactgatcaagaaaagaactaaggaagcttataattatatgtaccagaatgactaaaaaatgtgaaaatctaaacaaaaatgcaatctcttctgagaatctaagacataagtattagttttggcttcgctactcattttgccaaataatcttcaaagaatcctcatcttattttgaaattcagttctctcatctacaaaatcaagataaatataattgcactctctgcttcattgggatatttgtatgctcattctatcctgcatttacacatttatttagcaactatttattgtgtacctactatgtgttgggcaccaagctgttgtgagaaccaaatgaaaattaaagcacataaagctacctttaaaacagaaaagttagcatattttttcaggttattgatagtagtggcattgtattattccttgtataatcagactcaactctaggaattataagatcaatttacaatacaaagataactaggttagccataatgtgctttccatcctcactgttaaccacacgcggtaattctgatgacataaaatgctttttcaggtgagcttggtgtgagatcgaattgtcaggactgcccattgggagagatgtcatagagctttatttaccactttttttttctctctctcttccctggcctccaacattcacagacacatctggttctgccagttaattgcttgtgtttctcacacagtgaccaataaggtctcatctcacctcattgttattattcacctttgagagttgtggctacttaaaaaaataaaaacaaccagagtccagtgagatggaatatagtcagtagtcagacatgatttggtactgtcatttgatgagagaatctttgaatgcctattatgagattttatgttataactgatttttcattacatactccagtgccaacattggaataaaaaggtaaagtaaattatttctgcatattggggctatccactcttcctcatccatttgaggctattttgtaaagaacattgatttcttaaaatattgattttgtttttgataaagtaagcacatacacaattaaatagtattttagtactgtaggaatatggaagtattgattactactaacatgaagtagaatatatagacgccttttagttttgttggattagaaacggattttcaataggaaaactctaataaggtattttataaaaacctatcataagaagttttaaaatttataaactcttgcttaaagaaaagatttgcctgcatcctttacctgatatgaaaataaatgaatggtaacattcttatcatctatgtttgtgtaactgaatagcatatattatctatctctaaaacataagtgctttatatataaaagcatgacaaacatataaacagaaaagagagtaagacaataaaaatgatgctaaagtagcaagtcacccaaaaaacaatctaaggaaatccaaaggtaccatttcactgaccttggaaagagaaattttgttgtatttgtgctaaagttcaggagcaaatgtgaaagtttgaaatgtaattttatgaaatataaaatttcttgtcatctagattactttttgtgaagaacgaacacattcttggtaactataattacatacagagtaaaacaaacccatcctttagtctgtcaatggtcctgacactatgaaaacatagtggttgaagataaccagacacaaccttgattatcaataatgattggatatatgtcctctccattcttcctctctccgcaggctttactgttagcaatctccataggcaaaacctttctgaagaccagattggaacagaaatttgaaaagaaatgctgaaaggagcctacataagagcataacttccaccatttgacaattcagtccaggaaaccatcccgataattcctgataattacacacagcttgacagtgttaacttggactctttctcttatgcactattcatataggttgctgtagctcataattatatatttgaagaaaagagagagtatacaaacctaaaaataaacaatatgtacaaagacagcagacatggtcagagacaggtacagattacacacacacacacacacacaaatttttaaaaagtccctaatactccttattttgttcattttcacttcacagtgctactagaatagttttcccaagacaaaactatcaattatcataggatttcaaaatttaaaatcctgcatatagctcttaatcaacttgaagataaagtagctatttctcagcaagggatgtaaagccatctatgtgtggctcccaggttggaatctggcataaactccacctaaatctacatgtatagccattaagtctactgccagttcccaggaccagccacttggatgcatttgcatctgcttccgatgtgtttttactgaatttcactgtgtgttgaattcagtcaccattcaaaatttagctaaactaacaccgcctgttagaggccttccataatacctttcccttactatgcagagagagatgtataaatgatgcatgggccattacgataggtgccatagagaggtatagggaaagaggtaaggaaaagtctcacggttcagactagacagatcatttatcaccctagtgctttctgttcaacttcatggaggtagtggtctttaagctgtggagatttaataaatggacgtgatgatacaggagtggtaacagaagcttataagtgagagatagtttaaaataattttttcattagcctaataaatgtgaattttaatcttcaggtagagaagatattcagaatgttacgaagcaggaaagaaacagtcagttattctgtagaaatattaatatggtagatacatacaaaatgcatttgtatgggaaaggatattctggaagtgtgaagaacagattgaaaattattatgataggacaggagaaaaagcctccaaccaggacaaggttggaataaaaagggtgaaatttccaaatattttagaaacagaatcaaaggatttgtcacttttttacaggtgaaggatgagatttaagaagtgagaagatgactttgggattttgaatcttgatgaaaagaaatatagcaggaacaagtaaacaaataagaatcaggaactcctgagtaggcagtggacgatgagtttagatttgtcatagaaaatttgagtttatgttggcacatcatattagaagggactgtgaggcaattggaaatgcattcctgaagtttgggagagagctcaaggctgaaatacatatttgatagtagttttcattgtgtcagtgagaaattataaataggttatagattagatagagataatagatgatacagataaataaataatcatgagtatacatcatgacacaagccaaggggggaaacttgcaagagtacaacagtgatcaacactatccactagccactattgatagactattttgaatgaatggttgaggcaggattagaagttatgtcttcaaattccaagttttctcttttgacattattatacagccaagtatcacactcatcctttcagaattgcaggttttctctggtatttgagtgcttggtcataagtttcttcagggctgtgggacaagataatatagatttgtacctcctaactctacttccttgccatttaagtgcatctgggaatgatgtgagaggtagtggatagaaaagatttacaaacatatatagagaaaagaaagagaaatagcaagttgacattaaaatgtatgcacatgtagttcattttcatgattagaaaatatataattatgattcattttttatatgagagatctagcatgaatggcttgattattatgcttgtgtcacttttatcatttgagctttcagtttcatctctaaaatgtttgtttttaaaataaggtcaatcacagattgcatgatttgggaagccagctgtaaggtatgcctacctataaaatatgagatatatctaaatcatcagcagaataaatgtagtttattttgtaaacttcaggacctaatatcataaatgtcttaactttattacatctatcagtatacttacctcttctgaaattggaatgtctatatgaaactataggtttcatatatgaaacaattaaacaattagattattaattgggggttacttttaaatttattatatgcaatatgacagtaactcaaaaccaaatttctggaacttttaaacaatgtgtttgcattgtatttctatgcatgttttagagtgtctcaattttactatcataaatgtttaacattaattcatccttaatatgtctcctaagatacgacaaataatttgtgtgggttaaagtaaaacataccttgctccattagccctttacagttccgcagggcacagcaataggccccatggaactattgagaagaattaaccttcctttggcagcctctaccaattttgcactcaagctggttgatccccagagagtggctcatttgttagttggtggcttatgccatttatagtagtatattttaagaaatgagtctttctcatgaaagtttcatgctgcatcaatttcataatgattttctctaggtttatcataaaacttggaatcgcttttggatccagattagccactgtggaattcataagaaaataagagatagtttaagacacaaagtgagctgaacatagtattttgggttttaaatttataatggtgttgtaatatatatatatatgatgctaaggtaatttatgtgtatgtgtctatatatatatatatacatatatacacatacatatgtatatatgtatatctatgtatatatacatagatatacatatatatagacacacacacatatatgataaagacgactgtgcactattatacaaaatataagaaaagtatactattcccaataatttaataatttagcatattgtcctctactataaatgtaaaggtcctttgacatttggaaaatgcaaccttagttatagtaacagaagacaccgcaattactttcccaacaacctaatacttgaagggcaaatgagagaaaaaccccaactcagaatagtccttgcatgagtgggttatgtattatgattcacattataatagattaaataatattggataaataacagaaaacaaaaagaaaagccaaaggaatatacttggtctatatttgcatttttgaattgtgaatgatttcatttggtctttttccagaaaattcactatggttttatgttcaaagccagctttatagtgaatcaacacaattctcaaaatgttaaattagaagatttttaatgtaccttttctgacatatccatacatttttccacatatagtactaacagcaactgctatcagatattagtaagagattattctaatctaaaaaagattttttagattaagattttagcattgcagccagaatgctttcaatcttggcttggtaaatacagattcaacaacagcaaagtaatttcccaagtgaataagaagctaacaatttacactgtaggctgagtgttttaactatagattttaaacctgatcccaattgctttttaaggagtctctaaatattaaaaaaaattaaaaacaaaacaaaaaacaaaacatgcatgcattcacaaagcaagcaattctattttctgtacagagatccctattagtttgctaatacattgtttagaaaatgtaattccgtacacagtgggtttatttcccttgtgacactggctattgagcctaacattttgagcaatatagaaacactaatgcaaaaacctagcctatataaagcattttgtcatgtacaggtaaaccataacaaaaatataattgggggctagtgttttttgcctgtattacctatctaatttaattagttaattagatttttatgctatcatttgaaagtagatttgaataagtttctcctttttaatgataatgtgaaaccatgcagattatgttactaaaatatttcaattttacttttgttcataggccaaactttcattagcacatttaggtaaaattttcttttgtcaaacaaatttggcagttttgaatacttatatggagcaaaaaaaggaaagtataatgcctggaaactagagtcagaagaagagagtataaagtaataagataacacagcaagtttaaaagaatatgcagttgatcttcaactgcaactaaactttactggaaggtggaccccatgttgctaaatcttttaatgtttttgagagaagatttttaaaaatctattgttttttataagcaatcttaatttttaaatgttgcaacctattcatataaatttaaaattaataaacagattttttaaagcaaacacaaataaaaaaattactttcattgtcgaaatcatttggccccaatgtggtctataagctggccatgtataacgtctgactattctacttacactagaaaatttacctttggctcacatgtgatacatatgtataatgatgatttttaatacttgatagttaaggtatcctaaattccagcttcacttctctaattttcacaatagatatgacatttgaataactactaaaacctatttttgcatgtcctgtttttttatctaaaatttaactatttagtcattttacatatgtctgtctactacttgttctgttgctacgttttttcccctagtaaatgaaatcaaacttacaaactttggctaatattttgacagaatagatatctacttataagtcatgactattgcaatatggaggcttgctcttcctgcattccttctgtttacatccatgaagattttacgtgactgcctttggttaagtcaaccccagtggtacaataataaaatagataatttttctcacataacaagaagtcagaagatgggcatcagcatctgctcagaaaattaccaggggtctaggctagatcaagtgtcctcttgtgtatctttgattcttaactttaatccttatgaccataatatagttacttcacctccaggtgtggaatcagggtaacaggaagtaaaacagaggacatattaaagggcctcaggttcccgtcaggccttacccgtgcctcttagtcagcaaagtaattgctttcccaggacccgtattctgtgtatgttccctcacttctcaccacctggaactgggttataggattactgctagctacattggagtccacagaagggagttcgtttatatttatttatttatttaattttttgagacagggtctcactctatcacccaggctggagtgcagtggcacgatcttggctcactgcatcctctgccccctagctcaggtgatcctcccacttaagtttccagagtagttggggctaggggtggttgccaccacatccagccatatttgtctttaatgggaacactgctggctcaaatcagattaaatttggtagttaaggtattatgtagtagcagagaatgtttccttgtcaggcattgagcaacatctgcctagtatggtgattctactcataagtctgaaaatagggctaagaactaccagaagacttctgagagctatcagccaggaaacaaaaacatgttgttgctgctgctgcttttccctctccttcttcccctctttctccccttccatcttttatggaatcatgtgaccaactcttaagaaatcattcattatagaaaaatagaaataaatgtggcaacgcacactgtgtctattggcaagacaccaccagcataagctacttattatatgatgattcaaaaggatgggcaggggacagtgactaccttagctgtaatgcattattaatcagtctctgaaactgtaattactttctgattctgtctcttcaagcttgcaaacaactgcacttaacagtcttctcctctgcagatgacttagtgctcatttcatactgtggtttacagtcagttattgcattagatttcatatctgagattcactcaactaataagtacatctgaaattcaaaatatgtgcaaggcattatctactatatggatgacagcttctgtgggtgctctctagaacctcattttacaagctcaattaccaaactaattttaaaaatctctggatcatattttttgtaaggggaaacaaggaagtgatgtaaagatatcatctctttctttcaattagtttttgttaaagagagtcacaccttaacataaaattcattttcaccacatttttttaaataacggaatggatatacaggattgaaaatgaatgatgatgaatgcagttagaagtataactactcatctagtgtttgtaaaacctatgcttttacattcttattgatattaataaagactaatttatagcaataaagagtacttaaagagagatcacgagagacagctaaatatgtacaaaaactctgttacaacataggatgtcaggctaggggtttagctaaaatgcttggtagtaacatgttttcacttcctaccataagttaattcatattatcatcaacctactcagttcaaacagtgccaacctaaaaaatatatttttcagtgaattatttctaaacaccaaatgtcatttctcatggaaattctaataaaatgcctaaaatgcattatctgacattttagtggatcagtaagtagcttgccaattgaaattctaaaatctttacatgttatagatttcagctttctgttctaaactcttgactttttaaagaataatttacatctctatgcaactatttaacaagggatgtctaaacatcaatttcaattataaataatgattccagttacacatgtacattgcattatgaagaacctagcaattgagcagttctgcacttaatattgataaataatgtctcagacttgcttaagtcagcaatgcctacagctgaggggaaaaaaagctgactacataagcttgaatattttccctgttttaatcacactaacctttattaatatatggattgataatttagcaaatcttggccaggtttcctcctaaaaaggtagaataaagcatcattattttttagtcaactgctttgtcatgtgcttggtaggcaccttttgcaaaaacgaatgtatcttctgatattgcaacatctctttcatcagtataaaaatttaggttattattacccaaagaattcaatcctataacccaaaatataaccctgcaatatgagaggtctcatattttaatgacatcattaaaattcaactaatgctattgttttctctttatcagttcttagaaactactactgagaccattgatttgaggctccttccattcattcattgatttttgtttgtttgtttgctttgagacagggtctcactctgtcaccaggctggagtacagtggcatgatcttggctcactgcaacctctgccttctgggctcaagtgatcctcccatcttagcctcccgagtagctgggattacaaatgtgtgcaacaatgcccagtaaatttttgtggtttttgtagaaacagggtttttccatgttgccgaggctggtctcgaactcctgggctcaagcaatccgaccttggcctcctaaagtgctgagattacagatgtgagccactacgcctagcccattgattctttcatgaaatgtgtgtagagtattggctaaaatttacacactgggtggaaaacaagatagcctccattctcatgcagctttagtaatgcgacatactttacattaataatgatttcagcaacactaataattatttaagcaatcatttataatgataataactactccaaaggggaaaaaaaacaatgagaactgctgtaagagagtgtctgatacactcctaacagaaactgcagagttagcactgcagtcagagaaaacatctctgaggaaataatattgaagctgcaatatgaagagtgagaagggcattgattggtcaaatgaagggttgaggaaagaattgtaaatgcaaaatgagtagtaggtgcaacaaacagaaaacagaattataaagaagaaactgaggggaccaaagaaacagagaagcttaatatggtttggaagataagataaacaagattaggttggaaaaataacaagacaaagtggaatgtggttgattgtctgagtatagatttcatttcaaatcagagcaatgaaacgattttgaaggggttttaaaagcgggggtggaatggatagcaacataaataatctttaagtattaaaacaaaatcaactcttttatttgtttattaaaaatttaaaagaaacaatggtgggatgatatttatgtaggtcacatttatgtttgaaactgccacccaagtagattaatatatagaattaagaaacagctgattagaatggctgactcctatgaaattcaaatgatcattgcaaaaacattactgaatatcatgggtaaatgtttcagtttttttcggaagaggaattcgcattactctcttaagcattttaactttgaaatgaatgtgtcaaaaaagccaggaaggaagatttattagttagagatgcatattaatgtaactgaaatcttaaatataatggcagaaatggtagtatggtgaagagtatgtcccaggatttcaaaataaattcaaatcaaaagacggagtgaggaaaatttatgctctgaaccatccgcatgagggttattacattagtgtttctaacaagctcaaaccaaacccccattaaatatttgatcagcttgtgaaagaccagcatgtactcttcacaaccatgaatatgaacatcttgcagtcagtttaatgcatgacagacccataaaaaagattatacatgataaaatggtgcagtgttggcacatcttaactgcataaaaaaataaaagtgaaggaaaccacaaaacaacaaatgcaagctaaagctagtacacaataagctatgttaggaagacacaattgcaggctgagtcaggaggttacatgctagccccaaatctgactatttcacacaggaactaaggatttttctgttgtcttgggacaatatgtcaaacctataatatacagtgattttaggatactcgagcctagcttatatatttgcatctacaactgaactttaataaagaaatgccaaatcaattttctccctcaaaccttaatatataagtttgctattatacttgtcacttccatttgtggtaattttctttgggttaaaatatttagaaataaattaaaaagcaaaaatatattcaaaaagaggggagatggcaattatcacatcaaccaatttgcacattggtaccaattggttttgtatctgagagttcacttagcagagagacagcaagaaatagtacattttaaaggactaaaataaacacatttggacctgggaaaggtgaagaaatccaagtgccaacatgtcatcagggagggactcctcatctgggaacaggaaggaagatgttgatctgtgttacctagggaagtgttctgaataaaaccaattctaatgtatgggaatgttcaggaataaaagtaactatggggaagatacagattctattaaaattagcattacaacaaaattatttgattcataattttacctaacaagctattgaagaaactattgcttctacttctaaacaatctatttcaaaatacatttaaagaggaaaaatgaacattttaactattcagttaaaacctaaatatacatcaattctttctattttctttctctttttctttctctctttcttttctttttctttctttcttcttccctcccctcccctccccttcccttctctcccctcccctcccctccccttcccttctctcccctcccctcccctcccctctcctcccctcccctcccctcccattcccttcctctttttcagatggggtctcactccattggaatgcagtggtgtgattttgcctcacagcaatctcagcctcctgggctctaacaattctcccatctcagccatccaagtagcttggactgcaggtgcaatccactatgcctggctaattttgtttatttatttatgtatttattagagacaaggtctcactgtgtttctcagactggtctcaaactcctgggctcaagagatcctcctgcctcggcctcccaaagtaactgcaactctttctacatctgggcaaagatggaggggcatcaatggagagaaaggagagtccactgaatgactgaatttggcaatttaatattgataataaatgtcatctgtttaatatgcagttgctatttagttctaatcttaaactttgtctgctgaaagacgatttatgcatactttcctgtctggagattttaaatattgggatataatatattaataagtgtattatttattccacattgtatcaaaaagaagagataacctccaagtttacaagtgatcagaacagctactcagaaaatgattttaagacaagctattgagggacagaatagaagagcacttgttctctaaggaaaaaaaattctgagaattaacttgtgagaatttttaagagaaattaaaaataaattggataattgccttccattgaattaagttagcagaacctggaaacatttaaaattggttgctatattgattcatgtctttctttaaataaagcaaaccctttgtaaattataatgtctctcctctcactctcctgtaattataaagtatgagaacactgaggattgattggctcttctctaaagagagggactatagctttcacaatggacttgatcaatatgcaaccccttataagaataaattccaattattagatgctttgatagcccaccccttctcttagaccaacctttaaacaaatagtatcaatgcagatattaataataccttataatatctccttggtagtagcttgaatgaagatttttaacacacagggtttagaaaattttattcattattgatgcagaaataattgatggcaagtcggtatgacttcatagcaagaatgaaattcaaagacaagttatatggccaacaagtagatggataatattgttagtatcaatgttattaaaaggatatgcatagtagttgcctgagacatctgtctctccactgattccagagttgattgagctgatccgactgtgaagtcagatggcactccttcaatggcttcatatgcgttccaagatccctatatttcaccaaatgcagcgcattttctgatagaatctgctgtgatctagggtattcctattgatcaccccgccttcaaagaaacactcagtctttttgtataaccattattagattttgaaaacataacctctattccaagcttttgaaatactctatcaataatgatacctcacttactgtaagatttgctatcagaaatctctacatgttctcaaagttttggaactaatttaacaatcaaatgtataagtcaacaaagcaaatcaaaatttcaaattttaccaacacacataccatcttaatcaatatataatgtactttcctatactttatttaaatgagggccataatacattttttaagttgttattgttaaacaacatgatatttccctagtatatgttaaagttggtactcaggtccaggtggctctaggtttcacctcctccccaatctactactcagtgtaaaatggagacaagtattctagaagagtgtttatcaaaccttaagttccaacaaatagtttgggggtcttgttaaaaggcagattctgtttcagtaagtgtgaggtgggcctaagactctgaattcctgacaagcacacaggaaatgctgctactattgttatgctggccacatgttgagatacaaggcctagttatacagtaggcaattttaaaaacgttttaatgttctactgaggcagcacttaaatccccattctggccatatctctttttgttttttggggaagatgaattctgagcaaatacacactactacaaactatttttaatattacatgcaattttaaccctactgtctttataaacaattaacactaagttaggtttactctcttaattacaaggaaagagaaagtaataatgaggaattgcaaactgctaaacaatatctctgatttatttttaagtttgctgattttttcatactttaaaagctttattataaggaaataaaagagaagtcatgaggcattaaaaatgtttaattgtttgaacataccaaacaatagctacacctttcaaaacaaccaaactgcaggctgattaaatttgtttaacctgtaagatacatatcatattcaataattagttaattgatgcctgatttttcaaaataatgactaaaggaagaattttgcctgggttaaaaattgattttggatagagtacagatgtatagtaacaattttgtaaaagaataaggataatttttcattagtttaactgacaaaagtgaatacaaaatttacaccccactgtaataatttttttatgtaacaaacagaaactgctttcagatcattttgttttcacattgagaaatatatctgagcaagtatctaaaaagatatgtttgtccaaaccgagattttgatccactgattaattgtaaggtagatatatattttcttttttatataaatatattcacttctgctaagctaaaaaccaaacaaaactaaaaaacaatctaccatatttgattggacaattttcaaaaaaattttagttttaataagaaaagctagcagctagactgggcaatttttgtgttctttaataaaaggctgtcacataattcaggtaaaatgctaatgtccaaaaaagagttcctctaaactgacgtggtcattttagtaatctgactatacacagaaggctatgtgtattatatttttaagccattactttgatattctttgtgtgaatacattgatttattaactaaacaaagtttaaagtaccttatagtacagaattttgatagaaaaataatagaaattagttagatattatgaaatatgctaatgagccaaagccaaaaagttgaatatttatttgtttgttgttgttgttgttaaatctctggtccattatagataaattgtttttacacccattttttactttcaaattgcttcacattttggttttattgaatattaattatgaaaataatatttgaaaatatcaaaaattattgcttttacatttttgaaaatgtgaagcatgaagaaaagcatctataaaacctactctcagaaaatgcctctttcatccattttatataaacatttttgtgtttttgtatattataatatttctaaatagaaaaaggggctctctaccggtttgtttgtttttttaccttttaaaatgtactttgacaattttctatttatgatcatgagatatcaataagacaagctctttaaggcaatgtgcattctttgaacctaaaatttatttggaatacaatagaactatgagaacaaaaacttcagtgaacactttgataggaaacatctgcacatctgacaatctatgttcaaacgatcttgtaatttttttgtggttgtttaatttgtttgataaattaactgattctctactagacaattaagaggcactgaagacattaaacatgcacatatatcatgtacattacatatataaatatattacagatatatatgtgtgtgcatttgtgcacatatatgtgtgtgtatatatatatatatatatatatatatgatagcatactattctgtaaatcttgcagttcagcaggaaatgaaaaagaaaacaatcaattttatttagagctaatacgaaccctaaataaaatacttactctcatggcagttgatttatctaatagaaacgaccagatcatttatcatttgttgggctaacataagtatttgagataaattgatcataaaatgtatgtgtttccacatactattatctatcacttcccaataattgctaattaaaggaattattgtaaggtctcacgtgtgtgtgtaccagaaagatttaataaaaataactaccaatttttcaccaatctctagaatattctatattatatcattgggtttggaaaccgtttcctggagaaacataacaaaatctagagctcttgcataaattaaatatatattaaaacatttcttagacaagtttgaaggaaaagaaatgcatttcagtggcaaaacctcagatttacaagaagtgctatttgaaactattttttttccactttccaaacctcctgaggaagaaagtacaaaaaagtgaatactcattttccagtcatttacatcaggacaagaatttctagaactcaaaccaatgccaaactttttgagaaggtctcctgtcagggctgtctggtagttccagggctcctgaagaacccaggtctattctttgatacctatttgaaagaacaagatttgggtccttgcagctgtacattgcagtaacaatttctggagtttttattataaaaattatcctgtctgtaggttgggatataaaataaagagataatacttatatatttcatgttgtaagcttcctgcccctgtagatgagcttccatctttaaagcaaaacaacactaaacaaacaaaaaaacttttgactcagttggccctatacagatcagaaaaaaatttagaaatcctaaggaaggttgagaaccattctttttatcagtgatttaaatatactgtaatacactcttagtagctcagagacacagattaagttttttattttcttatttttcttattttcttagtagctcagagacacatattaagttttttattttcttatttttcatgatcatgtgtattgaattacacccggtacttgaaaatgcatttgcacaggagactgtaaaactggtaggggggtttctggggtgctcttgccttaaaaagtaagagcagctttttatggtttttcaagatttgagagtatagaaatcattttttaaaatgtgcattgcacacccctacaaacttctctttgcccataggaacttgttagcaacttaaacaaacacatggagaaacaaagtcactttatctccagaaatcgattcaacatagctattttaaagagttttcccgagactttgaatgacttgctggaggtaaacattaaaaatgttatgcaccaagagaaaatatttgattatacgttacataagttcaggccttcagatgggaatgaattcatctctatgcagcaaaagaataatttcttaattaatggtagaaatagaggaaacatgaagacagaagtccaactcattggaactttagaatcagaaagtaattccttttggttttatggcatcttgctcacttccaactctgataggacaaaatgtcatttcgatggaagatctctgactagcccagttctttcgcacctttgttaacatggcctgagattgtttctaccttctccagatatggctacactgtgcaaaatatatactgtatcagctcttcagtgtcagaatcttgctttttgatgataaaactgatctttattttactaatctcactactattttccaaataatgaatttggaacaccagcttaatacattggaaattatagttgtttttctgttgaatatgagagttgcctatgaagtgtggttttatctttcccatatattctttttaatattccaaaatattcaatgataaggtcttaacttatcattgtgcaatttatatcatttgacaataaatcgcaaacacactggttgctttttgtttgcctgtgttaccttttgttttatttgtcattgccctctttgccatttgggcaatacatgacttatttcaagaaagcgaactgggaattaaaatatattttttaatgtgcatgttctaagggatttaagagtagtaatactattttaaaataaaatttaaaaagttattgtatgttttcagctgcttatttgtcatgtcattggatagcatgtaaaatcatgaagtctgttcatgaatattttttctacttgcacttctgataggtaatcaaatggtctgtctgtctctcttggcttttgattagaaacaacttaatcagtacatcgcatgcttaatgtcttgtggttaagccattttatacaaatacctgtttttaaaaagatacaagtatacttttcttatataaaggttggaaaaatagaacgtgtgaaataatgacacctataatcttacaacatgcacacaactttactgacttactacagtgatattctttcacaatattgagttcatgctacatatgccattttgtatgctttttctatttaatgtgatattgtatacatgtttctaccatttaaaattgcataaccattttgatgcgcatggcatagtctgtcatgtataaaaaattacttaagttgctactgaagattcacattttctacatttctttatattttaaataatacagaaaaatcttttatagatatttgaaatgtaaaatcactggattaggaataaaagttggactctagtagacatctatagaactatattcctgtacttttttttctgaaaattgtgctttttttatttcatctatgtttctgaggaggtaactgtcaatttgtataacaagaacttgccctctgtcacaggaaacttaaatacttttctaagacattttaactgggactatgagattgaccttactctgctctgtgtggttgtactttgtaaatcccaatagctaatgatggtgtattccaacatctggattgagtgtacagaggaaccatgtctgctgttagaggaaaaataataaaacagatatacaaagagtagcagtaacaaagagcagagaataaaggcaagttgcaaattctcacggagaccaattcctgggcagatttgcactcctgactgtgggttattataagataatgtaggaatcttctatgtttattacaatcttcccccaacacattttttgttcctttttccatatttggtttctaaaacttcaaaagcttataatcaaagggtatcaatattttaaagtttcttgatgcatactgcctgtgctatattttattgcatcaccttaactaaactggaactacattttccataaattcattccctaaatggtttgaagtaagatttggccacaagagatatttgcacacgattttgtaagtagagaagtggtagtaatgtttactctccaaaggtggatgtagggtgttaggctcaggagcagcttgcatgcatccctggcctactgctgacttaatataggcagagggcagcaaaaagccatgtaaccccttaagctcctttgattctccttctcatacttctcaaatttgcatcaagtgcatgtgtggctcactggtaaagttagccaacttctcttgcaggtcatctataccatcaatattggtggtggtgagaaacatacaagaattccagtttatctttatgggtcccagttcatccttgtggatttcagttttgtccttgttctcctctacttcacaatcattcttccttcctaatggttcagctgacttacagcaatgtcactctcaacaccagatgcagatgccttctgcaaactactccatcaactctcacaattccataagatctaagccctataataaatgccatagtttgtatcatcatagtgatcttgcttctcaccaaatactgcctaacgcagatactggtttgaaagaggagtgctactgcaataaaaacagcatggtttggagcagcaaaaccatctggccatggctttggacccctgcagtacgaggaagctaaaagggcattgagaagactattaatagaagcttgtctagcttgaaggaggctgtcagtgcagactgaagagaagccagcaattaagccttccatctgaaagcccagacactgtggagcagaggcaaaccatttccccattccctgtctgaattccctgattcacagtttttttgtgttttaactagtcttgaagtggttagttaaatagtaagagatggttcataaagaatttggtgctgaaagtggagcagtcagagttgcatctgctttcctgctcttgtgttatacactatgcttctagaatcctgtgggcttagaggaaattccccatttttgcttgttagtccaaattgagtttttaaaacttgccaccaaaaagactcccaacctattagaaacaaactgtttgaaattttgtcatgcagattgatatctaaaaatttactgtgtccttacttatttttatgcaattttagatgaaaaaatacctcttagataaaaactcatgatcactttcagttggcatttttgtataaatttaaataagttattttgttcaataaggtatgtggtcattcattaaatcatctaggaaatatttactgagttatctcaatgttcagggtaggggattaagcaaggagaaggatatatcgaatcacagtttttctgagtagttaatcacacactagcagcaataagacatgcaaacagaaactaacacatttccttgattctataatgcatttattttttacatttaaattgttttaaaatcagggcacatcatatactgatggatgcatttcatgtgaaagtgttgcttcttttcccttgaaaatttgctattaaatcaacaatggcttctaatcatccagaatgtcttaggagaaagaaactataatattgcagaagttaatataccataaataccatgagagatgtcaggagtcttaaaatgtttcaccagctgagataatataagaagactatgaagaatttcaacagggtttcgaagaggagagcaaagaggcttgacattcagcaaggatctcctgcccatatataaatgaactttcttctaatcctcaaaacagctttcagcagtaggaattatcttcacttccctgatcatacaactgaggttcagattagtgagcagagaaaaaaacatctttgactttcgaacccatatgtctctaaattgaagtgtacactctttttagaaaataatattgagggaattcacatagtatgacatactacatgcagcatataacgtgtactacctacaccccatgttctaaatcctatatgtaaaataaaactcagtaggtactaatactaacctcactttatgaatgagaaaaccgagacctgaaaaaataaagtaagtttttcaaggtcacacaattaataaacaacagagctgcattctgaactcttgcagtccggtgaaagagtctgtctttttaaccactgtgtcatgagcctctcaggacagtttaagcaaaacgctttgtcccgaatctctaagcacctgattaaaagatgcagccccctaacttttgatttccctttccaagctctactgatcaccttttaacatacaattgtaatatttattatgtatataacgtaatgtttgttgctaccgccttcaagtaaactcctcaaagaaagatattttttaatctgctttgatcatggatgtatcttaacagcttgaatcacgcctgacacaaggtaggacttcaataggtatttgctgaataaataagtgattgatttctgtaaaatacgaagtgaggatattcagtgagtgaacagtaagtggagagaaacagaggcatggaagtaagagttgtgttctgagactccgattagtgcagtttgcctaaggcgtcaggtgggagcagaaaattcagtaagcagatctccctgaaaggggggttgaagtcacccaggaacaaccacaggagcctttggtccctcgcgttttgtttatagcttgttcagcactagacactggaaaggagggcaggaagacatcaaagtagctgtaccgttcatattattttcttcctttggcagctattttctctatttcctgctgacactacaatttcagcgatttaatgatacaattgtttctgaaaacgacacagaaacagataccctcagccatttaattggctgccctgaagaagtggaatctgctgttttctaatttcatttttgaggggtttgagaatatggaaaggctagaagaaagacaatatttacttccatttaaaaaggtaaaatcttagcaaggaattttaaactcagcccagttaattaaggtctgctatttccatggcatacaccaggatatctacgaagagtttatttgattcttgcaaagatattactaaaactaaagaagcacagtgctgttagaaaagtcttatttcttctcctgtacattttaggttttgtctacctaggtctctaggattgttgtggaattagctcctgcatctatgcacttgactgagacttgctaccttctcaatatttgaactaataaattaaatacaagaacatttatactttctgttgttgaagaaaatttccctcattctgcaaaatgttacagaaataacattaaagttgacccaagttttcctcatttttcttcttaacataaaaaatgaaatactaaatttctaaacaggcaagtatatatagtggaaagaatatggttagtatataaaatattatgatatcaatgaccaggtgctgaagctaagtattgtgtataaagtaagtatacacaatatactaaagataggggaaggcctgaaaataattcttcaacttagttaacaaagaagactctgaaaaaaggttataagataataggcaaatatacctatatgttatatcaaatgttaaaaggtgacttttctttatcacattgatagaataaatcagaaaataacataataataccaatagatccagaaaaaggatttgacaaaatccaacttccactcatgataaaatctctcagtaaacgaggaatagaagggagcttcctcaacttggtaaaaaatatctatcccaccccccaccaccaaaaaatataacatactgaaaacatcacattggtgagaagctcgaggctttctttctaagatcaggaataaagcaacaatattccctctcaatattcatttcaaacaatatactggaaatcatagataatattacgagaaaaggaaatcaatttactttgtttgagaaggaagaaataaaaccgtctttgcttgcggatgacaagatcacctatgcagaaaatccagaacaacaacaacaacaaaaatctcatggaactaatcagccgttatagcaaggattcagcacacaaggtcaacaaagaaaagtcacttttcctttgattgacagtgataagtcaatcactgtcttaaccaccagcaattaacaagtggaatttgaaactaaaaatacaatattatttacattagtgcccaagaaaatgaaatactttggcataaatctaacaaaatatgtatgtgatatacatgatacacactatgaaactctgatgaaagaaattaaaaatctaagtaaatggagaaatattccatgttcaagaacaagaagactcaatgtcaacataacagttcttcccaaattaatctaaatatgtaatgcaatcccaatcaaaaccccagccagttatattttggatattgacaaactgattgttaagctaacatgtagaagcaaaaacccagaatagccaagccaatatagaaggagaagaacaaagtccaggactgacactacctgacctcaagacttaatataaagccacagtactcaagactgtgtggtactggcaaaataacagataaaaagatcaatggaacagaaagagcacctagaaacagactcacataaacatagtcaactgatctttcacaaagaaacaattgcaaagcaatggataaaagatcacctttccaacaaatggtgcctggtacaaatagacattactatgcaaaaataaatgaaaaaatgaatctactcacaaatcttgcacccttaacaaaagttaactcaaaacatatcacagacccaagtgtaaaagccaaaactatgaaactcttacaagatatcatagaagaaaatgtagatgatcttgggtttgatgatgacattagatagaacaacaaaggcatgatccatgaaataaataaatgataaactggaattcgttaaaataaaaaattccagctgaaaaaagacactgtcaagagaatgaaaagacaagccagtgactgtaagaaaatatttgtaaaagagatatctgacaaaggaatgttatctaaaatatacaaagaaaaacaaaaactaaacaataagaaacaaacaacttcattaaaaaatgggccaaagacattaacaggcatttcaccaaagaatatatacacacggcaaataagcatgtgaaaagatgctcaccatgtcatcagggaaaagcaacttaaaacaacatagagatatcagtacgtacttattagaatggccaaaatccagaatactgaaaacactaaatgctgtcaaggatgtggaacaacaggaacactcattcattgctggtgggagtgcaaatggcacatccagtttggaagagagtttggcagtttcttacaaaactaaacagatttttgccacctaatccagcaattgtgctccttggtatttaccccacggagctgaaaacttatgttcacacagaaaaacttcatacagatgtttctagcagctttattgatatggtatgcttctaattaataaatgtgaatactaaaataagtgaaagacttaagtctttttttaaaagtgaatactaaaataagtgaaagaatactaaataagtgaaagacttacctgagattcagaaaggctgaatctcagaatttgggtggaagagaattagtaagcagaaggagaataccagttttgtgtggctcctaaagtgactaccggaaggaaacgagcatgaggattatgggtgggagttttttgtgggccagaaaatggttcacataattttgcctattttgcatttgccagaattcagtcacaaataaaaaataatatgaaaagagccaggattagcaagcatagaataaatcagaaaataacataataataccaatagatccagaaaaaggatttgacaaaatccaacttccactcatgataaaatctccagtagccaagaatattaggtctaggtaatatttatgtctgtcctagatggttggaaggttgaaaataaaaagaatgaataaaaaaaatcgaggaggggagacaaaaaagtcgacaaataacaatcggcagaaactataaagagctatatctaaaacaaaatactaaggggacacagggactagggtattagaccagtaatgaaatctggaaaatactactagaactagactgtgaaggaaaactggagctttggaagttggatttagggactaaagtcattctctatagacagagatgaaatggttccagatgtgcaatgaagaaataaatagcccaggaaattctgaatggagaatatccattcaaggtcgtagtcaaggagccatctgacaaactagacaaggtgagttagtttgcgactgcagcaacttcagcaaatactggcatctacacaaccttgcttatttaatttctaaaaaaacaaacaaaaaagacaacaaaaactttccttttcaactttatagttctaaaatcgagtggcccaattttggtttattaaatgtgtggaaaatattgtattaaattactttaaatcacttttgcaaacaccatttatgaaacagaattttccccctcattattatatatgtacacattttataataaattccaaataaaatgttaaagggtgagtatacatgtatatatagatacaagatacagatatgctattcaacgtagcacactttgctcttcctgatttataccaaatggatttagatatagtttcaaagaatcatatctatctctccacttttcatgcatctgaataggaaatttatgtgaacaaaacagagatagtatagtttaataggtcctaaagaaatgcataacattttaacatatggaggttgtgctctaacaaactttaatacaaaacaatattttgtatattcactcatgcatttttttcctttgcaatttgggaatttaaaaaaaccaacagttttatatgtaattaaaacaatgcttaagtcataaaactcttttgtaatactcaaaactaaatcttatttatacttatgtgtcaggaactttacctgcattaacttaattaacacttagagccagtctatgaggtagacatttttacaggtgcgggaactgaggctcagaaacatttgaaaacttcttcaagattatacaaatagcaaatggtggaacccacaattttacccgtataacatttttttcagaatccatgcttttgatctccttgccaagctgtttcccatattatatcttttatgttaaaatacgttttcagcaattgcattttcttaacactttcctaatataaaattttttttaaatttatcttgttgggaaaaacgcaaactttttcactcatttctccatatcaggtattaaagagtcatgaagtaagtttattcatatcatatgagcttcattctattttgagtccaaagaccaactgaaaatgcataaaaagattatatatggaataccactgggtcttgctagcagtatcaaagttatgttaggaaacagtgctgagaaaccatgttcattgccagttctcagcacaattggctaccaggagtcatgtatagtaagtgctatagctcagtgcctgcacagcctcaccttttctgctaatgagtaacattctagcaagcagaggactgattcctgagacagttgcctgaaatttaatgctcgatttctatccataccaatataactttcaactgatagtccttccacacgcagacaaatgaaactgacaaaagacctgtcagttacaagccaataatgcatttcaacaaataattttttgtgtgcccagcacatactgtgggtattcagtgttcatcccaaaaccccacaaggttggcctattttgacttttatcacatctatagataaaggtgtagtgttatctttctttcccaccccaaactgtactcatctttttattgcaaatacctggctaaaggaaatgtcaaaccttatatatagaatttacttgaataggtcctacgtcaaagtgctgctttcttagaagctcaaaactgttaatatgtattgacttagcaaaaagaactctaatggcaaaggcattgcttttgagagagatagcccatgtttggaacaggagaaaaaaaatacatatttttctctaagaaagtgaggagagattcaatatagaatggataagcttagcagatatatagcttataggataaatgaatataaattaaatagagtacattgctaaagaggacctggggtcataaatataatgtagacaaaaaaaaaaattccaacacagaagaaagattcatggatataaattcaactgagcaagaacaaagtaaattgttcagagttcagctgtcattacttgcaagatcatagacaataagcagcagagtatccaggtggtattgtttagctttattagtggatacatgtaagtcctggaagaaggtttgtaaaatgaggagagtcctgaagattaaaaaggaatcctcattaggagagaagttgatattggtcatctaacattagggcagaaaattttcagaccactttcttctataagtgttacaaccatgcagttgacattttaggaactaaatcagtcttaatttgcataaaggctttttcattgttgttcttttgttatacaatcaaaatgctttagcataacacaccttcttcctgtttgttttgctcttcaagagaaaagtaagcatcccttacttttccttcccttcatctgaagtgcaaatttaaggtaaacaggaatcttcaaagcacaaaaagcattttcactctgaaagacttcttatcttggaagaaatgagattccaggataataaaaagctatcatgatatctattctctcccttacttgacagggattttcaagatggatcggcaagatagaaagggaatttattcattctaccaatacttatgaagaaaagggcatttgggatgaaaatggatattgggacctcctcaaagttgctatagaaacccgggtgattacagctaatggtgtggggagaagtcctgttatctttaagagattaacaggaaaccttggtctcattattttttcactccccacattgctctgatgatagcaatgtacagattagaaccaacaaacaacaataataacaaaacaacaccttcaatatctccttgtttataaagtaaaaatataattttgaaaattgagcttcaaaagcttccatcaacaaatcccactccaaccttctgaaataacaccttattcttcataactatattctttgatttagcatatgccatattgacaatatatccctatttatttccaccttcaggtttctgttcatactctcctctctaaagaaaatgattttatataactccacataaatacatctcatccaaaaaaatgctaattacttgttcaataattatttcatactacaagagttaaagtagcctctgtcttctaaatgctcattccacattatctggacaagttctcaatgtctacctgtgatacggttatgtacatttgttgtcaatgtttttccccatgtttacaaatatcattatatgtaatgttctcatagcgaccagttttcaaagaattgctagctgggagtcaatagcaaaagcataccaatctttacagcatatacagggtcaacccaagtggatctgtcacgatttagttttctcttagcaccttgaactatgcactgtatcacacagctggctatatcacaccagtgtgagattatatactatttgtattggtctctttttgttttttgtttttggtttaagtacaaaattgtatgatgccaaaggtgaacatcttcaaagtcagaaatattcagaattaaaaactagctcagatattaaatagccctacatatttggataaactaccaaccatcctagagccttaatttctttctacaacagaaataaaaccatttttcttacaatatttttgtgaggattaaataagatgattcacattaagaatctaggacatggaaagtcctcaaatggatgccaacatctcatgagcaatactgtcagaagattccataattcactttgaagatttctccaaagtgtatagcaagactaaatccaggtggcacaccattagtgcactgaccatatgtgatttaagcagggataagaacatggtttcatgttttaaatattatttctcaaatgagaagctattattatgcaatggatagaattcagtttcttattatctatttctagttcacagatattacttactagttgtgtgactttgagacaggtcctttacttccttgattcttcacttcttcacctgcaaaaatgaggacattgggctagatccattattttacattaatttttaaaagtattggtttcttcattctgtgaataaaattgtatggaagtacaaaaactgaaagcattaaaagcagagttgttctgaataatacaaggagaaaatctaggacctccaactttcggtattgatttgtccatggttaacagcagattcatgaaaaattgtaacacttaatcagttactaaggcttactcagaaagtacatacaagaaatgccaaacgctaggccactatagtcacagaatattacctaaagaaaaatagcctttgaagctccaagaattgtgctgagtacattgtctaattagctgaaaattataaagtgaaattatacaactttaatgattgaataaagaaaaaaatgtggctcataaaagataatatagcaaacaaattagagtgatcagacattaatgttttgcgtttcaaagataatattgggtgcaaaattcatatggatgagttatgtcttcacactttcaatattgttaagcatgtgtcaagatggccacagtattgtagaatggtcagtatgcaaaaattatgcaagaaatcatgtaagaaatgaaacatgtggctttagagttgatagatggttttaacattgtaacattatagttctgggctatttacaaaacctctctaaactgctgcttatctgtaaaatgaaaatagcaatttggtcttcttttcatttgtttgttattattaaaggatatttgatatagaaagcaccagctgatattgagttcctaagtaatattaattcttttttcccctctccttttatgtagttccatatgtattgttaatattactcagcatagagtgttaagcaatcttagcaactcaactttttaatggtatctttcacagtggtttctagctttctaaccttttgaagctgttaaaataaagtcaaataatgatactgctgtggcttaagtgtatgctaggatcaataaattgtggttcttggaataaattgcaattaaagggatagcacttgattgcttgacagtaggtagtctttttggcccaaagaaacttgagtatcaatctgattcataagctaattagtatggacttcactttcatttcactggaagatcatcagatcgtattgactcctgtccacatcatgagtgcgcccttgatactggcctgtgtcacttataggtaacaaatcctcttcacttgtttactttgcttattcaagattatagtaagcatttttaatcaaatagaatatagaagaaatttaacatgtttgtaaataagcactctaatagctctaaaaacttcaatactattgcctgcctttttacatttctatacatttaggataaaacatgtcttaattcagatatgataaatgtatcaacattgtaaagaacgatgactgttactgaatctttgtagcaatagaaaaatttatataacaactaattatacactagaaaacacaacaggatcgatatttcatggtaaattatttgaattaatctaaaaataaagagtcaaagtattgtcctcaaatgtataaatacacttacttagagtatattattttattgttcttaattttccgcaccttctattccatgtggtgttttatatgtaataaattccagcatatacctgtataactattgaatgaatataagccattcagagactaaagcaaagtaagttaagcaatcccttggactgtaaattccattaagataaataatgtgcttgtgtgttttcttcctctatattatctacttaccagcatatgtccatccagagattaaataaatgttttgaatgaacaaactaaaaaggttggatttctgaaaatgactgtttaaatataaagtatcttctccatttaaatagcctgacctccatacctcttgtttgttacacactttttattttttatactttaagttctagggtacatgtgcacaacgtgcagttttgatacctaggtacacatgtgccatgttggtttgttgcacacatcaattcctcatttacattaggtatttctcctaatgctatccctcccccagcccccgaccccctgacaggccctgttgtgtgatgttcctcaccctgtgtccaggtgatctccttattcacttcccacctatgagtgagaacgtgcgatgtttggttttctgttcctgtgttagtttgctgagaatgatggtttccagcttcatccatgtccctgcaaaggacatgaactcatccttttttatggctgcattatattccatggtgtatatgtgccaaattttcttaatccagtctgtcattgatggacattctggttggttccaagtctttgctgttgtgaatagtgctgcaatatacatatatgtgcatgtgtctttatagtagcatgatttataatcctttgggtatatacccagtaacgggattgctgggtcaaatggtatttcttgttctaggtccttgaggaatcgccacaatgtcttccacatgattgaactaatttacagtcccaccaacagtgaaaaagtgtttctatttctccacaacatctccagcatctgttgtttcctgactttttagtgattgccattctaactggagtaagatgttatctcactgtggttttcatttgcatttctctgatggccagtgatgatgagcattattttcatgtgtctgttggctgcataaatgtcttcttttgagaagtgtctgttcatatcctttgcccactttttgatggggttgtttgtttttttcttgtaaatttgtttgagctcttcgttttcttgtaaatttgtttgagctcttcgtagattctggatattagctctttgtcagatgggtggattgcaaaatttttctcccattctgtaggttgcctgttcattctgatggtagtttttttttttttttttttttttttttttgctgtgcagaagctctttagtttaattagatcccatttgtctattttggcttttgttgccattgcttttggtgttttagacatgaagtccttgcccatgcctatgtcctgaatggtattgcctaggttttcttctagggtttttatggttttaggtcttacatttaagtctttaatccatcttgaattaatttttgtataaggtgtaaggaagggatccagtttcatctttctacatatggctagccagttttcccagcaccatttattgaatagagaatcctttctccatttcttgtttttgtcaggtttgtcatacatcagatggttgtagatgtgtggtgttatttctgaggcctctgttctgttccattggtctatatgtctgttttggtaccagcaccatgctgttttggttactgtagtcttgtagtatagcttgaagtcaggtagcatgatgcctccagctttgtttctttttgcttaggattgtcttggcaatgtaggctcttttttggtttcatacaaactttaaagtagtttttttccaattctgtgaagaaagtctttggtagcttgatgaggatggcattgaatctataaattaccttgggtagtatggccattttcacgatattgattcttcctatccatgagcatggaatgttcttccatttgtttgtgccctcttttatttcattgagcagtggtttgtagttctcattggtccttcacatccctggtaagttggatacctaggtattttattcactttgtagcaattctgaatgggagttcacgcatgatttggttctctgtttgtctgttattggagttatacactttttcaaaaagcaaaccaaaatcagaatcaaataaataattttctcatgccttgctttctctgttgtctcatatttatgttattcattttagatgctattataaatctaaaatcatataaatctcctattatactataataatgtaattttatctttctgagcattaaatcctttctccccatcatagaatggaaacttggtgaagactatggctaaaaaagacttatctttttggtatgctgatgaattccaatcacccaccattgcatctgattcattgcaagtggtcaatatttactgggcaaattcaaaattatcaaaattcaaaataatcaaaattataaattttaaataatatttcagacaacctcaatttacacatggaaatatattttcataaatttatagtgaacattttttctttttttaaattttgttattatactttaagttctgggatatatggcaggtttgttacataggtatacacatgccatcgtggtttgctgcacccatcaacctgtcatctacattagatatttctcctaatcctatccctcccctagccccccaccccccacatgccccagtgtgtgaggttcctctccacctgcccatttgttctcattgttctactcccacttatgagtgagaacatgcggtgtttggttttctgttcttatgttagtttgctgagaatgatggtttctagcttcatccatgtccctgcaaaggacatgaactcatcctttttgtggctacacagtattccacggtgtatatgtgccacattttctttttccagtctatcattgatggacatttgtgttggttccaagtctttgctattgtgaacagtgttgcaaaacacatacgtgtgcatatgtctttatagtagaatgatttgtaatcctttgggtataatcccagtaatgggattgctgagtcaaatggtatttctggttctggatccttgaacaatcgccacatgtcttccacatgcttgaagtaatttacactcccaccaacagtgtaaaagcattcctatttctccacatcctctccagcatctgttgtttcctgactttttaatgatcgccattctaactgatgtgagatggtatttcattgcggttttgatttgcagtcctctaataaccaatatcaatcatttaacctctttcatatatgacaacacagaaaatatatggaatttaagcaattatattgaaacacaatttaaaacagtacaagcagtgatagtatttgaaattaataggattctaagctcaaaatgcttaagtaaatgtttccatgtaaaaattggtagaagtctatgaaaagaattagaagcaaaacatattccctagctcttaatgtcatccaaaacaagaacctgtgttccttgaaagcaaaatatatgtcttattgaccttgttatgtccaggaatgaacatgacacctggttcattttgaggcttcaattcatgttttaaatgccttaataaatgaatcaatcaactaggaggttcagaatgtttaggaattgaaaattgacacataaagtatgaggaggacaaaataaagactgaaaaattatataagaatatatgatacagtaatttaataatttaatatcaaaaaactattcatgtgctatagtttcataagattatgttttattctaaactgcaagtgatattagaattccagaaaatataaagtatgtttgcataggtagattttttaaacattcatgatgaggcattatctttttccattctaaggtcagtgacctcagattcgagttgtagataatatttgacagcatcttttccccatgcctgtaaactgatctggtaatgagagaggatatcttgttttcctgtacttgtgttacatttactgaagtgaatgggtggaaaagtttgcacaggtgtgggtctgaaagcaagaggtaatgtaatttcacagaacatgtgatttgtcataggccttacagcaagggtcatagctctgagtaatcttagatctatccatctgtctaattatcaatttgttagaaatcttgcaataaagaattatagttttatgagctgcataattatgatgtcattacaataaaccaaatgtttaaatacttttatctttcaggtggccacatgctagaccatgggaaaaaaaataaaaattatcttttctgtccttactataaggcacacctcccctcctaactccctgaaatttcactctcatcagcccagatctccaccacacacccagttgtctttctctactcttcttttctcattcctctctttacacttcattgtctgccactgttattcaatggggctagtccagaactagtcctgcctctatgagcatattttgtttttcctccatgtatttttcctctcaaattatttctttgtaaataaaatttttgttgatgcataatagatgtacatagtttcaggtatatgtgataatttaattcactagcatactttgtatgatttgtaaagatggaatgtccatcatcttagctatttgtcttttttttttttttttttgagatggagttttgctcttattgcccaggctggagtgcaacggcacaatctcggctcactgcaacctctgccccctgggttcaagcaattctcctgcctcagcctcccaagtagctgggattacaggtgtctgccactacacccggctaatttttacatttttagtagagacggggtttctccatgttggtcaggctagtctcgaattcccaacctcaggtgaccacccacctcagcctcccaaagtgctgagattacaggcgtgagtcactgcacccggccagctatttgtctttatgctggaaacattctaattattatttgctagctattttgaaatgtacaataggctgtgagcagtggctcacgcctgtaatccaagcactttgggaggccgaggcaggaggatcatctgaggtcaggagtttgagaccagcctggccaacatagggaaaacctatctctactaaaaatacaaaaattagcccagcgtggtgcatgtgcctggagtccctgctattcaggaggctgaggcagggagaatcgcttgaacccaggaggtggtggctgcagtgacccgagatcatgccactgcactccagcctgggaagcagagcaagacttcgtctaaaaaaacaaaatgtacaatagattcttgtgaactatagtcacactatttatctatcaagcactaaatcttattttatgtcaaaccttatatttgtacccattaatcaacttctcttcctctctccttcccagttatccttcctggcttacgtaggattactttttttaaggcaatgttaggattggtcagagcttctaactataaactctaaaatatccattcacctatgccaatgatctactttctcaatatgaaatgttgttatctaagtttctaagagtgctgtttaattttaggtaaaatgaatgttagaaaacagcatttagagggacaaaaacaaccaaaatgatttaaaacagggttgacaagcatatgctgcaagcggtaaaacactgccccttacgtggtgcacatcaacactcagtcaaaactccttccctctaagcaaggatgcagcctctgaattcttctgagtaatattcccttggtcagataaagcataaaacttgtcttctctgtattaaaaatgtaccttttagtatatgctattgaaaaatgaaaaaaagtttacctcccctgtttgcatataacatttgttacgttatttcattttaaaaatcttgtaaagtttttctaataatgtgagtaaaacgctattacggaacttcgatatatgtgtgaaaggaaaataaatattgggaccttaaactcactaagctaaaaggaaaagtccagctgggaacttggtcacgcaagcctgcctgctattttgatccctaaataagatggctacaaagatgaaaagctatatacctccctaacattttgcccacaagtaaactccttgtgtgccccaagatttttaccttcaagcttatctgtcaaagttcaccatggcagtgtaattgatcaacctatcaattatctttgcaggtacaggggacataggacagaactcagagtcatccctctgcacacctgaaacaaatgcatatctgattgtttcctctgccttattgtctatgttatattatataaaaattcagactcactgagcaggacgaagccattaatattctcccctactgcaatctcacatgataactgtgtatttctcaacatcctgtcctttcccctttaaatttgaagccctcaaaatcatctttggggaaagtcatagacctgtctccagtggggtggggggtggggggcatccttaactttggcaaataaacctcctaaaatgagacctgcctggatcattttccttgattgacatatgcacacaaacacgcacacaaacacacattcatacatattttctagctgtaattactgcccctgcagataaattattccagttaacattgtggcctatgttcccatctgtcatacctaaataaacaagttactaaataggaaatatgcacagacacatacacaaaaatgcatatacataaacctctctatttgatgtcctgtggatttgtttccatgtccctcagtattttttagagtgtcatttgaataggtctttaagttaaaattaattttgactgtgtgaatacatgaaaaaaagtataaaaaggtcattttcatttcataatatctgttgaatttaggcttaatttaaaaataatcattaaaaataaaaacaaattttaaaaatcacctttggtaggctgaataattgcatcacaaagaagtccacatgataattctaagtacccatgaatatcttacaggtgcatgccaccatccccagctaattttttgtatttttaatagagacagggtttcaccatattggccaggtaggtctcgaactcctgacctcaggtggtcggcccacctcgtcccccaaagtgctgggattacaggcatgagccactgtgcccagccgggatcctttttgttttaaataattgaaagagaaacagcaatgcctatcaaggcagctggattggtcaaattaccttggaggacaatataagttcacagactagaaaagtctatgtgacactattgattagacaatacttcactaattaatatagacccatttcattggtgtgcagagtatacatgtttttttttcttctcagcaccctggattatatcttaagaaagatgcagcatagaggccttatcagtttttaaatgtttcaggcattaattagcaaagactctctttttgttgtcaaaatatagtcaagggaactataagaagaaactttaaagaccaagtcaatttatcttgtaaatagtcattctaaacaattctgttatctaaatattacctttattttacatgatatttatttgatataatatactttagggtggctcacttaatctttccagatttcattttacttattattaatagtatacaattattttataaaatcaaaaaaaattaagcatttactttgagtctctctgctaagctttttacatatattttgtcatttaatcctcattacaatatacaaaacatattgtcattatttctattttacagatgatgaaacagaggtgccaaaagataagtaattttctaagatcaggatcttggttagtggtcaaatgggccatctgccaaaacagtctatactgtattacactgtatataaaaagataataaaggcttctgcacaacctctcaaaacaataattaggattaaattcatccatgcattgatttctacattccatcataaagctaatggtcatcgtgcacttagaatgtgctcaccaaatattgagcgtggtgggatacagctatgaacaaagagacaggtgtttggccttatggagtttacaggataggtggaaagacatcgtaattccttagagtcataaaatggtgatgatataaaaaagaaagtacagtgagctatgataatagcagagaagagatgggtataatactgaagaaaggagccaaaggtcagttttagggagatggcatttgagctaagatacacaaaaggaggttcactaggaagataccaaaaagagaagtcatgatacataaagtcactttataaagtgttaaagaattgtaaaatttgaggcattaagcattaaaagagagttgtgacaaatgtgttgaagaaaaatatgcttgcaaactcagttgtaaatttttttttaatcatctactatcgtggattatctaaattactgtcgccctccatttatgtggataatgagttgactaagtattgaacatgtttaaaatagctgaaccctgtcttttcctggctccacacattgcctatcatatggtcgacactaaccaatctgtttcttttactgcccaattacactttgatagtgattaagagtcacatacacacatcttctttgtagaaaagggaatggatttgttcaaatgggacctcttactcaccattaagaaaatatattgtattggagtcatgaagtgattactgactgctaaatagccacgttggagtcaatcatagctggaacccttagcttttagctgtgggaaacagaggatcaaaagctataatttatccaagaaataatactgggcaatcagaggttagtacctctcatattttaattctaacttttttttttttttaatgacagagagggttcctaaaatcttttatcacatttgcactagaaaaaaaaatgtaaactttttctctgtttcttaatttcctaagctttttgaggaatgaaaatttgaaaacgcaggaaaatgtagaggcctagaacataatagacacattcatttcccaaatgatggtactttgatagtgaaaggggatgggtcacaaatggagatgggcatagatgtgttagcaaacctccttaggaaaatgtgccctaaaaacagaccgagttttgagtcagtattagctatgtatgccaattaactgtggaggcattgataggtaaatcctatttcattaagcttcattttgagaaccacaagtggtggaaagagaactgaataaagtggcttcttattcaccaatctctggactctgcttgtagttctaaagcaaatcatatttatctcattaacctttggcaggcagttcattttcacctcatttttgaaactaaattgagttttcttcactggatttttaagaaatcactgtactaaaatcaaaatacataaaattactttatcctgttttaatatcaatggattattttaattatacaaacactcctgctgatctgggtccttgtttcatcgctagaagtacttgactcaatattagtacatcacttcaattgggcagattcttatactcgattgaatgttttgaccattctcattcctattcttcttccatcctctctaacacattttgtttgactaaggctgaattaacatgatttattgctattcaagtagaaattttacatcacctttgcagacagagcagttgaggtcttgcatatgaaacacacaattgtcttacatgtaaggtcaaagtaatgaaatatagatcagaaggagaaatagctatatatgcataagcatgtttatttataattccaagagcataggtaattgaatgtattgcttgttcaagcattttgaggtgttggatacaagcctttcttactatctattactatttgattattcaatgatgaagtggttatatttctattgctctatatactcactataatatttaaatctgttgtgtaaatgactaaaggtaagtacaatctgcaaaataggctaaaatcttttttatgcaggattttatctagagaaatcctcattaactctcacctctctgcccctctttaagcataatactgattcctaaatgctgcaatacctttaggtggttttttaatcataaaataaatattaacttatattcaacagtttttggttgagtgaaatactcatgaaattgataagccacagagggtatgtatgtgaggcaaggtatatatggtaatttgccttttaacaagtcccttaaaattaccagaaaatcaaattttcaaacaacttaccagctagtttacctgaattcaaaatagaataatcttctttaaaataatcatctctatatactcggctaaatcacaactttatatttgaatttatttctcccttaaaattaggatttcagaggtgaagttgtggtcatattaatggtgttgaggtagtcctaatgttcttacaaaaaacacatcctctgtgaaaaacttacaataatggtcctaggataagaatggaaccactaaggacaaaatctaatgcttttccttttcctggcatttgactatttcagagtttgtttattccacttcctaacagcacttttcagtcatcaatattaattgaatactttgttcacatcattataataagaactattttaattctaatatattctgttctcaagaatacaacatttcttaccactcctgccaacctctgcatgggagaagagaggatttggaggtatagagaggatgagtaaaaattttcagcagaagagttacaagtttttaatatagagtctcttaaagactgcaaataagattagagagtcaaaataatcttacactgtttaaaaatcaagactatccctcacaaaatgagagcaagctctttaaaatgaatttaaagtttttaacaaccgtacaccaaaatataatttaaaccctattcattaactttaaactcatgtccaaaaaaaaggcgttggaataatttattagaaaatatggcttggtaaaattttttccatgttgctttggaaaactaccacaaaacacaaccaataactattaaaattaaataagtcattaggaatctccaaaggaattcacccataaaaaaatcaattgagtaaattttttacttattaaataactgaagcataagaaagacataaagaataatatagtgaacttccatgcactcaaaacctagtttaaatatggaatattatcaataaaatttaaatccactgtattgcacttccaaaatacattatcctcctaccctctcaagtactagccatttaatcggtaattgcaattttcatgctcttcctacatatacaaatatccctaaacaatagataacattgtccagcatattttaatacaactgggatcatccattatgaatgcttttgcaatttgcttagctttacctttgcagaatccatttaatgataaacatttgttgctatacatcttctatttatcttttatctctatgtatatcaaatattgatagacatttcagcaaaatacatttaggattttctaatttctgactgttaaaaggctaagagaatcaatcaactttaggttcaaattcccaaattccaatcttgtcctcttcatcacttttatgaatgaagcctcttggtttccggtttttaataaatgtgcacaagacagtcacatttgattcctacctcatcgtagtatttgcccctagagattttccttaagttctttgactctcaaatatgcttttacaagaatgtttattgtattttacttagcaattttatcttctattcagtttgtattaagaacttgttttaaaataccttatctgtcatattactagaaggattatatgaggacactgatgaaacatgaggctactgctagggtgacgttatatcttcatttcttttgtcacttccatcttcatgtcattttttactgtggcatgggaaatgcatctgacagttctaatggagagaaggaaagacatgagaaggatgtgtgccgtacgtgctttgtgtgtctagtacatatcataattttgcatgtgctcatggtactttcctctgacttcagcatgtgtcccattgtccttgatgaaaatatgctaaaatcaatttttacattgtatttgctaaatagatgtatacttcctcatgcaaggcttataaatgtattatttctcttaaataaattattcagaaaataaatttcttagaattgtaaatcattatatatttctactttggcaaattttattctggcaaaatagctcagttattttgagctagatgtaaaattctacaaaattttgacatttacttcaaagtttttttcatataatttaagttattaagaaacgtatgaggcaaaatatgtatcttggtatttaatagagcattgtgtgaaatttgtcttcttgggatattagcaagcaagcaaaactcaaaatgctatttttggtcaactaaatttgggaactactcaaggtactcagacttcccaggttcaatactttgctaatgtgaactgttatatttttaaaacatattgcaccatggaatgttttgttaacaattgagagcttatagaacttctgttctatagacgacactttagaaaatactgctatatttcttttcttttttttttttttttgagacggagtctcactcttattgcctagactggagtgcaacggcacgatctcagctcaatgcaacctccgcctcctgggttcaagcgattctccttcctcagcctccagagtagctgggattacaggcatgcacgaccatgtccggctaattttgtatttttagtagagacggggtttcaccatgttggtcagggtgatcttgaactcccgacctcaggtgatccgcccacctcggcctcccaaagcgctgggattacaggcgtgagccaccgcggccggccgctgctatatttcaatcctttaaatatatacttaaaacatagagtatgaaagaaacactatgatatactactcattttaactagtatgcgaatttgagatgttaaaatctaggtaaatattgtcagtagaaatttaatgattgtgtctactaagttaaaatctaaagtcgtattagagagtacactgagatgtacactgggaatgatatggacttaaaatattaatatctattaagcgaatatattaacataacattccaaatttttagttcatttgatttccatttttggttgtcagggttttgagggagctttaaataaaagagaaaattgccttttttttttttcaggtatttgttttgtttgtatcaaccaagctctgaactgcctggccacaggctagtgtggcttcctaaaagcctattcatacacttcagaaatattagcaacaagaagtaaagtggtgaagacagtgcctcaaggagattatttatctatcaggaattgtctgttccatgctgcccatgccaaaggtcaatctgatgactttaccatgaagggatacataagactcactgaatagatatttctctcaaattggtttgttctatatactcaaaatgatatttgaaaatgctgtccagtgatatttgaataattgttctgtagggttgtatacttttaaaatttacacaaatttcacttattctgtcattgttaaataaaactatataggcacttaatattcccattatgcagaaaggaagactcagaaaaaggatacataactacagttgcagagatgaacataatgcgtttttaccttaaatcttattttttcctaaattgtgagtagtggttttccaaacattatggctcatgtattcataaaaatgttttttttcttttttctttttttttgagacagagtctcactctgtcgccacgttgtagtgcagtggcactatttcagcttacagaaacctctgtctcccaagttcaaggggttctcctgcctcagccttctgagtagctgggattacagctgcctgccaccatgcccggctaatttttgtttttttagtagagacgggggtttcaccatgttggtcaggatggtctcaaactcctgacctcaggtgatccacccacctcggcctcccaaagtgctgggattacaagtgtgagccaccacgcccggcccataagaacagttttaaaaagaatataggcaccaccaatatttgtgtactattcactttcacttataaatgatgtaaatatactactaaattatattagtgtttatgtctttaaaacaaagcagaaaacactccaaaaaataagaaaagaagaactagcaaatataacagaaacataaatcctcatctatttctcctagaccccctagatcattttatgtactgaagcactgtacaccaggtatttttgagaacactgcttaagggtgtgtttatattagatttttctgtgtttgatttgatttaaccatcacaaaactacatttttgagcactctttactagaaaaaactattttcacttggattcgttccttgataataattggcactattattcagaatgaattctagtgttcaatgccttgatttcaggacttggcttttacttgatgcatgtcaaacagcaaactatttaacctctgttcagtgccagtaaaatggaataagattagcatttacatggtggagttgtgaataataaatcagctaatacgtatgcaaagtgcttagagcagaacttggcacatagtaaatgctgaaaacatactggtttaatattagcattattatatccttttgtgctggtaggaaagtttagatatttttgtttctttaaagtgaaaacaagtttgttagagaattaaagaaacaaaagaatggctactccataggcagagcagctggagatgcttttcaaataatttaaaaacaacgactatgcataaagtgccggaataggcactaagtatatgcaatgatgtgaataattttccctgacattaaaatgccttgtgatcaaaacccatgaggtcactggggactttttggtactgtattaaagaaaaagaattatataaacagaaatcagatggctattccaagctaaagaaatattccaagctaaagcaatattgaccaaattgataaaatagcaataatgatatatctccaggtactccatagtcaaaagcactaactactgtgctcaatacttggatgagacaacctcatcagaagactaatatttaaaatgcaagaaagctacatatctgatagaggacaaaaccctgatctgattatctaaggtatcatattatcatatttatccacaaatatgtacatatattatgtatctatgaaaaatagcatggtgagataatgagattctacataatgaattaacagtgttttgtcttcatcaaaagataatacttttgtccagaaattcttcaaatacagaactaagcatctttaatcatgctaattagcataaatttaatgcatggtgaacctatttgggaataaagatagcaaataaataatgtgtaagttttattaattattctgaattttacatcttatagggtattataatttcattgatcaatgaagcaatctttgttttaacatctaattacaaatattagacagtatatttactttagtttggcaccctagtatttatgaaacttttttattaaatagctgcaatgtcaatgaattaaatttgaaagatttatgtctcttagcatcacattcaaaatagcaaactgtctgaaaaatttagagttagaaaaagatatcctgtgtttaatttgattattatattctactattagctcagtatacaccatcttaagaaaagtacacatatatatataaagtttttaatctgaaatattatactgtaacataattgcattttgtgcccaacagaattgcttgttcatttgatagaaaattaatatcattaaaataagtccactaaaatcatatattttgagcttcactaagtaatgcatattgtattatgttgtatattgttttctgtataattatttagtaaacatgtgtatcttccatggttgctggttggtatactgtagtatgcaaaggtcatttgtaaactcatactttgccatagaattcacatctttgttttaatattactattgaaatgtgactggctaagttgttttttccttgcctatgtgtgtatatatattacaagtctaatacctaatgtcacaatgtggaacaacggtaccaatgcaaaaggatttttttcaaaaatttggaaattcttagttttatttatatcatgagatctattgttaacattataatattcattgttcagccatcctttctacataaattaaaataatgggaagatgtaggtgcaaagattgtgggtgaacatggtgtatgtatgtgtgcatttaatttttttaagcaaagtaatacatatatgattataagccatgtagtaaagaagagcttataattaaaacagttacatctcttctcttctttattcccccagttttactccccagttgtaaatattattacatctttaagttgtttcttctgttaatttccttcccaactcttggtaataagtaaatattttaaataaggcccaaaagcattttgtcacttttaaatctcaaaaaatgctaacattaaaatgtacctaagcttttcagtaacaagaagattttggcacaaattattaatctcttttctttatttctgaaagcaaggaagaaaagcagtattaactggcagtgtaatgggttgaacataaatctcgaaaatatctgttttataattaaaaataattgtgtgtgctgcagcgaactaagttctgcagtgtaattaaacctatttaacatacattaactctataagtaatttgcataaattattctgcttaacaattttagtgtacactaggggatactgtgatttttatcaatgcattctattcactgaatggataatgatatggttttaaaagttgagatgtaattataacccccatagaagctccaaatcaagagtgttacaggctgttggaataatttgccaaattacagggagaattgtatatgttgttttgaaagctgcatttgaatcttttatacaaatttttggccaatgtcagctacagatttacatttttctcaatgttccttttcagatctattagttcacgttaggcttttattaagagaaattgcattatgcatagagttctatataactattgtcataatttgtcctactgaaaaacgcagatactgaattttatgtgatacatagtaatataataaaactagaggctggaaatttgagttcttactcttgatttggacactatcaggccagtcactcagagcaagttggattatcaatcctggcttcagtttctttgcctatgcaacacaatgttattggactttaataaaaatttagaaagggtattttaagtacatcacaaaactcatcacaattagttttatatgctgctccatttattttactatatcagacaatgtcatgccattgctagccattctgcagggcatgtcattgtctagaaaaaagactttaatccacataacatgtcacattttcttttgttccctctatcattctccttctcttccactttgcaaaggcaaagtattggaaaggacatagagttgtcagagagtgtgagaaagaagtcacgacatggcatgcaccagcttttctcttgtcccaagcagccaagaaaatattacagaccagaagttttctaatatttttttgaatccctttagattcataaaaattattgatgaccccccaaaagctttatttagcacggtttttaatctaatgatatttactgtattaaatattaaaatgaagatctttgaaaacatttacattttgttaactgataaaagcaatctcattaaagggtcctgtaaaatttgtcattaaggccaggcgcggtggctcacgcctgtaatcccagcactttgggaggccaagacgggcagatcgcgaggtcaggagatcgaggccatcctggctaacacgatgaaaccccgtctctactaaaaatacaaaaaattagccgggcgtggtgccgggcgcctgtagtcccagctactcgggaggctgaggcaggagaatggcgtgaacacgggaggcggagcttgtagtgagccgagatggagccactgcactccagcctgggcgacagcgagactctgtctcaaaaacaaaacaaacaaataaacaaaaaattgtcattaagaccccttattttgaaagtcaaaaagtattgagaagattggcattgtttgacattaaaatttctatattgtatggcttaacagaagacaggtagattcttccatctgctttcaatctgttgtggtatctcatgtcatggagcttcttgaaatcttcactgtatactcataagagaaaagagtgaaaaatgcaaataaccccctggtgttatcgaaatagtttgatgtcacagattttcagaaagggttttgttctcagaccacagtttgtgaaccaccgatgtagacaagggtacaggggtaagttacaaaatgctgtgctttgagtagcagagtggacagttgggtgtggggcaggaaaaaaaggggctgaaaggccaatccctgaccacaagtagcatgtatacagttgtgtctactatacacccgaaataagcattcaaaatgcacagagaatcagtaaagaatctgaattaattgatacccatttctacttggaaaagaaacaaaattctatgtcaaaatctctattaggaacacttactattatatgatcgttcattaacttttaccattcctgttaggtattgaatagtattatactatttaaaagaataagagtcaccacttttactaaaactcatgataaggaaccaaggtaagcaagaattaaatacctgctcatataccaataaactatactgaggaagcagagattaaggagaaagagcatggagacatgagcaaggctcagagcaaattagatgggcacacatatttcttctatgcagagaacaaaagaaaaagttatctctgattatgcaaaaatgaaggaaatgtatcatggttaagatgtcagcattttcatgttcatgttttcagtccaggacagaatctggagaatggggtcttctccatcaacatctagtcagcaactgccacagcttaactaatgagatgcttcaggatccactggtggctgatttcataagaaaatttgtacataagccaaagcttgagctaatcgctcaacaatcatactcagaaaagagaaacgtactagtgaaatgtttatttcactaccataacagtaacaatttctcacacttacatggagcttattatatgtcaggcattgccctgtgaactttgtgtatttcggccccattgatcttcacaacaatcctctgacagagaaatttttttttttttttttttcagatgagagaattgaggaaaagagcttttaaacccaggcagtctggctccagtatatcaaaaggaactgagcaatgactgaatctgggcaaagctatacaacaaaagaatatgtagaaggttttctaaaaattcaatgtctagagaagtctacttcttgaaattcttactcttacacacgaattttctctacctctctcagagcacaatcgagtgataacagctggagtaaaataactttgtcagcccggcgtggtggctcacgcctggaatcccagcactttgggaggccgaggctggcagatcacgaggtcaggagatcgagaccagcctggccaacatgatgaaaccccgtctctattaaaaatataaaaattagccaggcatggtgtcacgtgcctgtaatcccagctacttaggaggctgaggcagaagaatcgcttgaacccgggaggtggaggtggcagtgagccgacatcgtgccactgcactccagcttgggcgacagagtgagacttcatctcaaaataaataaaaaaataaataaataactttgcctagtctcttcaccactgtatctttagaacccagaacaatgactagtatagaacaggcttttaataaatatttttggaatagaagtctgctatttataatgtaagtttatatcagaaattcagtgaagtacagctggaaagtgaggttctttgtttagttttgattctccagcaactctattatctatctgttgctaatctctagattttctgatttattttttctcaaattttaatatttatacaacaaattgtgaatcttgttaaaatgcagattatgatttggaggttcttgaatgaggcctgaagttccacatttttaagaagttcccaggtgaggtcaaggctattggtccaaggacaactctttgagtatcaaagtcttaaaagtaaataatagatatgactttcagctttaagtaaatcaaaatcacttacaagttataataagaaatagtaaataagccctctgtgcatcaagatttctttacacacttcccttcttattttcactgtcgccattattttaggacaaactgaaaagtgacatttctcactgctactggaattgtcacatgtgatgttaaattcttcaagctccacttggggacatggtgcaatgatttgtctggatatttccaactgtaaatgttttctctatgaccttttctatggattaaacacaaatcaacacatatttaaccatttgaaaaggcaagatatcttacagttaaaattagaatggaaaaatgcaaaatcatccacgtcaacatttttttggattcattcatgattccaggatttcaatagataaccattgtccaaataaaccaataaaatgtgaccccttatgggtttttttgcaatgaaaaggtcaggcttgattccattcatttcacacatgtagatagatgctatggaaaattttaaagaaagtaatcagtatttatttagcaaatactgttacgatatttaattgcttctggacactattctaagtattataggaattttttttgcttcccaggcataacttcccaatcaatatgtactattattattgcctccacattttcgggttttttttttttttttttttttttttgagatggagtcttgctctgttgcccaggctggagtgcagtgacgtgatctcggctcactacaagctccccctcccgggttcatgccattctcctacctcagcctccggagtagctgggactacaggcgcccgccaccatgcccggataattttttttgtatttttagtagagatagggtttcaccgcgttagccaggatggtctcgatctcctgacctcgtgatccgcctgtcttggcctcccaaagtgctgggattacaggcatgagccaccactcccagtctattacctccacgttttaggtgacaaagccaaagcactgcaaagttaaatatgtcacccaagctatagcatctatttgatgggctaatcaaggactctggcttcagcatctgtactctaacagccctgacttcaccactatacaatctatgcacgtaacaaaattacacttgtaacccatatatttatacaaattttaaaaatctgtactcctaactgctgtactccaggctgcttctctttatgcatttcttagaaaaatatatttgaaattttcaaagagttgaaatattctatccaactatatctttaacctcaagaatcagacttcctccagcaacttacatgtcacagattgaatatcaacaaataattaagatatagaacaatcaggcctacaaaattgccagggaagtggggcatggtctttcttctccatcatatcccctgggttcacattaattttcactgagcatattctgctataataagctaatctattatctctattaccatacgatatctatattttcgtagctcactaaaatttcagaattacatttccaattgtgcattagacatccccacttaacgctgtacaatggtaagagaaagtaaacatatcaatctcctacaaagatgttctttgtcgaaataagccaataagcgctgtgctgaatgatattaccacctgctcattaattaggaatctcagagacatcttaacaattctctctttttttctttattacatcaaagtgtaccaaccaatattaattttacctcaggcgagactacattagctgaaggactcatcatctcttctttggactattgtggtacctcctgactttctcatggctcccagttctccaattattctttgatactctcctcagacaggctttttaaaaccacatacagtctttccacttgcaggttaaaaaatgttaagttgtccactctgcttatagatttaagcccaaactacttagtaaggcatacaaggacattgctaacgtaacccctgactatgtttccagccacagtcccaactatttctcttcccaagtagctacatcagcttctcacttcaacaaaccatgccctttaaaatcttcttagcacacactttttctgttctgtctagaatattcctgtccatattttcagcttgacagtttttatttattcttcaagatgattctttatacttgaagtattttcctatttcctcaagtagaatgtactttatcactgactttctatcgtactttaaatgtattttctgagacactccagattatcgacttctagcaggcaagggattctctcatagtttttagaacataagaggagctcagtcaacatttactgaataaataaataaaaacaaaccattaggtttaaccaatggttttctattttctacttcataacttttgatattgaaataatagttcaatagttaatactacaaataatattaattataataaataatagggcattttatctcccacattgctatgtcaataatttctccgatttggatggaaaatatttgtagaaagcacagcaatgagagtaaattatattaatagtttcataaatccccaaaatatcctctactctgtttccatagtcatgcctttccagaggggagaataaactaaacagtcaaatgcagaatggtgtaggctgttgactgccaagagaaaggaaaagccattcatgttgagttcaacatagatttcattatcaggaatgtgctaaaaaacactgtcactgctgtggtcccaatgtaggtggtttgtctgacatgtgggaggctcatctttggttgaaacatgctgtagtgctgctgatatatggctctgcgatgtatgcttccctatgccatctgtaaatacaggtggttcctgctttatgccatgatctctttctggaaacccaactggagagaaaacaatagcaaacattattttctgtacattcacataaactgctatgtatacagaatacggaaggctcataaaggtgagaaagtttgcagttatcattttgacctctagatggtgatgctgctctggtttgacatttgcactataactcacattgctggagttgcactagattgttgttcccaggacagccaaaaactgtggaatgagcacactataccagacaaagtggatcttgagataagcaaaatatagagatgtaaagcagtgaattgttatacttaagactaaatagaacttttactgatgtatgtagactcacaacataaaattgtcatatttgttatttttgctatttttataattataatcatgggaattctaattgtgaaatacatctgaaagtagatgagtgatgtaatgaacctccatttgctcacaactcagcttaagcaattatcaagacacaacctatcttgttcatatttattgccacgtacttgctccatgttttgatgccacatacatacgtgcactaaaaaaactcataattctccttggcaaaactgactttgtgaaaacattttacttgaaatcactctttgaagagaagactatgagtatagactattaatttttgaaaagaacaccaggataatgattaggaagaaggaagtttcttggctttatttcatgacctgggtggtgaatacatgggtgggtttgctttgctgtaattcacctagacttataacttgtgtacttttctgtatacatagtttattttcacaaaagaaaaaagaaacagacaaacataaaaaaaaaaaaaaaggacctgtgccttatatatcctgtcctcttgatagatacaggtttacaatgtagagtagctattccttattgaaaaatggaatcacttagagtaatgacaaaaatgtatttaacttgcaagttaagagagaaattaaggagaaaattcaattgtgccaaagccttccactgtctttcttacctaaagggtaacgaagaaatccttggtgtttaccttaagaaaccctcttaagagctcaagtcatcttgacctttctttaaatggaagatataataatcataaaaggaagagttctgcccacttccttgcctacctctttacctactgtgttaccgtttgagccaaccactgccactgggttggtttgcagctttgtggggatacaaggaacacaaatacttgagtaaaataatgttgaaagtttcacgtcctggaagcccaatggggaaataaataacaagccaaaagcaaaataaaagtgcaatgattgtaaaagtaaaaagaattaaaggagataagtcaatatgaataaaagtgaaaaatgagaaggcggggagaagagagtatgtaagaagctgttctcacttgccacagatgcctttctttactactcctttgattcttctctcctctaagctcttagagtgttcaaagtgttattttatgtcaagaaaggcaaaatgggatacagacagtatctactctaaattcagacaatgcttgattggaacttgtaggaaagtactttacctccttgtgttttagctcccatagctataaaaaagggttaagaaaatctgctttacatgtatatttcacttattagagacaaaatatatcagcacattgttggtgatcaatgagtaacagccattactgttattattaattactatcatttttatgtttgttgtattatctaacttatatctaatagtattagaaataagctagggctatagcaggtgttttcaaccatagacaagcataatttgagtgtaagcagagacagccttaggggctatatgtgctgcctttgacacatattggtaagttgtctttaaaatatgtaagacaaaaatgatgagttttcctctttatatgttgttttcagtagtgtatgttactgatattcactaattttacaatttacttagaaaaaaagagagtaaatgtaatacaaaaagaagttatctaactcatagatagaagacctacaatgtcttctaaagatatctaatgaaagacttagaaatggattttctttgctagagacagtgatgacaccttacttgtccttctatttttgttctaagttcacctactgaaatgaaatagtacatgatggatagtaaataatacctctcacccttctcaggaatacattcaatgcaatgggttttgtttaaatcgataaattagaggtgtttatttgaaagcaatgtcattaaagtaatagagttttaatgcaggatacagaaatattagaaagaatacagaacattgtaattgagtaattttaggaaatttctgtccttttaaaggtaggctgtgattactagatattaatctcacttatgggaaggaactaaaaagacttatgatcaagtctagcataatcttttcttaaacatatgatgatgttaatattacaaaactcagcctgggcataattagacctattttggaatgctaatggaaagacatatggcaaatcatgatacaaaaatttactgattcatagaaggacctttcatcaacatttttacctaactaaattagtgattttcttgagcttaaaaagatgaagtagccagaggatatgattaagcagcaaaacacacaggacagagctattttacccattttaatggcttcagtcatatctgttctggggaatatgtgttttttttaattatgtttgataaaattaagcaaaacaaaaacacagtgccaagtgtctcaacttaggcatgcaccatggttaaaaaaattgtgctaaatttgaagtcaaaagatgtatagactagttcttgtttctccatttactagctaataaaacttatgcaaattatttttcctcttagggtccatttatttaatgataaaataaggagtttagaccttggcaaatactttctaaaattcttagcagttttaacagttcaagatgccattatcctttattttctattcaattagcacattgcatctattttcccaaaagatcaaacatgaaatggcaggtgtgcttcaattctcatagccaggcatctagtgttcttgtcctggtggtgtggtggtaatggcggggacagagtggagacagtagtgagagaacaaagaaagtaggtgagacagctgagtgtatccatacgaacagccacaattgtaatagcaagtacctaaacacaactttgaaagccaagtgttttctagtatgtataagaatgaggctagtggaaatgaaaccagatgatttttaaagaaataccctaaaaggaaaaaattcctcttctaactatcagcccatttaatttggttcttctaagtaataattgctgactgctgcctagtcgccccattctctttttctatacactgaatatttcaccagactgacggcttctggatcagacagtaagtcttgaaagctaatcttcaatactttccaaaagaatagcattaagtgagctacacagcacattagaattttttaatgaataaaaaatacctatctctcggttaagttttaagaaagcataaatagcatgtcatattaaatagaaacatagtgtcaaaaaaagaacaataatgagaacaagtagtgagcttgtgcttaattatatgcgaggcattgtcctaatactatacatatattatttcatcaaactgtcatagccatattatgatgcaggcactattattatcccttttctacagatgttgaaactgggacagagaaagatccagtacattgaatgaggtcttacagctcacaatggaacaaagactgaaacaagagacttgaaccatcacttatttgatggtttgcttatcagtaggacgttgttaagtcacatatttgagaacattatttattttcacagttcttatgttgaaaagcctcacttatctttttcttctcattaaaaatgtagtgaatgtaatcagtgaaaggaagtattagaacgcatgttcacaagcaagccacttaactgtgctttactaaaattttcaggtgaagagtgactgcattaatttaattttcagcggaagacactaacgctgtgaaatattttcctttcttggggctattctatttttagtgtaagaattctctgacatagtacaatacttactgtttcatgtcaacctgaaaatcaaacggttctatactaaacttctacatgtttggccttgggaaacatttatgtagaattttgaaatacattgaaattgaattaatcaaatcaaaaattaaatgaaaatacattttgaattgaagtctttctatgaaatttctgcagacagaatattttactcatctaaatatatttagaaatcttcaaaaatataccatgcttaatatttcataattaagaagctagaattttttcttaaatattaaaaaattctacctacatgcatccctttttaaagtagtctgaaaagtcagtttgatggtcccatttcctacctaatgctgtctttgataaaagatctcttctctcctgagatcacagatgcagacatataatgagtttctctgtgatcaataatcctcacccctggtctgagtgagtgttcagaggagttaaacatgtgatctttgcctgaagtatttctgtttgatggaattggcagaaaatatgcctcttttcaaaatgattttaatatttttctcagaataaaataggtaaatttaaaatttaaagttataatgaaaagcattagtttccctatccaaccaaatttgtgcttctcagtgatcatatttttcaacactttcagcttttttctattattatatatctccatttttctaaattataggcttatgctcttattgtaaaattttgaatgttagatattgtccactgaagacaatatgaatgatatatatttaaataccttacagtctctcatccacacatacttgctgtcttccatgcaaccaatatagtatagtgacataaccagttgctaccgagggtttatgctactatcgttggctatataactgagttgaactgcatattagtattatgtttattttcttgtacaactttttcctcactgtttcgctctatttttacatcttacttttcaaattaatattgtcacaaaccttttgataccatttaaaatgatatctggtattagctaccagagcactttgtcctcctgctccaaactgaacaagttatttatctgtctgttgagtcctcttcagaattccagttatcattatcttggaaacttcttctcttttctcctgtaatgaatattcaattcccttaacccaactctccctcttgtcacactactccattttggtggagatcatctcagaacatcttcctgacaaatatacacatgaagtaaatgtgcacatttggaaatatagcataaaggaaattgatcatttacatgattagaaagttggctgagcatataaatttagtatagaaaccattttcttggaatattttgggagcatatggtgtatgtctcagaattacatacctactgccttgtacctctcactgttgctggtaaaacagctgattgcattttgattctcattcctgttatgtgatctactttaactcttgggtcatggaaatgacccaactacttcttagttgaaagatgtgatgctaatggctaacagctatttatcaaccacatgcacagtggggagtagggcacagacaaaggagtttggaatccagtaatggtaggagaaaatggggccaacacaaagtcagagcaagtgctgaaaatagaaagaaagaaggagaaagagaataatttttaaaacagactttagtacaatacagttttcttttcattttgaaattcattaataactgctttattacaatgacctcccttcctctcctttagatttccacgtatacttagtagtaatatgaaattatatgataaattattcatatcaatgccctctgttttgttgtttgcattatttgacaggttttgagtaggttgtaaaagtgccacatgcctttgtgtttctgattagtattccttttgttcctggaagtttttgcttagatatttttgtcatgtaattcaggactttggatagtcaatgacacatatctggattgtagctcataccacttgttagtaaaagagtgccgccttgttcctgtttgccttgaattcttaccttaaattttactttgtctgccattaacacttttcatacccatgacattttctattacctttgcattgctgcctttccttttactctaaacttttacatattccattacgtcctagagcctccatcagtgcctggctcatggtgagtacatagtgagtatgttacaaaatggataacttgtaagttcagtcgcttcatgagtttgcaattaactagcgttcttgttaatgtttatatgcacaaaatctcattacaaagtgtgactagcttttaggcctaaaggtagaaccaaaagtatgcaaaatatttgtttttatacattattattattattattaattattattattgagatgtagtcttgctctatcacccaggttggagtgcagtggtgcgatcttggcttccgagttcaagcaattctcctgcctcaacctcctgagtagcttgggttatagtcacccaccaccatgcccagctaatttttgtatttttagtagagacagggtttcaccatgccaaccagactggtctcaaactcctgacctcaagtgatccgccagccttggcctcccaaagtgctaggattacagcttgagtcactgtgcccggcctgtctttatacttaaaaaaaaaaaaaaaattgatgaagtttacaaaaattcaacataaagcataatatatctaatgggttaaaagtgaggttaatctattcagactgtgagtaaaaccaataaaagtaatcaactttatagagtcaaataaaaaatttcattgcatgaattgatctgaatttagcctctactgaaaacctatttatgttttcaagtaactttccttgttctctatacttggacagttcttggaatctaacattcagattattttgtatttgaatacaacttaactttcagtatatgagctttgttggcctcacttatatatttactcatcattaattgaatcatcaccttgtgaaacagcatacaagtgtttgaaataagtagctagaactggacactggatcattagttaagctaatgcccttcaataactgtgtgaagtcaaaggaaaatagaaaattgtgtctcttattgcaggaacctgagccttttccccagctataggcaccttgatgatctttgcctcaatttctcttttttcactctttctctttccaatatctgttcttcttacctttcttgagacataccacctttacgccttgccatatttctcagtttgtgtaaaaatcagaagatttgtcaataccaaacccatgtttcaacatgtcaacaattagctggagcttagcagctgctgactcctgaagccaaaaactacactcttcattttaccatattttattccctatccacttcatttatttacattatcatcatgttcctttaggttgttgagttcacatcaatcacaggcatatctacctggttggtgtttggtcagatcatcccccgaaatatctgtttatatcaacattttcaggccttaatttagtacaaatactatgcatgcctctttagctgtgagatagataaagtagttatgtataagttatgtataagtaggaatccttaggaaagcccttttgagggtcctctttgcaaataccaacatagttattagttattaaaaaatttccctttctggtcatcaaaatgactcttgaattagttgatgctataggccttaatgcataaacaagtagaggcaattgtgtcaaaatacagaagtttgaatttgcaggcaggtgcaatgtaagaattataattgtatttgatttaagtgatagtgcattatctaggggttaaatgtgcatataaatatttggctgctcttgataaacaacataactagtccagttggctcttcccttgatactctttcagggaaaggctaatgcaaaaagacaagcactctggtccgtgcttgttcttttccacccgccagaacttgcccacggaataactgtctctttcctgatcataggagccacactcagatgcctcaggaacccacagatcatcagattaatatatgaattggaattgaattggagaacctaatcctgcctacgtttagtgtcctctcccttcattttaaaagaagtgggaggtggtaatatgaagcgtgatgcagttttccacacatttgctagctccatgttctctatgattggaaaggacccacttgattagaaaaaaatgaacctcttctaattcataagtaaaatatacttcttctgtaatcagttaattttggtggggggcggtatatatgactacttgaaaacagtactgatgtaatttgtgacctctcactaaacagtcattaaaaatttcaaatttgaaaattcaccctatgctcaataatttggaactgcagtgaaacattgggttacagcagcatgggatatttatttcatataattgtattgaactatggaaacatagaaaaactagataaaaacatctttgaattattgttaactacaggtttatagaactgggttgcttatattaaaataggttctttatgtaaattggctggatcaataagcaaggttcaaagaatctgaaaaaaatagacaatttactttttctacatggcaacatagatattttcagaccacttcttactggggcaagtaactaaatttctaagtagaggcttgtacttgcattatcatgttgcttgaccaaggtgatttgtatgcttaaaattatatacagaatgctttgggggataattctatgcatgcagaactggatctattttaaaactataagtctgatccttttatttctttttactgtctacgttattatgtgcatttctggttcaatttcccaagttacaaggtaccttcatgtcctctgaatttaataaccatgagactacctaattgtcatttcagcctctttatagcaagtgaggagaagatatctgaaatgtatttttaaatattctttaatcagacatgcgatgaatcccaaagcaaaaccatgttagtatgttctatctttgctaatcagattcccttggaaataacaaaaagaatagttcagtaatttaaaaactggcacattattgctttaataggaattgtgaatattttatcaccataatccccaatgaataattctgctttgttactttccctttgaggagaagagtacttgaagttatgatatgtggtgatagaatatctggaaaacctttgagattttttaccaagtgactctgaaaatcttgggtattctcttcagaataagagatagtgttcacaatgtggagcaattatttgtcaaatttttctaaatattgagattagcttatcgtgccctattttgaatttgcatttatcctttcatttgtttcaaatctgttgcatattaactagctttcttttaagtctctaggatttcttcattaacatagtatctttgccttttgttataatgtcatacactcttattcacacgatatttttatcaaagatattttactgacttgcctattctgtgtaagggactatggctgataaagtgttgttcatctcatatttaatgtgcttccctgcatttttcagaatactttgtaattaggtaaaggttataagactagttactactgatgtgtgatgagccaaaatgaatgaagtcatttcttatcaggtattattaattgctgatatgctacctgtttttttttctgtttcctgctgcattaccttggaaactttggatctgaacagtgcagctactgtggactatcctgttcaataaagaaacagttatgtacagcataagaaaactagagcaaaggaaaaattatagaacaaatatggttatttaagaaataatattaatatattaaatgcatgccttgatattctgcttgccttctagaggggcctcaaaattcattctaaatttgtaagtagtaaaaatgtataaaaaggaaacataattcgttacttgctttataaaaataaccagttgattggaggaaagcaattattactggaattaagacaggcagaaaatcatccccctatctcatagacagggtatcatgatctaaacgaacctatttattcttcaatgctatttaaatacagagccatgtaattttgcagtcagagaagataattctaaaatttatttggttatataaatcctcaaagcacatgactctttaggttatgtttttattttttaattgtattttttgtgggtacataggaagtgtatacttatgaggtacatgagatgttttgatacagatatgcaatgtgtaatagtcgcatcatgtaaaatagagtacgtaacccttcaagcatttatcctttgtgttataaacaatccaattatagtcttttagtgacttttaaatgtacaattaaattgttattgactatagtcaccctgtagtgctatcaaatactaggtcttattcattatttttattttatttgtacccattaaccatcccccccttccacccaccctctattaccctttccagccgctggtaaccatccttctactatccatggctgtaagttcaattattttcgtttttagatcccacaaataagtgagaaatgtgatgtttgtctttctgtgcctggcttatttcacttagcataatgatctccaattccatccatgttgttgcaaatgacaggatctcattctttttatggatgaatagcactccattatgtataagtaccacattttcttttattattattattattatactttaagttctagggtacacgagcacaatatgcagttttgttacatatgtatacatgtgccatgttggtgtgttgcacccattaactcgtcatttatattaggtatatctcctaatgctatccctcccctctccccccaccccacaacaggccccggtgtgtgatgttccccttcctgtgtccaagtgttctcattgttcaattcccacctatgagtgagaacaggcgatgtttgttttttttgtccttgcaatagtttgctgagaatggtggtttccagcttcacccatgtccctacaaaggacatgaactcatcattttttatggctgcatagtattccatggtgtatatatgccaagaatggcgatcattaaaaagtcagggaacaacaggtgctggagaggatatggagaaataggaacacttttatactgttggtgggactgtaaactggttcaaccattgtggaagtaccacattttctttatccattcatctactgatgggcacttaggttgttttcaattttggctactgtgaacagtgctgcaacaaacatggaagtgcagagatctcattgatacactgatttcatttcttttgggtgtatatgtgggagtaggattgttggatcatacggtagctctatttttagttttttgaggaccctccaaattgttctccatagtggtcgtattaatttacatccctgctaacagcatatgagggttcccttttctccacatcctctccagcatttgttattacagcctgtcttttggatataagcattttaaatggagagagatgatgtattattgcagttttgatttgcatttctctgatgatcaatgatggtgaacaccttttcatatgcctgcttcttaaatgttctggttatttatctcttgtctgatgagcaggttgaaaatatagtttccagttctgtgggttgtctctttactttgttaatggtctcctcggctgcacagaagcttttaacttaatgtgatcccttctgtccatttttgcttaggttatctgggcttgtagggtattgctcaaaaaattttgcccagatcaatgttctggaagttttccacaatgtttaattgtagtagttttatagtttgaggtcttaagtttaagtctttaatccattttgatttctgtatagggtgagagatagtagacccctatctctagtttcattcttctgcatgtgaatacccagttttccaagaatcatttattgaagagactgtctttcccctcagtatgttattggaacctatatcaaaaatgagttcaccataggtatatggacttgtttctgggttctctattttgttccattggtctatgtgtctgtttttattccagtgccatgctgttttggttagtatagctgtgtattataatttgaagtcaggtaatgtgaatcccctggttttgtaccttttgcatagaatagttttggctattctgtgtcttttgtggttccatataaattgcagaattttattttctatttctgtgaagaatgtcattggtattttaatagggattgtattgaatctgtagatgactttgggtagtacggacattttaataatattgattcttccagttcatgaacatggaatagctctccattttttggtgtcctcttcaatttctttccttgatgttttatagttttcattatagagatctttcacttctttggttaagttaattccaaagtatttaattttatttctggtattgtaaatggcattcctttttaaatttcttttttcagatcagtcactgttggcatagagaaatgctactgattttttttaattttactattattatactttaagttttagggtacatgtgcacaatcctgcaaatttaaaggatttgtttgttagttctaatagttttttttgtgtgtgtgtgtgtgtgtagtcattaggtttttccaaatataagatcatatcatctacaaacaaggataattctacttcttcctttccaatttagatgaactttatttctttttcttgtctgattgctctagctgggagttcctgtattatgttgagtaacaatggtaaaagttagcatccttgttgcattccagatcttagaggaaaggcttacaaaatggataattcctgaggttcatttaggtcagaatttatttttacttattccatatgaatttttcaacatcatgcaaatactccaacatttaaatatactatattactagcatgaaattctactgtaagtatttaaagaaatacatttttatgtctagtcatttgtattctgttaaaaagtataacagttcaaaaagaatatttccttaaaaagtataagtaaaaatttctgcattagtttgatggttgtgccttaaaacctttatgtctttctaacttatttatgatcaaaaatattagagaaacataatgtagtttgaactatgtggtacatttctcacaaatgtgtgtagagattaccaaatatctgagtgttgttatagataatatattttgtctgattcttttttagttaatgtattttatttctatttatatactcaaaatcttggtagaaaatctaagactattcattgttgtttatattttcttttttatctttagagatgaggtcttactctgttgcccaggctagcaggctagaatgcggtggcacaagcattactcacagcaagctggaaatgctggcctcaagcgatcctcctgcctcagtcatcagagtggctgagaatacaggcaggagccactcaacaatttctttctttcttttgataaagctattttgccaatttgatttctaattaacgttcaaagagaaccaaaaagaaacacatagagatgttgcatttcttgaaagcataatatcaaaaaggaaaacgctgtctttcctaaaacgctttgctatgcaaacttaaaatttcatggatgttctttggaaatcaatgacccatgagagcaaaccatgtacaatgcattatgggtcaatacaaatcttaagaataaaatatgagagtaagatggttttgaacatgattttcaattgcatttgtatcttttgaatttttaggaatgatatatttagcttctttgcatcagaaaggtttatttagcaggcctctaaaaacgaaacacatatcatagtacccttcactaatcagcaaaatgtgtctttactaccacatgactgaaacaaaaagtgccatcatgtgtcccacagtttttattcaaaaggaaagtactgtttaccaatttaccttaggcattttataaaattgaggcattagtggagtattctgaagtccacggaacaaaatccactagtaattgtgaaaaacgtttgtaaattgaaatatgaacataaccatagaaaaattatttctgcagcccttgtcatcccagctcaaataaatatcacaacaatttccatttttttcctagtttgatacctagatattctgtgccatgtatatttgagttcaattgtgattagtcgattatgctatgatcagaatagttttatcatctttaccagtttgaaaaatgcacttcacacattgaaaatagtttttcacaggtatatttcacacttagttactccaaagagaattgacatatggtagtgatatttaaaaatccacaggctgcttagaatggagagagattagtaggacgctcaactcagtaatcatagactattaattcaactaaaatataaaataattaaaatataagaccaaaaaaaaaagacaaaaagtaacccaaaccctgtattattttttaaatgctcccaactatacatcatggacgattactcactatctttttcttttttattattttctgaccacacatcgcctttacaaattttatcttttctttagttgtgaagtagttttctacttaaactgccaccatttcttaagtattttagttgcctaggaaacatacaaaggttttgctgcaatagcaggtattcatttaaccaccaaattccctctgtaagccagattcatcatttctatattgcagaagccttcagcggagcacttgactgcagccaactggcttgttagcatatcatgctttcaatagagtgaaatgggtcaaacagattttcagagatctttaagcacagaattatggtcctcccaaaatgattcagagtatcatttccttgacattcatggtcccacagaccaagcatctattttgtttctgttagtctaacctgttatctggctacaaaagcacacattagcactggagagggatcactttattctctctcttttcaaaggacataactctttcaggaaactaggatgtagtttaccacatacaaagttatctacagattttttggctctgtgtgacttttatatattatatttgtgtagcactagtgtggaggaaaataatattatgtcatacataatggcttattataactgctaggtatttcaccagtggcattattggaggataacttaatctctgtagctctcagttttcccaatgtaaaaagtgataatagtaatatctaaacccaaagtttattgtaatatatttaatttatataaaattatctcttttgtttcttataacagagaatagttctaccatcttcccagttcacaagtaagaaaactgaacctttcttacatcttacttcttattcttcaaatccagtaagtcgtctaatgtctgcaattcactgtcattgctatttccaaaactggtacttatttggtattaaagtctgaggttggactgttttaattctcaacaatgatgccaaactgatctttctaatacgtaatagctgactctgtcatttaatttcagtaactccacatgaaacttcagatttctaatataggcatttaaagcctttctttttcaaactcttgtttgtattcttcttcttatgagttgacaaataaacacatatcagtctagcttattgaattatttctagttatctttatattgtatgctttacttttcactccagtgcctctgcattgtaattgtttacctggaacttctggattctagaactgacttgccattagccatttttatttccacaacagaaacattacctcgtctatgaagaattattgaaatacaatctgaattgagtattcctgcttttatgttgtagaataggataaaatagagattatgacaggttcactatcatatacccatgtctactgtcccatatgacatatattgaacaatgtttgcttaaaataaagttcttaatcagcataccagtatatatcacaggatgaggtttcatattaaacagaattcatacaagtatgcctgatatagttaatgaaacaggaaaccctaagatatctatttttatccactaatttgcatgagtaaaataaatataacggcatttgtcaaggaagatggtccctgcacaaaatgcaaagcacaaatgataataatggggctatttttaaattttttatataaaagcttctgatagaatcttccttaataccatggtgtggaagtgtggtgtagagtgaggagagagaccgtccctttagttctccaagggacaatgagcttctgaatgagttggaaagtgacactgatatttggattactactgttaatataatcacattggtattcatgggctagtgatgccttaagtcattgttcatatttttaaatagtcatacaaagaagggacatggaaacatattgtgaacatattcacttagcttgtctttatatttttaccttaaaatgatagaaaccatgaacttacaggtattggctgttaggcattattcacaatttaaataccttctgttcagttattacaaacattcttatcagataaaatgtaactgttttcaaacactagttaaacatcaaggaccactatactctttaataaccaagcaattttaggttaaaaagagaatgcctttaattaaaatcacctttaatagataatgctctatgctcaggccctaatgttctcatttcagttatgacacatttcaaaggatgggactatatgtcatgcttcctttgctcctttcttctgcaataaatgcatggaactaatgtggttgataaggcttatgttttacttcaaatggaaaggagtaagtttttggaagacaattcagttgacatcttcagctgttcttattttaactcacttttctttttttaatttcaggttgaaaatggatgacaccttatcagatcatcaaagcacagtattaccagagttatagtgttgaatgtgtttcatctgcaccatttctaagtaataattcatcacaaatgacaagatagaatctctagcaataagattttgggtcatcgtcatcctatagacttcaaaagaaacacaggcactcaaacgtctgactctaatcataagttagcataataggaacgatggcaatagaagagtatgtttagctgatatcatttggaaatgggaacatgagcacgtgattacagcgtaagcaaaagaaacaatttatctatcttaagaatattaaccataggtttaatctaccaaggagttttgaaaatatcatttcaaaatcattaaagagggcaggcacatgaagacagagaggagaaggatggttaccaaagactgagaagggtagtgcagggactgaggaggaggtggggatggttaatgggtacaaaaaaaaaaaaaaatagaaaaagacctagtatttgatggcacagcagggtgactatagtcaataataatttattcatacatttaaaaataactaagagtataattggattgtttgtaacacaaaggataaatgcttgaaggaatggatatactatttcacatgatgtgaacagtatgcattacatgcctatatcaaaatatctcatgtaccccataaatatatacacctactaggtacccacaaaaattaaaataaaaatattttaaaatgtggtaggtattagtctctatactttttcttgactgggtgatttcctgggattcattacaattttctgattctatatgatcaaaaataataaaaaatgttaattgaatcaataatacatatattgagcaaaataagttatttcaaaaatatattgaagtacaattggaaggaaaataccaagaactttacatgtctgtgaaattaaaaaggtaggaatgatagccccaatcctagtcaacagagtaaaatatcacaaaacttgtgaaaaaataaaaacggatttttttaaaaagtggaattagttttaaaaaattgtataagaaataagaacgtttgtcaaagttagatttaaaagcagaaaccctgtaagcatacatgatgcaaatttaaaaactgaaaaaaggataatctctaaatttgtcagaaaaaaaaaacctccttctccatcttaaagaggtacatttgaattaaaatatattgcgaaggataatatgatttttaacgatgtataaaattgttcttgttgtttcttaaaccataacttaaactctgatttacatcttaaatgtggactctcactgggattctaacatcattcttagcctcaaatatccacttccctggcttctcctctctatgtttataatgtaaatggctcacaaggttatttctccttcctccatctgtatctctcaccattcctaaccttacgggttatttttcaatttggattagtcccctctcacatttttacatattgtagtattaggttcttcaaagctaaccacaaatactacttgttttttttccaaaaagtttattactccagccaaaagtaagtttattccctttttaatttttaaagctctttgtgcctctgactgggaaaatatcatacatatcctcatgttctggttatatatgcagtgtgtatgtgtgtcttatctctcccactaaactttaagctccttaaggactattagagtctaattaatggttattttttcttgtaggctttagcatgtattcttcacagtggagggttccaatctgtgaatgatgagaatataacatatctcattcatttattcagcaaaaaatgtatctatatactgagagaccaataaaaaagagtatacatttcagtgattcttaatgtaagtaagttcaaagaatataagctccaagtgtgagtatattctctttcctgaaaatgaaagatgttattgtggaatatgaagggcttttttctcggagagtcctgacttccacttaacagctgtgtgggcttgagcaaattaatctctttcagcttcagttcattcacttataaaatatagataatatttcacttatggcttatcataaatggcaaattgcaaatatgaaactttccagcttagtgcctgacacatagatggctatcacaaaagaaatgaacattatgagattctctggtgaaaggtgatagatggtcaataatgtaaatactaaattcttttctttaaagtaaagcttagaacaatactttttatgattataagagataattatattttttacacatgaaataatactagcaaaaaatcacatattctgttttattaaaacagcatcttttgaacaattatttctctaagttgtcatatttctttacctttggattttttttctttaaaagaaataaaaatatactgacccaatttttcgaactgtttttaaaattgaaggcatgaaattcagtctttacttagcaagtggattttattatccagaatttaaaatccactggctatgataaaatacatagagtcaagctcagacccaaggtttagagcgagtttatatttctgacttatggcaggtggaagaaccaccaacacacacgtacagaaagaccttatttagcccaatggacatatttttctgtagaaacagaaatttcccctcctttccacattgctatacaatggatattttggtcttctcattctctcatattttagcctaactagtatcctgaagaaaccttttcctatatttatctcttcctccatcatcaatctttatcacatagggttgaggaaatgatttaggtctggagataaagggcattgcattttgctgtccacagggactgtgcacatgaaacaaaccagaaaatgacaggtctagtaaccaacttcacgctaatggagggaaagacacttttctgtctctggttgaacctgaatttaggaggttgtagaccattagctgatagaagtcattttgctgccttttagaaattaagaacaaagcccaaagaccaaaaaaacaaaacaaaacaaaacaaacaaacaaacaaaaaacagagagagagagagacaaataaaagaagagagaagagagacaattctacaattctgtgttaggaagaacaatggatccccaaaaatagccacaccctagaagctgtgagtatgttatattaggtgtagggtgaattaagggtgcaggtggaattaaggctgctaataaaatgacattaagatagaaagattatcctctcaggtccaatgtaatcccaaaggtcattacaagatggaagagggaggcaggagagtcagtgtcagagtaatacaatatggcaaacactccatcagtcattgctggttcaaatgtggaagggggccatgagtcaaggaatgggggtagcctccagaagctggaaatagagaaaaaaataaaaagattgttcgcaagaatctccagaaaggatcacagccctacctataccttgcttttagcccagtgattcccattgctgagctcaccaaatgtaaggtaataaatttgtgttgttttaaggcactaacttcgcagtaattctttatagcagcaataggaaactaacacagtcgtttaacaatttgtacagtctccaataatgcctgtgtcttttcagtgacatgagccatatgttttttctttatgttttctaaggttgatgccttatagtttactagttaggcactacaactaagtacaggttaaggaaaaggctttactggggaaatgtgtaagtgaggattcagttatatcagaaggcataggtctcctcatcctcattagcttcccactgtgaggctaatggggctggctgaacacagtaagagtaggtgttctggcaatggacctggcctcgcctttcctccctgggaaattacattgtggatccacttcaccaggtcttctcctcttgctcaactttgaataatacatttccccagtaaagcctattacttaaaccatactttgtgtcattgtacaattcactctgagaacttggtacatgacaaatgaaagcttcaagaggactcaccttgcatcatgacagcttagcacatttgagaccatttctgtcatttacagctgagctagtcattactgatacctgttgaatacgatttaaaaaaaaaaaaagattttgtcttttttttttttttttttttttttgagaaaaggtctcactatgttgctcaggctggtatcaaactccttggctcaagcactctgcctgcctcggcctcccaaagtgctggaattacaggagtgagccactgtgcccagcaattttgtcttctttttagagttgtctcaagcattgatcttaaattctctagagtacactgggaacttcactgattcattccttcagacaacacaattcattaagcagagaattgcaacttacatgctaaaaacatgataaataccatttctctcctcaaagagttaatggattaaaagggaaaatggaaatgtaaatataaattacaatgcaatacaaaagatgctataatatgggtatttgtaaggtaaggaaataggaagataacagagaaacgtgtgattcaaagatattagctttatatagaatctggactcaactatcattattctcttcccaaatggaaaggaagtacatcctgagataaaatgattaaaaagaaatatgcttcctgactagggaatacaagtctgcatttcttggcaggagaagtgactaaatctgtcaactcaaggagaggcttgactatagtagatgcttaatgaatacttgtggaatgaatgtctaaatggataattagcaaaaaaaaaaaaaaaagctaatggtgcctaaatgatcttactaatcagtacaactaataaacacatgcattttgaagtaatttatatttatagttagaaattaaaatattatattgaatttatctttgacaaataacatactataatgacaaaaggaaggcagaggctttggacttaagaaaatttgctgcagacaccagcaaacctgggtttgagtcctgcctattgatcactgtgaccttagtcatgtcacttaactttgataagttagtttcttcctctttaaaagtaaaataatgttggaacctattctttaggaagtgtgaggaatagaggtagaaatgcatttgaaatacttagcagagagactagaatttagtaagcattcaataaatgttagctctaataataaccaattgtaagtattatccataggaaaaaaggtgttaaacatcaaatgaaattgtatagaagttgaaagatttaatcaagaaaaataataacttcaatataagtattattataagagatcccattggagtaatcatttgttgtgattttggcccatatgtttatgtcagagaaatggaacgtggccaaagattttcaaataattgtgtaaaattgctcctgttatgtaaaattaattgaggccttgcttcagcagctgttatgtgtacatagaggctgcaaaccctattaaagagaatggtaaccatataatcatgtttttcacacattattttgtgctatcacaatgaaaggtttacaaataacagtgactcatttaaatattattgacacaatgaaatgctcccagtgtgagaattactccctaggaatagatctgacattttggaaattagatgatttcttatcagagtgctattttaatataacattacaaactatttttcaagatatcccatgttactgataaccactcaagctaaacatttacactggtcaatgccagcaatccacacacagtaatttggcatcacctgtaactgttccctttgtttcacatagccaagaagtcttctataaacacttcaaaagtatttttgtgagacaaaataattcatatacattattttgtgtagtctgcactgtatttatatctgtaatgcagataaataaatccatattcagatggttaaaagacatacagccaaaatcatagcacatgacctctgttctgactccacatccttgattttctccataccactcatcattgactccacctccacatcattataataaataccacataaaatactttacaaacatgctttcatattagttcggtttctccatgtaattttaaatttttagcagtcatctattcgagatccttctttttttcttatcttatttgactttgaaggcacctttagaagtagaaaacaggtggagcttaccattgctgacaagggatattgtgatctaatgattccattattaattaagagaatctatagcttttacagtcaatgcacagctgataattaatgagctcaagataattttctgttttttctttagatgactttacatggctcacaattgcaattaattttttgataaattgcccattaggagcaaataaagaaaatattgtgtactgtaaggacacatatacagtacagattaaacacaacataatttcatataaatcatttcatatgctgtatatcttacttatctctgtattatagataagaacagtgacattcaaaatagctaaaagacaaccaaaatcataccatgtggtcttagactctgccacaccctttgctttcaccacatcacctccatttcattataatcaatacaccacagacataatttaaaatccaagtgaggctcagcttggctgcctcatctcttcttttctggattaacactagcctgtgaagatactggttacctgagagtcggtaaaggcagttgaaatgcaattcttcagagaaaactgttaaaaggaggcttatttctgcccacgagtttgcagtaacagtagtcctctccgaaagaatgcacatactgtatgtgaaacctaagataatctcaatagagtggtcagtgtttgactatgaagcttaaggaaatctggaagaatgataatgaaatcattttcactttttggccatgacctctcagatcagaacatacttttctcttcaagatggggaaataagtgcaagaaaggggctctctgagactaaacacttctaggaatataacaatttcttggaatagactaattccccaggcttgctcttatctgatttattcatatgacacatgtctgcaggttctagacttgagcctaaacttattttgctaagacatttaatatggatcatgctataggcttttgggcttaaaatagacacataaatttcccaaagcattataaaattattggtccactaccaacatctgtcaatgtccccagctaacagtcaccagaaataaaatggttgatgaagtttggtcccttgactttacaatggaggagaacactcaccatggggaactgtgcagtgtctcactaagaggctgttagaaagaaagacccattacagtattggggattgtgttaaattacttggggaagcattaagtaaattaggccttttctctggattggatgcagttggaaatcaggagtaattctctttttaggtatcttaaaaattattatatggaaggcagagagaacaaagaaggccaagctgtaattggtaaagaagcaacatatcaggatgagagatatttgattatttttgtggtttggacaatattcacattattatctacattaaaatctgacagttttctttttgtcttgatccatcatagtcagagaggggcctaatataatgtttttccgttacattctttatgctcaacagaagaatagcctgttgagcatggtctagccttaagtgttagggaaacttcaattatcacaaaggaatggctgacagtactagggcagttcctgtctgttagaagctgcttatttttcttatagttaagacagatatgaatgcctgtatagtcaatagtaaatctctgtcaacatttcctttaaaatataccctgagtataaccattgctcaaacctttccttgctccaaccttcatccaagtcaacattactgattacttggacctctgcttctagtgggttccccagaaagttctgtcaccatttaacagcaagagtggtctcttccaatataaattagaatattttactctcctgtgcacaaattccaatgggttcccattgcccttagaccagtatccagatccttactgtgaacttactcatggttatttctcagatattttttcactgctactcatggcatcttgggtttctgcacttgctatatctattatcaagagttctttttctccaggtcatcacaagtttcacttcatacctccttcaggtttctgctcaaatggtcacctgttggcaaaaccttccttaaactcttttatgcctcttcccttccctactacgttttatttttcttcttcttcttcatagcatttcatcactactgtatttaaattatttatttgggtatctatttattgtttgtctcttcttctgtaatgtaaattcaatgaggcccagaactacatctggccacagctgtatcctaagagtttagtgcattttctatcgtatagcaaagatataatcatgcataatgtatgtatccacaatatggatttagtcactagccacatgaggatcaggttgattctatggttaggtggcattactttgaatcatataaaacttctttctgcaagtaaagaaggttacatattagtcatttgagatcacctgattagataagaattccccattaccaagaatcaaagggagtcagccccattctgaagcagaccaatttgagggataaaaactctactgcatgaaatgcacccagttatgtaacatcattccttattttatttaatgaatatttatccagaatgtttcacctctgccttttacacagtgcagtgaatgtaaaaaggaataaaaaccttattccttcaaataatacactgaggaaagatggctacacaatataatatgggattaaaatgcccttatagagttagagcatgcattttaatgggaatccagagaagagaattcggaattctgccagaatattatgtcttatttgaggttttatgaatgagcaggagttcactgaaaaaacagaaaaaggattggaggaccattcggatggaaggaagaacatgggcaaagcttggatatgtaagggagcatgtgctattttggaagtacagacatttgctggaatagaaagaatggagcagatttctgaggccttcagtgggtggagtaggcaggtcttggtatagaatcctgtgattcatcacagtggggtctgctggattctcagtcctcaaagtagcagagcagagcagtctaggagctttgggaatttggactttccattgtgagccatattctagctgtgtcaatactcttaccctgaactcctgatgctcactccttagcctttcctatacaacagtgtttgtagtttgtagtgtgacatgcatagtcactaaaaatttgtctatctttatgctcaaaatatccattataaaatatttagatctgaaaatctttgatatagtgtccatagtaataaacttctgtagcaagtgaatataatcactagtaaaaaatgtactgacagaaaaagtaacaattggtctgctattttgtgtgtgtgtgtgtgtttgtgtgtgtgtgtatgtggtcagaaccaaagagagcagaagctatgtatgagtacatatttcttatgatccatatcataatgagattaatacattagacccatttctttcaaggttctgatttatatttgttacattagtttccctttgatttcaagaaacatgcaaaagagaaagagaaatgtataaaatagaaactgatggggccaggtatgatgactcatgcctctaatcccagcactttgggaagccaaggagggaggattgcttaagaccaggagttcaaggctagtctgggcaatatagcaagacccagtacttattctgcaagtatatatatatattagagagagagagagagagacactctattgggtcttgctatatatatataatatatataatatatatataatcaaatatataaatacatataatcaaatatttaaataaatcttatctaatcaagtgatcccaaatgactaatatgtaaccttctttacttgcagaataaagttttatatgattcgaagtaatgccacctaaccatagaatcatcctgatccttatgtggcgagtgactaaatccatattgtggatatatacattatgcttgattatatctttgctatatgctagaaaatgcactaaactcttaggatacagctgtgaccagatgtagttccaggcctcatggaatttacattacagaagaagagacaaacaataaatagatacccatatatacatattatatatatatatatatatagagagagaaacatatctatctctctctatatatggagatatatatacatatatatctttatataaagatatctatatatatagatatatatacatatatatctatatataaagatatatataaagataatatataatatatatttctatttctattatatataatatatagaaaatataaccatttgtcttatataagtaaaattctcatttgcctcaacatacttcttttgaaaacttgaaatctagtttagtaacttagatataatttaaggtttcaacaactggatcaagcccttatcttgaataatttggcaataaatgaataatgccttcttcttagttaggaacatacaaaggacaaacactatcacttagtagcagtatgatcttagcaaaattttctatcaacctttttcatcaataataataattgctacataaactaagttggaatgtatagaagagaatgcacaccatgaaaccttaggatgcaaataaatttccaaaaccacgtagtctatccaaacactctttaagtgagtaactcgcacatcctaatagtcactgaatgtcatgtgattaataaccttcataaaaatagccttttgtgacatctggggcacaattttatttactttaaatagtaaatgtacaatgatttaaaataagccatttaataatttagatttttgatttttgttaaatagaataaacgtcaatataaactttacaaaataaaattagaaacttgaatgatgtaatctattttaggtaccaagatggtcattccaaagataatgcttttatggtgctgatgaatgtggatttaatatgcatttactgaatcaacttatgtgttgccaccattttttctttttcttttttttttttttttttagtcagctgtcagtaacactgggttctgctgcctgcactttatcaataaacgtgtgctctcctaccgcttggtaaatgctgagaaatgtctcttagtgaacctctatttctgcaggctttctttttattattattattattatacttaaagttctagggtacatgtgcacagcctgcaggtttgttaacacatgtatacatgtgccatgttggtgtgctgcacccattaacttgtcatttacattaggtatatctcctaatgctatccctcccccatccccccaccccacaacaggccccagtgtgtgaggcttcccttcctgtgtccaagtgttctcattgttcatttctcacctatgagtgagaacatgcggtgtttggttttttctcattgcgatagtttgctgagaatgatggtttgcagcttcatccatgtcccttttacaaaggcttctgcaggctctctaaaggcagtcaccatgccctttatttctttcaaaatactatcattactgaaaaaaacttcaattaaacttatccaatatacgacattgtgtcaggttttaggcaaagcaatgagaaataagatgattattgaccacaaagatattaacgttttgagaaacaaatgtatatataactaatgactaattgttgtcctgccatcccatagattgccattcacctctcagggccaaattaatgatattcatacacataagctgatccacaggggccaaataagttctcccttccaaagatttacacttgtgcataggaatcctagttttaaatacctgaatgaagtgtaataatcacaagtgtggaaggaaaaggcaaacaaaacagtgaaaaacgtgcaatttccaggagaataaatgaattgtttgttcctagagaaggatctggaaacactgtggtcctgaagtagcagaggaagaagaaggaagaagaagccacagagggacatagagagaatgagagagagagagagagagagagagacagcgagagacacagcgagagacagaaggagaaagggagaggggtaatgatttcctggtgcctttagaacgttccagttttcagttccaatccttcgtgagcctgaatgcatccctgtgcttggactccatgaaaacccctcagattgttatacctcctcacctttttatactctatgtaatgcaagatggatcctttacttacaaatgataattttagttgaaactaatgtgatataataaggaaattaggaccctctagactttatctcagaaatagcaagtttattttactttccctgaaatcttctgatcattgttaaggtggaggaatgagctatgctttaggagggagatgctgaggtagcctgcgggagctggcttggcaatagaccatgtaattcttcaggatctattggcctattggactcaaactgttgggaagggttgtaaaatatgttgattatttaggatctaattatctaaattattcatcatcctttctttttcttctcccccagttctattcttctgtcaattctttcaaaactagctttaatcctattaatccctctgccagattctgggaagagaattagagagacagtgtaactgaaatcaatccatctggttagctcttagacacctagtaaaagatttgatggaaatacgagtaaagcaccttcttaatgagatttgggaaataactgcagatttcatttatgtctgttcaacctgactaatggggaagtatacataacaattgcctgtaatgcaatactgaataaaacttgctgattttccccagggacactgtaactgttcattactttacactgcagtataaattggcccagtggggaggcaggcatagattgaagggagctgtgaacaaaattacatagctaacactgcaggcacctcctccatacttgaggccctggaatcaggctcttaatacatacagtcaaacaatctttctgacaattgcaggtcacatacctagctacacgtctggggaaactacaggcaggtgtggggctcttacaaatagcttagaaatatataccacttgctcccaacaccaccactgggtaactagtccagaaaatgtgtctcctttataggattaacagcttgctatctctctcgaaaaggcaacaatttaaacaatattcaaattggaaaaaaattaaatgttgacaggaacgttcttgcatttgcacaccagatttaccagttaacacctatgtgacttgtcacaaattaactactctatgttgcagtttccatagctgtataatggacatgataatggtacatccgtcagacatttgttgtgtcagttaaacaacatgtaagtgtcccagcaagtaactaggtcatgaaagtgctgtacttgttacctagcaatgttattgttgttgttgctcttgacaacctattataattctgacctcaatccttttgtttttggagagggaacaaggcaaaatggaaaataatagtggactaatcataattgacacagttttaaaattatttacatatatagtcatgcactgacaacaaacagcatttcagccaatgaccgaccacatatctaacagtgatcccataatattataatactatatttttactgtatcttttatatgtttaatacacaaatacttaccttgtgttactattacctacggtatttagcacagtaatatgctgtgcaggcctgtggcctaggagcaataggcttctagagtgaaacctacaagtggtgggaagaaaaggggtatttgagctggaggatgtgtaactaagaaaatggattataggctataccatatagtctagctgtatagtaggcaatatcatataggtttgtgtaagtacactccacgatgtttgcacaataaccaaatcatttaaccatgcatttctcagaatgtattgttgtcattaagtgacacatgactgatattaattaggagcaggtaaaattaatacattaactgaattgtatgcatcatccattgttctaccatctctcaaatcaaaacaatattttctggccttcctctgcttgtgtgtttagcaatttatataatatgttaaccagaaccaggtgcagtgggctcacacctgtcatcccaacacttgggaaggtggaggccagaggagtgcttgagaccaggagtctgagaccagcctggacaacacagcgagaccctgtcattacaaatatttaaaaataattagccaggcatggcggtatatgcctacaatcccagctactcggaacctgaattgggaaaaattgcttgagtcccgaagttcgaggctgtagtgtactatgattgtgccactgcactccagcctggactacagatatgtctatatctatatctatatctacctatatctatatatatatttgtataactgtattcttttactataacccataacccataaccatgagaaaaacagctttcaatgcattttgctaatctttctagtgaattattaaaactgtgggtggacctgaagacttccaaactttataagaacctactatgtgctagatatggaccctggcactatagatataaatacaaatgaaaaacattttcttccataatgcttcttataattcagtgtaaaaatatatttccaactaacttcaccgtgttgttatgaggagcagagaaagtaatcggtattagtagtcgtgataataatgatgatgataaaaatggcggccacgtatgcatattgtgtttttaatatggaagaccttttcaaagtgctatcatataattattacaacaattctatgaggaggttattttcatcctcattttagaagtgagaaaactgaggcataaaaggaataaataacttatctaagatcagactgctaggaaatcatggatctgaggctttaggctatttgagccaaaaattgtgcttgattatctccaacatgggaatctcctaacacagtgtctggcatgatgagaatgtctaataaatgtcagactgatttctcttctgtagggtctcattcagaatattatctgaagtgagattgagagtggttggctcctgcagagatgaggtctttacttaaatatagaatgattgttaagaaatatgatatcaccaaacgaaatatactcatcaagacctgtgcaggaagaaactgaaagattcctagatttgtaaattagagaaggattgcaaagatgagacaactgataaagctgtatttatcagagaatgggaaaagcttagatatacttttttgatttcaaatgtttccactgttaaacacttacatatcaatgctttgaaagcatagacgctctaattcacaggaaacacagtagtggttttaagcagaaatacaacattaacattagagtatatttttattcaaaaaaatccaaaacattttcataagtgttatttaatacaacaaacactgagttcctaaaatgtgttcaggcagtggtgtagatgctgaaaatataaagaaccacatgaaactagttttaagaggcttcatgaagctatgcatgttcttgaataaaaatatctagtgatggtataattcattagaaatagatatgaggggcataagaggacaaggttacctatacctatgtggaggcttgttcagagaaaatttcagagatgaggtgacatctgaactagttttaaaaactgatcaagaatatttaggcatatgatatgtgggagaaagatattctaggcagtgagaatctaagaaagagcatgatatattaaagaaactgaaaatagttcagtgcttctagagtgaaacctacaagtggtgggaagaaaaggggtatttgagctggaggatgcgtagctaagaaaatggataggaatgggaccctaaaagacttgtgcgccattttaaagatgttatatttatgctgttggcaatgggaaaccataaatcattaaaagtaggggagtaacatcagatttttatttcagaaatacttctctctcaaaagttacattttagaggaaaaacttagttatgtcctattttatagagcataactccgatatagtggttaagcatgtgttcacagaagccagaggaaatacattcaattctcgtctccttcacttatgtagtagtcaggcaggtcaactgaagtctgtgtgagttactcttctcatttataaaagaaggataataatagtgctcactcacagacctgttgtaagaattaattgagataacagatattaagtatttacaacagagaaagtcttcaataaatggggttaattattaatgtggttattatattattactattatcattttctctagtcaagacaagtactttaaattttaaaataaatacattttttcatgtaattagttgacttatttttctttataataatgtaactccttgtgtttttgcaaattggtaacaggtaagccatagctagcaccaaaagtaataatgttactttaaaatgcattcactggggatcaaagtaaaaaatgaaataaatctgtaaaaatcagctttagaatttgcatcacttcaggcaaactaaaacatcaaatggaatattgttgaaaatttagcaagtttgaaaggattagtaaaaaattccttgaactaaaatgtcaactgaatttctaaaaaaaataataataatcagagtaattttaaacatattaaaattatcaaaaatgtttttcctatttccttcttagtttttactgatattatattttaaaattatatattattgtccctcataaccaatgatctgatagtttacttaggagctaaaagtgcattcagtgttatttatctatttctttgtgtttcctttgtattcaatgctatttaactatttctttgtattcctccaattcctttctttactccttaaacatatatattcaaagactattcattacaactacaattatttcctcacaaatcaatttccaatcaggtcaagacccaataaaaacttttattgcctgttctcataggcctagatgtttaactagatattaaatataaaatgctttgcttggcatttaaatttaatcctcagttaggtaccttactctacataccaatttttagttagaaacttaaagtttctctctaaaaatgaccgttttctttttccgcttgttcaattttgcctaaaacatcttactttgcacttgcaattgtgctactttattttatttaatacagcagtagcatcgctggaaataataaatttttcaaggacaggagctaggttctgtcttgcctgaagtaatttacttgaagtgatctctagatgacaagtctatcaagtggacattagctggaaaaaggagtctcttgggagatagtccagaacatgtctttccaatgggcagagtatcattcctaaacggataaaattggttcctatggcaaaaggtattagatatgaaaatggtgtatggccttccaaaagctcacagtatgtaaacaggtatatatagtatatctgtggtgtaacagtatatctatagtattaaattatatatataaacaggtacatacagtatgtctgtgatataacagtatatctatagtattaaattatcatctaatactatagatatactgttatatcacagacatactgtatgtacataataaaatggcattcagatataaaaaataattatcatctagaatttcttcctttgtatgattacaatgggatactcaggataatttacaaaataaaaatttcatatgtgtcctacccccataacagcatatgtaaatatgaggctttttccaagtttctttaaattcctaagtttgaatcaaaccctcactttaatatatttacatctgataatcatatttgccagtttatgaatttgcccaaaataaaaagtttaaatgtagaaattgaacatattccagagatacagcactggaataaaacaccctataagaaatccaattctaaaatgagatttgaaaaatattcataaagtttaaaatcagagtaaaatgactgtggttttgaagggaaaaaaatcaaaagaaaaagggtataaaatgtaaatggtgttcctatgtaattaaagagcaggtactaggccagccactgtttcacagagcaataaatacttaaatattatttagatatcttcagattgtcttatgaacatgcccatgcaataaatagctacatggggatttatgaaatatcttgagattacagaactgacaaaaatatttataacaattatacttctatgaactctctgggattctgaagggaatcatattccaattcctaagatatgttttaaaggtcaaatttaatctgtgattctaacattaatgcatttggaaatatgttttatatctactgagcatcagattataattttaattttaagatgagaaaatagcaaatccataaggcaaagtaaagcattcatttagtatctgaagatttctgaaaaacatcttgtggtaaaagtcatagtaaaatatctttttattaactacagtatacatgaacataaatgttgtaaattatgttatccctgacaagaatatcattatcccctcctgaatttacataaactgaagaaactaaactaaataaatgaaataccttagttgttagcttgactaaatcatttttcccagcctaattttgtctatctctgacagatttcaatctatgttaaactcatctcattttattgaaacggaattttctaaggtctccagtcatctaatgtgggaaaaataccaaggcctctctttctttcaaaaccatgaatgtctttattgccttgaagcctaaggagtagtaggctttagacatttattacatttctacctagccattagatctgtttgaattggtgtgcttctttcgcttttcaccgcttcctcacagcacatcaattatttaattcttagaaactactgaagaaactggtaggtaactcaattctcagcctaggttccccacatcaacataaatagtttcagtccagccataccaatatgtattgccatagattaggtatagaaataaaggtgcagttaaatttttaataactgaaaaacaaaagcaaatataaaaataaagctttggccttaagcactttgtttttccatttgcttttgtttttctgttatttgtgtgtgtgtgtaaatatatatatatatatatatatatatatatatgaaaaatgtagtgaatgatcaatttcctaaggtcagtcttgatattttaaaaagttgtaaagattgaatgaaaatctaagtacacagaaaggataagttaaaccatgctttaactattttgaaattttagttaattaatttttttaattttaaatttcaaataatttttctaattgaataactcttcacacctattagaattgacaaaatccactgactcagcaaatgctggccaggatgtgcattaacatgaactctcattcactgcttttgggagagcgaaaaggtacactttggcagtttctaacagaactaaacacactctgaccatgggctccagcaagtgagctcctagatgaacaataaacaaattgtagtacatacagaccatgaaatattactgagtactaaaaggaaataagatatcaagccatgaaaagacagggaggaaaattaaatgcataatactaagtgaaagccaatacaaaaaggctacacactatatgactgtaactatatgacattccggaaaaggcgaaactgtggagacagttaaaagaccagtggttctcagtgattaggacaaagggaaggatgaataggcagaacacagaggatttttagggcactaaaaatactctgtacgatactataaaggtagatacatgccattacaacattagtccaaatccacagaatgtaccacagcgagagtgaatcctaatggaaaccatggactttgggtgatagtgatgtatcatgtagtaatgacaaatccaccactctggtggaggatggtcactgttggacaggccatgcatacgtgaaggtagacagtgtatgcaaactgtactttccgttcaaattttgctgtgaatgtaagactgctgaaaacaataaagttgacaaaaaaatttaaagtaataaataaataataaacaaacaaacaaatgcagagctgagattctcaaccaggggtggtggaaggtggttatagatttctaaatagttgtttttcagtttcaaagcctctgcattttctttgtgaaattgtttaatatacacataggtgattttttgactttttgagagaaagttcaaaactttcatactttgttccagaacagttaagaacccctgcagagagatagtcaagagttattgtatcagttcttatttgtattattttaaatgttatttgattttttcaaaagtacataatctttgttaattaaacagtttagataatcatagtacacaaatgatgttcatttataaatacagctctattttaaacttaagccatgttggtgacacgtccaaaatcaaccagtgaccattaaataatgacaagtagcaattattgagtatgaacttctagaaattatcatttcatgttctggcatcttatttggaatatcaaactgtattaataaaatcactattaaatattaaatcttaataacaggacatttttatacctgcaagtagagaaagctctatagttcccaagccaatttcagatcctcagcactgacaaacatgtatcagccaaaatttgtgtctacagaaacaggtctaacttgatctttgttgtagtgagctaggatatgactttcttccctagccttctaaactactgaggagagttggctagtaaaaatgagagaatagcaatgatgagataacacttcaatctcatcctccacagccatgtgtgaacgccactaaatactgtggcaatggaaagggccagcttcagactgatgtaatttcatcccttcttgcttgtgaacaatcagaagagcaatctcatcacatgcttggattaaccaacaattaactggctatcggcatataactggcaggcaagtcctaaagaaactacaaaattaaccttccaaaaaaggaactggggtcagctcttagatagattcatgtcaaaatgccagaccattatcttaatagagagaattttgcaggaatctaaagccttcgaaagctaccatgcatcttggtttgattatggcattataacaagtaagtttttcgtttaaaataattatcttgtttaacagacagtgacatggaatttttacttatattttctacaaatctgttaacaagaaaagtaaactttctggtcctggaggggagaaaataaaacagataataatacttcaaccagtatagtagagcaagggttagggaaaaacacagttgccacagtacaacatatatagaatatgattaattcactaaacaaggaaataaaataaaagcaactgatataaataatttttattctgctctgactgtctggttcagaatcttctcaatcacttatatattagtttatactgcgtaaaaattaaagaagtgtatgtacagaaattttgtagtgatccaataacaagcttatatctgcaaataaatacagttaaatggaaactcaataatatggaccaaaagaataacttcaactagtaaatattaactaacttaacaataagatggtttggtgaagcctaattacatcaattcaagggaagacgataggcatcaagattttattaaaataaaatttaaaagaattactttataggaatacataatataaaaaaaggaataaaaacttaaagattggactacctcaagtgttgagttctacagcatattaatgctcttaaactatatcaatgtatattattatgtgaatgttataaggattaatcacaaaatgttcttgtaaactatccattataagatacattagctcagatcaatatttcttggaaatagaagatatattctaatgtatattaattagaaattactgatgttactagctgagaaatattgaataaaatattttctcggctagagaaatattcctctagctgagaaatattgaataaaagcagaaataaggatgatatttgttatttatatatgatagttataatttcagcagttcacataatttaaaaagagaaaattttattagtttattcatctaataagtaaccatttaagttaccatataaccagatttaattataaaactaatatcacatttgtacaaaatacctaatattatagtggaataacaaacgaaaattgaagaaatagtaagaatgtatgtcatgtctacacagatttcatagtattcatttgcgtaaagaaaaaagtgaactgtgtgtaccctatcaaaaatcttgacaacattctgactttggaaattagaaaaatgcatccataccccacagagcaagcatcacctgttctactgcaggaaaagacaccataaaatataaaacaaaatatctgcaaccaacatgaaacacattgctggtgtgtagaggtctgcccatatactgtaactttagctgtaaatatctatgacagaagaattttcacttttagcatgtgtatatcaattttctctaaaggtggtttcaatttaatcagcacaaaatcaaaaatgagagccagatttcacatgtcagcatgggtgagcaagaaaaatagatgtaaaaagattttgaaaattgttagactaaagatgttcatagagtccatttcaatctcacgatctcacaggatccctgtggtgagtggaaatggcaacagacaggagcaatcacctatttactgatttactagaaaaatatatggtcatcttcagtggtctcagtagttacaataaatgggcaatgttcaattatttttgtattaatgtcatcagaccatagacacaatttcctatagtattttcttaatgtttacttacaaacccatcaaataaatattataatgcccaacgtcttctcaccaacaaatttaaaaaatgccaaaatatctctgataccgggcagacatgcagataagtggaaacttaattattggaaagagtctgaaggtttaatctatgattataaaattaaaataaaaaatattgttctatatgattatgtcattatacccaataatgtcttaggctatggatttaaaatgaatatggtgtgataattggatgaatgttatatatacacataagaaatgccactcaagacacacagatgtgaatatctttgcgagaatatcctcgttttcatcataattcttatgttgagtttcattttattataaacttccatgtattctaagtatgagattttgaaaaatggatgaaaatatatatcctacctactaatatagttggttggctagcaccattcctaatagaaatcagctgcaaacagctttcggcacaccaaagttttccttaggtagaagaaaggttaaactctaagtcataaggtttacaactttttagaaagttgccagaaattcccagtgatttggccaatactcttctgtttagtgaacttagtttactgatgatagggtttctatatcagtatgtttaaattcatgacctattttgataatggtggcatgtatgtataatgatttttctaataaaatggtaacctgctagattacctgctagatttctaataaaatggtaacctgctagaaggaaattgtattttgttccagaatgctacatactgcaaatgtttcaatttttttttaaattttaacaaattaaaatttgttttggatataaattatcaactcatagtaagactttttcatggggaaacttttggaagaaggcgatgatttctcaaaagcttattttatctaatatgttacatgtaagatcttatatgttacatgtgtatacatatcacacatgcacctacatatatggtaagacaaggggtagaacattatagtttactatggtgatgaaccccatggcatttccctgccttgttatctttgcttgtgtttcttctacctttcttgtgactccgacttatctgaaaacaagtgacaaccaacctaaggttctggttcctgtaatgattttggaccaagaatgaagccttcctaaactgggtatttttaagtctctctctctctagaatgtggttatgggctaaattctgcttgtctaggtctctattatttccttagaataatactatgtgaaatttggagttagcctgctatgtaatgctataatctttcactatgtccatggataggcaaagagctgacggtctgtaataaaaaagcatcttaaataagaaagtaaatttcaaagatggtgcaatggaatctcagtaactttcaatgactgcacaagttcatccagctaggaattaaggctaggaagagaaagctggtattttttaggctgatttgtattttatcacccctgcttaatctaatgtggacctctagaattgcatttctagctttgccagataatacttctatatatattagtttcctcttacagagtataggtcccatgaagaaaagtggcaggcatgactcttctttgcatgctactggtactgtatttatcgtgtaacaacttgggtttaatccttgactccctcacttgggcagtgtgtttagtctttctaagactcagttgacctttccaagtttctacaccttagaacattgagggaattacagaaacaatgtcaaatgctttgcaagatacctggaaacttcagtgctcagtatatgttagatattgttattttcatccttttgctcattagcatttataaagtgctttgactataaacctgttcaatagatatatgctgaatattaatatgaaactaaattaaatgtaagactatagatcaggaattgtcaagctgcagcccatgttccaaatctggcctacagcctgtttttgtacctccaagaagctacaaagggtttcacatttttaagggattataaaaataaaaacaaagaaaaatacgtaacataaatatatgtgggctacaacacacaaaatatctaactttttaaagaaaaagtgtgccaacttctgttatgcatatagagtatgacttgttaaaaatatagaaatatcttttgatgagaaaatctagaaaactctcctgataaatctttagtatgattgggcacctttctaaaatttataaagttgtgtaactaatggtatagctttaataagctgatatcctttcttacagttccttccctctccagttaatccttcatattatggtcatactaatcaccctaatagcatcattgttatcacatcactcaatttgtcaaaaatacatccataaatatgaacatgactaaagaattgagtttaaattctttcaccaatatttaaggctaaactcttactcacttttaaaaatttatctcctacctttctaggacatttatatggaataccagttatactctactcttaatactacatttatgcatatacattgtggttttaaaacatgaccacatcatacttgacacttttctctttaaataatagaatctcatttgcctttatgtaggccaggtgtgtaaatttgcttctaataaatacaaatagtggaaatgatgttatattgctttcaaggtgtgtttctatgaagacactcagaagcggcccatagagacaggatctaaggcctcttactaacagccagcaccacaataccagccatgtgagtgagccatcttggaagcagattttccagccccattcaagccttcaggtgactgcagccctgactgacatcttgactacaacctcacaagaaaccctgagccagaagtgttcaaattagcagctcccaaattcctgactcacagaaactgtgtaattaataaatatttattgttgcatcaagccacgaattcttgggataatttggaataattatatagcaatagataataaatataatatatcaatggatgccatgatagaacaacttttgattctgttttctctttattcaaacccatcagctctgatagttcaaataaacttcatcttcttttctaaagactttcattaaacaaatgtgctaataaccaggtaattaactggacatattttgtgtatatatatatatatatacacacacacacacaatatataatatatataatatatatataaaacataaatttatgatatattttacatattcctctctctgcatctctatcttaagtcttcaacccaaacaatcctcaaagggcagaggtttcataatatgactctcagcagtaagctaggacatctgctgatagtttgcctttgataattatactttaattacacttatcaagatggtttatagacacaaactgttgatgtagtgaatgtctccaaaatttagggacattgatacacacataataaaaattataagaccatttcttatgtattcatagcttcttacatcaaatctatttaaataactgaaaaaaagtacttgtaccaagtgacataaaaaggaacagtcattgttaatctaaataataacattgattcagacaaagatttatctttaaataaaaccatttttcccaatcttaacaagtgtgatcaatagatataaaagtaaagaagtgtaagagtttgctcattggaaatgccaaaaccaactaaatttcacacactgttttactgataatatgaatgagtggttaagactagtgtgtttggaatcagtctgcctacgtttaaatcacagctaaacttaccacatgaattaccctccatgttagttagcttttccaggcatcagttccttatcaataatatggggctgagttttattaccttcatttaggaataaataagaaaatttgagtcaggcactagtacggagcctggcacatgctaagagatcagcaaatgtttgcctgttacctttttaaatttatttacttttactatttacattattgttcagaatgagattaacagtagactgccatgacaaagaatttgaatgatgtaaaattctaagtgaacttctaaggcttttaaactggtatattttgtatttttcaataggcctctaaatcacctaatgagaagaaattgtatcccagaccaattttgaaggatactactacttggcaaccaaaatcctttaatcctcttgtagtaaaggaattataacttgtagttgactttccagttaggaacaggatttcccagttcatcatgaaaggatgcaaccatatgtctaagttcttatcaataatgtataactgaaacatgtttaatttctccttcatttgcttaagaggaaattgttgactctgcacttctgctctttgatgcccagaatggtgatattcagaaagtgttggaaacctgtgtcttaaacttggcagattcaccatcatcctatgttcctaaattaaccccttgaattagacttacttgctgatttgctatattgtgcctgaatttgcaaacaggtaataaacaaattgctgtagtcatttgctatttgattttttttacttattagctactaattattagctactaataattctttaatataccctatattagtttaataggactttatataatcattagtaattgcagtggcctctaggtaaaaaagctgaaaattattagatgtttaatgattatgatcaagttaaaacattaaaaacaaactattaaatatcccatataatccatatttatgaataaacttggggtaaaaccatttcaaatatttatgatggcaattaagaatgcatatggatgaaaagtacttaaattgttcttaatataacaaatatactgtacttcaaaattagcatgcatttagacctgcaactataaaaatgaatttcataacttttttgatgttttaatgctgagtgtccatttcatgataaattctattcatgtaaactctgcagtgcattagaaacagcctgagggaagatttgaagccaaatgagaagaatttgaagactaattcctcaacttaacataagctatactaataaagaagagagaagatccaaataacataattagaaatgaaaaaaggaatgttaccactgaccccacagaaataaaaataacaattagaaactactacgaacatctctatgcacacaaaatagaaaacctagaaaagatggacaaattcctggacacactcacccttctaagactgaatcagaaagaaattgattccctgaacagaccaataattagcttcaaaactgaatcagtaataagtagcctgccaaccaaaaaaaaagcttaggaccagatgtagtattcatagccaaattctaccagacctatgtaaagagctggtaccattcctactgaaactattctttaaaaattgaggctggacacttccccagctcattttatgagggcagaatcatcctgataccaaaaccttgcagatatacacacacgcacgcacacacacacacaaacacacacacacacacacacacacacacacaccccttgaagccaatattcttgatgaacattgatgcgaaaaccctcaaaaaacacttgaaaactgaatccagcaacacatcaaaaagcttatccacaacgatcaagtaggcttcatctccaggatgcaaggttgcttcaacgtacacaaatcaataaaagtgtgattcatcacataaagagaagtaaaggcaaaagccacatgattatctcaacagatgcaaaaaaggctttaaataaaattcaacatcccttcatgttaaaaattctcaataaactaggtattgaaggaacatacttcaaaataataaaagccacccatggcagacccacaaccaacatcataccaaaaagggaaaacctgaaagctttccccttgaaaaccaggacaagacaaggatgtcctctctcaccactcctattcaacatagtattgaaagtcataggaagagcaatcaggcaagagaaagatataaaaagaatccatataggaagagaggaagtcaaactatctctgcagatgacatgattctatatctagaaaaccccacagtctcaacccaaaagctctttcagctaagaaacaacttcagctaagtctcaggatataaaatcaatgtacaaaagtcaatagtattcctgtacaccaacaacgaccaagttgaaagtcaaatccggaatgcagtgtcattcacaattgccatgtaaataacaaaatacttagaaaaacagctcacgagggatgtaaaagatctctatgataagaactacaaaatattgcccaaagaatcagagatgacccaaacaaatggaaacatactccacgctcaggaataggaagaatcaatatcattaaaatggccatactgcccaaagcaatttacagattcaattctattcctatgaaattaccaatggcattcttcaaagaactagaaaaactatttaaaaatttatatggaaccaaaaaaagagcccaaatagcgaaggcaatctcgagcaaaaagaacaaagctggaggcatcacattacctgacttgaaactacactacgtggctacagtatacaaaacagcaagatattggtacaaaaacaggcacatagacaaatggaacagactagaaaacccagacataaggctgttcacctatgaccatctgatcctcaacaaagctgacaaaaacaagcatggggaaaggactccctagtcaacatataatgctgggatgactggctagacatgcagcagattgaaactgggtccctttcttacaccatatagaaagatcaacttaagatgaataaagtcttaaatgtaaaatcccaaactataaaaaccttggaagacaacctaggcaaaaacattctgcacatagaaatgggcaaagatttcatgactaagatgccaaaagcaataacgataaaagcaaaaattgacaaatgggatctaattaaacttaagagcttgggcacagcgaaagcaactatcagcagagtaaagagacaacctacagaatgggaaaaaatatttgcaaactacgtgtctgacaaaggtctaacatctagcgtctatagggaacttaaaataaaaattaaaaaaccattaaaaagtagacaaattacctgaacacttttcaaaagaagacatacatgaggccaacaagcacatgaaaaaagctcaatattactgatcattagagaaatgcaaatcaaaaccacagtgagataccatctcacaccagtcagaattgctattattaaaaagtcaaaacataatagatgctggcaagatcatgcagaaaaaggaacacttagacactgttggtggatgtgtaaattagttcaactattgtggaaagcagcgtggcaattcctccaagagctaaaaacagaactgtgatttgactcagcaatcccattactggctatatgcccagaagaatataaattattctaccataaagacacatgcacgtgaatgttcattgcagcactattcacaatagcaaagacatgaaattaacctaaacacccatcaatgatagatgggataaagaaaatgtggtacacatacaccatggaatactatgcagccataaaaagaatgagatcatatcttttgtggaaacatggatggaacggaatgccattatcctcagcaaactaatgcagaaacagaaaggcaaataccacatgttctcagttataagaatgatgagaactcatggatacaaagaaaggaaaaacagatactggggtctacttgagggtgaaggatgggaagaaagagaggagcagaaataataactattggttactaggtttaatatctagtattaataggtgatgaagtaatctgtacaacaaatttctgcgacacgagtttacctacataacaaacctgcacatatacccttcaacttaaaataaaagtaaaaataaatagataaatataaaaaacatagcctaaatacaccaaataatttgtgacttagcttcttcttttataaactaatgattaaaaataaatatacctcacaatgttgctgtaaagggtaattgagattatatacataatatataaatgaactctaaagtactttatatatgcactttattcctcagagaacaagaatgtcttatacacacacacacatatatatgtacaaacatacaatatttctggtaaaatttttggtaatgtcctattttatatgctcagaacaaatgggttgttttattattcaacaagttatggactcttttatatttgccattagaatggttatcattttaatatttcctaaaatcaaactagtattaagaaagtcaggtaagagaaagatttattaagataattttgggcaacagcttttttgttcctttgtttgattaattcttgctgtccttaaagataagaaaacactcctagagctaggcaattagaaagccattggttatctatgaaagtggttttgatagagagacgtgattttgccaaattgcaaagtattaaaaagtgaatcattgctgaaatgtggaagcaacatatgtaaatcttaattcccccaattctttgttgtgaaagaagacagatcagagaaagaggagggtttagagaggcaagaggtggtgatttttacagaaaaagagggcatgagaatatcataaggacatttttaaaactaaagacaatgatggagacaatgcatgaagtgagaagaaacagcggagagaaagaaatccagagagagaacatttacaggagagtctaagcagcacagagccaagatgcacctttttaaaaacagctttatcgagttttaattccaaaattaattttgagagacaacagagacatttttttcaaagataagaaaaaagtgtttaaaaatacaaaacaagcaggacatggtggctcatgcctgtaatcccagtactttgagaggccgaggcgggcggatcacttgaggtcaggagttcaagatcagcctggccaacatggtgaaaccccacctctactaaaaaaaaaaaaattagaaaaaattagccaggcatggtggcatgtgcctgtagtcccagctactcaggaggctgaggcaggagaattgcttgaacctgggaggcagagtgttgcagtgagccaagatagtaccattgcactccagcctgggcaagagagtatgactccttctcaaaaaagcaaaacaaacacaaaagcaacagacaaacaaacacccaatgtttgaaatagaaatgctcaagatgagtggtataaagaagaaataatttgaaagaagttgaagaagagaacaaatgttaaaagaaataggaagaaaaagtagagatttcactgggaaaataaagcatgtgttactaaaaaagcgatgagaaaaagaacagcttatgagaaaacaaacagtgaaaattgtcaaatataagtttccagaaaatactagaaaacaactgttggtatggcaaaggtgagtttttttcttactgttgtaaagcagtaagaaatatcacatatcacggtatctagtaccgtaatagagacttaagagtatctctgtggagattgcaatgtcaagatatttataagtttgggggactggctgaaggtgggtgtttccatacagtgggtgaattcagactaggcaaggatgctgttataatagtgtagaattgatgggcatagcaaggagagagttctgaggtgagggttctaagagtcctggaaaataattgtttgatgctattaaacagttgcacagcaaatagattttgcaggaactctctgaaacaaatctttaggttctaaacaacttttatcttccagacaagagttgccttgaatagtagagggtgttgatgaagacagtggaataataaacttatgttagtgaagacaacaaactgtggggttgcagatgtttttgctctcactccgttcatttaagaaaaagtggaactagatatgtttccaatttatggcaagaatttctctcctaggaagggatgatattgaaggaacatagttcaacctagtcaatcaagttctattaagacaagtattcaaaatcttcaaaacttattacattctaataatcgacctgtgtaccttcttccaatgaaagggtgaacattgatttttagagattttaagaatgccttgtaaactttgttggattttttattttcttcattcttgaaacctcaaaatgatctctgaagaatatcttatctttgcctggccccctaactctgtgctctttcttcataacataaatacatttaaattgtaagtataactaagaagtatagcaagtgtaatgtgactttgccaagttattatgatttgcacattttagcttaaaagaaactaaatattatagttaataagcatggtaatatttatttgccttataataaccatatatcaataataacatatataaataaatatagattctgaagcatttagtaatgcatgttattacttaatattagaaagtaacaaaaaattaaaattaaaattggaaacaatagtagcaaggaagacccttccccatgagaatacatgagaaaactgggacctaagacaaggagctctgaatatagccaatatgaactgaatcttaattagagaagcgatctagtcttcactgtttgcatattcaaatcttccattaacttgccagcagcacttcagttttaacatatcttcaggacttcattaaatgaatctagatggttttttttttaagttttaaaacatttacactgtgaatatatcattttacttatttatggagtttaacagattagttaatgacatctcctaaagcagaaaaaaaggaagaaaaaatgggaaagaaaccatgaaagacaaacgattaagtaatttagatttttttaaattaaaactacaaggcaaagcgaaatatatggcgcttgctattgttttaaaaggcagtgaaaataaagaagcataatggtataattataaacctttgaatttcttcactgacaaaagcattcaatctattaatgcagcaaaagtgtgtttatatctagctcaagacaaatataatagcattatgtttcccaatggtataattttaaacactgtctataaatgaaaaatgtacacttcgcccttggttaatttttttaagtatccctttgcccttggttaattaaacagaaagtaggattccattgtgagagttctctctactagtggggccttccttctacatttaaaatgaagccttcccctctacacacacacacacacacacacacacacacacacacacacacacacacacacttcatatccttccttctgctgtaattttctccatagcatttatcaccatctggcatacctgttaattttaaatctttgttattacttatttggttaaggtttctctttcccactcccacttccaccctagaatattcagcaatataataacaggaacattgttttgttccctgctttatttccagggcctaggtcactatctgtcacataataggtactcattaataataattgcagaaaaagaggcagaaggaagaaatggttggaaggaaaaaagaaggaaattattattataggtgagttattaactggacaacagagataaacagcagagggacagaattagattcctaagccctcctagaagtgatttcctgtttcacttttatttcactacagtatcaaggaaagagggcctagagctggatctcttctgggaatagtctctactctcacttgtttttccttggcatctgtttttccccaactctcattacactgggcaatttaggacttagcagagaagtggtcaaggacagcactaagcctggcattagggctgaagtactcttagccccacctacacaaaaattggtcccacgtagggtctatgtttgtttgaggacaaaacttcatagcaataaaaaaaccacttgtgtaaaaatcactaatgactttcatgttgcaaaatcccgtaaatgattttcaggcctcaagccctgtgatatcccatcagtggtcaaaaaagatggccatgtgtcttttaagctttctgctagtttcatttccgtaacactggactctaatcttttgtttctagcacactggtcgcttctctcctaacattagtgatgtttactacattatcagggctataaaacagtagaaggcatagttccgttctttttacctaaaactctattttatatcaaattatggccattataaacattaaatgaaaataaagttaaaaagactgagataaagataaaacagcaatatttctaaatgctgtctaattgcaatggctttatattatcatcagcaaataaatcaggtcagaatatacatgatatactttgattaagatatattattaataattatgtatgaaaatccaagctttcaatagctttcttaatttttttaaacacttagtctgatctcttggttgtcttcatcttatgaagtgccaatgaagaggtccaattaggatttagaaaagattctgctatgccattttcttgttatttcctgtgagctcattattatcatgtacaatctgaaatttctttacattaatacttcaaagcagtctgttcatttagtgagacatattttagttaatactagaaaattcaatatttaaacatacttcatatatttattatttatttggttaagttttgcttctagaaacccccacactagaaagctcagctccacaattgctcaactttactaggcatagataatcagatttataatttattgattggaaaaaaatatataaaatactgctctcgatgtctttatactgtttaatttctattgtatcctaagaatgaaaatgatgataaaataatgacaataataataatcatcataaaatgagtaaaaagaggaggaagaaaaggaaggaaaaggattagaagctatcattttttggatgactttgctatgtgtcaagaattcttctaaacaaattgcatgtataataataataatttctatcaggaattaacattgagtttactctgagaatttattccctcttaatttttggatgaacaacaggtaatctcttgtcctttgacatctttactagtctttaggatttctcagataatattgaaaatggctcaacaattctccaaatcctttcattttcataggacataattcaccttgacttagagattagaactaaattaggggagacatagagattggtggccaaggttgagagtgcttgaagggggaaataatctcttgctgagcaattactctccattttggtttatttgtttttattagtcctttaaggtacaaacgacgggggggctgaagcagattaaagggccaggagtaaattaccatattcttctccaagaagtgggcatactccttggttattttcttataccgaattctcaactgaactcctaatccttatcctgagtggcttcaaatgtctactaataaaatgttttatatttcaacaaacattaacagatttgagctacattttcttattcattctaaagtatctattctttatcacttaaatattgttagatatttcagtgtgcttttatactgtcagagttaggtaccttctttttttttattctttataagttattgtaatgaatggatattatttctaagactcccacattttgctactgttacagaaattgtctcatgctttcttcactgaggaggccaatgtgcatttatcatttacacagggattccaatcatttggcttccctgggccacattggaagacaaagaatttcttgggccatacataaaatacactaacactaacaatagctgattagcttaaaaaaagaaaagcaaaaaaatctcataatgtcttaagaaagtttactaatttgtgttgggctgcattcaaagccatccacgggatgcaggttggacaagcttgatctacaaaaaaattcactacttcagggggttctgcactgcagattacgggaggagttccctagctaggtgcacatgccacttagacctcatacttacctatattttcttctctttttcttgctcacccccacacatacacacactcatgtttattcttatttctactgtaatatattgacagcaatgttggcaacattagattaaatggagcaaggttccgttgatgaaaaccatatccagatagaagagatatgaattatacttcttggtaaattatttggccatttctgattggctataacaactaacaaatataataaaataccatttccatttttactgagccagtttaaggagataatgataaattataacaacagattttactgtccaattttatgaacgtggtccagtttaggttttatatactagttctacaaagcattgcataccatatatcaaaaaggtatcatttgacataggcaatagtgatccatttggtttctaaatgtacattctacctatcaatatcagtaaccgtctctttcatagaaacttgcttgttattttcgtttactttattactgtttttcattccattttgtgctcagttttatctataatcttagttaatatatttctatttttatatttttttctgctttggttaattttattcatatgccaataacagcagtcctttattattcatccagaaaactctgtgggaacccagaaaagtagatccagatatgaaattatagattagtatggagaatgatttaagtataaaaattcattcattatagaaatattcaaagagtatctactttgcttcagacactgcaattgaaacaacatcacgctacctgacttcaaactatactacaaggatacagtaaccaaaacagcgtggtactggtaccaaaacaagatatagaccaatggaacagaacagaggcctcagaaatgacaccacacatctacaaccatctgatcgttgacaaacctgacaaaaacaagaaatggggaaaggattccctatttaataaatggtgctgggaaaactggctagccatatgtagaaggctgaaactggatcccttcttgtaacttatacaaaaattaattcaagatggattaaagacttaaatgttagacctgaaaccataaaaaccatacaggaaaacctaggcaataccattcaggacataggcatgggtaaggtcttcatgactaaaacaccaaaagcaatggtaacaaaagccaaaatagacaaatgggatctaattaaactaagagcttctacacagcaaaagaaactaccatcagagtaaacaggcaacctacagaatgggagaaaatttttgcaatctacccatctgacaaaggtgggtagagtctacaaagaacttaaacaaatttacaagaaaaaaaacaaacaaccccatcaaagaatgggcaaaggatatgaacacacacttctgaaaagaagacatttatgctgccaacagacacttaaaaaagtgctcgtcatcactggccatcagagaaatgcaaatcaaaaccacaatgagatactatctcacacaagttagaatggcgatcattaaaaagtcaggaaacaacagatgctggagtggatgtggagaaataggaaagcttttacactgttggtgggagtgtaaacaagttcaaccattgtggaagacagtgtggcgattcctcaaggatctagaactagaaataccatttgacccagccatcccattactgggtatatacccaaaggattataaatcatgccactataaagacacatgcacacatatgtttattgtggcactattcacaatagcaaagacttggaaccaacccaaatgtccatcaatgatagactggattaagaaaacgtggcacatatacaccatggaatactatgcagccataaaaaaggatgaattcatgtcctttgtagggacatggatgaagctggaaaccatcattctgagtaaactatcacaaggacagaaaaccaagcaccgcatgttctcactcataggtgggaattgaacaatgagaacacttggacacagggtggggaacatcacactctggggtctgtcatggggtggagggcagggagagggatactattaggagaaatacctaatgtaaacgacaggttaatgtgtgcagcaaaccaacatggcacatgtatacatatgtaacaaacctgcatgttgtgcatatgtaccctagaacttaaaatataatttaaaaaaaggaagattaatacaactcagtccttgttctaaaggagattatggtcacatctctacacaaagatatgctagtatcattccctcttttgtttcattttattagatttctccgagacagtgccagtggcattcaaagcaaattataatggcagaatgaaaagtagcaacactgcaagtgtaaggtgttttttagagatgctcctgttaatgcagagacatagcaattgggtagcattaaattatgcccccacataaaatttaagtattcaaaacctgaatgtaagtttactcataccggaaaaatcatacttaaaatcactgtttcagtccatgacgtgtatacagacatggtgatttccactgcatgtttttaggtttgggatgcacccgctagattttggaaataagttggaacctatagttttttgctgtattttttcccttttcttttaaatgctaataaaatgttgaattctcaagtctgaacctttcactaagattttccaatagagggtatattctttttcagaattcaacaaattaattgcggaaagctacttcagcgactaaaaatgtcctgtttgtttcagaagcaagaaaatagattacattaaaacattttgtttgagttaaatgtgtgccttacagttcaaaacgaagaattggtggaacattatggtcatatccagagactttatgaatgaaaatagattaacattagatgaaaatggtatgtgtgatacttattatgttatgaatgtatcaggtagaatgattaataagcattggccaaaaaaagaacatctaaatcaaaatggccataaataaagcttgataatatggtttccttttctctctctctctctctctctctctctctcaggaattatgagatctgttattatatttttaggtaactgttcagaactattattcccataacagcaactttccataaatgagtctctgtggcaatggtctatcatagaaatctttgttcaccatttgaaaaggagggattgaaaactataaatttgtcaaaaaataacacatcagcagtcagacaggggaaagtatcatgtggatgctctcctgacgcttacttgtcctctctcccacctgtcttacgaagggcaagtggataataaaatgaggaaaaccatgacagggatgtatgtaatgcaacgaagaacaagcaaaggggtttggaaacccagagtcaccgagtttctaatgctcataaatggtaaatgaccaccactagaaggatttatgtgttcaatattcactgctatacttccctttaaaaactaaaacgaaaaccctgctggaaataaataaaaaatgtaagagatactactatttttgcagttattactgaatagcatgctggttctacttctctaataatcacttttttaccataatgtaaatgattaaatgaatagtcttactctctccaaaatagtaggaattcatgtgttatattactttagtgttgcattccaagttaaaatgcaaaggcaatgcaaattgtgcagtttctttagcttaatgaaaatagagtacctatatatagggtttatagttttacatgtaaatccatatatttcagaacaatataaaaagaaacaggattttaataagagtcttggtgttcatgctataaataaaatcaactccagagaccagtgataatggtctagtaaatataaaatggctgctgagtttgctggcagcttacagtcagctcattagagttattcaaatgtttgcttcataaaggaattagtgaggtattaaaatgctaaacaaaaaaaatccaataatgtttcagcctcagtgttgcacatactttacaacacattaaaccaatatttccctcttctattacctatcatagtcaccagaacattctcattttgttcaactttataataacattatttgtgaaaacatagagcaacctttctctctatctctctccccctgtgctctatttatcatcagtaatgtgctactttgttctccaagcactgaggtatgtccttatagcataggctcccttataaaggtttttacccacataagagtccataatatcatgctcatactaaactcatttcaaacaaaatgctaatcatctctggattctgttgtttttccacaagtaaaaactaaaatttgttttttagtctgttgagatgttcatcagatttacattttccttctcattacagaactttaaaatgagccacacttcacggctcaaagtgtggaagatgtcattaaaccagcagtctaatcaagaaggtgtaaaaattttaattaaactaatagcaggctgactcaattattataaaatatattaaaacacatgctgtacatgtgattatattcataagtcatatacaatttttatttacttttctgaacatcttattaaattgaactatttctttgtagatcgtatatagacaatattcaagaatatatacatatacacacatacacatatgaatatataaggaagtatatatacatacatacactattataaataccactctataaaaatgtaatattttggatatggatcatttcactgtttgcttttttagaacagataatgatgcaatactaaagccaatgcttaagaaatctctttctataccttcccttgcatgtgaatattgcttttcctattttagcttggtgttattcctaaaatcagcaactcttgctttttaaaaatggcaaaattcaactttgttaatgggtgccaaattaaaccctaagtttaagttaatcaattctcatttcatgagtattgtcattgctctgagttacttttttttcctttaattgagccctcattcttgctttttctatcggttactttgcttgtacttattttcttcaaaaaagcccaaaaattttcgaaggacttgtatgtataattctacataatttttctaagaaaaaaatctatagttatcaccaaaagcataaatatcagggtttttgctatgaaaacttgtaatcatggctttgtttaaaagccattggtccatattcacctcatttctagatgtcttacagagctccattcttaaggaaactggataagatagcagtataacttcacactgacaaagagatgttccctctgactgcagaaacaactgcagaatcaacaatccaaagtaagggccaacttctcggatgctaacaatgccacttttgcatttacctgaagtggactatagtttttttgcagaggcagagatgaaaattaacaattaccttggattggcatattggcctgaataatactgtagccaaaacgcatcacacaactttccattcttcctctgctcttgtgtccacaggttggcaaaggacgtctgtcactgtttctgaatcttccaatgttataaatttcaaaggtaaacacatttttcaaacatgttttagaaaacaaagatgacaaagaggcccaatgtatcaatattaagaaaattaaagagtcttacaagagatttcttcacaaaagatctgtattattgctgcaaagaggtattttggggggtattgtttttcttttaatttattaattacactaatatgtatcacttgtctctgaagcagataaaatgtagattcagtagataaatctattttttaaaacaacagcctctactttaacagctatgacagcatataaaaacaggtggccatgcttttggccaggatttatactatcattttttctatgaataacttcctgataaaagatgtctagatatcttccaaacaaatacagtgtaagcacaccactatgaaacctatgcctcactaaatatgattataacaaacattgtcaagaaaaataaccttttataattccttttagaaacttaattgctaaggccacactcaggttttggtatggagagatcaagacctacttcaatagctgctggctctcagttgtacttctgagccatctttaaactacttagtaagcattactccagatggcccatcggcagctgacagcaattctacccaccactgcatatggtccactgatggttgataattgtcattcaggtaaaactcactagagctatgtgccaatcataaaacactcactaaaaaggggatcaaagcctgagcggacatgtagtttctgtcccgattagataaataattagtcactttcaatggaaagcttcccttggatatagcaaaaaaaagaaaccaaaataaaacaaaacagaaaaatcaacccactggggtggaaaatgtttgttaaaatattttgcatgagtgattggccactaaaaccaccgcctacctccatgtgaattattttatgtattttaaacccacttaactgatatattttttaataaaaatggagtagagaacacattttaacttaagcatattctttcaaaaaccataaaactgttttccacagttgcatgcatgtttgtattttaaaatatttgttaagtaataagtttaaataaatacaatttaaacctcatttaagtgttcctggacgggcacggtggctcacacctgtaatctcagcactttgggaggccaaggcgggaataccataaaggtcaggagtttgagaccagcctggccaacatggtgaaaccccatctctactaaaaataaaaaaataaaatagctgggtgtggtggctcatggctgtaatcccagctacttgggaggctgaggcgggagaattgtttgaaccggggagacagatgttgcagcgagctgagatcatgccactgcacgacagagcaagactctgtcttgggggaaaaaaaatcatattgcagaatttcttttatttctttataatgcctcagtaacatggctaactcataacagatctacctttaaataccaactgtttaaaattaataagctataaattctgggtaaaatattttctaaaagtgccacatgttgcaaacagttatttttacctttttgtctcaatgctgttgatacctatgtttactttatattttagggagaatatgagagtaagaaaactttggaataagccttgacaactcaaccttcttaagatcccactgttctcatgtcacatataggttcagagaggatgttatttttaataaactttaaaaggtcaatataaagaatcaaaattactcagttgcaaaaatctgcttagccaaatatctcttactaaaatctatggaatattctatttggtccatggtctaaacttttggaataatgagtgactgtatttgtgaggggaatatagacaaaacacatgagtggagctttggtaattgtattcctcttgatttgaggaaatgcagcctggcatacatgtaacagcatataagctggagtcagactcacatggccctagacaactcacttaaaattcctaagtcacgaaagtttctgtagttataaaataaagataatagtacctgtcgcatagggttggttgtggcaatgtctggggcatagtaaatccttaaaaagtggaagatactatcatcaaattaattttcatcatgtgatgataaaaatttaaatttatgtttttaaatttaaatttatctagaactagaaaataactacagtatttaattgtataaaatttgtatcaataaaaataatgccaaacttaacacagaacattatagatattgttaagtacacagagaaaagaaaacttttctacactgttggtaggaatgtaaattagtacagccactatggaaaaaaagtatgaagagttcgcaaagaagtaaaaatagaactaccatttaacccagcaatcccactactgggtatctactcaaaggaaaataaatcaatacatctaaaagaaaccctgcagtttcatgttaatctcagcactattcacaaaagcaaaatatagaatcaacctaagggtctatcaacgaatgaataaagtgcggtgtatatgcacagtaagatactattcagttataaaaaagaatgaaaccttgtcattttcagcaacatggatggaactggaggccattatcttaagtgaaacaagccaggcccagaaagaaaaaatatcgcatgttctcactcataagtgagggataaaaaatgtgttcacataggcatataatgacagataatatatagatatatattctatatatgttcacatggacatacaatgatagagtataatgatagataatgaagactcagggggctaaggggagtggaaggggggaggatgatgatgaattagttaatggataaaatgtatgttatgaatttcttttgaatacatcatattaattgttttcacaactgtaggaagtaagtagggcattgttccccttccttagacaaaattaaggcacagggaggttatataatttgcctacattcaaaatattttcattgtaaaaggcacaatttaaaccaagatgaccctattccctatgccactgctctcaccagctccctgtgttaccactaattcctatatttggtactctttataaactttctattatataatagcttatgttctattaagagttatgttctccataaatgcctcagcttgagtaaatgtagaacaaccttcatgtatttccctccataagggagatgataatggataaaataatttgatttatggttcagactaagaaatttagaatatttttccttcttataaaatgttttaaaagacaatttgatatccttaacatttctcattgcaggcaaatattgatccttttatctcaaaattattttgtactttaatttaaaaaaagaaattaaaactaattaatgtaaatctataaatgagtttttgcaacattgacaattatttaaataatggttaaattactttacgcgtgtgagtatgcctctctatatacagatagatagatacgtatgtatgtatataatgaaaataaattcaatttgaaatataagctgcaaatgcctataatttagaaaatattttcactctttataaggcatataattatatgtaaaattaggacattcaacacaatgctaatattttgatttagtctcttatatttaagatagtctgctgaaacaaaatgtatacaacaacaaatacctccgtcagaataataatgcaaattaattatgcctgagttctataaaaatatataactgaaatatacttatagaaatctattattagttaatattagtgttggcaaaaggtcaaaaaagattgttatgttttagtcattttaataatgattagtacatggtaggaggcaatagacctgtcttccataagccatcataccccttttttatccctgatgttaatcagaagttgacaacacttagtgataaagaaaagttcaaaatgctttgattatatggacatattttaagcttttatacacttaaataatattggctatcaaaattaaaacttctttatatacataaataataacctataccttgaatgtcatctgaatgcttatcacacagtaagctagttagaagtatatatgaactaccagagaataatacttgaaatcacagacaatgcagacatttctcagctccattaacataagcctctcaagagagctctaaaagtctccttttattgattctctccttttattttcttattttcctaaatttcatcgttcagaatcactgtttgaaaggtttctttccagtttagccatatgtagaaagctgaaactggatcccttccttacactttatgcaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaagtgggatctaatgaaactaaagagcttctgcacagcagaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaagcacatgaaaaaatgctcgtcatcactggccatcagagaaatgcaaatcaaaaccacaatgagataccatctcacaccagttagaatggcaatcattaaaaagtcaggaaataacaggtgctggagaggatgtggagaaataggaagacttttacactgttggtgggactgtaaactagttcaaccattgtggaagacagtgtggtgattccttagggatctagagctagaaataccatttgacccagccatccattactgggtatatacccaaaggactataaatcatgctgctataaagacacatgcacacgtatgtttattgtggcattattcacaatagcaaagacttgaaaccaacccaaatgtccaacaatgacagactggattaagaaaatgtggcacatatacaacatggaatactatgcagccataaaaaaatgatgagttcatgtcctttgtagggacatggatgaaattggaaatcatcattctcagtaaactatcgcaagaacaaaaaaccaaacaccgcatattctcactcataggcgggaattgaacaatgagatcacatggacacaggaaggggaatatcacactctggggactgtggtggggtggggggaggggggagggatagcattgggagatatacctaatgctagatgacgatttagtgggtgcagcgcaccagcatggcacatgtatacatatgtaactaacctgcacaatgtgcacatgtaccctaaaacttaaagtataataaaaaaaaaagaaaggtttctttccaagttcaaattctcaactaatttatcctagtttttctccttttccctcaacactaattcttcaccaaaagctggcatctctagctcttaacacctgtcacattcttttctttctctcaatcctcacgacttcttagatcagaagtggactagtgaaaccatcactgagcccagtattacaacctgatcattgaatatactgattaaaacaccaatgccctcaaatgcagcagtatctaaaggacaacgttaaatgttttataatgctatatgaggttcttctgatctttcactagccttctatgctccagggtctcccttcttcactcacatctcctttctatatgaatgctgggaccaaacaaactactcctatttcccgaggatgacaggttgtttcatacctcattatttttgctcatagtgtccagtgttccttctttattggagcttaccccatccccttttcatttgctatcacatttgccttccattgagaacacctgtttgcctttcttgtcaggtccatacgtaagtccctgttactaatatagctcctcctttttttgttttagtttaataagatcatggtattaagtattattacaattcaaagtgtgcagagacaatgatgtatgtgtttgtccttttctttagggaagatgttactagatcaaaagcagctgtcatgcaataactcatctgaagacccatatggaaagagaccttattacctttcctagtcctttacttttatctatttctgtaaatataagtttatatacacacaggctcttgtgccatttgctgtcttcattaatataaaaatatattttgagatacacgctgtcatctactggacataaatgtcttcagcacttcttatcacaggtactttccagttttgctaatcgaggtatataaaacacctactagtttcaggacatagttcaagggactcctacactgtaaagccagtcctatcctcattgctcaatttctgatagggatatcctctgctctttgcatttcagttacgtatattacagcattattattctgattcacctaggaagaaatatgctcttatgtcatctgtctaataatgtcagatattctgtgtgatgaatgttaccacatggaaaacttgtcacctaatttggagggtgtgtttggaaatagataaaagcaatggggaggaatacaacattataaaaaagtagtaattttataattaatgttcaaaactaaaagttgactcccagagtctatgcttaggagatgacagctatatttttaacataaatatttctattaaagaatgcttttaatgtaaatatataaaaacctttgaagaaaatttaagaaaactctttataaagtgaataaaggaatctataggttcttttagtctcacaattgatcagaatactgtattttaaaacattacatatttatttggaataccattggtaatgtaataaatcaatcactataaacaaaaagtgttattaattccaaagacacctgtgatatttcagatgaaaattataaacaattattatgcaacattttaatctgaatactatattttaaatgtcatcatagagaagagacatcttaatgcccttgactacatcatataacccacaaaaatatgtctgcaatgatgggagaatgcaattattttttttatttcaaatttagttgactctctagccttcagtataaataaaatatgtttaaataaactccatatgcatcactcagtctcccatataaaggtaccaaataagacctatgccttatttcataatgaaaaggtacctcaaggcactttttaaactagaaagcatgatgcaaatgtattagatcaaagattcccgactacaaaaattcaatgtttcagttcaattaataactaaaatttatagtcaactcttaagaaaatgttaaatattctaaattagagaataattatcattggtttgctttgcttagctctccatcttatatttattctagcaacctaaatattcaagagtttaagaaaggagtatcagacattctttctcttaaaaaagaatgcctctgtatttgacaatagtgatcagcagtatcctactataatatgtactcattcatagtaaaggctaacagagtcacaacaaagcctatacttaaaatgattgtttgaaaacagcaggagttaaataacttttctttcaaatataaacacttgcccacactgttgctattggtggagaagattcttttctctgcatgtaatttgttttgtcaaagcttattttctgtttcgcacaatgagaactttattatatgcagttatagtctctgttttctgccacttttatgaatcttataaatctggactggttatggctcccagttaacatgatgctgccctttgcacttctttagtgcatcttaattttttggcttcatgcactgagtgaggtacaatctctatgctaccccgagcgctggactaggaattggtagatgaggaggaaaactctcaagagagcaaatacgaaacactaaactgcgaatttttcaattttatttgaatctcaagtaagaatattttttgaaggacagttttgctcattatttcctaaagaaggggcattactgctccaaggactcgaggaagccaatgcaagttggcactatttgagcaaagttcaaaagtacaatctgtggaaactgaacaagaagaacacttgttccctcaagtgtagccagtgctaacagtgcaaatgaacaggatccagcaggaaatccatatcttccagaaggtgctgtctttacaacattgtaataaggtatcctaatagcactttacacgactcatacagaatgcaaagtttctcaaagcatttagccctcgttttcacaattattttagtatattcaatttcacagaaagaaatcaaaagacagacaggtgaagtgatttgctcatggtcttatgagtaaagaggaacagagccagttttacagtctgaattttccttactcctgctactttgctctttttcctggatcaatgtgctcatcactgcattagacctctgttataaatcactacttcaaattattcttatttatttatattgtactttattcattccaaataatatttgaagacactttaagaattgcttacagcacagcaggaaaaatgaatatctggatgaatataaaataaactaataatcatgcataaaatatgttttattatcctgtataattatttaatgagggttacacattttggctctcagcaacttcacagacaagacaaaggaagaaaaggatgagttataaaaatcagtctactaaaacaaatcaattattcagaagtgagttttccagtggcttatggcccatatagtgtcagttgatgaggctgcctttgcttttcatgttttcagacctttaaaagtacctatttttgtgtttcaaaaatggacatacacacacaaatacactgtacagagacaacgcagcatttctggactatcaattccctaagatgattaaagcggtataacacaaagtgaaagaagtttgaaaagtcatttagtaaactgtgaccatttgtcaagtttcttagaagaataacaccctcaataaactgctcttttagaacacattagaagatgataatatgtcaaaaatactaatgtaacatttttcttgaaaagacagtgtttacaatcaagataattcttctctctatatagacattgatatatgtgtatgaatatatatgtatatgtatacacacatatataaatcacataaattgttttcagtgtccacattagcattagaaataaagagaaatgaaaggatgctctatttgcttctcccaaccctcactataaatgcctttcactcaaagttcatatcatattgtataaggcaatgtgataagacagtatgataaggtgacaatttgtaagacaggaattaatattcatcatttgagaaatagaataaatcataatgaattagtctccaacacattttgttatatgtatacagtacacatattatattatataaaatgcacgtattcttactataatcttttccttacacacacacatatacacacacacccctacacatatgtatataatgcataaactcttacttttctctcttctagtgcttgaaataagttctaatcaattaaaattatttaaacatttattcttcagcttgtctctattatttcctgttttatttggatgaatctctgtccaaaatactgacaggttttctgtccacgagcttgtcaaacattcctcatgattgccatggaggaatggaggagaactaacgcctgaggcttggttcaggaggggcttgaaaacagagtttaagagctaatatactcacggaactaaatatgtactaaatgtagatgcaagatgtccacttacatgtgccaacttgtcagttaagtgtcaatgtgtgggctgagcttaactgggtagtcattttggaagcagtcccttagctgctgagataagtatatatgcaataaccaccttcttagcacaacaacttgacctaattttacaattccccgtgtttccctgaagaatggtacatttacagaacccatcatccctatatacttgctttctgtcatcattagtgatcctcatgagactatatgaaatttgaaatggttttggaatccacattttaatcatagatagccaatatcttttaacagaaagcactatttagaagtatatttcaaaaactataaaccagcttcaaaaatgttacatacattaaatagattgcacaaatacatatattcagactattgcaaattgatagctttttccctcctgagtttccagatactgtttaaggtgttgccagttaaatatgatcagcactgatgtggtatttccaatttgactttcagatcatgtagcacaaaattagcacagaacattaatccaaaaattaatgtggcttgatatcagaagttaccttaaggatgctaagttatgtatgaacgatgcttgattactcttcaaactttgagatactattcctttaaagcatgagggttatttcactgaatattgtcaatatttccgtgtctgtgtttctctactttttaatatctgttattgagcaaacctacagtgtaagaccttgtgctgagaagcagatatcttcaaagaagggtgacatggttctatcttcaaaaattccaacgattccacagaatagtccatttttgttttatcagatatatatatatctgataaaatgctatatatatctgataaaatgcctttcactcaaagtgagttttctagtggcttatggcccatatagtgtcagtagatgaggccgcctttccttttcatgtattcagacctttaaaagtacctattctgtgtttcaaaaatggacatacacacaaaaatacactgtacagagacaacacagcatttctggactatcagctccctaagtctacatatatatatatatatatatagtgaagggtcatgttcctataatataaaagacaaactcatggttcagaaaaatttgatttactcaaaataacatatttactaagtactagggccaatattcagcacaggtggtccatttattaagtaagtcattttcattttcctttttggttcagttttcattcatataacaattactgagtgcctatacagatagtctccaactttatggtctaattaatgatggaggtaacctcatcgtgtgtcaaggagcatctggaattataagggttccatttatgatttttggactttatgataggtttatcagattatcaaatgcattatcagtttatgatatttttgacttacgatgggtttatcacaacataatcccattgtaaatagaggagcatctatacggtgataaacaacaccacattgagaaaattaaggaaaatcagagatagacttcaacttcaagtaatttatgagtctttggactccaattcgatgtttttgtttccgccactcccaaggttgtctggcaactggttgatttcacattccattattataataattattgtttttgttttttaatgagttattatctctatttatataattcctatttcagcagtatatgtggatctctttcaagacctctgtatttacagtttggcaaaggaactggcatactgaaagagaaaaaatataaacttttaaaatctttttattataaagctcattaattcagtctctccttatagtagagagctcagattttcatcatctgtgggaagggttatatctacttgccaggtgtttgatgggtagctgtctgctatttcatgaccatagtttctgaaactgaagtggaggagacagtatgagagaggttctgtagaatgtgagaccaagggtcccagtgagtcatatctctgtgtatccacgctttttgttgtcccctgtttggaccagagagaccatgtgacttgactgctaaatgggatattaacaaacatgatacagcagaggtctgaaaagtgcttgtccgttggagcttaccttcacttgccactgagaattcctctgccaccagcttaaactgtcaactcacagcatgttttaagccatttagtctgtttcacagcaataaacaacaaatacagagaccttcgttcagactccggcatgttttgtgtcactcacgcgtttgagagtacttcccctgaatgactttttatgacccagctagggagaaaaaggatgccccaagcattgtcactactaagtctagagcaatgctggcaactaatgctatcgtcatggccagctgtgaaaaatcaagcaaacaaacaaaaccctacatctggattacttctattaaattaaattgtattcaaggaaaaagtactagaatgaaaaaggaagataaacaggattgttaagcttgaagttacattggacatttatttacaaggtagtggtcttggacacatatttaagggtgaagaacagaatgaaaaactctctgaattcaagggtttcactattaagtcaggcagaaagtaactatgatcaggaaaaaaaaaggtaagatatttttgtgcaaactataaagtgagttttaaaaaagaacaaaataacaacaacaacaaaaaataaaaataagaaagacacagactgtttggaattttccacaattatttttcctacttttcacagccctctccctctcttactttctctgtgatggtggtgggaggagccaagggagcaagtaatagggcaggaatgaaaatcattatttttcttcttaaataatgtttcttgttgatacattcatttacactgtactgtttatttttaatcttccctaatttttaaattgggttgaaatttttcaagtgctcatctgttatctgtgttgttacggttttgtaatataacgtttgcataaacttagaaatacatgtatcctggaacttaaagtataacaataataaaaatatatatataatagtttcaaatataaattttgcatctactaagttaaatatcctaattaagcttttacataaatggttaaaaaatcggctattactatttttactattagtaataactgctctggcaatataataaatgtactttactagaattatcttgaatttgttataggaaactataaaaacagtttttgtttgaagcatcaggtattcctttaaatactcaataagttaaaacaacattttctaagattgcaaaaagtttatttttgttgtcattttagttagttttttaagttagtgctatgaatttttaaaaagagcttcttcaaaatacaatttgctataaaatatacagtactatcatataaatcatatcagcatagatatgaacactccatagaaatattttaagaacagctggaaacttcctggtaattcatatgtaaagaaagggtggtctggagatttgagtggagataaatggataagaaaaaggagaaagaactggtgatgagacatagagaaagatagagcaagaaaacagcagaggcgctggtgagaaggggttaaaatcaggaaccacagcaaaagtaaacgtgttaatggtaaatgcagaccaaacttgaaagcaatgagaaatctaggttggacagatcatttcacctcgagagccaataatatgaaataatagccaattgtaatagagtatattttattaggtgtgggcagtttctcaaattaaaaccaatattaaggttgtagaggaacacaaatcctgtctggatccatttacttcaacactaatctccatggcaatgaattgttctaaattactaatttataagtagaaagatactgaaatttggaatatagactcctggagatgaaaccactgaatgtgaatccctatgttcacacacttagtacctctattttaatcaaaatcattttttactcttacttcaaagaaatagcaaaaatatttcacagagtgaaaatatccacatgttctcaaatttctaaagctataaccttatttaggacttcatcgtttccaacccaaattttggctttcgctttctatccagtctcatgtcctccaattttgctctctcctagtccaccatccacaaagctaccagactgatgcatttaaaatgaaaatctttcatattagttaccttacaatcattcaactgctttccacaataaaagctcatatattggagcatacggtgaaaggcctttcctgatttgatctgtatttatctctttacaagtactaagagaccaagatggacttcctttactctttcctatgtatcaggcagtataggcattctgaatgttttgaattttctcaaaagtgccaggttctttcatgttgctttacttttcaaatcagattttctattcagaatgcttttcttccctttgacaccgaatatatttattacatttcaagcctcagtccaaatgtcaccatttctgtaaaaactttccaattgcttccaataaagtatttttttttcctttctgttctcatcatatctcaacttatccttattattgtgcttattacttactatactatactcatctgttcatgagttggtatttacacttaaccataagtcaatgaatggtcagtgacaatattttaaatatctttgcaatatctgtttgtatctggcacatacagcaggtagttaataaatcaaaataaataaatgaatgagtggtttaagtcaaataaatccacgacaaataaatacactagtaatatattcatttagtatgtaagaggtattctctagttcatttatttaatatttgcatacatactaccatacctattagtaaattacaatcattggctatcagttgacaagactaaatatgtctactgtcacaagacacatcatgtctgatgactaaaaaaactggagaaaaaagttgaaaaatttttaaagcttattttttattttagtatacgctaaatataaatgtttgaagaccttacataatcactaactatagctgattctctcataaaattctacaaatctagttcttgagcttagtcaaatacatttgatttgagcttattatcctcaactaaaataccttaaatgcagaatttgttattgattattcagtaaatgtaatttaaaatgtttcttaaatccttatttttaaccaatatttaattatttctttccaaagttattatccttttggtatgagaacaaatctgcaatcaaggaaaaagggtattgaaggaagtagaaaagatttctgaataggttttagtagcacttgctaatttacttgattagttcaaaagttgcagaattatgtaagtctgaaaggtaggagaatgttacagatagtttgacctataagaataagtttgatccgatattggtttatgtggaggcatagagaaggggcaatccaacagattctgaagaatgactctaaagctataggtaggtcagcaaagggatctctgatttgcttcttttttcctccagataggtaaattaacaaagcaagggttaataagggagagaacttggtagcaaatagtcagagaaactgagtccctgccattgctgagttcttgcaagaaatgttcatttgaaaatttgtaggttagagtacatttacaaggggaaaacaaggcaagcataaatctttacttctgcttgtaaaaccattgttaaatgttgtctataatgataagaagttaaaactggtagtattatggtcctatttttgcttgttgggaaaataggatacactaataattagactaaaatatacagtatggcagccaccctatcatgtttcttgaaaaactgacaaattaccctttcttgacatgtattagttgattgttgtatgtgtagaaatgaatgtattcacacatgtctgtttggatattcttttgagggatcaagtagaattttctcctttggcatagaattatacattttaagataattaggaaaatgaacagaggaatagaattctgccttctaatgtgagcaatttcagaaaaaaaaaaaaaggcctggatggtgtttgtgtttttttattagagatagagtcatgtgttaatgtggattgtctgaaataaagtcagttcactataaaatgttcacattgagactatatattcttagaatccggtcacatataccaaaaaattaatgaaacctgcagcataatttttctaccttgtggaactatcagataaagtaatgtctgatgataaattgggtttatggtgagccgctacattcaatctatggtagtaaatcttccaaactaacttcacatagcctgcaagccagagtcaatgtactgttcaccaactgtcccttgaatcaaacgaaatttgacatactagtattcccctaagaaattatctcttatatgaagttacaaagagctcacaataatactgagaaaagaaatattctgaataaagtaattgaaattctctttcaaatacactccattacttcagtagatatccatttataccttaatgttacattacttgatgcctcatagattttttttctttgcgtggaatgcagatagacattctcatatcaaataagatttattgctaaatagctttcccatgaggtctgcttgcctttcccttaggaattctcctcagtattagagtccattacctgttaactacaagctatttcataaagtgcctggcttcagaagatgttaattagaaaaaaaaaagctaataatttaggactacacagagctatttacctcaaattcacacacacacacacacacaaatgtttttccaacctcttatgagaaatcctagaattcatttttttttcaatttacttgttggtgtctcctataagttgctttactctatttatattaataggccacactgagtgctgattgtggctttctttaaaccagttgcccaacattcatattcctgccaagttagactgtataaattgaagtcaagggtcaataattatccagtgactatttaactcaacatgcttacatttctgttgtagctgccagaatattcagaagccaaataaaaaccaataaaagccatcagcttatgttaggtgactgtatcacctattctatccccttactttgattacctctgctttgttttattctgaaatattttattctatgatgtttaacgtatatgcaatttaggtgctttcaaaatagacaatatctaaattttaagtaataaaagatatttaatgactcacaaagaagaatacggcctatttgaaaaatgcatagctccatagtggtaagtagataaaaacacctttacagacataaatactaacattatataggcaaaattattcaactcttccaattccatattaatgggtaattaatgtttcttaactttctttactgaggttgtaggacatgtgatattattctactttaactccagcaatcaaggaaacacagtgggatctacagaatgaatattccactaaagacaagatacatgcctactatgacaattatatgaaatataaaggaagattaatgacaagtttatttaggaatgtaatgaaagtgaaatgttatttggaaactcttatgattccatgagatataacaaagacaaaaaaaaagacctaatagaaatttccaatttaaatacaataaagtgtaataaaagtgtatcatgattttggagacataatgttcagataatctttctgaataaattagactttgtgtttaaaattaactaactttttctaatttttaaaattgtttcatgcattacatgtcaacaattagaaagccacttttctcacagaaaaatagagtaggaaaaattgtacatgtatacagaagaacaatacaaaacacagaaaatacaaatgttgttaagagaagggcacatgctattggcctggaagagtgagatgaagagttcagttgagaatattaggaaaaagcaaaggtatagaggatttcaaacattatggataaataaggtgctttggtgagaaggaatttcttgtggacaaaaagaaacaaaaggaaaagagagcataaaggtacaagaaaccaaaaaatcttgcacttacaggaggaactaattatagaaaagtggtatgagctaagcccacaaagatcaaattatagccagatcacagaaggtcttgtcaactgtgaaggagtcagaactactttgagttgcaattgttgactttgaagcacttgagcagaaaagaaatgttgttggagttgcatttttaggcaggtacagagagaagctggaaacagggaaactaatgaggacatgtctgcaataggagcaatgaagtaaatggaggtctacactactgctatggcaacagaaatgaaaagaaaggaacacatttgaaaaatggcaacagaaatggaaagaaaggaatacatttgagaaatatatagaagatctatgcatacaggacttagtaaccagttacaaattgggtagaagagaaaagttgaagtatacttagaatttggtttgcatgtctggaagaccaatgaaaccattaagatagagtgagtcagggacaagggctggcttgagaacagtggctgagcagatggaacacttaatttgggaagcactaacaagaaagtaaaacaaaaacatcatgcctaaaaatgagcataggtaccagaagcacaggcataatgaggtcaagacaaaatgagaagcatgaagaagtgaaagcaagtgaggtctacttttaagaagtttagtgctaaaaaaaactaacaacaacaaaaagaacacagaaaagatatgttgaataagtggtaggagtttggtttgcttgttggtttcttatattaacctaggagcaggtaaaccaaaatgtgtgtattcagaagtgaaaagggcccagtggagagggcaagatcaaagattcagtaaagattcttaacacaggatccagtatcattccagagcggggaagtacccaaattcaagcccacatgttcagcctctagaaaaagaaaaccaccttctccaccccaccccctttgaaatagaaagaggagaaaggatttgatgctacaggtagtccgagataaaaatgaagaaagctaaggagagtcatatttgacagctttgacttaataatatgtttttaaaaatatgttgagaggaaagaagtgcaggaaaaaatggaatatgaagagagtaggaaaggtctgaaactgtagctccatggaatattcaaaggagttaggaagagatgaatataagaactattgaagagtagtgctggtttggcttaactttttattaaaactatttttttctttttttttttttttttttttttgctatgacaaccattgcacagctaaaagattgaaattctcctcttttagtgggacccaatatactttccaataactccaagaaaatcaaatagtatagaaatacactctagattttaaaaaatcataaatgtgttcttttcaaactgaggagcaagatatcattaaataaaatatgatgtaagtgtgcctaagtgaagttgtttagatattttgtgtgcatggcatgaagccatgggacttgatgtttgatttatctgcaagaaaacctgctgccctaatcaccagtaaacctcaggagacttttgcatatcaaagggacaaattgtttcaatattacgggtatttaaaaggaaactggatccatgaagagagtgatgactttgaaaagaaatgcaaaaaggttttcagaaatcatgggcctaatgtttgtgccacagcatactgcccatgcttatatacctccagttatgcagaatatgtacaagcaaggacacgtttacagaactccatataagtgcaaagggtatttagtgagacgatcagcccaaatatactctgataaacctaggcacttcataacattataacaataatttgctcacataggtattgagatttagtggttcagagagaaaacttttgccaactttcatcccatgtatcctggcagggcgattcctgtagtggaagcagcttttaggaagaaaagtctcctttctagatctcctgatgtgcagcaaggtagctaacaggagatccatttcagcctgcgtgcagcaaaatttagtgccaagtcagctaattttgtagtctacacttgagcacatggcatgcagagaaataattgtcatggaagttaatgagaagactctattttaggttaaccacgtcctctgtcatgtcctacaccatcatcttccttgattgaaggtacctttgggctctcatttgctactgttaatattctcagcttttcacataactatctctgaacactctggcttttgggagcttggtggaaacctgaacctctgccatcagatgtggttttgccaacattttctgagatcaaatcattcttcagaccaaattgccttccactattcccatccaccacatctcctgttttagagcattgaaaaacaataatataactaatcatactatatacaaatatttgttttttatttctcaaatacagacaggaatacagaaagaaaaatgcaagactaagaacccaaagaggtccatcacagtgaagtacatgaccagagcttttgatctaccacccagtttccttcctcattcttcaagtaagaaggtcagacttcaggttctctattatttactgctctattattctatgcaaagtagtataagtgacatgctgggtaatataaaacaatggaagaggtgaattaggatactcagaattcacattaacagagaaacttgaaatcaagcacaacctatgtgctgagaatattgagaataatcatactgtctaacagtttgacactggcacacatagtccccattataatcactgtgtgtgagtgtgtgtgtttgtgtgtataatgtgtgtagctataagtgcatgtataagtatctctattttttagttgaggaaactgagccccaaatataattgaattattcattacgcaattgtaactgaggctacaaattcaagtcttttcgagtcttaagacagcattaactttactacattaccataactaaatagggtggaaaaattcctaacttaaggttttgattcttccaaacttttaagccttgaatgacagataacataattagagagttggtgatagcctggctcttgagaaactggccaaacagagggcaacaaagaggtctacttctgtatatatagatagctgctgcttttgagtgtttctgaacagactaaagtaaaaggaaagtagccacaatggctccaatggctcctgccctgtcatattaatcaagatcatataaatcaggtaagtactaagtataataagtataatacttagtgaaaggtggttcatctaaaacatagagatgaaatataataggaagtgggtaaagtggcaagtgatagtgaacaccttaaatataccttaccggtagtggtttaaactttacatgtatgatttgtatgatttgatcccttcttcactaccatctattaaaatgaaaattacttttttcctattttacatctgaggatattagagctaaggatgtttagttaacttggccaaggagccagcctaataactggcaaagtggaaagagtctttatctgttctcccagcccaatgctctgtccaacgcatcaaatcacactcaagggcattttgcatgcccaagagaaagcattctctccaaatagagaagggatccacttaccacattattatctcttactaatatttcatgctttttcaaatttagagtctttgcaaatacttcattaacttagtaatgattatacttaatgaaaatagcagttattcatatctttgaacttaagacaaaaccaatataattttaaattgtaccctagaacttaaagtataataaaaaaagattctctccctctccgtctcccactttccacggtctccctctgatgcccagccgaggctggactgtactgccgccatctcggctcactgcaacctccctgcctgattctcctgcctcagcctgccaagtgcctgggattgcgggcgggtgccgccacgcctgactggtttttgtattttttggtggagacgaggtttcgccgcgttggccgggctggtctccagctcctgacggcgagtgatctgcccacctgggcctcccgaggcgccgggattgcagacggagtctcgctcactcagtgctcaatgtcgcccaggctggagtgcagtggcgtgatctccgctcgctacaacctccacctcccagccgcctgccttggcctcccaaagtaccaagatggcagcctccgcccggcggccaccccgtctgggaagtgaggagcctctctgcctggctgcccatcgtctgggatgtgaggagcccctctgcccagccacccagtctgggaagtgaggagcgtctctgcccggccgccatcccgtctaagtgaggagggtctctgcccagccgcccatcgtctgagatgtggggagcgcctctgccccgccgccccgtctgggatgtgaggagcgcctctgcccggccgccccgtctgagaagtgaggagcccctctgcccggcagccaccccatctgggaggtgtacccaacagctcattgagaacgggccatgatgacgatggcggttttgtcgaatagaaaagggggaaatgtggggaaaagaaagagagatcagattgttactgtgtctgtatagaaagaagtagacataggagactccattttgttctgtactaagaaaaattcttctgccttgggatgctgttaatctataaccttacccccaaccccgtgctctctgaaacatgtgctgtgtccactcagggttaaatggattaagggcggtgcaagatgtgctttgttaaacagatgcttgaaggcagcatgctccttaagagtcatcaccactccgtaatctcaagtacccagggacacaaacactgcggaaggccgcagggtcctctgcctaggaaaaccagagacccttgttcacatgtttatctgatgaccttccctccactattgtcctatgaccctggcaaatccccctctccaagaaacacccaagaatgatcaataaatactaaaaaaaataaataaataaacataaataaataaaaataaaaaacaaaaaaagattattatgcacataactgtatataaaaatgcatcatgtatatgccatataataaaatacgtgcttaacttctttatctaattgtcatactagcttgctgttgggaactataagcaatttgtattatttaaggcatgctatttgtcaataattcagagagattttcaagaatgtgcaccacgattatttattgctttattcaaagcctttcagaatttatagtccctaatctgtagtttatattttacgaatccttaggtatgcaaaaactgagagaggagtccagttccattttaaattaagctattatccttgaaaagaactgtaatattaaaatttgatcatatattttactgtcttgttgtttggcaaatgtgctttcctcagtccgtgcactgatcagtttgtagtcattatttaaaaccatcctgctggcctttgttctttctgtgaaaaggcttaattcagaagacttaaaagattttagtgaatatgactgctgctctaccatcacgtcttaaaaaattgttggctgttattatttggggggcacttacattctttggaaagaaaataaacaggttattcatatagaatttcaacatttttaatcattcttaacacatttgatttataaaaatctctaagtactctgagaagtcaaaacccatattgctagcaatcctacatgtaactcactagagggtttgtaaatgccacttaataacatgatagataatcttgacactttactcaagaattctgcatttttatgtttttagtccaccatattaagaggttttaaaagtatttaagtatacgtattttgatatttctgattagtttgactcactacacagtttaaaacacctcaagtggcaaaatatacactaatagataccaatttgaggctctattttgaacaaaacactgtttcaggtgtgctggggccaagcagagaaataaattattgttacaatttatgaattacatttgcttatttccttatttcactagagaattaatttctgaaacaaaatgactggagtctgtgattacaaataatgtcatcattctgttttatataataaagtcaatcccatggcaattgtggctttttcttttttaatactcaaatgcagttgagtattgtggatgagatccttaatgagacatccttggtttgaatcttggtcctttctacttcccgcttgtctgatctggtgcatatcttcagactgttcattatctgtaatcggatgattaaaatactatctacctcgtagtgttgtttcaaggattaaatgaatttcacacattcagcaactagatcagtgacatcagtgtgtggcacaaagcaggtactataaaagtgttcttatccttgttatattgaagtctgtaaacaaatttcactaataaagtggttttctaagtattcatgtgtgtttttcaattagaaattaggctcattttaatttacttgttcttaatacgaatgctttcttagctccttctaaaactatctgaacaaaatgagacaacactaaacctcaccctactcgtatgttacataccacagtaacttcatagcgtcagttaaaggtattattttcgaattaaagcttaattatttcttctgtgggaagaaggagaagcaaatatgaaagcctacctctggagcaaagaaagagctttcctgttagcttctgaattaaaaattccttacacttcttatttatatccttaataatttacagtttcatcagtgagactagtagaagaagcttcaagttcaagagcaattccaaattgttttgaagaggtattatcaatagattattacatgcaaatagaagaatacacaaagaaagctttgtactttattgtgtatatatatggcacattttcttccttcattaatccattggtggacactcaggcttttccatacgttggtcattgtgaatgatgcttcagggaacatgggggtacagacatatttttaagatactgatttcatttactttgaatatgtgcctttaagagtgattgatggattttacggtaactctatttttatttttttttgaagatcattcatactttttccataatggctataccaatttacattcccaccaacagtagacagagttcccatttctccacactctcaccaaaacttgttatcttctttttttatattggccaccctaacatgtgggaaggaatatctcattgtacttttgatatgcattttcctgattagtgttgttcacctctctgatgattaatgatttacctagtggccatttgtatgtcttctgaaaaaatgtctattcatttaaaaaaatcagattattcatttgtttcatttcgttttgttagctattgagttgtatgagtttcttatatattttggattttgcctcatgtcagatacatggtttgcaattattttttcttataacattggttgccttttcatctatgagttgtttccattgttgtgcataaggattctagtttgatgtagtctcatgtttatttttgcttttgttttctccgtttttggaatcagatccaagaaatcactgtgaagagcatatcaatgagcatttctcttatgttttattttgggagttttatggtttcagaccttatatttagagatccttaatccattttgagttgatttttgtgtgtggtatgagtttaattccatttgtttgtatgtgaatatataattttcttaacatcatttattgatcatcctatcttttctccattgtatattctttaagctcttgtcaaggattagttgcccatatatagatgattttatttctgtctccatattctgttcttttggtttatgtgtctgttttcataccaataccatactgttttgattactatagacttgtaatatagtttgaaatcaggtaatgtgatgtctccagctatttgttctttctcaagattctttgactattcatgagattttgtggttccatataaattttagaagttcttttaatttaaaaaataacttaagaagtttggtagatattgaactgatctgtatgccacattggatagtatagatattttagcaatattaattgttccaattcacaaccatgggatttctttccaattatgtgtattcttcaatatcttccctcaatgttttatagttttcagtgtccttcatctccttggttaaatgtattcctaagtattttatttttatagctcttgcaaatgagattgcttttttaaaattatttttcaggcatttcattgttagtgtattgaaatgctaccacttgtgtatgttgatttagaatcctgcaactttactgaatttattatgtctcaccagttatttttttttgtgggggtgttaacatttctctacacaagattatgtcatttgtaaaccaaaaccatgtaccttcttcccttccaatgtggatgtcttttatttttgttcttgcctaattgttgtttaggattttcagtactatgttcaatgaaactggtaagaatgataacccttgtcttcttctagatattagaaaaaaagctttcagcatttcaccattgagcgtgagtcagctgtaggcttgtcatatatggcctttatcatgttgaggttaccccaaacaataggctggtatttaaagttcttttgtgatttaactatgtattttctgaaaacaagcataatacaagatagtatccaccagttattaatgccctataataacgaaagccatctgtcattagagtctgtttctatgaaaaaaatagcaaactatacctactaaactgtaatcaacagattatagttgataaacagaatctggatacccagatttccattttatcatttcagctagttattgtttaattacaaaggccacatatttccttgctttcctgaacatttgccatctgttcccaatactagatataactacccttctctattcctcacctaaatccttatactgctgatgactttggaaaatagtacagggttttacagtctaatcatgacaatacatctccaggatccttgagccaaatacattcctcagaatactttttttaaaaaactgaaattgattacttgtactttgtcatcaccaaaaatatctgtagcaagacatactgttctcagcatccacttctaccatcctcactattgtaactcacagtagactatgcctcctactttactgaaaagatacaaaccattacctagcaatcattcttccaccttaaacatattccatattttctacctcttctctcccatagttcttgcatcagaatgtgttcatcctgaaattattctttgtgcttcaatttttcattcttagcttaatccaggatttgcattaattgtttcctcttgcctttggacccttcatccatttacttgcttccctgtacccaaagcacatatgcagaatttttctttaattctaaaaatgtttacacacacacacacacacatgcacatgcacacacacatataatagaaaactctaagagtggtcctaaagatgaaacaaagtgatcaaatgtactgagtgcagacaaaaaagttcaaaacctcagtaacaggcaagaaattaaagttgagaggacaaaaatatttttagaatattttctccagagatgcatagtgtatatttgactttttaagaatactttttaaaaatgtcctattccataccatctctcaactaacctgttatcaccttgttattggttttctgtctccccacattttaagaaaactgctcactcaaagcttatcaatgatcttcttgacacaaactgatgatgtaactcttttttcagcctcctctggagcctctgtagcactgctgacgagagctttccaattgtttttttctttcattactttacgtgaaagaattcccattgttctgcttttatttctctgctttcagttactaaggtatttatcctcctttcgacctttaaaaattccttccatctctaatttcagtgttttagttccttaactttactgtcctctacttggtcctcaactatcaccttatgcaaaaacgtctagctctatatttcttgtcttaacctatcctttaagtcatacttacatgtccaatgactttttttacatctccactctgatgccccagccacacctcaaactcaacattttttaaacctgccatcacccacattattttgctttacagtagtttttaattccttttgttcgtgatctctctccttctctctctccccttttgtctctcccattcgtcaccatataatttggatagaaactttatgggacatattcatcctttgttgagaaccaatacaatatgttctccaaattctgtgaaatgattggtaaaacctttgttcattaagttgttcaaaatttcagcgatgtagatctttcttcatcatttatttataaggaaaaaactattactcctactgaatgtgattactttcagtagaatataaaatatgtaaaaccaattgtgttaccttttttgctttgactgctaggaaatcacaaaataagatgtaatgtagttacaaaaaatattagaagtttgtttctaatcccttgttcttctatttctgttttaattctcatattatatagctgtctttgttataagccaacccaaaattgtttatgcctcaggctcactagaaccaagtagaaagaagtcttgtagtctttgtctattacataaagatgaaatacacagatagtttgggctcattaagtaaactacttcagactctgttccattcataaaacccgataaggctaagcaacttcagcagcaggagaaataggaacctataaaaatgtaacagaaaaatacaacaaattaaatgggtatagttttaaagtgctgttttgaaataccatttcatagctatcattgtttaaaaacctgataataatttttgaagctccatttaccaagtgaatcaaaacctctgcataacgtgtattgcacttgccatgcaatcactaagcatgatggtgttggttagcactattagaggtggaaacatttcaatttatttttgtttgtttaaaagatcaaagtgagaactttaactctagagacacattaaatccagagattaggactatagtttaagaaaatcaatttttttcttgtttgtttgctagttttcattaacaaatgttatggatcagtcgtcaaatagatagcacctttctctggaaaaagaacacaaattctggcaaaacagtaaggcaggctttgatgcagactcagacacagcagatttgtcccagattcagagattcatctttttcagtgtgttttcttttcttactaaccatctcttacaggcaatgcaatggaaacacatttgtagtctattttatacttccttaattttcttcaaacagctttgcagatgatacagaatataactcatttctgtatctaggactttctttgttagaaaattcattgcatatatataggctgcccccaattcatgaacaggtagtagtccaaaaactaattgtttaaatcagtagctaggaatatgaagcacattttttctttaaattgactttatatgaagtactgtatactggtttcagaattacttataaaagccaaaatagctccaatttcttgagactctgttaaatgtcagaaaaaatattgtatattatacacatctcattgttttattaacttttttcttttttattgagctaatgcatataatcagaaacttcctgacgtgcacatatcttaaatgtagagctggagtttcagtaacagtttattgaagtataatttgaatgccataaaattcattcattttaagggttcaattaaacaatttatttttatatgtgtatatacctataaaatggctacctggatcgggatattgaaagtttccttttgcctcttttcagtcatacccatgccattccatggaagtaaccattatttgaacttctatttccacagattgttttttcctgctcatgactttatattcatgaaattagtcatcatatagtctataaagtcttggttatttctgagaacgcttctttcagtgtcttcacgtgtattagtagtgtagcattccattttaagaatacaccacacttcatttatttcttctactattgacagacattaaaattatttccattttggggctgttatagataaagctgccatgagtactgaaatctctaggtgaactattactggatcaaagagacagtgtatgtttacttgtagcagaaactttcagaaagtttccaaagtagctgtggcaatttttattcccaccagcaaggtatgagtgttcctatttctgtttattactaccaaaacacactgtcagtcaatagaaatgttgttgggtgtgttgtgctacttcattgtaatttaaatttgcataccttttttgaaaacataaaattgacatacccatagccagactaactaaacaaatagagataagacttatatataaaatcagaaatgtaaaggatcataaggaacctttattaatagctatacaccaacaaatttgataaattagagaaaattgatacattactcaaaaatatgaattacaaaagtgaatcaggaataaatagaaagcctgaacagaccaataacaataaaagagattgaagcattaattaaaaatctcccaggaaagaaaaacccaggacccaatggctttatagctgaatttgaccaaacttttaaataaaaattaatattaatccttcttaacttcttccataatagagctggagggcataatttcacattttatgaagccagcatcaccttgagacctaagacaaagatatcccaaggaaagaaaactataggccaatatctctgaagaacattattgcaaaaattactcgacaaaatattagcaaattaaattcaacatcccatcaaaagagtatatttcatgatcaagtgggatttatccttatctaaaaggttgttttaacatatgcaaatcaaccaatggatacatcatgttaacagactgaaagatataaccacatgatcataacaactgaagcaggtaaaaacattagacaaaattcaacgttctttcttgacaaagcctctcaacagtttagacatagacgaaaagttcttcaccgtagtaaaggacatttgtttaaaaagcacagctaacatcataataagtggggagaaactgaaagcttttcctttaacatctggtacgaagcaaagatgcccattcttgccacttctatttaacacagtactgaagtactacaaagagtagacaagaaaaagaaataaatgctatccaagtaaaaaaggaagaagaaaaattatctgtatttgcaaatgataccctttatgtagaaaacgtcaaagacaccaccaaaaactgttaggtctaataaatgaattcaataaagttgcagaatataaaatcaacatgcaaaacatcatatcatttcttttattttttaactttaaaaaggatttttttttattacacttttaagtcctggggtatatgtgcagaacatggaggtttgttacatagttacacacgttccgtggtggtttgctgcacctatcaacccgtcatctacattaggtatttctcctaatgctatccctcccctagccccccatccatgacaggccccagtgtgtgatgttcctctctctgtgtccctgtgttctcatcgttcagctcccactcatgagtaagaacatctggtgttcggttctctgtccttgtgccagtttgctgagaatgatggttcctagcttcatccatgtccctgcaaaagacatgaacttatccttttttatggctgcataatattccatggtgtagatgtgccacattgtctttatccaatgtattattgatgggcatttgggtttgttctgagtctttgctgaattgtgaattgtgccgcaatagacatatatgtgcatgcgtctttacagtagaatgatttataatcctttgggtatatacccagtaatgggattgctgggtcaaatggtattactggttctagatccttgaggaatcaccacaccatcttccacaatggttgaactaatttacactcccaccaacagtgtaaaagcattcctacttctccacatcctctccagcatctgttgtttcctgactttttaatgatcgccattctaactaacatgagatggtatctcactgtggttttgatttgcatttctctaacgacccgtgatgaagagctttttttttttcatacgtttgttggttgcctaaatgtcttcttttgagaagtgtctgttcacaccctttgcccactttttgatgggattgttttttcttgtaaatttatttaagttccttgtggattctggatattagccctttgtcagatggatagattgcaaaataaatttatcagtattttaattaaatattttaaagaaataatattaagaaaagaaatttaatagtatagtttctccttaaatattaactgcactttttccaattttttattatggcaaatatatataacataaaacttcctattttaacaattttaagtgtacagttaagtggcattaaatacattcataatgttgtgtagtcagagagtttcggagatggatggcggtgatggttacccaactttggagcatatctatacacaaataacgacctagaccaaaaataaatcaagaaaacaatcccatttacaatagcataaaaagcttaggaataaactcaaccaaggaggtgaaagacccgtaaactgaaaactagaaaatacagataaaaaaaattaaataggacacaaataagtgaaaagctattccatgcttatggatcagaaacactaactgttaaaatgttaacactacataaagcaataaatagattcaatgcagtccctatcaaaatcccagtggcattattcacaaaaatagataaaaaaaccctaaaatttgtatgaaaccacaaaagatcttgaatagccaaaacaattctgaaaaaaaaaaaagttgaaaacatcatacttcctgattcaaaagtatattacaaagctatagcaatcaaaagaatgtgatacttgcatacagatacacagaccagtggaagagattaaagagccccaaaataaatctaaacatatacagtcaactaatttttgacaagggcaccaaaaatacacatgaggaaaggacaatgtcttcaataaatttgctggatttacatatctggatttacaaacctggattgacatatccgagacaatgaaatggaatccttctcttacaccatacacaaaaatcaactcaaaatggatgagagacctaaacataagacttgaaatcataaaactcctagtagagaacatagaggaaaagctccttgacattagtcttagcaatgatttattgggtatcacaccagaaacttaggctacaaaagcaaacataaataaaagaaacggcatcaaataaaaagtttcttctcagcaaaagaaaaaatcaacaaaatgagaaggtaatcaacagactgggaaaaaacatattttcaaaccatataacaaataaggggttaatatccaagatttacacataattcatacaacttaatatagtaagaaatatataacctgattaaaaactggacaaaagactcgaatagacatttctccaaagatgacataaaaatgtctaacaaggacatgaaaaagtgctcaacaccactaattccacaggaaatacaattcaaaactctatatatcctcataactgttaggataactattataaaaaagataagagataacaggtgttggtaagaatgggggaaaaaaggaaactcttgtactgtgttggtgcaggcattatgggaaacagtgtcagatttctaatgaaattaaaaatagaactaccattctaagaaaataaaatcaccacctcataaagatatctgcaatcctatgttcattgtagctttattcacaatagtcgagctatgaaaataatctaggtgcctatcaatgaaaaaatggatgaagaaactatcatagtttatgaacattattcagccttttgcaaaggagatcctgtcacttgtcacaatatgaatggacctagaggatactatgctggatcaaataagccagacacagaaaaaaacatgttgcatgatcttccttgcatgacattctttttttttttttttttttaagatggagtctcgctctgtctcccaggctggagtgcagtggcacgatatcagctcactgcaacctctgcgtcctgggttcaagcaattctcctgtttcagcctcctgagtaactgggattacaggcgtgagcctccaggcccagctaattttgtatttttagtagagacggggtttaaccatgttggccaggctggtctcgagctcctgacctcaggtaatccgcccgccccagcctcccaaagttctcggattacaggcgtgaatcaccacacccggtctatcttgcttgtatgtgaaattttaaaaaagatcaaatatatagagatggaaaataaaatactggttaccagggtcaggctgtgggaggcagaagctatgaggagatgtaggtcaatcgatacaaagtatcaaatatttaggattaacacattgagagatttaatgtaaactatgaggaatgatagttagcgtattatatacaggagttttggtaaatgagtaaattatagctgcttttgtcacaagggggcaaaaataagtaaatatgtgagctgacagtacacaatacagtttattttaaaaaataaaataaaattgcctttctctcttaaggaattcatgtagaaatatttctatatgaatattggtcatttcctttttatttgaatgtgtaggagtattttatataatctgcaaatgagtctactatctatctcagtgacttttaagaaaggtaatatgatctacacttaaatgatggtaaaaatgagattctggaaagtaaactaattcaccaaacacacacatcttgtaagtggtagaagcagtaccggatttagcctggctcattcaaaagcctgtgctctttagagcattccacactgtggggcacataatgtaagatataaccaggacataagaaaaactatcttgggggaaatgaggtatcagaaacatttttgtctggataagagtaagagatgtgcctatttccaccagtccccctttctgaacagtgagagtgagctagtattggaagtgcattgagaaggaagtaagatatctaaaggaaaaaaaagaaggatataagtaaaaaaaaaaaatactgcatttcacaaactttgttgaaagagatactagttacaggacatattttcttgctgtcctgagaaagtagtacattgtaaaatgtataaaaattaatatacaaattagcatattaattattgtatataattatcttaaatttatgtaatatagcattttaaaaattatttgaaaagagaacagttttccagagagtgtgtatatatacacacacatatataatataaaaatatatattatatatatgccatactcatttgagtaatagtcattatctgggtgtggttatcacaaatgatgtttttctgttgcttttctaaaatttctaaattttgatgatgtatgtaatgcctactatatgttgagttgaaaatgggttcagttatctaatatattatgtatacattaagacaccatcatatgcttatatatttctgaatatacgataattataacttgtttctgggtgctaggattacaagctttttgttgttacaattttaacgagcatttatttgagaagtgattgggagaactatatatgagaattcatgttgctcaaatatgtatctgcttaccagaagttaagcagatgatacatataaaatagaaaccaatttaatagagagagacagaggatgaaaaaggagatgacagatattgaaaacacagaacacagaagtagaactgaattaataaacaagaataagttgtttatttcaattcacttggtttataactctttacaaaaagatttgaaagaattaaagaaaacttttcaaaactacaaaaaaagtgttgagattgaattcacaatgacctcagtacaattgttaaggaaatagtcttaaatttcaaggaaaaagagggtttttttttctatgtctataagagaacaaaagcaaactctttcaaagaagccaaagcattattgtttcagagttctctgctgtgacactcaacttcagacactaacagaggaataacttcagagtcttacaaaaaagaggtgtgatccaagaaaaaaagaggtgtgatccaagaactctgctttacccaagcaagttgtaattcacatatgaagatgagagaaaaatgatttcagatctgtgaactttcataaaatttaccatcaaaataccccttttattctgcagaggttgaaaaaataaaatagaattataaataaataagagaacttctgtacatggacattcattactatacaccaaaatcaggagaataactctttattttaaaaagataatcctctgttagcataaagtataagtacaaatacctataactataaatacctatagctataaacatattaaaagttatcagattaagaaagaaaaatgtggccatgtgcagtggctcacgcctgtaatcccagcactcttggaagctgaggcgggtggataacttgaggtcaggagtttcagaccagcctgaccaacatggtgaaaccccatctctactaaaaaaaaattttaaatgcaaaaataaagattttaaaaagctgggcatggcactagaattgctcgaacccggaggctaaatttgcagtgtgccgaggtcatgtcactgcactccagcctgagcgatggagtgagacaccaaagaaagagagaaagagagagagagagatagagagacagagagagagagagagagacagagaggaaaggaggaaaggaggagaggagaaagggaggaagggagaaagacaggaagatgaagatgaagatgaagatgaagagaacgaaagataaattctgaccattacagctactttgtgtgtgtgtgaggagagcatacagaataaggtacacccctatatcacagattaaaagggaaggaaataaaaattataatagaaatgcataaaggtcctagtgacctaattatgatttgaatccaatcttataaaataaaaattaactttttaaatattttttaaagtagaaaaaaaaactcatcgtctcatgtaacccagagataaaaggatatttcaatgtaacaacggtaatgtcagtaggctaaaaacattaaattgcttatcattaaaaaattccaggtgaaaatttgacatccctcccaataaaatacttttgaaaaataaaataaaatactattttagaaatagtcatatagcctaaaactaacattacaatcaatgacaaaatgatggtcaaagaccccttcaaattcagtaacaaacaaggctatgaatcacaaccaatattgctcaacattatagggaatcctgctaatttaaaagacagagcaaataaaaatatgtgttataaaggtgaatagtgttatttatagaaaacactgagtgccttggaaggtatcagattaattcccactaataacaataaagaaagtcaataatgaatcctggttagtaatacataatcaaataatatttatgtaattcagcaaagatcattagcacacacaacagacatttgtttgcttataacaacagcatatgtacatgacatgtaaaacctttgccacctgccacactagccgcaacaaagttcttttagataactcccctgcgcaaaaaaggaggtgttcataacatttttttgagtccaagtagatgcaaataaatggaaatacatataatgaactggggtcgctctattaataccatatcactatagtaaatatataggcttaccacaattccacctactaaagagtgtcgtcatgtgccacatgacatttcagtcaatgacagactgcttatacaacggtggtctcataagattataccggaactgaaaaatttctatcacctggtgttattgtagccattgtaacttcatactgaaaagcatcaccttttctgtgtttagataggtttatatacacaaatacctacactgtgctacaattccctacagtactcagtacagcaacatgctgtacaggcttgtagcctagaagaaccaggctatgccatatagcctaggtgtgtaggctataccatgtaggtttgtgtaagcacattctcaatttcacacaatgctgacctcacctaacatggcatttatcagaatatgtcttcattgttaagcagcgcatgactgtttatacagatcctaaatactataaactaactgctacacagttccaaatagtaaatactatatgaatataaaaatgcatagatttaggaaaatttcaaatacaatcaaaatacagttttagaactatgattaccgattgaaaaacttatgtggagaaatgaatgagcgaaactaaaaatagcaattctcaatttgcagtagctggggatactactgtgatgcctcttgcctatgatttgttgaatgataaatcttttcttcacggtatttgtttctatcctccaacaatcagatgaggtaagtacttttattatgatttctctgttttattcatacaatgagaaaactgatgctcaggaagcctaatatctagcctgaaattatactagcgaaataatggagtcagtatttgaatgcaggcagacttcactgcttctctctcaattatttgaagataaatatcataaaagaaattttatgccgggtgcggtggctgatgcctgtaatctcagcactttgggaggctgaggcgggaggaccacctgaagtcgggagttcgagaccagcctgaccaacatgaagaaaccctgtttctactaaaaatacaaaattgaccaggcgtggtggcgcatgcctgtaatcccagctactcgggaggctgaggcaggagaatcacttgaacccaggaggcagaggttgcggtgagccaagattgtgccattgcactccagcctgggcaacaagagcgaaactccaactcaaaaaaaaaaaaaaaaaaaaaaaaaaaagaaaagaaattttataacaacgtgtatagctctaaagtgaaaatcagaaatgtaaagcagaattcagacttcgagcatctgaaaacttcacataaagtttaaaaaatggtaaagtaagcttctcaaatacaaagggggaattatgactagatggcttagtggcaaaacctgcatagcaattcaaggaaagggagaaatagaagcataattcacataaggctttaaaataattttcagactggactacaaaacttgccaccaagcaggtgtgagagatgtagatgctgaatgtccagaggatgcactcttttctaggaaactatgatagcaaatactatgagcatattagagttccccgggaaccacatagatgatggcaaccatccatcaacctttatccaatccactctgacctgtgactaccctcactcagaagacattgccagttgttttgaagtgtgctatgaccaagcaccaagaagtttctagtctatcaatgttaacagagtacagtgagaagagtatacaatttcactacttatgggggcagataaaaaacttggctctactctcaatagttgtgggatgttagatctggcatctgccaaaagggaataaacctgtcaatatactgtgttgttttaagaatctgtaacaatttgcttgtgaaatatctgcataattcctggaacagcaattaagttgttttcctatcatattattacgaatatgatgataaccaaaattattattattggcatcctaagaatcttctccacaagtcttactacacatgcactgcaccctccccatattactaaaactcaaaatgaataacagattttaatagacactccttcatctgcatcaaggggaaactgcatgcacacaaatttattacttacacaaaatttttaaatatataaacgtgtgtgtacatgtgtgatagttgtgattaaaattacaattatatcaatatatatgtatgacaaaaatatacattccaaaaaaatggatgatatatatgtgtgtaaacacaacacaatagagatgcaaattgtaatggagtagagagagaagagggaacaaataaaatataaaaggatagctacatagaaaatgtttatctaaagcaaagaaatataaattaaaaacaaacctaatttatttttgtcatcattcaagtaaaaaacataaagatacttctcaaaggaggcatttatttggccagctaacatatgaaaaaaaaatctcatcatcattggtcattagagaaacacaaatcaaaaccacaatgggataccatctgatgccagttagaatggcaaccattaaaaagtcaggaaacaacagaggctggaaaggatgtggagaaataggaaaacttttacactgttggtgggagtgtaaattagttcaaccattgtggaagacaatgtggcatttcctcaaggatctagaaccagaaataccatttgacccagccatcctgttactgggtatatacccacaggattataaatcattctactctaaagacacatgcacatatatgtttattgcagtacaattcacaatagcaaaacttgtaaccaacccaaaggcccaccaatgatagactggataaagacaatgtggcacatctacaccatggaatactatgcagccataaaaaaggatgagttcatgtcctttgcagagacacagatcaagctggaaaccatcattctcagcaaactgacacaggaatagaaaaccaaacaccatatgttctcactcataagagggaggtgaacaatgagaacacatggacaccgggaggggaacatcacacacgggcctgttgggcagtagggggccaggggagggatagcattaaaagaaatacttaatgtagatgatgggttgatgggtgcagcaaaccaccatggcacatgtatacctatgtaactaacctgcacattctgcacatgtatcccagaacttaaaatataataaaaacattaaaaagaataaaggaagtcagagggaaaggcttattaaaacaaaacagaactcttgagaggatgtctttcctctcaatgacaaattcagcagtgaatgtttatgtatatttatgcatatataaggtattatgagcaaaaatgaatggttactaggaaggcaaaaatggtggaatattatccaatgaatacatttaattactcaaagtaatatattaaagaagaaaggtcatatattcttgcccacagattcagaaagcccatttgacaaaagtcaatatccatttatggaatggatgtagaagtaagtgaattagaaaaaaagttatccagaattgtaaatataactacccaaaacctatagtaaataacacacttaatgctgaaattaaaaattatcctctttaaagataggtatatagtaagtatgtctactactcatgcctttattcaaatagtatactagatttcatagctggcaaaagagttataccaatccaaatggaagaaacaaaagacaaacattatggttgcccatacagaaaacaacttcagttatgaagtagacccagacaactttcagaatattcagcactttttcattcctctacacaagcaacaaaataccagaaaatattttaaaagtcagcatttataaaagtgtctaaactatcaggtgtatggcaaaaaattgaacaaaataattgaaaaacattataaaacaggacataagcgtgaaagatgtgcagaagcagagagaaatccttgcattattagatgaaaagatcattaaagatagcaatgcactaattatactagattcagtgcaatttcagtcaaaattccaaaggaaattttatgaaacgtgaaaagctcacactaaagttcagagaacacagtcggtggcaatgtaaattagtatagccattatgaaaaacagtatggcgcttcctcaaagaactaaaaatagagctactatatgaccaagccattctactgctgagtatatatccaaaagaaagaaaaactgcatataaaagagttgtgtgcactcccacgtttatcacagcactattcacagtagccaatatatagaaccaacccaagtgtccatgaatgaatggataaagaaaatgtcatatgtatacataatggaatattattcagccatagaaactaaaatcctgacatttgtagcaacatggataaaactggaaggcattatgttaagtgaaataacccaggcattgaaagacaaatttgcatgtactcactcatatgtgagagctgaaaaaaaaaaaaaatctcatgaaggtagtcaatagactggtgttaccagaggctgggtagggtatttgggagggggaataaagaggcgttggttaacaggtagtgtttggtaccaaaatagggggcttatatttaacaatgatttattgtatatttcagtaactagaagatatggaatagtcccaacacaaacaaatgacaaatgtttgaggtaatggatgtgctaaatacccacatttgatcattaaacattatatgtttgtatcaaaatataatacacaccacataaatatgtacaactattaggtatccataaaaaaattaaaaacaaaaataaaaaataaagctcagggaacagtgaagactcaaaaatagcaatataagatgtatcttatgtgaagtatcaaaatccattatatagctaaagtagataaaattatcatagtaaatggatttcaatgtcaagtttataaaaaccttctaagaaaaacagtctgatgcaatctatataaaatataaatacataaaattatgtttcaatgtatattatgtaatgaaagtatgaagacttccagggaaataattcaccctaacttcctgatagcggtgactcctcaggagaaaaagaagtggtaataaatgggatagactagggttttgttgtggatgccctcctctgcattgtaggttatttaacaacatttttggctttaccctttggttaataatagctcccttctccccagttgtgacaagcaaaactgttttcagaaattttcccctctgaggcaggggagaaaaactgcttctagtagagaaccactggaatagactatctttagtatcagttctcaaaaggaaacaggagtggtggagggtatcagaagaaagatatgaaataaaattataaaatatattgcagcactattcacaatagcaaagactggaaccaaccaaatgcccatcaatgagaaactggataaagaaaatgtggcacatatacaagatggaatattatgcagccataaaaacaatgagttcacgtcctttgcaggacatggatgaagctggaaacatcattctcagcaaactaacacaggaaagaaaaccaaacaccacacgttctcacttataagcgggagttgaacaatgagaacacatggacacagggaggggaacatcacacaccagggcctgttgtgggttgggggctaggggaaggacacagcattaggagaaacacctaatatagatgatgggttgatgggggcagcaaaccaccatggcatgtgtatacctatgtaattaacctgcacgttatgcacatgtatcccggaacttaaactataataaaaaataaataaaataaaattataaaatgtcaatctctactgaattgggggtttgggggtcatgggtgtcagctaaattatttctttgtactttttaaattgtttgaaaggtttcatattttaaaagtttcatcaggtagtatgactctgtagtttaattgtttagagtactagttgtagtttaagactgccctggcttgtcatctgagtttttagtgtttgtatgattttgtacctgtttcttattttcttcaaatctcagtttccaaatctggtatctgtgaaaattaaatgaaataacccacatgaacatcttagcacagtgtctcatacacagtatgtgctaaaacataattttattatcaactgaaattaatatttctttgctcataaagacttcatggaaatatttatgatatatagataaagaagtcatcgttatagtaataagtataaccataacatattttatattttaagttgaagagatgtcagaaaatatttataaaatcaattttagctttaaaatgaaaacacacaagtaaattatacctagaccataattatttgaaaaggaaatgaacaaaaatagcaaaccaaaacatcataagataataaatatcaaagaagtcacaaggcccgacaattcaaaaaacgatctttgtgattatttcaatttatgcctcatgtttaaaatgacacatgtgagtttaaattcaaaattttatttagcttatgagatatcacaaaatgataaaatttttgctacatgctaataagggcaagtaagaacaagatattcaacataaatttaaaattatatgaaaattttaattagaatacagtaaatgaactatttgtccaagtccttatttaaaaggtgttagaataagtctagagcaaaagaagtataaaagcaatgtttgactttagaactttatgcataatgaacctctttttcaagacttcctaagtatctgacactgcaaactcatttattctctaaaatccaggacaatgacaccttgaaattaaatgtttgtactattcaatatttgttaagtttcacattacagagatgggtaactttgcattcaagaatttataatttatcttttgcaaatgtggtccacaaaccttgactttctttaacataggatgtctggtaaagccattcttgaggcaggttggagtagttggggactggcggaaacaagtggcaatatcagtgaagtatagaatcacaggctacttcggtcatctattcacaaggctgagcaggagctcttgagcatcttcacaatgtttgggataactctgctatgtgtaataacaaccttcttttgaatagtatccaatgcctggaaaaatcctagatgttcagaaacagatttttttttctattttcctctgtacctaggtagctagaattctcttatacatggagaatacttataacatcctagaaaactcaaattaaacatatatctgatatagcaaacctaaatcattacttactgagaaaacaatcattataattataactcaagttatttaaaaatatttcaaaaagggacaaggagaaaaattttaaaaaaattatagtatttaaaaacaattaaaagtgagttaagcaagagattatattgcatataaattgtttacttaatacattaagtttatttaatacattatttcttaatgtattaaacattaagcttatttaatacattaagattattttaatgtatatgaccaaattaaattttaattgttatatcacgctccagtacccaaaattattttaagcacttaaaattggccgacatagaaatttggtgttcttgtgatccgacacatgtggccacattaaattcaaacagctgtaattttgtcttttaaagaaataaacattagaatcaattagaacacagaatggttatcatggagaggtagatatgacttagaaaaaaattcatgttgaaagtagagacatctctcacattcacataccaaaaagcacatcttcccctcaaaatctgtgtagttggaaagccaccatagttatggttgtgtctggatactagcatgtctcacttttatctagagatatctcagtgctattaattgacaatagtgaacttggaagaagagataatctatcaatctcatattccaactataaaaactaatgaacaagactgagcttgcacatgcgtgagtgtgagtgtgtatgtgtacacatatgtgtttgtatggaattgtaacatcagaactaaatttactcattttgtaactaaaataccaaatgttgatttttgagtaggtacatcatttctgattgacattttttatgaactcaatattttgcaaatcccaccactccttccaaacagaaataaataaatgaaagtgttcagtgatcctaacatttgaaaagcttaaagagacatttagggaggataaatattcttggaagttgtgttaaatattcttgaaacattcttggatcattataaattattgccccattgtttttataaagtaagtgtcaaattaaaagctcctcttaatgttgatgattcagtgcaaattatttcattttatattagattccccttgaaaggaaagtttcagaaatgggattttgtcactaccaggcctgctttacaagagctcctgaaggaagcactaaatatggaaaggaaaaaccagtaccagtcactgcaaaaacacacaaaaatataaagaccagtgacactatgaataaactgcatcaactaatgtgcaaaataaccagctagcatcatcacgacaggatcaaattcacacataacaatatgaaccttaaatgtaaatgggctaaatgcccaattaaaagacacaggctggcaagttggagagagtcaagattcatcagtgtgctgtattcaggagacccatctcacgttcaaagacatacataggctcaaaataaagggatggaggaatatttaccaagcaaatggaaagcagaaaaaaaaaaagcaggggttgcaatcctagtctctgaaaaaaaacagactttaaaccaacaaaggtcaaaagagacaaagaagggcattacataatggtaaagggatcaatgcaaaaagaagagctagctatcctaaatatgtatgcacccgctacaggagcacccagattcataaaacaaattcttagagacctacaaagagacttggactcccacacaataatagtaggagactttaacaccccactgtcaatattagatcaaagaggcagaaaattaacaaggatgttcaagacttgaactcggctttggaccaagcagatctaatagatatgtatagaactctacacaccaaatcaacagaatatacactcctcagcaccacataccacctactctaaaacagaccacataatttgaagtaaaacactactcagcaaatacaaaagaatggaaatcataacaaacagtcactcagaccacagtgcaatcaaattagaactcagaagtaagaaactcactcaaaaccacagaactacatggaaactgaacaacctgctcctgaatgactactcggtaaataaataaattaagacagaaataatgaaattctttgaaagcaatgagaacaaagagacaacgtaccagtgtctctgggacacagttaaatcagtatgtagagggaaatgtatagtactaaatgtccacaggagaaagcaagaaagatctaaaattgacatgctaacatgacaacttaaagaactagagaagcaagagcaaaccaattcaaaagctagcagaagacaagaaataactaagattagagcagaattgaaggagacagagacatgaaaaacccttcaaaaaatcagtgaatccaggagcggatttttttgaaaagattaaccaaatatatagatcactagccagactaataaagaagaaaagggagaagaatcaaatagacacaataaaaaatgataaaggggatatcaccactgattccacagaaatagaaactaccaacagagaatattataaacacctctacacaaatcaactggaaaatgtagaagaaatggataaattcctggacacataaaccctcccaagactaaacaaagaagtcgaatccctgaatataggaataaaaagttctgaaattgaggaaataactaatagcctaccaaccaaaaaaaagcccaggaccagatggattcacagccgaattctaccacaggtacaaagaggagctggtaccattacttctgaaactattccaaacaatagaaaaaaagggactcctcctcaactcatggggccagaatcatcctgattccaaaacctggcagagacacaactagtaaagaaaatttcaggccaatatccctgattaacatgatgcaaaaattctcaataaaatactagcaaatcaaatccagcagcaaatcaaaaagcttatctaccacgatcaagtcggtttcatccccaggatgcaaggctggttcaatatatgcatatcaataaatgtaatccatcatataagtagaaccaatgacaaaaaaaaacatatgattatctcagtagatgcagaaaaggccttcaatacaaattcaacatcccttcatgctaaaaactctcaataaactagatattgatagaagatatctcaaaataataaaatctatttataacaagcccatagccaatatcatactgaatggggaaaagctggaaggattccctttgaaaactggcacaaaacaagttatgccccctctcacctctcctattcaacatagtttttgaagttctggccagggcagtgaggcaggagaaagaaataaagggtattcaaatgggaaaagaggaagtcaaattgtctctgtttgcagatgacatgattgtatatttagaaaaccccatagtctcagcccaaaaactccttaagctaataaacaacttcagcaaagtctcaggacacaaaatcaatttgcaaaaatcacaagcattcctatacaccaatagtagacaaacagaaagccaaatcatgagtgaactcccattcacaattgctacaaagaggagaataaaatacctagaaatacaacttacaagggacatgaaggacctcttcaaggagaactacaatccactactaaaggaagtaaaagaggacacaaacaaatggaaaaaacattccatactcatgggtaggaagaatcaatattgtgaaaatggccatgcagaccaaagtaatttatagattctatgctattcccatcaagctaccattgaccttcttcacagagctaggaaaaactaatttaaattttatacggaaccaaaaaatagcccatatagccaagacaatcctaagcaaaaacaacaaagccagagacatcatgctacctgacttcaaactacattacaaggcaacagtaaccaaaacagcatggtactggtacaaaaacagatatacagaccaagggaacagaatagaagtctcagaaataacaccacacatctacaaccatcatatcttcgacatacctgacaacaagcaataggtaaagaattccttatttaataaatggtgctgtaaaaacaaggctagccatatccagaaaacagaaattggaccccttacttagacgttatagaaaaattaagatggattaaagacttaaatgtaagatctaaaaccttaaaaaccgtagaaggaaacctaggcaataccattcaggacataggcatgggcaaagagttcatgactaaaacacaaaaagcaatggcaacataagccaaaactgacaaatggaatctagttaaactaaagagcttctgcacagcaaaagaaactatcatcagagtgaacaggcaacctaaagaatgggataaaatttttgcagtttatccatctgacaaagggctaaattccagaatctacaaggaacttaaacaaatttacaagaaaaaaataaacaaccccatcaaagagtgggtgaaatttgtgaacagacacttcccaaaggggcatttatttggccaacaaacgcgtgaaaaaaagctcatcatcagtggtcatcagagaaatgcaaatcaaaaccacaatgagataccatctcaagccagttagaatggtgatcattaaaaagtcaggaaacaacagatgttgaagaggatgtggagaaataagaatgcttttacactgttggcgggagagtaaattagttcgaccattgtggaagacagtgtggtgattcttcaaggatctagaaccagaaataccatttgacccagcaatcccattactgggtatatacccaaaggattataaatcattctactctaaaaacacatgcacacgtaggttattgcatcactattcacaatagcaaagacttggaaccaacccaaatgcccatcagtgatacactggataaagataatgtgacacatatataccatggaatactatgcagccataaaaaaggatgagttcatgtcctttgcagtaacatggatgaagctggaaaccatcatcctcagcaaactaacacaggaacagaaaaccaaacactgcattttctcactcataagtgggagctgaacaatgagaacacatgaacacagggaggtggacatcacaccgagaactgtcaggggatgggggacaaggggagggagagcattagcacaaatacctaatgcatgtggggctctaaacctagataacaggttgataggtgcaggaaaccaccatggtacatgtatacctatgtaacaaacctgcacgtttagcacatgtatcccagaacttaaagtaaaatggaaaaaaaaaagatttcaatcagaataccacccgaattcacagtatgttaaactagaaaagtatagtcattatttcccattgaaaacctaataagcattattacacttacaagtaagatggcaagaagcccatttttcacttacatattacccacatgttgtataaaatataaaatatgaattttaagcttaccatttgctatgtgattttgggcatataatctgagtgttttcagccacggccttgatacctgtacaaaggagataatacccgtatctggaaactacttagcatttcccagtggaagctattcatatcacccctttaattagactcctgcctagaagatgcatttttctatagcactgtgccctttataaagatgagacagttaagcaacatataattaaattaaacatatcttattacattagtgaactagagaagtagttcagtttgtctgatttcttttccagctgagaaaaacactaaactttccattttacaatttctgctgctcatttttgacttaataacatatcaaaatacaattacagagttactatattctgtaatatatatgtatatgtatataaatatatatatattcactcaaataagttgaggaaaatttcagaaacaaattctattgcctatggatctgaatgttgcatttcccttatgataactgaaactgaacaagaaaattcagaaaaatattagtatttactatccagtgagatcttgaaatgaaatttcaaacctaaaatataaatctatttatgtctctccatacataaatctatttttaagagaaatattaataattgaataaaaagttttttaaaagcccttcaaaaacgatgaaaacttttcaaacattacacaattttcacagaagttacagtgtaattaagtcagaagcaaagtttcctggtagtgttttccatacagaatgtttggctaggctaaaataaaatgaataaatataatactaaattctatactcgtataattctcagaatgctaagaaataatggcacagaatttccaggcacattctgttacatgatattccaaacatgccctgggcgtttacacacatggtacaacaaactaaccttagaggtacttgtgtgtcatgtgcagagcattagccaatcttcatatttcaggcttttaaagaccaacacataggaaaggtggaaaaaaacaaagggagatgcttgtaatacatcatttctttgaaagcccctagtggtggggatggggataaaggaaacctaaaagaaactcaaacttaacttgtactctaacccggcacgacttcaactttaaaccacacattttgaagaataacatgcagacagaatatactttgaaaatgttgaaaggattccagtaatcaagtgacaactccttaaccaagaccaagctagcctgggtaacacggtgaaaccccatctctaaaaaaagaaaacataaataaataaataaataaataaataaataaacaaaaatacaaaaatttgccaagcatagtggtgtgcactggtagtcccagctacttgggaggctgaggtaaggtcgcttgagcccagggttccaggctgcagtgggccttgattacacgactgtacttcagcctgggcaacagggtgagatcccatcttagaaaaagaacaaaccgcggagctgtggtgctgaaaagtacattcctaaagactgtttcaagagtcttcaatctgaaggggcttgttattgcagggatgttaaagaaaatccggggtcttaaaatttttcgtttttaagaatcaaattttctacccctaataaaaagggagaagtctggaggcaagctttatcaggaagatatgaatgattgttctcatcctggtgaaagtatactccaataaataggtctcataagctaatggttttatgacctattttgctgggcagggagaaaacaaaaaacaaacaaaaaattaaacagaagataaattcaaccccatggcaagtgtgccacactcagatgatgtcctattctcggcccaacttggtttgtccccaatacagaattttcaacagagaagcacatatctaattttctcaaacatgactttgagggtcacaagttctatccattctctaccaggcagctgagaaaatgagcagagaataaagaccatcatattcccaccctccagctaggattataaggggaatgaagcaagctagtattacaaggggaagaaagtaagtattataaggtagtattacctgagaaggtgagtcaatgcaatgttacaaacgctattttggtggcaattcatatgccatactcaaagattaataaatagaaaaaaagcaagacattttttataaacttccgaagaaataaggaagaaagaaagcatgcaaaagacaatgaaaacagataatttgaaaaatattatctcaaagaagagaataaaatattaacatatttatacaatattaaataaaaacaattttacagattacaggaatatttttcaatgtgaactctcaggaaacaaaagtaaaaatgagtaaacagaatggcatttgtatcattgaatcaaactataaaagaaagagttccacaagcctacaaggagagttaactgtgttaattacaaaattgagaaaaaaaaacttattcaatatttccacaacttatttaaatgctagggaaattatcctactgtaagacactagtattcctgataaaaatgcttaaactcttctttgataccctgtaataagattggaacttgttctgggaagccattcatttactccagtgactcaagtcgagtcaataataacatgcaagcaggttcttccctgcatctcatttggtacttttttttttttaaacagttctgtttgttatagatgatcattaaaaatctatcctgctcaagaaaaaaaaggagaggtgttctgaaatatttatggatgaaataatgtggtgcctgtaatttgctccacttaaaaaaatccagtggcaggggtagttaagggcatagacggtatatggatattatcaagccaatgaatgtcatttgggtgaggggcattttaggttcattctagtatacacttgtgcatgtttgaaatttttataataaaaagtaaaacaaaacaaaacaaaaaatatcctattggattttttatggagaaattatatgattcaaattacagctaatctgatattcatattgaatataaaaacatattcatagatatcaccgactcagaaataatattatccatttatccttcccaaaagacataactgagtaatgtaacatgaatcctgaaggaagactcacagatgtatttaagaagacaaggatttgcctgatttgtgtgttatcaatgtctcttagcctcatgagaaagaagttaaaatatagtttttgaatgcataagtgaatgaatgattgaatgattaaagaagtcatgacagccatgaacttattgtaaatactcagcccataatcattaaatgttaaaaatcctcataggtatgctatagagtgaaaacattttttaattatattaaaattggctaaaaatctcagaatatagagacaaaaccgaagagcagtagcagtcgaagtaaggcaatgggaaagtgtaactacatatattttctcatcttttaagagaggtagaggacaaccagcagattcatttgcttctgaaatacagcaattgaaaattaagtgtaaaatataagcttaatttttaaaaggagacaaaattatatttaagacttagactttatcctctccagactttcagaggggtacaaaatgaaagaaggcatggagtgaaaaaaagaggaaagaaatataaaaaagtgaataaaaataaaatgaagaaaataagataaaaaaaacaaatgttggccgggcgcggtggctcacgcctgtaatcccagcattttgggaggcccaggcgggagaatcacgaggtcaggagattgagaccagcccggctaacacagtgaaaccccatctctactaaaaatacaaaaaattagccgggcgtggtggcgggtgcctgtagtcccagctactgaggaggctgaggcaggagaatggcatgaacccgggaggtggagcttacagtgagccgagatggcgccactgcactccagcctgggcgacagagcaagactccgtttcaataaataaataaataaataagtaaataaataaatcaatcaataatattataacaataattaggcaagataaagaaataaagggcattcaaattggaaaagtggaaatcaaattatctatttgccaatgatatgatcttatcttagaaaaccctaaaagacccctccaaaagattatgatttaataaatctctttggagaagacccctcaaaaagattatgatttaataaatgaattcagaaaagtttcaggttgcaaaatcaatgtacataaaccagtagcactgttatacaccaacaatgaccaagatgagaatcaaaccaagaacccaatcccttttacaacaggtacaaaaaaataaaatacctatgaatatacttaaccaactaggtgaaaaatctccaaggggaactacaaaattctgctgaaagaaatcacagatgacacgaacaaatggaaagaatcaatattgtggaaatgaccacacttccaaaagcaattgacagattgaatgcaatccctattacaataacaacatgattctttacagaattagaaaagataatcttgaaattcatatggaaccaaaaaagagcagaaatagccaaggcaatcctaagcaaaaagaacaaatctggaggcatcgtatgactcaacttcaaattatattgtaaggctatagtaaccaaacagcatggcactagtgaaagcagatacacagatcaatggaacacaatagagaatccagaaataaactcaaatacttacaaccaactgatcatcaacaaatcatataaaaacacaaattggggaaaggacattctattccatatattttgctgagaaaattggatagccacgtgtagaaaaatgaaactggatccttatttctcaccatgtacaaaaatgaactcaagatggattaaagacttaaatctaacccctaacaccataaattctaaataaaaacctaggaaacactattctggatactggcctaggcaaataatttatgatgaagaccccaaaagcaaatgcaagaaaaataaataaatgagacctacttaaactaaaaaagtttctgtacagcaaaagaaataatcgtcagggtaaagagagaatctacagaatgaaaaaaaaaattgtcaactctgcacctgacaaaagactaatatccagcatccacaaggaaacaaattagcaagcaaaaatcaaataaccccatgaaaaagtgggcaaagaacatgaatagacatttcttaatagaagatatataaatggccaacaaacatatgaaaaaaaagcactcaatgtcactaatcatcagggaattacaaattaaaactgcaatgagatatcaccttactgtagccagcatggccattattaaaaagtcaaaaaacaatagatgttggcacggatgtggtgcaaagggaacacaaacacactgccggtgagaatgtaaattaatacaacctctctggaaaacaatatggagatttctcaaggaactaaaagtagatccaccattcaactgagcaaacccactactgctcatctatccaaagggaattaaatcatcatatcaaaaaacattcaaacatgtatatcgcagtaaaattcacaattgcaaagatatgaaatcaaaataagtgtccaacaaccagtgaatgaatatagaaaatgcggtatgtgtgtaaacatacacacacacagacacacacaccatggaatactgcttggtcataaaaaatgataaaataatgtatttgcagcaacttggatggaactggattctttaatctaagagaagtaactcagaaatgagaaagcaaatactacatgttctcacttatacgtgagagttaagctatgggtacacgaggtcagacagagtagtacaatggacattggagactcagaaaaggggagtgtggaaagacagttgtacccctacctattgtgttacaacatatactatgtgggttatgaatacattgaaattccagactttaccactatacaattcatctatgtaaccaaaaaccacttgcaatcctaaagctcttaaagatttttaaggaccctccaagctgttttccatagtagttgtattatttacattctcacgacaagtgtacgagggttctcttttctccatatccttgttgagtatttgttattgcctgtcttttggataaaagccattttaactgggataagatgatatttcataatagttttgatttgcatttctctgatgatcaatgatttggagcaccttttcatatgtctgccattgagaaatatctatttagattttttgctcatttttagtcagattattatattttttcctatatagttgtttgagctccttatgtattctggtcattactcccttgtaagatgtgtagtttgcaaatattttctcttattctgtgcgttgtctcttcacttttttttcctttgctgtgcagaagctctaccttgatgtgattcaatgtgtccacttttcctttagatacccatgcttatgggatatttctcaagaaatactacccagatcaatgtcccagagagtttctctaatgttttcttgtagtagtttcatagtttacggtcttagatttaagtgtttaatcaatttttacttgattttttttttgcatatgaaaggagatagaggtctagtttcattcttctgcatatagatatccagtttttccagcactatttattcaccagattgtcttttctccagtgtatttttggcatatttcttgaaaatgagttcactgcaggtatgtaaacttctttctgcattctcttctctgttccattggtctacgtgtctgttattatgccagtgccatgatgtttaggttactatagccctgtggtatgatttaaagtcaggtatgtgatacttccaattttattaactttgcccatcacagtttagactattctgagtcttttgtggatccatataactttgagaatttttttctatttctatgagaaatgtcattggcattttgacaggaattgcattgaatctgcagattactatgggttgtatggacattttaacaatattgattctttcaatccatgaacatggagtatctttccatgttttggtgtcccctttaatttctttcatcaatattgtacagttttcattataggcatctttcacttctttggttaagttaattcctaggtatttaattttatttgtggttattgtcaatgaaatttttaacatttctttttcagattgttcccttttggcatatagaaatactgctgatttttgtgtgttgatattatatcctgaaaatttaatgaatttgtttatcagttctagtattttttttggtggaatctttaggtttttccaaatacatgatcatatcgtttgcagacaagaataatttcacttcttgttcctgcatacaattgaaatagattgttcagtttattggcaggcagtttctcatagtagatactaataatcctttgaatttctgtggtatcagttgcagtatctccttaatcagtaatgttgagcttctttcatatgctcattggctgcataaatgtcttctttcgaggagtgtctgttcacatctttttcccactttttgatgtttttttttttcttgtaaatttgtttcagttccttgtaaattctggatattggacctttatcaggtgggtggattgcaaaaattttctcccattctgtaggttgcctgttcactctgatggtagtttcttttgctgtgcagaagctctatagtttaattagatcccatttgtcaatgttggcttttgttccaattgtttctgggattttgtcatgaagtctttgcccacgcctatgtcctgaattgtatttcctaggtttattctagggtttttatggttttgggttttacctttaagtctttaatccaccttgagttaatttttgtataaggtataaggaaggggtccaatttcagttttctgcatatggctggacagttttcccagcaccgtttactgaataggagattctctccccattgcttgttttgggcaggtttgtcaaagatcagatagttgtagatgtgtggtgttatttctgaggtctctgttctgctccattggtctatatgtcttcttagtttctttattggcccattggtaattaatgagtatattatttaacgtctatttatttgaacagtttcctaaactctttttactgatttctagttttactccattgtagtcagagaagatgcctgatattatttcaattttttaaatgttttaggacatttttgtgacataacatgtggtctatacttgagaatgattcatgtgctgaggggaggaatgtgtattctgaagccattggttaaaatgatctgtaaatgtttattagttccatttggtctttagtacagattaaacttgatgtttcttcattgattttctttctagaagatctgtcccatgttgaatatgtggtgttgaaatctccagctattattttattggggcctacatctctatttagctctaataacttttgctttatatatctgggtgctccagtgttggatgcatacatacttaaaactgttatatcctcttgattaattgacttatttatcattatatactggcactctttttctctttttatagtttgtcttgaaatctatttggtatcacgagtatagctactctcactcttcctggtttccatgggcatatctctttccattcctttattttcagtctatgggtacccttataggtgaagtgtgtttcttataggcaacagatcattgggtcttctttttctatccatttgaccactctgttttttgattgaagagcttagtccacttacattcaatgttactattgataaggaaggacttactcctgccattttgtttgttgttttctgtttgttttctgatcttctcttccttctttcttcccttcctgtcttctctttagttaaggtaattttctcctgtgatatgatttagttttgttcttttcattttttgttgatacattataagtttttggtttgagtttaccatgaggcttgcaaatactatcttataatatcttataacccattattttaagctgataacaacttcacattgtttgcataaacaaacaaaaagcaaacgaatatagacacaggaagagaagaccaaatacggcatgttctcactcataagtgggagttgaacaatgaatacacatggacacagggaggggaatgacacataacagggcctgttggggggtggagggtgaggggagggaacttagaggacaaattgataggtgcagcaaaccaccatggcacatgtatacctatgtatgtaacaaacctgcatgttctgcacatgcattctattatttttagaagaactttttttttttttaaaaaggagacttgtagaggtactacctctattatcttgggcaatatctggaagaattctctgaattaccaggtagagactcttgttctcttcccttaatttctcccaaatgaacacagtctctctctctctctctctctctctctctctctctctctctgttctgaaccacctggagctggggggtggtgtgacacaagcaaccctgtggccaccatgactaagactgtgccaggtcggctgggcatggtggctcgcgcctgtaatcctagcactttgggagcccgagccgggtggatcacaaggtcaggagatcgagaccatcctggctaacacgatgaaaccccatctctactaaaaatacaaaaaattagctgggcgcggtggcgggcgcctgtagtcccagctactcaggaggctgaggcaggagaatggcacgaacctgggaggcggagcttgcagtgagccgagatcgcaccactgcactccagcctgggcaacagagtgagactctgtctcaaaaaaaaaaaaaaaaaaaaagactgccaggtcacacctgaagccagcatagcactgtgtcttgcccaaggcccactgtaatcattccctgactatggcctgtgtttgttcaaggtcctgggactctacaatcagcaggtggcaatgtcaggcaggcctgtgtccttccattcaggatggcaagttcccctaggcctcaagagtttttggaggtgctgtctgggagccagggattaggataaaatacattagaagtctacttggtgatctattttactgcagatgatctggcactcaaaccatgagactcagtccttcccactcttccctcccctttccaaaggcagagaactctcatcaacggccaccgccaccacaggcccatggggagtactgccagaccatcatcaatgttcccttagggcccaaagtctcttcagccagatgtggtgaatattacccgacttgggactcatctttcagggcagtgggctcccctctggcacaggagaggtccagaaatgcagtccaatagccaagtcctagaatcaaggaccccaagtgtccgcttggtgctctaccccactgtatcttagctggtacctaatgtgcaagacaaagttccctttgtttttccttccacttttcttaggtggaaggagtcttgccccatagacaccacagctgggaacgtgctgagcctcacctgaagccagcaagtctaagagtctcacccaaagcccttaacatagtactaagtatcactgctgatcactcggggcccaggaactcctcaattatcaggcgatatatcctgccaggactgggtcattgccttcaaggcatcaagtatccttctgcccctgggtgtgtctagaaatgtcatccaagagctagggcctggaaaggggaccttattaccctgactggcaccttatcctactgcggctgagctggtatccaagatgcaaaacaaagtcttcaccacctttccctctattctcctccagtggagataagaagtctcttttggagccacaagccatgcagcctggggtcaggggaggggtgatgacagcaatcccttagctgacctaactagtgtctcagtatggcacatgtacactgtctctgtgcccagttcagcactaggactcacctagaagttgtagtccttgtggcctagactgcctttcaagtttatttagagctccagagcactttggcctgcagctgctgagacttggggagactaccatcattgtagtacctctgcagctgctgcaagtcttgcagatcctcaagttcggaccactgggatcagcaatttccctctggctagggatggtttaaatggtccctccatggttagttatcagctgagtttggtctagttttgttttctgttatgatagggcagcactgagttcaatgccttaaaattggtgtgctttcctctccccagcacacagaaacactccatgcataaagctgcagctgctggggaatgggggagggatagcattggtgactccagactattttgcttacctcttcagtgcctctttcagcaatataaagttaaaaccacgtactttgagtgctcacttgatttttggttcttatgaaggcgcattgttttgtgtttatgtagatagttgttaaattggtgtccttgtcagggaagagaataatcagtagagactcccattctcccatctttctcctagatctcagtagtcaatttaaagtaggcttaattgtttaagtgatcaatccactagggaaatcttttggagggatatagttatttttctctatatcaacatttaaattggtagacaggagaaaatgattattagggaactaatgacatcctttacatacaattgcaaaagcagtgtgtgataataaagagtatttattttatattaatgaatgatttaaatatctgacaactaatatatatttaccaacaataagatgaaagaaaaacagaaaataggatgtaaaagacagtgttcataaaaataattattgccatcatcctaatagaaggtcttgtatattatgcttggaatttgcagtaaccattctattacatgccctacttttatagatacctctcttctttccttctcaaatcagtctgtcataaagtccctggattaattcagcctaaagcatttttgacatttcttaagtttatttgtcattagtttggcttgaaatttaaatgattttgcaatctggtctcaatttgcttttcaatttttctctatattctccttatgtaagttacagttttcctcctgtctttaaatcatatttcacactctagtttttatccatgcataaggctttacctattacttccataacattcccttatacatttcaggcaaatattttggtacttggcttgatcctccagggaacatttatttgaaattatatgtcatttagcatattttgctttttgctttgcgccttttaaaaagttattaacaactttactactcctactgtttaaattctggaagaataggttataagtggggttataatcacttttgcatttctctatcttaatactgtacacataatcactagatttacacacatatacaaacatatataatttatttgctttgcaaaaatttggtctttacattcccaccagattgcaagcttcctgaatgcaaagagttgaactgccttgttcacagttatatacctggccgctataagcatatccaggatatcctgtgttcaataaataattgataaatgaatacatgaatatgagtaatcacaaatgaatgttaaaggtaatatattgaatggattcattcttatattgaaaaatgcaacgtataatcacatattattagcttataatttctgaaatttaatggacaagaccacctttcttttcattgaggaatacatgtttctaataattttagactctaatgtctaataattttagattctaatgtcaagtaagacataagaattagatcactgaagacatgacattttctgtattttatagtctacttgtatttctaatagcaattataaagaatcacgaagtaaatatcaatatggaatctttaggtatagatgctacatcatttttattgcatgcctacaagatgaacaaaaaaaacccattgaaatggttaaaattataaagggccaaatgagcaaaaatatttccacatagatgatttacaactagataaaaaaaaatttaggccccattaaaagacctggaggcttgcttttagagaaaaaagtagtatttctaagacgatatgccacaattttcagggtttctttctttttttttttattatactttaagttccgggatatatgtgcagaacatgcaggtttgttacataggtatacatgtgccatggtggtttgctgcactcatcaacccatcatctacattaggtatttgttctaatgctctccctctcctagtcccacaccccacaacaggccccagtgtgtgatgttcccctccctgtgtccatgtgttctcattgttcaactcccacttatgagtgagaacatgcagtgtttggttttctgttcctgtgttagtttgctgagaatgatggtttccagcttcatctatgtccctgcaaaggatgtgaactcattgttttttatggctgcatagtattccatcgtgtacatgtgccacattgtctttatccagtctatcattgatgggcatttgggttgattccaagttttgctactaggaacagcgccacaataaatatatgtgtgtatgtgtctttatagtagaataatttataatcttttgggtatatacccagtaatgggatggctgggtcaaatggtattactggttctagatccttaagaattgccacacagtcttccacaatggttgaactaatttactccccccaccaacagtgtaaaagtgttcctattttttcacatcccctccagcatctgttgtttcctgactttttaatgattgccattctagctggcatgagatggtatctcattgtggttttgatttgcatctctctggtgaccagggatgattagctttttttcatatgtttattggccacataaatgtctttttttgagaaatgtctgttcatatcctttgcccagtttttgatggggttatttgtctttttcttgtaaatttgtttacattccttgtagattctggatattagccctttgtcagacggatagatggcaaaaattttctcacattctgtaggttgcctgttcactctgatgagactttcttttgatgtgcagaagctctttactttaattagatcccatttgtcaattttggcttttgttgccattgcttttggtgttattcatgaagtctatgcccatgtctatgtcctgagtggtattgcctagactttctttcagggtttttatggctgtaggtcttacgtttaaatctcagccctaaatctcgttaagcagataagcaacttaagcaaggtctcaggatacaaaatcaatgtgcaaaaatcacaagcattcctacacacaaataatagacaaatagccacataataagagaactcccattcacaattgctacaaatagaatacaatacctaggaatacaacttacaagagatgtgagggacctgttcaaggagaacttcaaacccctgctgacggaaataagagagcacagaaacaaatggaaaatcatctcatgcttatggataggaataatcaatatcgtgaaaatgggcatactacctaaagtaatttttggattcaatgctatccccatcaagctaccattgactttcttcacagaattagaaaaaactacactaatttcacatggaaccaaaaaaagaacctgtatagccataacaatcctaagcaaaaagaacaaagctggaggcatcaccctacctgaattcaaactatactacaagcctacagtaaacaaaacagcatggtactggtaccaaaacagatatatagaccaatggaacagaacagaggcctcagaaataatgccacacatctacaactatgtgacctttgacaaacctgacagaaacaagcaatggggaaaggattccctatgtaataaatggtgttgggaaaattggctagccatatgcagaaaactgaaactggaccccttccttacaccttatacaaaaattaatacagggtttcttttaataacacttggtcaattgttgaggactgtgtttgcctaataccacataacatcaaacactcctattcttatattttcattttctaaagctttaaagtttggaaatttataaagttaaaaataagatttcccccatagaatagattcatatgtaacatcttttcacttctcccaagactctcaactctttaactgtaatttaagtgtgccatacacacacaaatacaccttttacctagaatactattaattatacctaataactatgatctgtttaagttacatgaactaatacagcaattatggctaaatacaactagcaagtgaaggtagatgatgccatatctatttgacatactgtattcaacattaatctttatgtttcttatcttagcataaatttgtataccagatgccttcttgtaattaacacgctgggatttgtgagcagtagattttgctggtaacaaactccatcaagtcgacatctgtgatttatacctccaactccttttcaatatatttacataatcagttcaatttaagcccagattatacattcttcttacatttttataagcaatatcctctaaagatagtttaaaagtaaatcaaggtaaaatttaattctttcttcttttctaatcaaaacacttatcatgaacatataatcaaattctctgattacatgcatttctattttaaaagaaaaaataggtgattttcttctgataaatatatataagatcatttactctaatttctgtcaacacaatcatatccacatcattatatgtacatagctttataagcattttaacagtattggcctcatattgttctttggaattatgcctagatgctattagtctcatttaactactaaggaaattgagtttcaagaggtcagatgacttgattaagatggtttaaattccagcattataatttttttgttttgtttacctgctgtatgtaagggaagattttaggtcttttctctcagtctggggctttttttttttcactctaacaaattgtttttaaacacaggtaattgtaaaacttaaaaaaattttctattacggtataaatgtaagatgttatttaatataaaaattttacagatgaatctgattatttataagatatattaatcatagtatatttaatgtcagtttcagatactgtatattaagatagaattgttttgatataattttattcctaaaaattctagtattgggcaaattatagcatataatgtattgtaaaaattctagaagatgcatttgacatattgttgacatacagatttggtaatcaaatgtattgttgccatatcatcactaaaaatctgtcttaacataagaatattgctgataattttatgtcgtgctcaaggtaaataattgatcaaatgtgaactacattttcacatttatcacatgatttttattttatcacatgataaaatgtgaactaaaggaatacatatcctttaataggaaagaagtttatttgtcacctatgccctagtttctcaatgttgtacaatcacaaagagaataagagagagaaatggagtagagttatcagaaatcagtaagagtgtgttagaattaaaggagtgcacttgggtactctactgatgaaacatctcttttccacaaagtcaagtcagaaatcactcagacttgagagacataaggaaagactggagcttaaatagaaaatccacttcactcaaatcctgattttacaattgttctgctgttaagagaggaatctgggcttccagatgtcagctgatggtgatagtatttctcacctaaaatgaatcctcattcaccttttattattctcctataggaatttgttctgcctagaattatcctctctgataataatgtctgataactctaacagcttttactatgtactattcactgttttaggtgtcttatattcattgtctcatgtaagttttggcagttatataattgagctaaaaatttcagtaaggataaaagaggaaaatattctaatatatttaatacataattcctaagtggaaacatagagactgtatgaaacattgtaagctataaatacacaatttaataataaatgctaagaaacaacatgattgctggtatggagcatttaaaatgtgaaacatttaaatgtaaaaaattattacttaatggtatatgttacatagaatctgtagtctattttatttagccagttaaatttactgattgggaggaataaattgtattttactaccatatagagaaatacaaattggctgagtttttacattatcaaagttgtatttagtattgcatgtgtttcataacatcaatgatatgttttatgaaaagcatttgatcaaggttattaaatatttttaaattattgtattattaatctagagtaactgcccataatatatattactatttcaatatgtagaaacaaaaccataatttcataatattttaacattaaaaaacagcctttgtttaattattagtgatggctataatataaaaaatgtatttaatgcagacctaatttagggtattgttatcttcgaatttttgtaagagcacttgaagctattaccagaactgccagttaagacaaaaacacatttaagtacagaaagataaaattttctggatattcactactaacactctggcatttttcgaacatcaggcaaagatatataagccctactttatataataaaacaggaacaaatgtattaaatttattaaatcatttatttattaaactatttagcagctaatttattaaatctatttgtttttgcactaagaatatttgacatttgcaacattaatattttaaaaacctgctttaagttctgtgagaaatctccaaactggtttctacaatagctgaaataatttacattcccaccaacagtgtattagccttcccttttctctgcagcctcaccaacatctgttcttttttgacttttgaataatagccattctgactggtgtaagatagtaactcattgtggttttaatttgcatttctctgataattagtgatgttgagcatttttgcatatgcttattggctgcttgtatatcttcttttgagaggtgtgtgttcaggtactttgcccacactttaacggggttatgtgatttttgcttgttgaactgcttaagttccctatagattctggatattagacctttgtcagatgcatagtttgcaagtattttctcccattctgtagactgtctgtttactttgttgatagtttatttttctgtgcagaagcatgaaatactacacagccataaaaaagaatggaataatgtcctttgcaccaacatggatgcagatggtggccataatcctaagtgaattatcacaggaacataaaaccaaataccttatgttcttacttataaataggagctaaacactgggcacacatggacataaacttgggaacaacagatgctgcaggctaatagagggtggagggaggaatgggggcgtggggcaaaaactaccttactagtactatgctcaccacctgagtgatgagatccatacccctaacttcagcatcatgcaacatactcatgcggtaaacctgtacctgtatccctgtatctaaaattaaagttgaattttaaaaaacttgcattatttctgtatcttttatcacgtgacatatacatgtatactagattgtaagctccataaatcaagggcatgcctgtctcttctaaccatgtactctcagcctttaatacattgtttggtacacagttcatgctcaagaaatctaatttaatgaatgattgcaggaggttagtcatctggttttcagacatatataaatgtagttcaaacatgtattttatttgcgcatttaaaagtctataattgaagttagtttttagaatattctttaatgttttatggtgcaaggattaatcttatttttataataaatgcaatggcggatatgctaaattattttgaaattttaagcaaatttattgttgagaatataaaattatgtttaaaaagaaaagaatatgaataatgtgtgtatatacttaactatgtaatatatatttacgaatgaaagatttgctattatgtttatcttctacttttattctaaaattaacgtttattgttttataaaaatatccacagtcttctgactataaaaaacagtattaatagtaaacaaaatatttaaaaatgtgataggagaacttttatgtaccatacactggattgcttatctagtctgttggttaatagctggactttttattattagcttcacattaaaagattagctaaaagaaggtcatgacttcagttaacagaaatattgctcatgttttgcttgcttcatgcataatttataatctatttgaaccaaatgagctgcagagcaatattacaattaacattcagctcttccatggatttggttgaactccctttaggatactgtttgtaatgagtagcaagacatgacatgctacctaacatgccaccacggattctgatgcttagctttttaaagaaaggagtctcaatacattaaaatgaagttatgacttcctcctaagggcctagaaggtgaacaaaacaatcaagttacaggagagaaaaggttatcttaaaaataatctgaatttataattgataagcaatatgaaacacagtatttttgtttgcataccaaaaaaattaactgttagctttattggcactaataattatcctatcatttgcttcatgtcaattggttataccacattaaaggaaggcttccttgcacctgggtcaaaacaggtcacatcaaatttctcttttatttcaaatatctcctcaaatctgtaaacagaatgacaaagaaaacttacttttaagatatacgcatttttgtatgaaccaacattttcagtaatttgactataatagatatcttatagcctgagacacaaaaaaaaggtaagaacaattggtgttgtatattataaatagcaattaaggtaaaattttcacaccaataaacttataagaaaaaaagacttaaaaccttcttggccgggcgcggtggctcacgcctgtaatcccagcactttgggaggccgaggcgggcggatcacgaggtcaggagatcgagaccatcccggctaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaccttcttgaatatctattccctcagcaaaagttggggcaactttatatctcagttaatgttacatttgttaccaaagaaaattcaacaagattcaagtatttaagctgaactgtctgcccagctaccactagatttatccttctgtacacataccaagcttgaggtttttaaaatgagaaggtcctcattgttcaactcccacttatgtgtgagaacatgcagtgtttggttttctgttcttgtgttagtttgcccagaacttaatgtataataaaaaagagaaagtccttactaaactcgatagattattattactagggataaacaaagaccatatattcaacctgccaccatcttttttgtatctgcccaaaacatcttaaaatctcttaccatcaatcataccggacagttcatgttttcctgaaaaatgtctacattattaactgtttgtgaggctgctgtcaaatgtgactaatgaaaatgtttgaaaagcatttttaaatgtgtgtgattaatcaaatcctatatggctgctctgcaatttctaaatagatatgaacttgtttctaaatttatgcacaagccaccagaattaaaggtgtaatcaaatcccagatgtgaatccattctgaggtcttattttcaaactaaatttgtaggtttctcctcttcccttgatttaagaccaccatgtcccacattaagtttcttatcattatttttccactatccaaaaactttttcataatatttattgtcatgtgccaaagagtggaattttatttttcaagtagttatcctaccaggttatagatatatctttttaaaaaaatgttaattttaaaaaattacaaaatttgctttcagaagcagagattcctggaggatggatgaaaagtctcataattagctttagagtattgcctgtgccagctttctttctctgtccccaaaccaaatatctttataagaccatgacctttttccaatattggaatatttttctattttaaatcatcaaatatatacatttctactaacggatttctcccataagaagctatggcttcaataatacatttatttagtacttctagttacaactttcatgcatatgtattacatttggttcttgcaagcattctgtaggtcagtaaactaactttctgtaagaaaatgcattcaaagatggcctatccctgaaactattaactccttgaaggccacagacttcattcagaacctgaaaaaaaatgcatactctttttccaagaaaaacacaagaatatataaaaatgcatacagatttgaagtttcagagggttcatggacaaccttgattcttttgttaatttttaatttttgtgaatacatagtaggtatctatatttttatgtgaaatatgttgatactggcatgtaatggataataatcccttcagggtatgtagagcacccatcccatcaagcatttatcctttgttttacaaacaatctaactatactcttttagctatcttaaaatgtacgattaaattattatttactatagtcactctgtagtgctagcaaataatggatcttttcatcctttctagtttttgtacccattagccattccaacttccccccaacccctccccaactacccttcccagactcttgtaacaatcctactctctatctccatgaattcaattgttttaatttttagcttccataaataagcaaggacatgagaagtgtgtctttttgtgcatagcttatttcacttaacataatgacctccagttccatccatgttattgcgaccgacagaatatcattttgaatagtgttcccttttgtatatataccacgttttctttatccgttcatctgctaatggacacttaggttgcttacaaaccttggctattgtgaacagtgctggaagaaatatgggaatacagatgtctttatcatatactgatttccttaatttggggtatatgcccagcagtggggttgctgtatcttatggtagctctatttttagtttttttgaggaacttccaaattgttcttcttagtggttgtactaatttacattcccaccaacagtgtagtagggttcccttttctctacatcctcattggcattcactggtgcctatctttgggataaaagccattttaactggggtgagatgatatctcattgtagtcttgatttgtatttctctgctgatcaatgatgttgagcaactttttagatatctgtttgccatttgtattttttagtttgacaaaggtctgaataaacatttgtccatttttaaatcagatttttttctatagagtcatctgagctccttatatattctggttattaaccccttgtcagatggactgtttgcaaatattttgtcctattctgtgggctgtgtgtttacttcgttgacttcaattattaaattaagaagctgagatctacctaatcactcacacccagcagatttaactgaccttaaagttcatatcattaattaacagtactaaaagttacataaaaccatgagagaaaacaacttgggggaattagacaaagggacagtattcttaagaatatattatttgttcttcactgatgttttcctagtactgatagggaacaaaataaagggtaggatatattaatagagtgggactttaagtattaatcgtctctcagattcaagttacaaaataaatacactctaattgctttgttgacaaattcaacacagaaggtatagacgaatgcttctcaattctggaagcacattagaatcacacaaggagtattaaaaaaattacccttgtctacgatcctatcccctgagagatactgatttacctggtccattatagagttttgacatcattatgtttttaaagctcctcaggagattctagtgtacagagttgagaaccactgctatatagaaaccaataagaagaaaatcgagcttaattttttttaagaaaatagtgtgctattgtgaaagaggtcccaagcaagagaaaagaaaacaaacatttcatggtgagaaaagaaagccaacatgcaaattagcaaagagagggattttcaagtaaattttgtcaaattaaggaaaacctattaaaaagatgaagaagaaaaataatcttcctatggccagaaaattaaaaggaattaagactacattagagaaattgtaactatataaataataaaaatataaggagaaagaacatataaaatttttgataaatccaaatttaagcagtatacatgagttatgaaggagagactttacagagaacccaagaatcacataaatatgttattataattaatttagctatttgcaaatttaaaattagtattaatctctatacacaataaggtaaaaaagttgactccacaagacacaattttcacccaactatttgattaaaggtcagatgttctcataagttctgccagctttaatatttttttgcaagcaagttagtggaaaaatacagaataaatagagtacctatcaaattcaaagaccccattgcctaagcaggctaaaaacgaaacactgtgcatgcacacacatacatacacagatacaaaaactgtaatatatgtaagcatttcaaaaatgtaggtatgtatcttatactgttgcatgtagttatctagcaaagaaaccagttgacccataaaatatccatttagttttcagataataatataatacattaatagtaatagaatcactgaatcttagagtccgaagataatttatatggttaattccttctctaaaacattctaacatattgatagcaatccctctaaaacatacatagcagaaagccatagattcagtatctgtattctttccattgcattgtccatcaacttataaattgtttttgctttattttgaaaactttaatcattgataatccttgttttcctttagaatgtcaattttctttttgaactatggttaccacaactcggtccaatactcccatttttgtctctccaatgtatgatgatttacagaattaaaagaatggttatctggagagtgaacagtgaagaattcattgagacacagctgcaatacaaaaaaaaaaaaaacaaaaaaaaacaccatttttttcccagaaaagtttggaaaatttaataattaagtgaataaattatggtcactttgtcgtgatcatcaatattactaaacaagccatgtatatagcaaaagaaggttcgtttttaagattataagttagagttcaaagtgatttaattttcaatggtaataaataccttaatattatctaccaaaaatattgaataatatccaaataatcaagtcaatttttttatttttagaattaagatttctaatagtacctaaagggatttaaaatgtttaattggagaagagaggggcaggatatatagaaaaagatatttaacctaattattttgggtactttatcttttacttaacaaacatttttgagagactactttggcaggtactattggatattggaggttctgaaaatatagcagtaaagaaaatagacaaaactatcttacctcctggagattacactttagtaggccagattaaagataaatgaatagactatatggtgggtgagacaattatacgtgctaggaaggaaaataaagccaaataggggacaatagatgtccagggtaaggaaagagactgtaattttagaaaagatatacgaaggctgggcgcgggggctcacacctgtaatcccagcactttgggaggccgaggtgggcggatcataaggtcaggagatcaagaccatcctggctaacacggtgaaaccccatctctactaaaaatacaaaaaattagccgggcgtggtggcgggcgcctgtagtcccagctactccggagactgaagcaggagaatggcgtgaacccgggaggcagagcttgcagtgagccgagatcgcgccactgcactccagcatggggcacagagcgagactctgtctcaaaaaaaaaaaaaaaaaaaaaaaaaagatgtacggggaaagtgtcattgaatggcgattcttgagtctaaagccaaaggcggtaactattgctgtaacaggtgtgatatatgcatcgaactctctcctatctacatgtacacaaacagtcttaaaatgaacatcactgcaagccagtattatgattaacagttaatttgactctctagactttttatttaaatatctagattaaatccacccacagctccaagtgacagaacacttcggtttactctgcttagtaggcttctgtatagacttaatttccatgcaaatgaaagtaattttgattgccacatggtattattgcctcagaaacgatggacatttagaaacttttggtgcaagtttccaaagataagagcttggaagcagaagggagagccatatcaattcagagtgtaacagcaatatcaagataaatttgtttggaactttgattttacatagcaactcttccgaattcgtcaattgcacaaccctatgaggtaaacaggacacttccttttatcagcattttatagagaaagaaactgagattcagaaaaaataaaattacttctccacaggcataaagctaattactaaagaattacgtactaaaatctgtgtcttcttattcctaattcatgtcctttttcaattcatttacctgactaccccacatgccttctccctgccaagatgaaattatctcttactattatattaggagatggatgtgcacctgtctgttaatgttaacagaggaaaggggttgctgagtgtctataaagctgacttgtaacactggtgtatctgctacaacattggctctacatacatatcaagcaattttgaactgctcaaacaccatgccaatcttaatgcaagagctgtcatagccagagattctaggataccatcagaaattgcagtcttgcaaaagaaaaaaggcaaaaccttaaagtgaacaggcttcaagttcgggtagcaagtaatatgtctgctacaaggatatacatgtcctccacgctgtgatttctcaatatgattaaggtagtctaattcaaattcattcagcttatctgaggtattgcaaaagtgctgttgcagtcactggtgacagtattcccaaagagaggcaattagacttcactagatttaaagtttaggtctcattatatatgatattttcagctggtacacatattgtagttttcatgaaagagctgcataaaacaagggttcctgtttgagctccactgatcctttaagaatgctgactgccaaactgccaattgtgttctcaaagaatagacatatcagccactgagtcaaacagctacgaagctctcacctgtcaacagtgggtaatcaagaaacaactgaaagatataccttcagaatgccagaataaagtgttaggaaacatcggattgctataaaactttccctcctgtagtcaccaggcataccatgggttaaagcaagcatgctccaaagccacatctttctccacatctttcttgaacagcaacaacaaaaagttaaaaaaaaaaaaactgcagattaaacccagctatagttccatgttatcaaagaaatactattttaagtgagtatatgtcattgctattgaggaaaaagcatgtacatctagcatagaagccaacaggaaattattcataacagaattatgttttacataacactttaacttaaattttaagcaatattttaattagatatatcaatacataagcagaaaaataatcaataagtagaaggtgtatgaaaagatgagggagtcaattcagtgatcatagtcttgaggtatgtcagctataatgatcattttactcacatttctcccaagatggtgaacataaatatcattgaatcaaggtactatttaaaagacaaatagatggtatgaaggttattgattgcaagtggcaatgtttttctaatacatatttcatagaagaatgtaaagattctctatgaatccagaagaacagatgggtaaggggaaatggatacttttaaagcttcaagactttttttatcacttttaaaaaacattttgagataattttagctttataaaagatgtgcaaaaatagtatgaagaattaccatatacctgttccccaaattctccatatacatcttttataaaaataggacatttgtcaaattgaaaagtaaccttggtaccatactattagccaaagtagagaactttgatttcatcagtttttccattaatgtacttgtattcaaaatcatgatttcgactaatttatgtacattttaaaataactaaaatagtataattggattgtttgtagcacaaagaaaggataaatgcttgaggtgattggtaccccacttaccatgatgtgattattatgcattgtatacctatatctcatgtaccatataaatatacacacctactatgtattcacacaaattaaaaataaaaaaattatattattgttgctccaagatctaatccagactactacaatctatttagttgtcagggagccacagtttcctgcaatcagtgacatttcttcagtttatctttcatggccttcactctgttaaagaacactgtcaattatattttagaatgtatttttgtaacgtacttcaatttgggtttgcgtgatatttccttatgattagactaaaattagacatttttgggaagtcatccacagagataatgtacccttctctgtgcattaaattgggggcatatattgaatacccttaatttctttctcctgcctgattgccctggccagaacttccaacactatgttgaataggagtggtgagagagggcatccctgtcttgtgcctgttttcaaagggaatgtttcctgtttttgcccattcagtatcccaaaatctccttaagttgataagcaacttcagcaaagtctcgggataaaaaatcaatgtgcaaaaatcacaagcattcttatacaccaataacagacaaacagagagccagatcatgagtgaactcccattcacgattgcttcaaagagaataaaatacctaggaatccaacttacaagggatgtgaaggacctcttcaatgataactacaaaccactgctcaatgaaataaaagaggacacaaaacaaatggaagaacattccatgctcatggataggaagaatcaatatcatgaaaatggccatattgcccaaggtaatttatagattcaatgccatccccatcaagctaccaatgactttcttcacagaattggaaaaaactactttaaagatcatatggaaccaaaaaatagcccgcattgccaagacaatcctaagccaaaagaacaaagctggaggaatcacgctacctgacttcaaactatactacaagactacagtaaccaaaacagcatgccactggtaccaaaacagagatatagaccaatggaacggaacagagccctcagaaataatatcacacatctacaaccatctaatctttgacaaacgtgacaaaaacaagaaatggggaaaggagtcgctatttaataaatggtgctgggaaaactggctagccatatgtagaaagctgaaactggatcctttccttatgccttgtgcaaaaattaattcaaggtggattaaagacttaaatgttagacctaaaaccataaaaaccctagaagaaaacctaggcaacaccattcaggacataggcatgggcaaggacttcatgtctaaaacaccaaaagcaatggcaacaaaagccaaaactgacaaatgggatctaattaaactaaagaactttggcacagcaaaagaaactaccatcagagtgaacaggcaacctacagaatgggagaaaatttttgcaatctacttatctgacaaagggctaatatccacaatctacaaagaactcaaacaaatttacgagaagtaaacaaccccatcaaaaagtgggtgaaggatatgaacagacacttctcaaaagaagacgtttatgcagccaacagatacatgaaaaaatgctcatcagcactggccatcagagaaatgcaaatcaaaaccactatgagataccatctcacaccagttagaatggcgatcattaaaaagtcaggaaacaacaggtgctggagaggatgtggagaaataggaacacttttacactgttggtgggactgtaaactagttcaaccattgtggaagacagtgcggcgattcctcagggatctagaactagaaataccactggacccagccatcccattactgggtatatacccaaaggattataaatcatgctgctatgaagacacatgcacacgtatgtttattgtggcactattcacaatagcaaagacttggaaccaacccaaatggccatcaataatagaatggattaagaaaatgtggcacatatacaccatggatactatgcagccataaaaaaggatgagttgatgtcctttgtagggacatggatgaagctagaaaccatcattctcagcaaactatcgcaaggacaaaaaaacaaacaccgcatgttctcactcataggtgggaattgaacaatggaacacttggacacaggaaggggaacatcacacactggggcctgtcgtggggtgggggtagaggggaaggaaagcattaggagatatacctaatataaatgacgagttaataggtgcagcacaccaacatggtacatgtatacatatgtaacaaacctgcactttgtgcacatgtaccctagaacttagagtataataaaaaaataaaataatagtaaaaatataaattggaggcatataatgtcgatatgtgtttttagtgatactaactttgaacccatggctaaaggaaatacctgctatgattctccactgtaaatttattattttttcctttgtaattataaaatatttagggggatataataaatatctatgcacatattatatatgcaggtaaactttgacctacttatatgaagatccataggaggaatttgcctgcaactccatattaaaaatcattgcaggataatgtggtgtaataatgatttctattttcctcattcatccttcagttttaattgaggttcctctgtgtagtaatttatttgccatttgtttatttcttcagttgtttataatactcatatttgattcatagatatggattttattctttggaatctaatcttatgttacggttattttactcctcttgttgtttcagcttcatccattaggtactctttcatgttggctcctgtgcccttttgattgatccatctatctatctatctatctatctatctatctaatgatcattatagctgacttacctataataaatatatttacatttaataaatattatatatatatatatatatatattttactcacttacttactttctggcatcacaagattctccaggtacatttggcgttttttaatgccctcactcaccttgcattgtctctactgcactcttacgattgactgtatgtccaaggagccctggttccatgatacagaggacagtatttcaaaaccaagatctggatgctactatgttccttgttattagaatgttacaatttctagcacctattaggatatggagctaagatatatatgcatgtataccaactcatatatatacaggtatatatttattcctctatttatctgtatataagttttaaaactataattccatttcagtacctccaatgccaatgagcatcacgaggttcactctagtattcctatttccttattggtagctgctttctacaacagaaagaattcgagttcttatgatataatatatttaatactttgctcagctctagtatacatataaattaatttcagaatttcaaccagtaaccctttaaggatcaaaattatcaactagagtacagtgtttgggaactgtttctttgtatttggccttagaatatgaagtcaaatgtcaatttgccaaagttgcttagtttcattcctttctttcccataccactcagtatgggtctatgattcattgttaatacagttagaatcgttttgtcacagcctgcactccatgtaccccctcgacaatctgattgatctttacaattcacatacacaaatttcactttttatagtacacagctttatgggtttgaaaactgaagttcaccactactgtcacatatagaacagttccctctcctcagaaatttcactgtgttataccttcctaaaagatccaatgatgtgttttcttacctagtgttttcttttttaaaagcatcatataaatagggattatgcaaaatgttgctttcggcatatcgcttttttgtttgctttgctttttgtgtatttttaatttctaatttttatgaatacatatttgtacacatttatggagtacacattatattttaacatgagcatgcaaggtgtaatgatcttatctgggtaatggggatgtccatcattttaaacattgattatttctttgtgttggaaacattccaaatctactcttctagttattttaaaatttagagtaaattattgttaactatagttgccctattgtgctacaaaacactagttcttacctaaccgcatttttgtacctattaaccaacccttcttcatccttccctccccagtatccttcccagcctctggtaatcaccattctattcactacctccatgagatgaatacttttagttcccacatatgactgggaacgtaagacatttgtatttctgtgactggtttacttaatgtaacataatgttctccacttccatccatgttattgtaaatgtacttatgattcatacatgttattgtaaatgtacttatgattcatacatgttattgtgtgaacaacagtgtatcctttttatcattgagaataattccagtgtatggaatggatgtgtatatcagaggttatttactcatttcatagtcgaagtatgtgtgagttatttacaattttttggcaattatgaactttctaaaaccttcataggcaagttaatttgtgtgaatatgtttctaattctctcagataaatacctaggagtgggattgccaggtcagaagataggtgtatctttaatgttactagaaactgccaaattgtcttccaaagcggttgtaccactttacctcaccggcatttgctgttgccatttctctttatttatgtatttactgagatggagtcttgatctgtcacccaggctgtagtgcgatggtgctatcttggctcactgcaacttctgcctcctgggttcatgcaattaccctgcctcagcctcctgagtagctaggactacaggtgtgcgccaccacaccctggtattttttttttttttttttgtatttttagtacagacaggatttcatcatgttggtcaggctggtcttgaactcctgacctcatgatccacccgcctaggcctcccaaagtgctgagattacaggtgggaaccaccacacctggctaccatttctttaaaaactttttagacattctatagttgtgtaatggcatttcattttacgttatatatccctttaccacatgtcctttactcaacttctccatatacatcttataaaaccatggaaccatatacatatctgtgtgtgtgtgtgtgtgtgtgtgtgtatatacacacacacatatatatacatatatatatacgtgtatatatatatacgtgtatatatatatacgtgtgtgtatatatatatacgtgtgtgtgtatatatatatacgtgtgtgtatatatatatatacgtgtgtgtatatatatatgtatatatatatatacacacacgtatatatatatgaagtaaaaactatgattaggactaagaaacacagaaaaaccaccattcaagaggttgccagatcaggctatagatggcatggtaataagaagataggctgttagatgtagttacaaaaaaagcttatttaccttaacaaaaaaaatcagtaaaaattaaaggatgtcaagacaaattatactgatagagtaagtaatgaaatgtcacaaataggaaagagagggagagagaatgtgtgactatgtgagtagaagatttcaagaaactgtgaaatgaatgacgcaataatcattgagagaaagtatactgccaagaatggtgagtttgcatagaataaaaaatgttgaccatgggtaaatgctaatggaaagggccggaggaaaggcttgaagatgctatacagagagatagtgctcctatgatccataagtatgcggtggtgggttggggggaatggagcttagacaaatgatttttatttaatttctactttaacagaaagcagcaatcaaagttgaacgcacaagtaccttcatttctcatggtgagtcaggtttctattttatttctgaagagaaaataggtcaatttgttgagagggaaggaggaaatggaagaaaggttgtgggtggagagtacaggactttggtgaggttttggagaaaaatacaagctacctaataaaaatcacacaaaaggtttgataagcacattaaggaccaacctaaggttgcaaaccagggtttagagtattaaagtataactagagaagacaaatatttgatctttttattgcactggagttgaaactgtccatgtggtagaaaggaaagaaaaaaaaataatttaagggtactgtcaagaggactgaaattacttatcatgagatctaggatagatattatttaaataaatgaaagaactaccagtttggaagaaaaatgaacagaattgtactgatttttgtgttatcagagccaaagacaacctggtgaaaaatagctgaggagaagatgatcttcagttaacattattgaaggatagaaaatggtaccagtattttgtttttgtttttctttttgtcactgttattatttggttttatgattgtgtgtgtatgtgtgtgtgtgtgtgtgtgatttaatgaagcgtttattttaaaaatgttgtttggaagttatataaggataatgtctaaactgtagttaccagtatgaggaatatcagtatatcagtgaatgactataagtgcaacaggacaagcagtttttcttgtgagacactcagctgttagtttaggaggaagttaaacaatttggatgtggttaagagtgtttactatggaatggaatttcaaaaatacaatgaaaatattttaaagtgagagaagaaattgggagtgggaagaatcatcaaagaagagcaatggcaattgcaagcatacaggaaataaggaacaggtagataagttagtcattagagctggttaccaaatcaattccgctttttctgggaacatggtaagattgtaattttcatctcctttgaagttgggcatgtccaagtgatttgacttggctaatgtaatgtgagggaaggtgatgtgtgtcacttcctggtgaatactttgaaagtcagggcctgatttgccaagtctctatctcactgtggcagtagtcaatgattagggcctccctggcaactcacattggacacacagtgcaaaagaaatttttaaaactgtgtcaaatcactgatcactggggattctttttaaattcagcataacctaggcctcctgactgaaaaatgagcaagataccaggatgagccatggtattctcagggttccaagcaatgcaaaaccgtggaaataaagttacttcaaagaaggcacacagatggagaatcaaatgacaatgacttgacaatgcttactgttcccttatgtgtaagctttgtagatcagtattacactacattaatgtcaattcatatcagctaacaaatccaatctacattttaaatcaattattcatatggaacaagtgagtaaaggtcagtttataacttggataacatatttataaaatgaataatcaactaccaatcaataaatacaaatttatacatagatacatatatttacttgttcatttttgtacaagtatagatacttctaaactctgcatatttaatttttcttttatgtatttttttttataaactcttctttggggagcaaaatcaaaattttaagaattacaattacatttagaactttgattgataaaatatgatatgatcattagcagtctttaacattcataatttgagcatttaatcatatatagtatatatacaccatagtttgttatagacatatatagttatatatataaaataaacttttttataaataggaaggtgatttgattttctcttaggcaatgaatattttttattttattgcagtaaatattcaaattatttccaaattgcacttattttttctgtattattcatggttttggaattcagtaacttttcaagaacttttatttgaatagttaaccaagtgacttttttttcctcttgagaatttaaagttaaaaaaggaatgcaaaacaaacatattctttattgtattatacagactagataaatttacgtataagcaagatagtttgttgttgatgtatccagatttaataggcatcacagtggtcccaaaatgtatccacatggttctttaaaaagtatgaatttctactactagaaacatacatgtttacatagtagttcaccattaaaaagaaattattttttaaaaatgcaaatgcttctgggaaccagggtaaaaagatggattaaattaattcatataaaattgttgatgatttttatcagattcaattgttttctgaagaggaaaaaagagagattgttagtacttaaaaagtaatgtaataaaatcacctaaaaattgacaaaataagaataaagctttgctacatataatattatcccacccacaatttctcaatctgtatctaatttataggccttttaagacaaaagccagtttcccataccaactttctaacacagcaccaaacacactggcaagtataacttcaacagattcttgctgctaatggtaatgtattcttctcagacaccaattctcatgaactatgagaaaagaagagaaatataaattttttatgctccatgtcttttgaaaaatgctaaatactgaagttgctggatatctaatgataaagcctttgtggtccacaatcaaaactatagactacttggtcttttattaccataaaagggcaacgccatttggcgatatacactattgctagcttgaagaacaagaaaaagtacaacataggagctatgatcttatgaataatgtttaaattttttcttcatagtttcagcatattttattttaggcccaagtaatatttttacatttttattgttttaatttttatttaaaatttgtagtaagaatacttaatataagatctaccttcttaacagatttttaaaagtacaatacagtcttgttaactctaggcatgatatttcacagcaaatctctagaacttattcatcttggctaacttaaattatacacctgctgaatagtaactccctatttctctttcactcagaccccagcaaccaccatgctactcactgcttctattagtttgattatttttcataccttggaatcatgcagtatttgtccttcgttgactgtcttattttacctagcataatatcctcaaggctcatccatgttgtcacatatggcagaattttcttttttatggctgagtaagattcctttgtatggatatactacattttactcatccattcatctgtggacatttaggttgtttccacatgtttgttattgtgaatagagatgcagtgtacatggtagtgctaatatcttttttaagatatttattgaaattattttgaacaaatatccaaaaataggattgatgggtcatatggtagctctattttttattttttgaaaaacttccacaatattttccacagttgtttcacattttatattcctactaacagcgttcaagggttccaatttttctatatcctgatcaacacttgtctttttttaaaaaaaataatagtcatcctaactggcatgaggtgatatctcattgtggttttgatttgcacttcttgacaattagtgatgttgagcacattcttatatatctgttagccatttttatgtcttctttggagaaatctctacttaagcccttagctcattttttaatgaggttattagatttttggaaatgagctgtaggagttccttatgtatattaaaaattaaacctttatcagatatatggtttgcaaatattttctccaactccttaggtttccttttcactctgttgattgctctctttgctgtgtaaaaggtttttagttttatgtagacatacttgtttattttctcttaatttgcctgtgcttttagagtcatatccatgaaatcactgacaaggctaatatcatgaagcttttactctgtgttttcttttaggagttttagagtttcaagtctcatgttcaaccctttaattccttttcagtttattgctgtgtcttttgtaagataagggtccaattttattattttgcatttgaatatctagttttcccagcaccatttgctgaagaaactattattttccaatcttgtatgcttggtaaccttgtgaaaggtcagttgaccaatcatgcgtgctttcacttctggatttgctattctatttcattggcctatatgtgtctttatgtttgtaccatactgttttaattactgtagctttgtcatatattttgaaatcaggaatttcaatgctttcaattttgttctttcttaaggttattttgtggattcagggtcatttgtaattccacaaaaaattttagattttttttctatttcattaagaaatgccatttgaattttgacagatattgcactgaatctgtagataattttaggtagtatagacatgtaaacagtatccagtatcccaattcatgaacatgggatgtatctccatttgtttgtgtgatttgatttttttcatcagtgttttgtatttttcagtgtacaagtttcttacctcctcagttaagtttattcctaagtgattatttcttataggtgctatggtaaatgggattgttttcataataaattttgcagatagttttctgttagtgtatcaacaatgcaactgatttttgcatgttgattttatttactaaaattttactcaatttgtttattatttctagaagtattttttgtggactctagggttttctacacataagatcatgtcatttgcatttttccttcatagattattactagttttcagattaggagaagagaacaaactattttgtccaatgtaattttcagaactacattaatattatgtgtagtatatatatgaatgtatcaatatctatagttatagctgtctatatacatatatacatttatgtaacacctctcatttgtgtataatgttattgcagttactggtgagagtacaatgtacaaagacagaagaaagggtctttgcttccaagttggaaatgttaacaccagtaatctttttaataaatatatttctccattgacataatattcatttataggtgtttaccttttgaatttaaaatgtgtgtttaaagaatctgtataagtcaatgaaaatgaataattttacttttctatatgctgaaagatccactggttctaaggtagagagttttgaacagagtttggaacttattgaatacgaattggaatatattgaatatgaacattactaaatatatacaggtataaattctataaccacttagagaagaaaggaaaaaactgtcacatgggtgaatggactcaatgacctcaatccattgttctattccattgttctaactagaacataatagcattgttattgaatacctgtgtactgatcacctgacaaataattcaaatttgatattaatagtgagaaaattaaggataataattttatgtttttttaaatggttcaatatctttcaatcaccaactacataaatcatgaagaacatttcattagggaagctgaagagcctggcgtatggttgtacatctcacttccagagactggtaaattcacttatcgtatctattaattacctacatgtagggcaaattttacaagtagaaaaaaattaagcaccatgttggcaatcagtccagtggaaattgagtgtgaaataaagatgtttcattccatcaagtttaaggaattaaaagtcaaatgtgtacagcttggtcaaggttaaaatttatgttaagatcatttacaatttttttttttttttgagacggagtctcgcactgtcacccaggctggagtgcagcggcccaatcttggctcacttcaagctccgcctcccaggttcacgccattctgctgcctcagcctcccaagtagctgggactacaggcgcccgccaccacacccggctaattttttgtatttttagtacagacagggttttaccgtgttagccaagatggtcttgatctcctgacctcgtgatctgcccgccttggcctcccaaagtgctgggattacaggcgtgagccaccgcgctcagccttacattgttttttttttttaaataataattgaaattgttttaacagccatttcaaaataattaaaataaatcctcttcatacataaaagataatgaacagggcaagaagatgccatgctaattttctttttctgggtagattatttttttaatggtcagaagaaacctgcactcttatctcctattttcagctaactcttaccttttgcctcccagctttctgatactacaaatccagcagcatatcctcattgtcagacgagaaacttgaaagggatttcatatggtgaaaacagttagataactcttgaggacaaaatggcaatgtaaaaatatcctcctccagctttgccagtacacaaaaaatctaggtcattttattcagcgggagaagttattagaagaactcctctcatttcctccacaaaaaaaaaaaaaaaaaaaaaaaaagcaacctcacaaaatttaatgacctgcgaattctcctctggggaaggtaccatgccctagacatttcattaaatatatatgtactgttactaagactttaaaaatctgatgattgaaaacacattacaaaaataacataataaagatattcaaacatctaacaattaaccaatatatgccaaacaaaatgtttggcagaattttaaatgaacagaaattgagccaactccatttttaaataacttcttagagctgagtataatgtgtcttagcacatagaggcatacctcattttatcatgcttcacagctattgcatttttttataaactgatgtttctggtaagtctgtattgagcaagtccatcagtgccaattttgcaatagcatgtgctcaactcatccctgtgtcacattttggtaattctcttaaaatttccaactttattattattattattatatctgttacggtgatttgtgatcagagaatctttgatgttactattgtcattgtttcggggactcataaaccatgtccatataaaacagtaaacttgattaactaatgttatgtgtgttccgactgttccaaagtcctgcatccccccatcaatttccctctcctcaggctcccctattccctgagacactacaatattaacattagcctaattaccaaaaaccacctatgcccccaaaactagagaaatacaaaaattagtccagttaataattcaacaatggcctctaagtattcaagtaaaaggaagagtcccatatccctccatttaaatcaaaagctagaaatgattaagcttagtgaggaaagcatgtcaaaagccaagacagcccaaaaactaggcctcttgtgccagtttgtcaagttgcaaatgcaaaggaagagttattgaagcaaaagtgctactccagtgaacacacggataataagatagcaaaacaaccttattgctgatatgaagtaaattgtggtggtctacatagaaaatcaaaccaaccacatttccttaagccaagccctaaaccagagcacaaacctaactctcttaatcctacaaagactaagaaaggtgatgaagctgaagaagaaaatcttgaaactagcagaggttggttcatgaggtttaaggaaagaagccatctccataacataaaagtgcaaggtgaagcagcaagtgctgatgtagaagctacggcaagttatccagaagatctagctaagatacttaatggaattggctacactcaccaatagatttttaattaagaagaaacagacttctattggaagaagcataccatcttagaccttcatagctagagaagggaagtcgatgcttggcttcaaagcttccaaggacaggttgactctcttgctaggagctaatgcagctggtgactttaagttgaagctaattctcatttaccattccccatatcctagggcccattagaattatgttaaatctactctgcctgtgttctataaatggaacaacaaagcctagatgacagcacatctgtttacagcacagtaaatagaatatttttaaacccactgttgagaccaccctgctcagagaaaaacagattcctttctaaatatgactgcttattgacaatgcatctagttgccaaggtgcaagaagattaatgttgttttatgcccagtaacacaacatgtagcctatggatcaaggagtaaatttttactttcaagtcattattttagaaatacagttcataaggctgtagcttccatagatagtgattcttctgatagatctgggaaaagtgcactgaaaaccttccggaaaggattcaccattctagatgccattaagaacatttgtgactcatgggagcagatcacagtatcaacatgaacagtagattggaaaaagtaggttccaactctcacagatgactttcagggttcaagatttccatggatgaagttactacagaggtggtggaaacagcaaaagaactagaattagaaatggatcccgaatatgtgactgaattgctggaatgtcacgttaaagactgaattggtgaggagttgcttcttgtggatgagccgaggaagtggtttcttgaggtgggatctactcctggtgaagatgtagcgaacatttttcaaaagacaataaatgattagaatattccataaacttagtaaataaagcagtggcaggatttgagaggattgtctccaattttgaaagaatgtctactatagtcaaagtgccatcagagagcattgcatgctgcagagaaatccttcgtgaaaatctgagacaatcaatgcaacaaaatcattcttattttaagacactgccacagccatccaccctaaccttcgacaaccaccacccagattagtcaaaagcaattagcatggtggcgggaccctacactggcaagaaattatgaccgactgatgggatagatgactgttagaatttttagcaataaagtatttgtaataaaggtatgtacattgtttttataaacataatgctattgcacaattaataggctacagtatagtttagtcataatcattatatgaaatggggaaccaaaaaatatgtacaatgtgcttttttgcaatatttgctttattgcagtggtctagaacctgcactctctctgaggtatgtctgtatggtctttttgatccataagtacacaaactgttagggaagggatgtatacatatgtgtatatccacacactcatagatggatataatatttaaggaaaacagggagattaggtgtgaaggaaaggtactggtggtacctgacttcaaataccgaaaggtttggtcttcctgacttacctcctcccagtgctactccataggcagtggatattgaaggaattgtgcctttaacactaaggagtctctgaagggactattctttgtaaactaatgccagggccaatatctgcaaaaacttggggcagtaaaatatgaggctctgaatacacagccctcaagtgtgtggtgtggacatcacaagcgtcctcttcagtggtgcttatatatgataattcagaatttgcacaaagcttttgagaggtgcttttctattaaaggctgagaaagcctgttttattttttaagacctctcaccacatggtgtaatttccaaaagcttgaactttctaaaggaataaacaaacctgattacttacctatgtcagaatgtttggaatttgtgcctcttaaaagtaatagcaataaaggtgaatccagattttacagaaaggactgatgtactgagagaagcttataactctgaaagcaccaactgtgacctactgggaagggtagactcaacctgaaccatcatataatgttttactttattttcaatatgatgatacaggttcaagaataatttcagttttcagactgaaaactgagaaagaaactgagggttctttcagtctgagaaccctcaattttgatgaaattagcacagtaaagctgaacttttaaaaaagttgaaaataaaaaattaatgcataaatagaaatattaattattttatagcataaatacaacagtgttcatctaagaagggtatttcctaaatgagaagctaggtttttaatcataatttttattaatgttctgtgagggggttcataaataagtatataatatgaagtactagtttacaatcaattttttgatgaaatattcctcttacagccaaacacctgtttcacgtttgttggatgtataattaatgcagcctaatgaacatgcttcatcaaaatttctctgtggttgaaaaataaaatcagagtggtaggtcttgccaattagaacatttgggaaatatacattaaaatgttttaagtacatatcgtgatgttttaatttaaggcagagtgtgcctagattgcaaaatcctatatgaaatcacgtaacaaatgctacgatttaccactacatagtaccacgtataatcaacacttgtgttgcctgcctggattctctagaaggcgtgtgtatttcctgcatgccttgatatattaggtgtctatgacaaagcaactgtcccaagcaacacttctcctagctcagcaagtctcctactgttcccacttcagtcttttctttcctcagccatgccctgcaatcataatgaaggcattcatccttctgacaataagtctgacttcaaccctttaatataaacaagcaggtagaactgtaagaaaaaatatctttctaataaaatacccccaatatttttcaagtatatttatctgtatatatatatatatatatatagacagaaagaaagggagagagagagagagagagaaataaagagagagagagagagagaaagcggctctaatatgtttgtttacaggtgaaattttacataaatggctattgattctctttatgattacttttgaaaataaatgatgtgtccattgatagaagtaaaaagtcaaacataatgctggtaattttgatttcaggggcctaactatatattctagataccaaaaacttttatcatttaattaataaaatgtaaaatgctcattcagtgtgtttgggctgccataaaaaaaggtcacaggtatgatggcttaaacaaccgaaatatattttctctcagttctgcaagctagaagtccaagatgatggtgccaacatggtcagtttaagctaagggtggttctctggcttgcagaaggtgtccgtcttataagtcctcacgtgaactttccttggtacacgcacagatttcccacactctctctttcttcctcttctaaggccaccgatcctatagaaaggcctcatctccagatgcagttacataagggaatcaacatgtaaatttgatgtgttaggagccgttcaatccttagcatgttccaaagaaactaggcacttgggagcatctatcacaccactacctgcaagatttacatttgttccgaggcagcgcaaaatgtggaggcagttctaaatttaaagtcattgtgtttgatacatagtttactgtacgataagtttattactagttttattttttaattttaagcaactacatctgaaacatacacacgctaacatggtatgtctatgtatctataacttaataaaataggaaaatgaaattatcctaacaccataagccataaaataaaaatatttttcagaaaaaaaaaatcattgcattaacagaccaaatcctttatgaagtcaatgttgtattccgtcaaaaatctttaaaagaaatacatttttcaataaggatatgtgttgccattgagagcacatagtctcttcagcatttggattcagcatatattgcagcagtcaaccatttttcagttaagaggagtgttttatcccctagtaacgtataatctcactttgagaagagaaaatcgagttcatggacaactactaaaaacagttttcaattaaattcatactattataggctatttttatttcatttttacattgtaaaagaaggtacctgttactgtttttaaatcatagctacaggtgaatttaaaaagataggggtaaattgtaaaaacaaaccaaaatatgatgctaaaaaaaaaagcaaaataagtgtaatatattcttggtgggctcatagtagggtagatcacaacactaagacctatatcatatgtttcttctctgcagacaaatgcttcggtttctattttcagggtagtggtctttattttctctcaaatgatattatcaggaagaagtattattttgacagttcttttattccaagagaataaagttagtacatttatccaaattattatttaatttcccaggattctagttatcagatttgtcaagccatataaaatatgaaattcataaatatttctaatatttcttttcacaaatttctgaagaagccctgcaataataacattagaaacatgtagatatatttcagataaaagtctccctatataatggttgaacaggatgccacaatgcaaagaatggcagagaattttcacctgcttagtgttggtattctaatcttgctcagagtactttttctataccaagccacccaatcattatatactcagtacaaattacagatgatatgaaaattaatccaacaaaaacttaagatttcagggcacaacctaaacaactgtaattgatttatagtttctaatcacatagttctaagttgatgttatttgcttcttgctttaggcaagctctttattgtcttacttcagagtcttgaggaaataaactcatttagaaatcataaaattaaattatgaataaaaatattctccacacatatccagaaagcttgagccatcaattttcacaagtcagggaaggatccacaaagattttcaaagtgtgtgtgtgtgtgtgtgtgtgtgtgtgtattttccctgaaaaactgatacattgaagaatccatctgccattgagtcatcacagggttctcgctttccactttgtttttacatttgttcttcgcccacttaacaaaaagtaaagcccacttctcaaacatcctgtgttaaatgcattgccctaatactgtgctatccaagacatagttactaacctcatgcggttatttacatttaaattaattaaaagtaaataaggttaaaaattcagcttatcagcctactgcccacatttcaatttactcagtagacttatctgacctagtgggtgttgtattaagcagtgaagattagaacattcctgctgtcatagaaagttcttttgaaaaacactgttctaagatataaagtctctctgaggggcaacactgccaactataggtcaataccaactaagtctttgaagaataaaatagcgcatttcattcagatgaagttctgttgagaaataaaaggaaatgaaaattaaaggagaaaatcatgtactctttctgacaataatttcttgggcacatatttcaaaaatggatgattgtgagtataatattgctaaagtgtggctatatcattgaacacatttttaagtataataattatttctaaataaacatgttataattactgaaaatcatacccatgccaatttcatcttataaggaaaatgatagatttgagaataaataagtaaaaggatgtacatgttttaaaaaattatttcaggagcttataaggagaatattttgaaggtagttatacaaaactccttttggttctcacaccagaaatctcttataaccaatctcttcattctctgatattcctaataagtttccacacagtaccctccttactcctgttctttaatttaattatctttcaataccctttacataaaagagttacccaaattttaaaacaatttcttccacccacccctactggcaatagatacagtattgaggttccttaaagttacagtagtgcagtagagaagaaggaaattttattaacttgtcgattctcaatgagagaattgccaagcaaacctcagaaagaggggaatggctaaggcaagcataatatgtgtctgtgaggaaaagcttcattatctatgtgttcatcctcatctgcagatggcaacaaattgaggaacatgggtccagaaatccagtttctcctttctaactactattcttattcctcttagcctgctccaaggagtcttatttaatataaatgtacaattgaaaagcaactctatttacttaagatagctctcaccaacttcagagtaataaattagacaaaagacaaatacaattggaaagagttatttatcaccaggctatggtgtgaatagacagaaactaagaataaacaattaaattgatttcaggctttgccatttctcttcatttctttaaaacagataaatatgctcgcaagtctgctcatgcctcccactacagaggcaggggcattcatgactcagtttaccaccgatgcagtaaagaacagcctcaaacagcccgtctcaaacaaatgagataagagactaggtaacaataattagtgacacacctgggaggtctgtttcaaaacacatgaactactgaatacagattatgtattcaatgataaagaggaactaagaataaaagcgtaagctaattccaaatgcattaggtagactggaagaagacaattccaaagaaaagccataaatggcttgtacattgtcataaaatttaaaaagcaacaaggttaatacatgtagaatagcttaaaaccacaaagaacactagagatgtaaaccactggaaaatgaaacaacaggaggttaatttgagaatttcccctaaaattcaatcaactttaaggacctacaaatgtaatcaccataagaagattcacactgataattccgttaacactaactagaatgatttgctttctaagtttatgtaacaagtagagccattatatcagcagatgggatttttctttagcaataattacttatgcatataattcattctgcctagttcaagataatagttgcatattcaatatttatggcattatgagaaagataattatgtggctttcaagtgaattacccttgattatagttttcttgtttttatatacactatattctaaataatccatagtaaatattgataataatttaaaagattaaagctaatcatgacctaaaccttccattgattcaatttcctttctcacaaaacctcaacaaggattcttcacatcataccctataacacacacacacactgagttgaaagctcagcaagggcaggagcctgatgcagatctctacagtgaatcctgctctaaattcctccagaagaaatgtttctttcttactgttctcatcatgaggccacagaaagaaggagttaaaaacatggatgctccaggcagatatcctgagtctgattccaagttctaccacagacctgctgtgcatccgtgcatgagttattcaaactctctggacctccccatctccagtttccacatctgctaatctacctcttaggattgtcagagtaaactgagttcacatatataaatgcttcaaacagtacctgacacataatccatgctgctactattaatgtggagaccaccttcattatagaacctgttacagtatattataacatcttttaccaccacaagaatgtcaaatttaggaatatatattctattaaaatatatacaaaatatgacatttgtatcatatgtatactcagggcctagcccaatggccagcacacattgacaattgatgctgtataaatagatgtttgatcacctaaatggcatgcacataagttgacacacaacttgtccagtaatttgggcattaattaacattggtatatagcttgcttgtataatcctgacttcttctgaaggcagttgagatttaactgtgagtgtctttaaatattctctaacaattactcctttatccatactatttcaacaacattaaatgatgtttttatagttatatattcatattagttactcaagtttttaaaagaaattaaacataattaaaacagatttatatctatatatgtttgtgtggatagggttagttttgtggtggatggaaaaaagagaaattgacttttttaattaagaaaaatagatgtgccggaaaaatttatggcttaggtttagtgaagctcctagtttagtttctttcttttttatttgttcatgctataaaataattcattttcatgacaatgaaagcaaaaaatagatttgatctccttgatttattttagctgatgcattcacatatctcttttaaatgcaagaactcaactattctaggatctagaaccagaaataccatttgatccagcaatctcattactgggtatatacccaaaggattataaatcattctactataaagacacattcacacgtatgtttattgtggcactgttcacaatagcaaagacttggaaccaacccaattgcccatcaaggttagactggataaacaatatgtggcacatatacaccatggaatactattcagccataaaaaagaatgagttcatgttttttgcagggacatggataaagctggaaaccttcattctcagtaaactaacacaggaacagaaaaccaagcactgcatgttctcactcataagtgggagttgaacaatgagaacatatgggcacagggaggggaacatcatacacggggcctgttgggggatggggggcaaggggaaggatagcattaggagaaatacctaatgtagatgatggcttgatgggtgcagcaaaccaccatggcacatatatacgtatgtaacaaaactgcacgttctgcacatgtatcccagaatgtaaagtataataataataataaaaagaatgagttcatgtcttttgcagggacatggatgaagctggaagccatcattctcagcaaacttacacagaaacacaaaaccaaacaccacatgttctcactcataagtgggagttggacaatgagaacacatggaaacaaggaggggaacatcacacactggggcctgtcttggggtggggggcaagagaagggagagcattaagacaaatacctaaggcatgtggtacttaagacctagacgacaggttgttaggggcagaaaaccaccatggcccatgtatacctatgtaacaaacctgcatgttctgcacatgtatcccagaacttaagattaaaaaagtcaatttaaaaaaaatattgcagtgattgacacccgtacttaagaatatttagaaaactgtttagacaatacatcttctaaaataaagtctatagtaaaattatctttttctttcagcctgaaattcctgtggcctgatattagactcaaacttaatctatacatccatgttagagagtaggttttatacttagttcattatttaaaggtatccagtggcaaaaataggagtgtaccaaattagactttttagaggaaaaaaatctaaaatgattataatttacgaaaaagtaagaaatgcaaaaagtttaaaccccatgcaaatggagtacatcttttttacaaactcacttttgtcttgcaaaaagtacatttttttcagaacaagtgttccctaatagcaattagcacacttaccacgttttgaatgctaagtattattgtcagaaaaagaagtcaataaaaggtagtaactgatcccagtgctgattcagggaaagcatacaatgagcctgcaatagtgagctgtgtgtgaacatagcatagagctcaggaaatgatgggactatggcaaaataataattaatcataatgataataagagccagattaaaagaactctcacaggcttaatttaggaaatctgacaatcaaaataaataatgatgacagtgaactataatgtattgaactagaagaaaaattcacatgttaaaacagatatcaaataaataaataaataaacaggagaatagtgaaagttcatcctcacagcagactaccactgctaaatgtagaagatattagaaaaatgccctattaaatccaccatagttataattaatcgatacagacaatggatgctaaaatcagtagacaatttttttttttttgagacagattcttgctctgtcagccaggctaaagtgccactgtgcgattgtggctcactccaacctccacttcccaggttcaagtaattctcctgcgtaagccttccgagtggctgggattgcaggtgcaagccaccacgcccggctaatttttgtatttttagtagagacggggtttcaccatgttggtcaggctggtcttaaactcctgacctcaagtgatccgccctcctcagtctcccaaatggctgggattgcaggcatgagccactatgcccggccaatggataaaattttaatggaaaatgggatatatacacagacttaaaagatctacatcatattacagtcagttctgctataacagaataagtgttcctaaaaatcaccatactatgcaaaaatgcacaacaaaaacatagggatgatggggaaatgggatgacagacagaatactcaaagacagcatcactgacacattaaaatagatgggagcctaataaaaatggtagcatattaaataatgaagtaatatataaactacaataaatatggcactttaccttgaaaaagacttgaaatttgcttatattcatgagtgttggaagaattgtagcttgtaaatcattgtgaagtggtgaaagggaagttctctgacattggatacaaagttgtaatatcaaatatggctggctttaaggtgtatgcatgtatgcattttgtgtctttctacatgccatggctcaactgggtgcaattttctgtgttcatttagtgtttctccatgacaaaaatcacaaataaacaaacacaattgtagctttgctgcaataattttctgatgtatcaatggtattccaacaaatttacattttcaaagaaatgtaatagcagaactaactatagttattgtaaagtggacaatggtaactttcccatggagaactccaacagaccctgccttcaccaagtgatcagaattaaccttatttaatagtgggaataactgtattacatgccatgtaattcatttaatactttattttaaaattactctcccacttgttggggagcctaatttcatttagcagtttgtaaaacaagcattaatttaaattaatggacttttaagctgatatttgttgcagaagcttatatataagattttagattacttcagtgccacacccacctttatgtgtttgcatccaactatgataaatttatgtatgtcacgacagtggggacgctgtgagctgaacagcaaatcactctaattaaggttgatgacaagaacaaactgaggaaactggtaggcctctgtaaaattgacagagagggacaacctcataaactggttggttgtagtcatgtagtagttaagcagtatggcaaagaatctcaggccaagaaagtcactgaaaatatttcaaatacaaaaaatgaacaaatgacacattggttagtgttcctaaaataaataaataaataaataaaaaatacataaaaatgaccctatccaaatggccagatgaacagtgtctgtgcaccttttgtaagacttctgttgaatgtggttgtgctgtaaaagtcctatatatatacactatatatatatttatataatatatataaatcctatatatattagatatttatatatattagatatttctaatatatatattagatatttctttaaaaacattgcaccagggaatctctcctaaatagcaggttttattcttttaatcaatgagaattacctaataaataaaagttttcttttttgctttgtgtgtaaggactcttagaataaaattcaatgcttccagactaaaattctcttaggttgtggttttcatgtatttacctgatccctcagttttatggctcctcatgtaaattttcagaaagccatctgctatttttttagtttgtccccaccaaaactcatgctgatacatgattcccagtgtggcagtgttgggatgtagggtctagaggaaggcatttggatcataagagtagctccttcatgaatagattaatgccctctaatgctctccagatagggtgagttctcctgggaatggattagctacggggttattaaaaacagtctggcatcctgggtttttctctcttgcttcctctctcctacatgatctctttgcatacacaggttccattcctgctttcctccaggagtggaagcagcctgaggccctcaccagatgtcaccactcaattgtaaaccttctggccaccagaatggtgagctaaataaacatattttctttataaatcacctggtctcaggaattctgtgatagcaacacaaattgaactaagacagcatccagccatcatacatcacttatgtatttagcaattaattagctgttgacaaggaaaaatattcttatattgtgtcttatttgtagatgagaaaattctttggagatgaaatttacaatcatagagtgggtatatacactcagctgtctcgctgagtctttgctgatttatttccattgtattgaaattagtctaatttttggtgtttttttttcagtaatgtattaaagagtatgaaacacataaacctcatgtcacacacttataaataataataaataatggtaatatgaattaataatgaatagtcccatgtataacaaaatgatacaaactaacacctccatctgcattaatatgcacccaattatatagatatcagggaattaagagctttttaaaataatcgacaggctagtaagaatataataataaattaaaaacttttcactattatctatgttttaaagccatatttcatgcatactttcatctgaacactagtgacctattttataataaaaacactattttataagcatttcagagcatataactagtttcacctttttttattaggaagttttttttaattaaaattgctcagttaaaagttaagtttgtagcctatttttttctaagggaatattttatttattaataaatataaaatatttgttatcctttttcaatattcatagtgaaatgtatttttatttgaaaccaatttcactgaaagttttaaatttttaagaagagttctaaaaaatatttcattaagggaaacccttactatcattgtcaggttgtttaaggattatatcagcattgtagtgtaatgtgattcaaagatggcaatactctctccatatcttttaaactttaacatcagagttctaaaaagatgttaaaattactctatgggaccatcttccaaagttaaaaacttaaaatacagcatattagataaattctcccatttcaaattaaaaagcaatggttttgtatggaagaaaacatattacttcacccattattaactttcatgataaaatattttatttaatttaaatataatagtgtgaccaaagtttactttaaaatgatgattttggtgtttgacttttctaattcagaaaacataattgaaggcaaaagcaatggttttgatatgagcttcctaggcaggtatttttatagcccattaacataaatatgtgattaaaattattcagaagcatttagataggaatttcacaatggaaacataaaaccttaacacaacaggaccaaatttttgtttaattcgtccttactaggttggcagacacaagtcatgcccttcaaggtttccaacggcaaatgctactatctactaagaagaagaagaaaaaaaagcagattacttttaattttctattaatcatctgcatttctgcttcaatttgagaggcaccatttcatttaattagtcctctcattataaatattttccacagtgattcagttgacacaagttttctgacactgactgtgcagatggcacaaaactggtgtctggtctcaaaggaactatttgaccattgcaataaaagagcaataaacaaaatagcaacattgcagcccacttcagtttatgtaggcagtcagccttttatcgctgtaaaaccttgaaatggatgtatgagctttgctgctataaacaaagagttgtttacagctgggggatggcaggtaccaacagtggactggagcttcagcagcctgaatgtcaggaactgactaatgtgaagaaacatattgtggcttgttttatggagaatatgttttataaaccccaagggaccatttatcacaaattcatccactctgtagcagattgctgctttaatgttgaatactggatttcagtcaggttttcaactaaaaaattgaggggaaaagtccaaatgttattttgtttctgtttgcttcatattgatgaatctcaaatttcagcatagaaaatccattttaacaactcatcctctcccttaaacaaactaaatattttatgatttggggctgattcattagaaaatttacatctacttaccgtcgtgagctgtttcaacaatgccatttatttgtaatctggtgagcttactgtatgccaacatctttaaaaaaaagtgtctaacaaaaatgcactttgctaatgggcattggaaaatgtatactgtttcccataaaatgaaataatcaagtcaccacagcaagagtttttatagccttttttaaaaaaagtcaataaataaagccacaaggatatttcacagagatgtcatggttgataaccattaagtgaatataatatatttgactttactcattacatataaaacatcattacatgagaaaacaacagctcatctcagtctcatgaaactgtgcacagcaagttgaaaattgatatctagccttgtgtcagcaactctccctgttgtaggtgaatccaggcatatggaataatatgtcccaagatacccttttacctctttatggcctctattgtcacaaagtgagaaagcagacataggtttcacacaggtatgcttgtcttaatactcgacaaaacagttggttttgggcttcaaaaatcaaaggaaagtatttggggaaataataaccgtgaagagggtataaaagagtttttttccagtggttagcaaacctcttacagcggaatcacttgtgagtgagcgggtgtcgtgctagactactgtttagattcctggaccaaatcctaatccatagagccaaattcttcagaggcaggaccaaggaatatgtctgcttaagaaactccaaatattactgtgatacacatatacaggtgaattattaaagcaattatataggaaaaagtataaatataagtgtaatatcatctgtgcacagatagtgaacatttaaaaatttgggggattcagagaaattctcttgtaagtcacagaattttattgatttcttctaatttctgccttaaagcttttctccttgtcctttcaagatttcttcttttgttctgctgctgttgactcaagcatagaatacaattcgttttaggttaaaatctagactaatccatacatttattattttcatgtttatgagaaacttcataataataattttaaataaacttccctatcctattaggaattggatctgtttgcctaactaccatccattacaagtagagttagaatggctcaatcaatgtgctttctggttatgttttgctggaactatgcagttctgagtgtaaaaaatgcacactccacgctgataagcacttcctgttcctggttaacacagaatgcattgcttgtataaatactggcccagggaacactgcagagaataaaaaacataagtgaaaagtcagctgtctcattaaaagtgaggttaatacctcagaactcctcttcttctacctgaggtttgaatgtaaccattggatcatgccctatttcatggtaccaattttcttttaaatctaattagtaattggcaatgctttatttccagctattagagtttcacctaagccagcaactaatagtaaagcagtacggttattaggtaattcaaatgaaagcttcaaagctccttttccttctggggaatctcaaactatcccataattgggttgggcatttcttttctagctctgaaatagcattctgtgggatgaacagcatttgctcctttttagagataaataattctaaaaactataggactattgtcaccaaataaagatgcatggcgagatctatcagattataatcactaaattaggtcatatagtttaacaacgtatttcttatgtgaaagaaatgatttaaaaaatctaagtggcttaagagagtttattctagagctgacatgatatctcttacaactcagccttcttcacacactgatttgttaatgtcagccttaattccaaattctgttaatgagctcaacaacacattctgttttgtttcctatttttgttcttgaacttgtttttgctgctgttaatttgtgttgtacttatttttataatgtgagatcgagtatgtaaatcataattggctgaaaaatagctatgtaaaaattgggcattaacataaactaaaaattgtcaaaattgaaattgcaatgatttttggtatttacttcaactctctttctttacattgttttttcttgaactgtcaaatcattgtctattccttctatccatcaaagttttgtgcttttctttacatgatttcctccaaatatttagctaatgtatctgttttctccttcagtgaacactccttcagtgagtttctgattatatccatatttatatttatcatcataatgtcttaaaattctctcttataatctcataaaagtttcctaataactaaatcttacatgacttaaactgaaacaagccaggcttttccttattcctctatgcaggtatcctaaagatggttgccagatcagcacccttatagtgtaaccaggaagcatgttaagaatgcagattctcaggccccaacccagtcgaactgaattagaaattctgaggatgacacctcgcaatctgtgttttaccaagccttccacctaaaatttggaacctctggtgtagaatataaaacccagctccttgatgtcagacagacctgaatctgagtttaggcttgtcaacttgcatagtcttaatcaaattgcttaactctgattggcccagcttgaatcacagtgcctatccctatccaatcactgtgttcaaataaatgggaggatttgtttggcttatccatccttggccatgagacgacactgtggatagagaggtgagaaagcctcatcataaaataaataaataaataaataaataaataaataaataaataaataaataaataaataaaaagggagaggagtggttctgtaaagaaagagatgatgaagaaaaacattttctgttctcaatgactttgttcatatttccccctctctattcttcatctaaggatctgtaaccatttactttcttccaggcttgaataaaaatcaattattttcaggagctttcttcggttaatccctctctctatatatacacaattttaccacacttgaaaatacaatctttatacaatttctttatgatgattcccatgccagttttcctacatgattggttttctgactgtgctataaattatataagacaggaacactgattctcccctctcatctcccttgcattttgttaagttctcccatatataggatgtactgaataaattctttcaagttgttaatcctgtttatcttttagattccaatctaaatcatataaaggacttgagacattatcttattttttcttaaaatgtgtaacaaatttatttaaaattatgttttgagtatacagatcttataattgaaaaccctgataaatatcttgaatcttgatatatagtatcatggaattttttaaacaagctgcttctaccttattttctcagaagtttaaggtgtttataaatactaacttctaatactccagttacacagtcatttcctgggtcaccagcctgtgcctggaggaccttatccagggagtaaagttttggtaatggctcttccctaaatccaaagcatcactctttccacattaatgcaaatgctcctgagaactgaaaatacccctttctctccatcctgatcttgcacttacttatacaggtcaaattagggacaatcctttcaagagaaaacagcatttgaatttatcattattgtttatcacttttttgttgttgttttgaggtggagtctcgctctgttgcccaggttggagtgcagtggtgtgatctcagctcactgcaaccactgtctttcaggatcgagcaattctcccacatcagcctcccaagtagttgggattacaggcgaccgccatcatgccgggctaatttttgtatttttagtagagacggttttttgccacgttggccaggctggtctcaaactcctgacctaaggtgatctgcctgccttggcctcccaaagtgctgggattacaggcgtgagccaccacgcctggcctgtttatcattttaatagaaagtctaactccatgttttatgtttgactgctgacagctttcaaatcccaacagtcctttcacccttctgccccacacagggccaagctgataagaaagtctatgagctcccttttttggtgccaacttgaagtttaaactacataaaagccctactctgtgagcacacaagcccctcatcttagttccacccactaaccactattaaaacctatggctgtggaccctctttgctctctgtcaagacattttcagatccgctttggaggcggacctcctttcccagatagctcacaatatgagtcataagagtttcatcacctcttgttgtatgggtggcatcatcaatcttgacatctcaaattttaggtgaggggcccatcttgcgtctgtggtgtatcaacaacaatcattattatcattgtatgccaattaatcagcaatgttttaaatacttctctggaattcttctttgtattcagataaactaaatcaacatagtggggcaaactatgtttgttggtttgtttatttatttattttgaggtggagtcttgctctgttattttgaggttggagtgcagtggcatggtcttggctcactcaacctcctcctcccaggttcaaccaattctcctccctcagcctccagagtagttgggacaactggcgtgcaccactatgcccggctaatttgtgtatttttgagagacagggtttcaccatgctggccagactggtctcaaactcctgacctaaagtgatcttcctgcctcggcctcccagagtgctgggattgcaggcatgagccaccggacccgggcatattgttcttttaaattggtgttctgtgtaaaagtcagaaattctgggttatcagtcctaaagtccattaccctcaattagtctgaatgtgcctaccatctttctgaatcttgtatgaggaagatttaaagaaatcaaaccactaaattatcttttattactccttttcccatgtataatttgctaagtagtagttttggagtttttaaccaatatttctgaaaatatctcattttgcttgcttcttttcatccattcctacatgtttagtttgcatttgtaacttatattaatgttacaattcaggctaaaaggtgtaatgtgttccaaatccactggctaggtggatgcatttttccctgctcaaaaagaatgtggtaatttttgtttctttatttgtttaagtatacaactctcaaggctgaggttgaaatttggctttgtttacaagtaacatgaagtggtgtgtagactcagactagaacttaatggatgtttttcaaatcataaaactactctgcagtttggcacaatttagaatgactggcaggctccccttagcagaggccaaagaatgaaataccaggggtgttgcaggtcagtgcactggcaggggtgtatgggaaagcttgcctggctttagctcctgcaattactcactcaagttcatgcacgataaaattgaatcaagtaaaaaaagaaaccattaaacattgatacgcactacacattgacccaaggatgaaaaagagactattttccatatgcttcctttatttatctgctttatggcataaaacaggacttaattatactattttattcccatagatagtgccctgtaagagttggaaaatgtattcattctttaaatgctgatataagaaaagaaggattgtaacatcaatctaagctgccttgattaaagatataatgagagaacaggacaaccaaaaggaaagatgtcagttcctgtcatttccacagaaaaacatatccaattgacggaacttattttttaagtgttataaatttccagttctatacagtcaccaggacctttatgtacattatttcatttaatcataaaaggattatatgttccaaattcttaaggcaaatgcattttcaattgtctgttgattattaaagagtaaaaaatcataagtttatgcagtgagtgtattttccgattcttatctccttatatatatttatataatacacaaataaaaataattgtgtcaataaagaaaaagttagttaccattattacatattaaataaatatatgtttgttattctttatatttattttttgtcttgacaactacaattttaaataaacatatcaccacaggtttttaaaaaggcactaacatgtttaatactttaatcagacaattctatggaaatttaacttctataaaaggtaatataaagatacatttataatatgtagcctattgcatgcaactgaagacccctccaaaatgggttaaatatatttaataacaaatgagatttttaccaataaaagtgtaagacagttgacaactttcatcaattatttgattgtgtattttcccctggcagataaaactgaagttccattaattggcataattattatgttgttaaggtatttgtaccctaacaggtcataaccccatttataaacatagtaattaataaattaatgcacgtggccaattatttctcaaggtgagaaataaagtcttaaaatatagacttttgtaattccttcttatcttgaaagactaataaaagacttcagatataataaatttaatcaaaatctacttgcagttataatgacaaattttacttaataaacacagctgctttgtactaagaatagcctcctcctgtcaatctctggtaattctgcatcagctcatactgtattacaaaacagcatgaattttttataagttcactgaaagggtttgaaagatggtattctacttactatccacttgttgcttggctttaaattgctatgtaaggatttaaagaaaagtacaaaacataaatcttaaatattttatttaaatcaggtactctatattagaacttggtcattctcaaccatgacctctaataccttacatagttataaatacattttgttgaattttaaaaacatgctcatatctgataaaattacttaaatacctagtgatgttgtcttattagaattaattaattgttattatttcaccttataaacatttcttatttatttttctctcagagttataatagttgttgatcacttacctttatattggtaacacatatattcacagtgaaatattgtagctggaaatatttactatagattttcttcctttttttaattaactaatttatttatttttttgagacagagtttcactcttgttgcccaggctggagtgcaatggtgtgatcttggctcaccacaacctccgcctcctgggttcaagcaattctcctgcctcagtctcctgagtagctgggattacagacatgcactaccacgccaggctaattttgtatttttattttatttgtttatttatttgtatttaattttagtagagatggggtgtctccatgttggtcgcactggtcttgaactcccaacctcaggtgatgcaccttccttggtctcccaaagtgctgggattacaggcgtaatctacctcaacaggacaattttgtatttttagtagagatggggcttatccacgttggtcgcactggtcctgaactcccgacctcaggtgatccaccctccttggcctcccaaagtgctgggattacaggtgcaagccaccacgcccggccactagcttttcatttttaactaacatgataaaggggaaggcataaagctaagtttgtctaactctacatttaagctaaaaatttgtctaaagcaatttatgaaatattatataatttacttatataatttgatttcggagacacctttataacaatctaattaaaataccaaattctgactgctaagagttctttgcagagctgaaaaatttactcatagaatttgtgtgtgagtaaaatataaaattctggtttccttaactctaccagtttgaagagtttaatatatatatatacacacacacacacacacacacacacaaacacacacacacgtacacacacacacatatacatatatgtaaatatatgtttatgaccacagatgtgttcctgatctatcagcattattggaaaataacattatgttgtcttaaggcatcgtgcttaagcacaagatgggctagttcctttgaagttggacatttgaactatagtaaactctaagcttttgcaacataacttgccaagggatagagatggttggctctggtgccaagagctattaatacatcgcagtcaacaacctttcactgtttgcataaataatagtagtatataaccacaatgcaacatcttaacagaaacataaaatacagatagggtttgaaccatatctcagaggtatatccaagtgctaagatgtcggggaatctgcttgtgatagaaaagatccaatgtggagcctgattgaaggtagaggagggcagcaataatatagaaaagttccacccaatgaatgcatgtctcaagatctgaccactatttcaacatttttcacaccactcctttaaggtactatatcatcatagtcttaataactttgaaaaacaaatagaactatagtttataaggaacaataattgtccttccctactttataagtaggctctttctacatatttatatacttccacatataaggtttctgagataaacatatctttatatatcataaatatatctttaaaattatgtatggtgtccctagaaataaagtgctaaggataaatctgtcacagggacaaagtttcataagatagtctaaaatatgttattttgaaagaggtttatataaatgagaagacaaaaatgtaccattttaacagaaacaaaagtgatacaacagcttatcggcatactactataatagaatgtcttttcattgttgcttttttcttaattcttttcattgttgcttttttctttaacagtgtacttaaaaacacattttaaatgataatgtgacttaaatgtctctcaataatgggataaagcaatttttcttcagtgatctatcctagatctgaagaaaagagaattatcacccatcatttgctaaccagcaaccagtatttaaggctctaggactataagcactctacactttggaaagctcgtcaggtcagacaatcattttaaagatttttgagtatcaaatgtgtaatctgacaacatcctctttttgaaaagtaggttttcttcctactgaacaaatgcagcttgaaaataggaatagccaaagtcttgagtatatttcactttaatgcttatcagcaaaatgactaatggtcctacatttcaatgacaaaataattttggacattactacataaaaatagggaaatgttcctcaaatatataataaaatttcagaactcaaattctgtcccgtacttacctagaaaaacaagcacataaataaaatgtaatttttttctggttcaggaaatggtcgcatctctcttttctttaacttttataagtttaagttttagatatgtaaaagggagaaatgtcaataaaccgaactgcattagagacgtattttactgttccactttaaatatggaaagacttctaagacaactgggcagagcaaactcccacaagggtgtggtttctatggagcccctctttcatacaaggcctacatatggcacctgttcagaagctgcatatcagagatgtctttaggactttactcaaaaggtactgatggaagatgcaaagtggggagagagaattctttcccttccctgcatgcctggaggtattcatagcctaccatgaagatgaaaattgtgtggctgtattgttagatatatagttttcaagcatgaggggtcatttctttcagatattttagcatgcttttgaaaagggctatttacactatacacacaggccttaatacaatctggtttatggctaattagttcaactggttgtagcacagagattataaatgtaaagtttattttaatcccttgtttatttattgattgattttgtatttattttgatccaggtaatattgtccttccattcaaagcataccatgtttaattgagcaactactcaaaaataagttatgcatatagaccaagagaaacttgcacaaattagtgtaaagaaataactgaatgtagaagtataaataaaggaaaaacagttctgttgaggagccgtctctttcagaagttttctctggaagaaccccaagctgagcaaagttctttcttattgctagacaatagaattcttggcatttctttctttacttcctctcttgtatttatttttatatgtgagttttcctaaatttgtactattattccatggaacacaaggcacagcagaagctctttgaatatggattccctgatcaaattaggctggcatattataatagagtctcatcttcaggaatgaatgcatcttagcacattcgactatataagaagtagtgcaaacaaagtaacattttttttaaaaccctgaatattttcagcaactcttattcaggaaagggacacaactatcattagctttatcctaccagtaattataaatatcccttgggaccaacattactctattagtgagggatagtattggcctgtgagtaaatgaaaacacaaacagacccataaacaaattacatgtgcatgtatttatttttttttctatgtaacaaaaattctggaaagtagctgttcttagtttgaggttagtggctcatgtgtatattaaagccttgatatgtgatattatcttaacattttcctcatgtctccatgaaggaaccagtagttctagctatcaaatccattttctatgcaaaagagagaagaaaatgagaaagaagaaaggtaattttctgaaaagcctcagcaaactttagtttattgctcattggttgcagcaaagtcacagagaaatctttactgcaaagaagtaggggaatttttttttttaattttacatattttcacctaggaaaatatcagggtctattagttaaaagtgaggaaagaacaaatattgtataaacaattggtactaattgacacaatttcctgggtcaaaatatggaaagcattatatgcctttctaggagaggatccatttttattgaatgttgcatccttatcaatgaagcataatagatagtcaattagtaatattaatgtgagccctatagaaagggttctagcaacatataaaagtatagtttgcaagaggtacatatgaataacaatgtttgcattgtacaaaaacttcaacggccagatagatggatacatagcaaaatagggaaaaatagaaaattccccattacaaccctaactagtatattaaggatattagccatagttcttgaagcaaaatttgaccaagtttgaccagcactgtacaggtaagagttttttaatcgtgtgagggaccactaaagctgttaatggaggcaggtcatctgctgtagggttcattaagcctcaccaagactccaatataatagtcctacaggtcatatgacgctttttctctaagtgtaggctaacaaataaactttcttatttcaagtcaacctataacatacctcaatatcaacagaagaattggggcagggtggggatgacagagagcaacacatttctgctagtagaaaaagtttctcatttacaatttcacaaattgttctcattttacaattttacaaattattctaaggttttattgatttatagaatgtagtttgattaatggttcttaccaagggttttttttttcttttaagtcactgccagatttggtgctaagtctgtttccagaactgcaaaactttagcaccaaaacttgacctccagtagatacacaaagatgttaccatgctctagagtctgtgaaaaacattagtcttttgataccttctcagatgtgaaagcattgtctaataaacatgtgtttagagcaactttgacctgtgagattaaaaaaatctcattcccctcttccctgacacctaccttacacataagaaacacatatatgaataatatatttatagtatatgcttcattctagtgtctttttctatataagtagtattgtgtaccatcaagacattcatcacataactgtagacataacaaacatatacatatatgttatatatatatatataagtgtacatatagcaacacttggtgaatttaaaaatatagaagaggtggaagatgctaagcaatggaggaagtaacaatgacagattgctgtatttttaaagatgaatactgttattttatcttccatctcttggtgctatatgaggaataacatgatatttggttgggatcgtgttttaatagagatgtagttgcatggtaatttcagtaatggatttctctaagtttgtaatcaatcatgagctaaagacatgtttacaaacatgataattcagattaatctgatgggctattgagagagagaaaagacagagctctagcagttgctgtgggtggaaaacattttatgagcctctcacagctctgagacagtgaacctccgctttttaaaaagcttaaaaaaagaggtaaacaaaatttaaattagaatacttaaccatatttaaagttgggcaaaagtctgggaagtgacagaaactcatatattaattgactcaagattagaacatatgcggaatgagctttccttttaaatgtaagtaatcttttactctctatatataagttgttgctttttctcctcctaagaataaggagaacttggctatcaatcatacacagaaggagatactctctgccacccagctattaaatgaagaaatgtacattttctacttcatatatcaggcctactgatatattttcatctatggcatcaatcactataggagcttaagtacttgaaaatgggaacccaaggggctcagccaccaccaatgagggctcagctgttctgtgaaagcctggaaaagtgaaacatctgaaagacctaaaaatacagcttagagtctcagcgtaagcactgaccatgtggtgtccctggctcctggaatcacacagaggatttgaataacttgtgcaaattctaaagacaaagaaaaaagtggtagcactgagtttctcactagtgatttccagaatgtgaaggaaaccaggcatcctttgccactagattaactttgagcaacatcttagaatgctgggagatgtgtgcactccaggagaactgccaatgtcacagacaaaaggtttcagcataattataaagtctccatgggggaaagaagcacagtatctcactggagaaatggaaatgatctttaggacactgttaatgtgcataaaattctggatagcaaccaactgtgaacacataaccattaaatcgcaaaggaaaataagagaaaaaaattgcatgtgtctgctttgaacattttccacaagcaacttcatgtatgagacaattatggcaagtttaaattttgtggttttgttcaattcaaaaggaaagctattatattaattacatcaacttatagacactttgtcttatcaatatatgtcctgcgtaatactcaggattatagaataattgttctgtgtagcatataaaaactgtctcctggtattcctaattcttaaccatgtattattaactaatgtaagtactgcttttaaaagtagttgaacataatgcaatgttgtgtcaaataaccctgttagacttctacatccaaaccgaacagccctctaatcaccagtgagaatctagagtttcaggagttgattccgatgaaggattagcttttaactaaaggaaaaaaggaaaggggaaagttgggaaaatagaaaaaaaattgtctatcatttagtctaaattaatccccttctcccccatccttgcaagacaaagtggctatgctacaggatgaaggtagcaggactcattccagcagagattaggtgcaacttggagtatgtacgtagcaatataagagtcaggctgagaactacagagagaacttgacacagatcattatgtttagacccctgagggccatgtccctatccgtcagtgtatatccactccagaagattatctcccttccttaaggagattctagtctgagagtataaatccttagctctaggaaaagccatgtgtacttctatgttgtttgtcttcttcataaaaactatctgataattcttgggagtattccactgtacttccagagaagagaccaggttttaaaaagatttttttttaatttagattaaaaggtaatgaaaaaataatggttcacagaacaattccctcctcccaaccaatgtgtcttctatcattcctcaaaattgttaccccaactttattgtgttacccatcctcatctttcctttaagcatagtgccttgaacgtttccaagtatttcacccctctggcaggattgatgaggatggataggttggatcccatcagtgacattttcagaacaatgaaatctaagtgcatcacagatgaaagaagagaaaagtgacttaagggactgtctgattacaaatgcaaatgcaaagctgctcctgacaataacccattgctaatcaatttcctataactttcactacagtttcctattccaaacattcttcactatccacaagtcccctttgctaaactattaactgacaaaataaatcaagtactttcttttatacatatataattttttaaatttagattcagaggatacatgtacaggtttgctacatgggtattttgcgtgatgctgaggtgtaatttggatttcctttaagcagagtctgacatgatgatttgggtgaagttagtctaggatttaattccaggaaacagaagtgagggagtagggaaggatgaaagacaataaagtgtgcttcactgagctggttgctgatttaggcaaatggaaatcaatctttttggagaccctctgaggagtcctgtagaacctacctcagaattaccacactgaaagacaggaaggctggtaaaattagactcatttcacccattggttgaaaatggtccttgggtgcacacaaacccaaaggcacatacactttggagctgagagagtgtgttttagagaaagcctaaggcaaaaaagcagaaataccccatgatatgtgcttcaggtgggatgctggaaagatgcaaagaactatctatctcagcttcagctcttctgaaattggttgggcaaaagaaaggtgccaccagtggccagatataagctttttctccacctctacctctctttctaaatgttattccacacatcattacatatattggcatggttcccatggccttattcacttcggtattaactttcattctcctatggctgtacactgtacacacatttctaaacttgcccttcataaccaaaaccaggtctcccttaatagcatggagactttgacacaactctgtcattaaaattacatattaggctgagtgcagtggctcatgcctgtaatcgcagtcctttgaaaagccaaagtgggagcatcacttgaggccagaagtccaagaccagcctgggcaacagagtgacacccccaactctgcaaagaaaccttaaaaaaagtagccatgtatcatgtcacacacttgtagtcccagctacttggaaggctgaggcaggaggatccctcatgtccagaggttccaggttacagtgagctatgattatgccactgcactccagtttggactacacagggagaccttgtcaccaaaaataaaaaataaaaataaaaattacatatttaccaccgtgattcatgttccttgtgctatggtttgaatgtctatgttcctcaaaaatatatatgttgaaatcgtgaccctgaaggtgacagtattagggagtagagacttttaagaggtgattatgaaggtcctgaagaagaaggcctcatgaatgggaattgtgcctttgtaaaacaggccctaaagagctgccttgccctctccacatgcattaagtctatatctataaaccagacatggaatctgccagtaccttgattttgaaatttcctggctctattatagaattataagaaataaacttctgttgtttacaagttacccagtctatggcattttgctacagtaccttgaatgaactaagacaacttgcttcccactattgcttccagaccattcatgttgggctttggcaggatccaagctgagaaagtaccagcatatgcccagaaaaaaaactagtgaaaaatgactttacattattcagaatcctgagacttgaaacatgctgtctttcatttctaccatgtttggttactacttcaagtactccctttctgcacattcatccactcagtcgaattttctactttgcatgcatgttttcaacacctaatgccaaatcacttctctatggaggtgctttggagtcttcaagcaaacatctctcccacaaattttcaaaggattcatgttatatcacttggctcaaatgaatgattgtctctttttattagtacaattttgcagtcatttcaagaggttcatcctcctattcacactgttaatggagttttgaggtggtggtatcatttttttgtaactccaagttagtgtgtgcaggccattcgacactaatagaacagaaaaccaagcttttttatctgtattaagaatttaaggtatcatcattccagtccaaaagtttctaaattctctaaatatgaatgagctatcacaccatgcttttggatacctattgctccccaaactcttaattttgcaatcacagagaatttcttgagtgctgaaaccttaaactccatcatgctcttgacccaaacttattatttcacactcttctcattcttctgtcttttttttctacatgatcatgtgtaacagtgtcttgacccttttgttaagtttttcagtttttcctcctatctccagccatcttagaatcccataatgcatcacatttatatccctaccactgtggacgctagatcaaccaattgctctttcctctctccaacttccattctgttgtcaaaaaataacatatctgaatgcaagaggagcactgcagatttatggcaggagatttctatttcctttcagtcttctagagaaaagagaaagaagtggccattctgctctcccatggaaagaaaaaaaaaactcacattggataagcaacaggatcttcacatggcaacagcacaggttgaggcattcctatcttctctgtatggaaaaaaggaaacctattcttgtcctaaattgggtcccatgactctcccaatagatacaatccagtttctggagattcacgttgcttgatatagtagtcttgatgatggagtttatgatgactatttgtcctagggtagatttatttacagttcaaagtgggacacaagaattcagctgaggcagtctgtgcctccagttgaccattccctgagcccatcatagtgatcactagcaacatctccatgctgagaatcacagaagcacatctggatttgttatattcctgtccatccagcctaaggaggagagaatgtagtaggatacagcacagtccccacccaggcagaaagcaaagtaataattgcatgtggaagatcatttatgagcatatcttagatcctagcagaaaatgaaaaacacctagaaggctgaaacttttgtgattatgcttgagatgggtcaagtcatagactcatatgttaacaatctttattttttttttttttacttaaagatgtaatggttatacaggaaaaaaatcctacacataaaatagttcacaaaaaataattaaaattctcatccctgagttgtattccaaaaagaaacagctataacttgtttgttatgtatacctccagagatttttccaaaatatgcaagtatgtacatattctctccaaggatagacattcacctgtgtactttctttttataacacaaaatcatttcatatgcaactgagtttcatctggctttatttacttgtcaatatattttaggactctttctaaagtggcatgtataaatcaaacaaatccaattcattttaagaactgtgaatatatatgtatacacacatatattcaaagagagagagaaggagaaagaactatgcagctagttttcttattaataatgtttatagtgttttaaaatcttccagttacacaaattagtcaatgaatgtaattaatatatgtttttactcacttgtacagctatatctgttagatttatacagtttaaattactgagttaaagtatgctaaaaatttacattttggtaaactcagtttctgggagactgctgtttttaattttttctaccaatattgttctttaatatcccctttattatattttcttggataagtagtgtgggaaacatgtttgacctgatttccatacaagaacatcacaaagttacatttcttaatctcttaatcccatgcaaatgtccatcccaaatctactggattaagagcttttaatgatgagaccttttagtgtataactcaaccctttctgcatgccgttaaactctactgttccttgcccttaaatggaaatatgtttcctcacttaaattggctctttttcaggatgttactttttccccaatggattttacttctctggtgaagtcattcaataatctcatggacctttagcttgttcacctgaacaaaatagaagcagcaaactataaataatttccaggaccatttccaggtgcaatcttcttagctccatactttttcatatctgtgtggctttaaaacatacttagaaactttcagagtaattactctcttcccttattaatttaaatattccagctcaatttttctgatcattgaatattatccacagttttttctttaaccctctagtttcataacagcatcaggtatttgagaattccaatttccaggataatatattatttgacctttgctattaacatttttatacatccctaaagatgattaacaggtttatacatttctttttttaattttttttgtttttgtttttttcaagatggagtctcgctttgtcgctcagactggactgcagtggcaccatcttggctccctgcaagctccgcctcccggcttcacgccattctcctgcctcagcctcccgagtagctgggactacaggcgcccgccaccacgcccggctaattttttgtatttttagtagacagggggtttcactgtgttagccaggatggtctcgatctcctgacctcgtgatccgcccacctgggcctcccaaagtgctgggattacaggcgtgagccaccgctccaggctatacatttctaaagatcatgatgtctaccatttagataagaatgtgttagagtagtgattaaattgccacccatttccattgctctaaattatgaaattgttataatttatttgactggtccagctagagtctttgtaaaagatcagttaaaaacaaacaacacacaaaaaacctttaaactactgtcagaaaacctttccactgcaacctaaaatatctaaaaatgacctgattccaaatcctatattatccaatttttacatagctaaaaccaagccttatatatttgtcaaagtaaggagtatgttgtggtgcttccagaagaaaataaaagacaaactcattagttacaggtacaacaaataaaattcgcaaaacgttttatcatatacctaaaaaatggttatcttacttcaaattgtatcaataggaaggaagatattacctattacacaatagcagttagtcttcagatgtgtttcaaacttaactgggggtattcccttgcagttctgggctgaaatccaagctattaggagcacttgggtttttgcagccctagcatgcctttccccacctccaaaactacattcgatcaaacaagattagggtaaaccagtctcctacaaaaggcaagaatactcaacattctaattaccggccttgaaaatgtattcctttttgcacacagacaaatcctttttattacatgaaaacaaatatgccctgaaatttggaatactcagataattttaaaaattgaaaagaagttttacaaacaagtgctagaaaaaaaccacaaaactcaatcatcagaataaacactgccaaacaaataagaaactagattcctctaagattctttcaagtaaaagacattgtaaatattgagtactaagaaaatatcaaattagtgaataaaataaaaaggtcatggtggggcagaagaataaagagcgtgaagagaatagagaaaatacagggaaatgtatgctagtgaagtaaaaatgaaatagcatagttgatgagaatacatattaattataaaccttcagattacaacaaatttcagtaacaaaatagtttttaaaacataaataccttttgcaactgttttttatacttctgaggcctcatcctaaaaagttatctgagactgcaatcagtatttgcaaccaaagatgtttactcaatagtatttttgtagtaaaaacaaacaaaaaataggactgatctaaatgtcaaactttagagaaattactaagtagatcatttcctatcaatataatagctatacaaaatgttaggtagaaatgtaaaataattcgaaattttacaatgtatgtgatcttaatagagtggtaaatatttaggaaaaaaaaacatggaaggagatatgctaaacctggttacaaatgggggatattatgaaaacagtgtttttccatgacactatatcattttaggtatattttatattttctatagggcacatatattactaacattcctatttaaaatgcaaggaaaaacgtagaaaatactgagagtcacgtggtgatacaacgtaattaaagaaaggccctcaaaagtttaaaagtccttaataattgttacttttcctgtttttaatccctaggctcaaattttgttgactttaacagagccctgaaatcgcaccaataagtattttgttgacaattatttttacaagatcttgagtttttaatgaacatctaaaaacaggaggaacacatttaacaacaggtgtgggcagataaatggattaaaatctaaatatgagattaattatattttagaaatgtactgcgggaagatggattggtacaatacagtaaaaatacttcaactaattttaagcaacagatagtgatttgctatccaatacaatcaagagtgaaaaaaatgctaacttggttagaaacgttgaaaaaataatacaaagaaaacgggtaagtacaagtaatatatcagttaaatagcagacatcctatgaaattacggatataccaggtggacaacattcctgtatggttatattacttatgaaaaacaggctgaatttacttgtaattcaggttttcaagcacataattgaaattacaccatggctttcattacaaaggaccatttgattaaaagaaatgcaacccagtcaaattagtagaaataacagaagatttatattaaggaaacaaaaaacatgggatggaaagaatttcatagatattgtaaagtcataagcatctgttttctgcttctctttttctctgtctctcatttaaaaggatgccccatcctatgaaaggatttaaaaaaataaaatgtcaacataacacagtattgtcaaaagattagcagagagagtgaatacctgtctccaacgcagcattctttctctctttctccctctctcctccctctccctaacctttctctttcattgttatgtttgattttgtttttgttttttccttttactgggctgcacaactcagcaaaatgtaaacctgcttaagttagatccagctttcccataacttgttattcacaaagttttcactgctgctctgctatcactgtccccaaatctccaaacctgtacagtttcagtgcttccaaaactttgagtatatttctgtgttcctggttcaaattttcaaaagagaaatctgatgggctcagcttagattaaatgtttacccctggaccagtctactgcagcaacatatggaattaccttagaaaaacgtaggcagctgggataactcctcgggaagggctaaggaggtcatttccaaagagaaggcatacagtttgcagaagaagtgtttcagacttctctactacatagcatatatatttatgtcacgttctaagaagcatgtaaatgttttatagcaaaattattatcatcaggactgttttaatgagcctgtgacctgtgcaatttgcacagcattctgcacagagaagagcccaacacatgtgctctgttggaatcttgttgaaattcttaatactactggaacaaatggcccctgcattttcatttcatactggactcataatttctatggttgtatctgactacagtccttgctactgaaatgcacaaattccttaaactggacaaggctaatatgctgaaagagtgccctttttgactccttcagacttagtgccccaaagaacagaagataaaagtagtcactgacattctaaaacagtaatttaagactatgctaatacactcaatatattgaagtatcaccatttatcttaaattgtattaaaatccaatcatctttgatatagatcattttagatgggatattaattataagtagatgatggaggaaaaaataataaaagtttcagagtcctggtaaaagtaatttgactttaagattcttgataatattcctgaatccctagtgtttagcaaatccaccaaggagatgtaccttcatacacatttcatcatgttgtctgaaccttctctgacccctctccaacctctccagcttgagaacacagtaggtgcagctacttagccatgtggccttgggcaagctacttaacatttctcagcctagttaatttattacagcatttaccatgatgttttacaatttatgtcactttttgtctacctaccagactatttggtaggttcttcccaaaggggggagtttcttttttatttttgtattgcaagtgctaaatacagtgaccagcacatagtacaacctttacaagtgtttgaagaatggatggatgaatggattcactcaatgagaattttgtaagcatgtaaaaacaatattccctagtttactaaaaaccaaaacaaagcatttgtttaaggaaataaccaccagaaaaacaacacagtcttggaattgcaactcttttcacacatcttgttaggaattatgttttaaaaggtatgcatgtgaaaggaaaaactgatcacctttaccagaattactgaaaatcctatttctatattatatattttgttggggaggtttccacatccggaggcttggagacaaggttaagtaagcatcaacttcatgagagtaaaaacaaatgtaatatgagttaaatacaggacttagaaaatagaaaaacatgaagaccttaaatgcttccactgaagagaaagatttcttaaaagttttaagaatcccatgaggatctgatggaaaaacctatcttaaggacattttatatgcatacaaattatagtattaagttgcaggggttatacaagtcctctaaaatttattcatgcacatccaaatgtatacagacttgcaatattaatttactatgctatccattaaccaaatgtgattatttaaatttaactaaaattaaaatttcagttcttccatcatcagtcacattccaaataatcaatggccacacagttctatttaagttacatttttaaaattattttttgttttagaaataatctctcatagtcccaacactgctgatacacactaagctttctttctgaatctaaaataaaaattgaaatttaataagaagtacaaatgagatctaattaaactaaagagcttctgcacagcaaaagaagctaccatcagagtgaacaggcaacccacaaaatgggagaaaattttcacaacctactcacctgaaaaagggctaatatccagaatctacaatgaactcaaacaaattcagaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcaatcattaaaaagtcaggaaacaacaggtgctggagaggatatggagaaataggaacacttttacactgttggtgggaccgtaaactagttcaatcattgtggaagtcagtgtggcgattcttcagggatctagaactagaaataccatttgacccagccatccattactgggtatatacccaaaggactataaatcatgttgctataaaaacacatgcacacgtatgtttatcgcggcactattcacaatagcaaagacatggaaccaacccaaatgtccatcaatgatagaatggattaagaaaatgtggcacatatacaccatggaatactatgcagccataaaaaatgatgagttcatgtcctttgtagggacatggatgaaattggaaatcatcattctcagtaaactattgcaagaacaaaaaaacaaacaccgcatattctcactcaaaggtgggaattgaacaatgataacacatggacacaggaaggggaacatcacactctggggacagttgtggggtggggggagtggggagggatagcactgggagatatacctaatgctagatgacgagttagtgggtgcagcgcaccagcatggcacatgtatacatatgtaactaacctgcacattgtgcacatgtaccctaaaacttaaagtataataataaaaacaataaaaaaataaacaaaaattcaaatgaaggttgatgtccagtttaatcaaatatggagtaagaataagagaatctacacacatgcaaaactcaaagaaatatcatacatccaatccccagaatacagtgcataaagtgctgtaccagtcgcagtaaaccaagaataattaaatgacatttaaatgaagtatgaaccaattaaaattacaaatttagttcctctgtcacactaaccatatttcaagtgttcaatagcaacaggatgctagtggctaccatactgtacagcataaatatagagcctgtccatcactgtggaaagttctgctgaacaagactgacacagacctcagagagtgcttaacctagaagaagtgtgatcttgatgaatgtgggtgaattgggtggggagaaattctgttcggataaagtgtaaatatgagtatttcgtagtgagcctaaagttgatttttttcaattcttccaaatactaattccatgaatatataaaattgacttcaatgcaaaaatgacaaccaacagtagcattgtattttagatggtgtctagattttggttttaaacagacccatggttgaaatccatgtcttctgttttaagctgggtgaaactttagagcaggttattgactttttcatttgaaaagtaggaatagtagcacttatctgtcagggtcgttttataagatggaaacagaagacctgaagcacttatttaacaagtatatttaagatatggtagcaaatgtaaagatacttttgacatggagtagtctcagattccctttagtatgtttgattgattttaatgatcagtgttgaataatttgtgttatttctccactgcaacttgattatactgaacgtgattatatgcacttatcatctttacacccctattacctagaatactgcatagcacacatcagtctttcaaaaaaaatttgttgaatgaatatgtgttcaaggctacagattcaatagagaccaaatataacccaggaataaaacccaggactcccaaatctgtgtggtgattcagttcaaagtgcaatagacagagaaggaaaatgtcttcattttctattttgtgacataatctttctatcctcagaaggtttcactttttgttttgtgacataatctttctgcactcaatttccttctctgtaaaatgaagaaccgagattacatgatccatcagcacttcagctgattctctgactcttggcttttaatattaatatctcccccacttatactatagcatatcccacaggatataggataataaaatcctctggcttataaataagtatgtattttatgtttcagaggtcaattaatgccacagaatgcctttaattgtattactgctcttatttatttttgtttaaagaaggaatatttaaggctacatttgtaagtaatgaaagaaagtataatacttgcaaaacataaactgataacattaattgaggagtgaaacatattccattatctcttttgtatttactgctctatctcattatgaatcctttcatcctatatgtgagacatccatatccaagaacctgaagatgatggtctgtcttgagatataaatcactctgccaagtgttctttttacctatgtactatgaccacttctctgaactcaaatagaaacatctagtgagtattcagttcttcttcaacgtaatggagggtttcttataatgtaatgaaatgttcgttaacttttttttttttttgctgcctgtatgttcagtgtctataatcagcacaattagaagtaacaaaagctctttgagaaaactgttctgtatgtttgtctgttttgttaagggaagagcagcaatataataataaaagttgaaagttactgaagcattttagttcatgcatctatttgaaatacaaatgatccaaaactttaataatagaaacatcttgaaatcctgaataattattttattatattgatatcacataaatatgagtacatgaatgtactttcagaaagttaatacgtcattaaatttattttccatatatttatagaaaactgtaatgttaattgtaatgtgccatgcaaacaagtattatttcactgactcaaattttctacatgcatagaatagtccaaatgacacagcacaatgagtcagaaagcctgtactgcagttccatttctgagccacctttcagtcatgtgactataagcacattggagacttagagtcaagatttgctcagatacttgatttatatcatgctttgtaaaatgatttgtagaaaaaaagcaaaagccatatatagatacccagccatgattgttgtaactatatttaaagtatgtagttaatatataagattcacatttaaaaaaattatagaaatgatgagacattaaggcctaataaggaagtgaggctactacagagcctagacataatctgtgggaatgcctatccttcaaatattccctagggcatgatatctgtgtaattccccacttgtcatggaaaattgctctgaataccagaaacatgctaggacaaatacagcattcctgactgtcagcagtggttttcctgggtttggtcacatgactcaaattgagccaataagaactcttccttatgatttgttaaaatccagctggcagaaaggaatcctttccttttgaagttaaagttatgaaggtgtaagttctaatgtgccattcatcatggattcaggtcaggaaaatagccagaaggaagaaatgagaaaaaaagagacagaaaactatccagccatatgtacacttgtgacacaggcacagatgtgtaccccaacagtcctaagactcaaatcatatttctcattatttgagtatggaaaccagtgtttccctcttaatattttagctaatcctacctgactttccaacttttatcataaatattactaatgaattagttacattatttaaaatatatttatttcaatgtagaaattcaatttcaaaaattatgcttaaataccctgtcattgaaacactgttgttgttgttgttttgttgttatcatcgttatttttttttatcttttaaattttggaggaggtgtgcagacttttgctttacgtgtctaaatggttgtataaataagatgttttgcttttgaacaaattttgatgttgagtaaaacaatttttgaagtaactgtattatatcatatatagagtgacataattatttatttatttatctatttataaaatagcattggttttgtggtatgtttaaagagacatgtcctgtgtaaataagatctataaaattatgtttgatagaaaagacatactctacagcccacttattttgaaacatcatctgtgccagttgtttcccctacctacatcctctttttttctctctctcttttgagaaaggatcttgctctgttacacagactggagagcactggtgcgatcatggcttactgcagcctctggggctcaagtaatcctcccacctcagcctcccgagtgctgggactactcgggagtgtgcaccaccacactaggctattcttttttttttttttttttttttttgagacataggggtttccctgttctgcctaggcttgtctggaattcctgggctaaagtgatcctcccacctcagcctcccaaattgctgggattacaggcacgagctgctgagtccagcctcatatccgaattttaaaatagacgaaaccgttttccagtgaactatattttccctgatttcttcgtaactgacttcttttaaattttggcagtaggaggcactgaaggaactaagaaggttgattaaaagaaaaaaaaaaaagaaattttctgcttctgtttctagcagtatgatagttcctggaagtggccatattagctgggctaaagtgattctttccaagggcagatagcctaagaagagctatatcctttagagcatttctagcctcaatggaggcaacatccctgttgaatccatggctaactgcaagactaatagcacaaaattgggtgcagactcaggggctcaccaatattacttttgattcccaaattcactcttatctaccttttgctgttctagcctttcaaactcttatgactaatttactgtattaactacctgccccttctcatttgaaacacctagaatagttttccttttaatgaatagaccataatgaatacttacacagcattctttttcattttatttttggatatagtcctgagaaagttttacatgctattcagttaattaataacctgtctaacttcatcttctctctttcataaataaccagttgactatattagggcatgaagtccaacaatgatggcttggctaaatttgaaactttctaggcctctaattttctaatcaattacatgaaggaattcctaatgtagcatattttttataagccatgtattgctcatcatttgcctacagacactgtgatatacataataaatttgatttctcaaagattacacttaaaatatacaggaatatatatatataaatgtaggcacgtatttctatttaaagacatatttcaccaaaagaccctatcatctgccaaatcattcaaacagaaacttaaaattattcataaattagattatgaaaataaaattttaagtaatctccctcatgctcaacttcatcattttaatgctctttttctactgtataaatattccttggtggttcataattgcctttaagatttatctgtataattgaacaattatttttgtagcaaaaattatggaccaagcataatgtattaagaatgctgaattagacacaatcttgactttatacagtttatgatctggtaaaggaaattgactttcagaaaaacagcccaacaaataatttaggagattgtgtttatagtaagtactgcaaaattttaaaatgctgttacggaactgtataaatttttaaacacacacaaacacacccctttggataatgtataacaacatcagcagtaaccaggcttcctttcttaccaatccctaacttatacccagtatagcaacctagcttactatagccctaagttttctcagacgtcatcttactcttttacttatctgagcctttgcaaattccatttcttaactctggcacacatttacttcatcactttttccttgttaatatacagaaaaatacaatacatatacatgcacacacccacacacacacagtatgtataatacatataaatgttcaagcccctcctttttctctaaggttaaccactaatttgacttttacttcatcattcttctgcttttcttcataattttgcttcctatttacatccttaacattatggtataaggttgtctatttttgagttttatgttaatggaaacatactacatgtattgtctttcatgtcttttattcaatatcatgtagaattcatcaattttgttgggagtcacggtaatttgataaatttctttgctcaggtactcatcacattaatttgtcactatttaacaattcaacctttgtgagcacttgtgcctttccaggtttttaagatgatgaacaatgcttctgtatatattcatatatgtatattttttggtgtctatttaaaagtttttaaatttctatctagaatttgctggattgtagggtgtgtatattgtcagcttttctatagaatgtcttagtattttacaaaaaggatgtgccaatttacaactgcagtgtatgaaaattcccaattgttttacagtcttagtaatatttagtattgttagacttaaaaaatttgcaactaacctggaatgtaatttttaaaacttaagtagattttcatatgataactggttatttcgatttcctctttgtgaaatgcctaaggtggttgtttttctgatttgtaggagttctatgttctgtatattagttaattagctgtctgttacacatattggaaatatgttttctcattcagtgtcttttcttttcactctcattatggtattttctggacagaagttcttagttttaatgcaactgaagtcagcttcttctccttcatggtttgcgtttttttgcgacttaagaaattttcccttaccttgagtcatgaagatactctcatagcatcttccaagtttttaagtaacttctttaggtatcttccaggaactgatttgaatgtggaatgagtagggttcaaaatcattctctcccttatcctcataggaatagtctgtttatccagcactattaaaacatttcttttcattttcacatgactacctctcactcaatatttaggattctgttaaaatgttttatttactctataaatacttctgtgaaactccctctttccttcctgagcaatccctatggtacgtgactctccacccatgtgcttacatagtatgtttgcttttctctctcctagtatttagtaattagtgttgtgagagcctacatattgtctctctcagtgaactaccagtgcctttaagaacagagatacactaagtaatctttatatttcatatacctagaaccatttttagaataaatgatatgacaatccagacttcactaaatcttaatttactgtggtcacaaaatgaaaatgaaatacttcttaatgtgtttcaaggaaaaaatctatcacatattcataataatacaaatttcaatttttgagactattattaggtaaatactatagcttttctgcaaaaaataattagaatataaaacttctatttccttaagtgataagttttcaattgtaattttatagtatattatctgtaaccagtttccaaagaacaccaccataatgtgaccttattttgaaagacaatctgaagcaggtcaggttgtattagagtgggtgcttatagccctacccttttgtttttccttgatatccatgagttggtctctaaagttattttagaatctgatagtcaaatggaataaactgtaaaaatcatgactctctgtaacagtaaatacaaacttttaaatacacattgttttaaaaaaacctttggtttttctactaccaaataattatttgtctctgaatttttgtctatatatatacatatatatttagtgttcagtatttaaccttctaattatgtatgtatatagtttagaattcaggtgtcaccagttaaaccattgcattaattttcattaaattattggaaacaatcaatatgatttttgcatttttttgtcttaataatatatcattgttttattttttatttttttattttttattttatttatttgttattttttaaaattttattattattatcctttaagttttagggtacacttgcacaacgtgcaggtttgttacatatgtatacatgtgccatgttggtgtgctgcacccattaactcgtcatttagcattaggtatatctcctaatgctacccctcccccctccccccagcccacaacagtccccagtgtgtgatgttccccttcctgtgtccatgtgttctcattgttcaattcccacctatgagtgagaacatgcggtgtttggttttttgtccttgtgatagtttgccaagaatgatggtttccagcttcatccatgtccctgcaaaggacacgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtcttcatagcagcatgatttataatcctttgggtatatacccagtaatgggatggctgggtcaaatggtatttctagttctagatccccgaggaatcgccccactgacttccacaatggttgaactagtttacagtcccaccaacagtgtaaaagtgttcctatttctaataatgccacatatctacaactatctgattgttgacaaacctgacaaaaacaagaaatggggaaaggattccctatttaataaatggtgctgggaaaactggctagccatatgtagaaagctaaaactggatcccttccttacactttatacaaaaattaattcaagacggattaaagacttaaacgttagacctaaaaccataaaatccccagaagaaaacctaggcaataccatgcaggacatacgcttgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttacaacctactcacctgacaaagggctaatatccagaatctaccatgaactcaaacaaatttacaagaaaaaaacaaaaacccatcaaaaaatgggcgaaggatatgaacagacacttctaaaaagaagacatttatgcagccaaaaaacacatgaaaaaatgctcatcatcactggccatcagagaaatgcaaatcaaaaccacagtgagataccatttcacaccagttagaatggcgatgattaaaaagtcaggtaacaacaggtgcattattgtttagagtaagactttactcttatctccagaaggctcacagccaaagtagtgctcaattttaaaacctacaccagtattcccggttaacatatctatttcttctccctttcatgacctggttttctgaatttttaaattattattttaataacttattggaatacattctctttaatctgagttactaaaattcatcctgtatacttgtgtatatgcatgtctctctctctctctctctctctctctgtgtgtatatatatatacaggctttttacctccattgagtagatactatacaaatatattgtaaattagggttgataaattattaggattaatttcatagctatgtaattcattataacattttctctataatccactttttcttaattttctgttagattcaatcacacatatttctccaaagtgagacaattattgaattgcattttattcaatcatgtgaccacaattcaataggtaaattatattttggtgtgctttacctcgagtaaattaaaataatgcatataactaatgagcttggtatatttgtggatgtaaagaaaaatattttccaaatagtaaatactgcaaagtgacacagtagttctagtgttactcattagatatactcaatgtcttgctctgaatgtgttttttatgatatataatatgtctataaaataagccaaccttaacctattacttatatatactaaacaggtcattttcgtataaaactatgatctttgtcaaatgtataaagtgtaaaattattaacttatattcttggattttctaaaaaataaaaaaaagaatcttaaggagactgttcatgggtctctctcacccatctttctccttcacaaatcactggactttatgtaatctgtttttgcatttgttatccatactctccattttgataaattagaatatccaaggatatccatcttgtttgaccattcaagtaataatacattatcagactaaactcattaagaagtccaaaggatattaccacctggctactgcaagaaagtggcccaaaggtcacaaatgattatggggagctgaaattgccaaacaagattagacatatcaggagtgtgttctctctctcaattctaaaataaggcaacataattactacaaaaagatattgaaaggacagatattgatgaacacatatagtatgagcggaagaatagaacaaaccttatgtaaattggaattctgaagaacttagatcaggttctggaaaaatgcacacacatacacacacacacacacattctcacacacagtgggatgggaaccttattattttattccatggcctggcccagctttctccagcattttgctagtcaggaccatctacccattcaactccctcctttgcctgaaaatttacaaatgcgattttcccaaatctaggacatttatatggttacactacactggagattaagggtcactctgtcttcaagcctggagctcaggcttcaagtgctctattggcttactatctcctatgtcgtcagtattactggaggcactcccagttgcaaacaaggtgagtcttctttttttttttttgtacagggttactattctttccatatatggctcctttactccagagcattttaggcgatagaaatgaaggcctcaaacccataacagtgtgcagcagaatataccagaaggtcatgctgctggtttttgtggcatttccattaatcttccttactattttatgcatatttgcattatagtgaagtattttttaaaatatgaatggcattatatatgacatgcagcatattttgtttttttaagaatataaactagttaaaatatatgaggttaattattgactgcagtttttaaatctgatttttcttatgtgaaaacactatcagatcatacttgggtttcagtagatacgaagaaaattaatttagaaaaatttacttgactttgttaaagttaattaaaaactgataccacagccctctgacatttacattatacctatctttagtatacaaatattttcaggacactttggtatttctttatgagtagaggataatacctttatttcatgtgttgtcatcagatatcataaatgctgtgttaaattttaatggtttccatgatatagtaaagaaactagctttcggaatgagacaggccttgatttaaatccaggttcccttacttattggatgacagaccttggaactgtattgttttctgtgaacctcagttccctcatctgtaaagtggtcatgaccaccatcaaggaatgttactataaaactgtgtatgtaaaatgccaatatataaaacagtggtccccaaaccgttttcagcaccagggaccactttcatggaagacagtttttccgggactggggcagggggatggattccagatgaaattgttccacctcagatcatcaggcactagattctcataaggaacaggcgacctagatctctcacatgagcagttcacaatagggttcatgctcctgtgagaattgaatgccgctgctgatctgaaaggaggcggagctcaggcagtaaggcttgctcgcccactactcacctcctgctgagaggccccattcctaacaggtcacagaacagaccagtaccagtctgctgcccaggggttggggacacctgatataagaggctttgaaatactgtgcatgcttcctaatacattactctatgtattagacatacagacatagaaacagtgacaggaaacattgaactccataaggccacgattattagaaaatgaaacaaagccatattttctcaatatgtatgactaagaactcatgtacctgcatagtaaagtatagaatttttggaaaatcattaactcttccaggcttaggggctatatagggaaatacaataaaatgagtgttttaaagctgtgcaatcattacaatgataatcgggccagtatatctagctctactgtaggactcacaatttatattatctaataagtgtcattcctggaggaaacaaccattgtttaaacaaaaagtgcagtattgttaagtcattgaccatcattgtcttctggacaaatcatctcaatatcacactttgaagaaagtgatttgaccaactctttaaacttgttcctatgaggtaaagtgggacaaagaatgatgtcctcaagaccaaaaacagtgatgaaggaagctaattgcaagtgaaatccatagcataaagctgtcagcatgtagatgggggaggaagagctattcttaccaactaaaaaaagcagttgtccatgcctgtgatgtgtgtttataattcagaataagaaataaatcttaggattaatttacatagaatatttattctatgtactcaactctccactgaatcaagtaaatgtattgactccagacatgaacatgctaaatagcttttactaataaacaacatcacttttggtggaaaactgatgtctctctagaaccagaatgaaacagtgtccatccacagagctcactccaatttgccccgtttcttttttttatttttttaaacttttaagtttttttcaaggtagctgctgatgcttttgttttatagcatgtgtgcagaaaattaacaggatgcatccattccagatgaggtactgtatagaagaaccactattggatttccagatgggaaagtgattgttgagttgtcaactgaaatttgacaggatctgggcaattaccaacagaattagcagataccttacttgtgagtatacgagtagtccccaatacgtgatgcctccaacacctcccccacaaaaatagaacaagattctcaactcctgaatttagaaatatgtgctaatttcaccaaaagaattaatcttattttatatctgtacattttgatgtttttttactttatcaataaaaaacacacacgaatgttgaatgttatttaatcccaataaatctattcctgtttgcgcatgaatacaagttcccaaatgcaagtaaccccaactcaaaatcctgaaggtcgcaaatttatttctgtatacacatccagtaattattcacatttgagttcagatatcctcatagtgcacacaggtccagtcattttgttaggaacaagaaacagtatttgtatggaggaaggcaagatggccaactagacatagccaggaggaagtctttcaccaagagaccagggctcaggaagactgacacactcctagcaaattttcaggaggaaggcattgagagcagatggagagaagacacagatgctaggctgaagggggaggaagctgggaatcctgcacggggctacagcgcacctggactctttcctggcccctagtgaaaaggaaatagtatttgtatctcaagtattttctggaaataagaaaaaataataaataagaaaatgaggaagttgaaggagtaggaaagagaagaaaggcaaatgtgagagaagcggaattgtttctagtaaagacatggaaggtaagaaagatgagtaagtgaagcagaccaccatggcacgtgtatacctatgtaacaaaactgcacattctgcacatgtaccttaaaacttaaagtagaataaaataaataaattaataaacccaggacagtgaagcaggatggaagtggataggcatgggtcatgtggggagtttgccaaggaagaattccgaatgttaaaatcagtaacctgaggtatataatccaaattcaaatagagatttagatattgaaacaaatgagggacactcattctatgtaagacatctataacaaatacaatgattttgtaactacctcattgaagttcacaggaagtaagagaaatgatagatgtgtgtgtgtgtgtgcgtgcatgtgtgtgtattgttttaagttttctgggtctatctctgccctccaatcttatttttttaactaacagtttcaagtttgtcattacagagattctatccaggttgtcaggaaagcataagaggaaccgttgaacttcaaaatgctaatccattctcaggaaatgaagcagcatagtatattgaaataattactgtactctgaggtagtcggtacaggtataattccaaatctgtgactatagagaagtacacatcacccctgtcttcaggttcttatcagtaaaaggaagatacaactacaactagagagaaaggaaaaaaaatatatcatttctaagctctggctaagatagggaaagtttatgattcaaatacatttgtgggttaatgttcattaagattttgaatagcttacacaggaagttttcatagcaaatttgagaaaatgaatcattatatgatctaagaaagtatgcttccatttctatattaacttatatcaaattcacattacattagataaattataaatggttcaaatatatatgtgtgtgtgtatatatatacacacacatcaaatagatatgtgtgtgcatatatatatatatatatatcttagattctctttcttccccccatttaaaaataattacctaaagaaattgccttttcccatttgtctacaaaaaagaatttaagaagactttctaaaagtatttgagaataaatctcacaggaactacagaaaagtgcaatgtggagtaaaaaaatcaacaaagaaaaaaatcatcaggaaagatacaaaaactacttttaatgtatgagaaatatttttcacatcatgatgagattaggcagtatgaccaacatcctttagattactgaaatcactggctattttcacttgaaaacataaaataattttcttcccaattatttgacactgtagacatcaacaaaaataggtaggtcctttcaaagattagtaatcatcattattaagaatttaaagatgatcaagatcaatttcccaatactaattacaattaaacaaacaatcttgaagaatatgaaagttgggaaaaatactaatatttaccattcattaaataactacaaaattaaaaaagaacataaaaaagttctttctctaggaaaaaatgatgtgttctacctagtcattgcattttatgagggccacaaatagatttttttagtcatgatctaaagtagaaaagcagttgcaaaacaccagtgtctttgtttatgatctagaaattaactgtgcacattctccttggtaattaagcaaaaaaagtcttcttttaaatcagtcttgtaaagtatggctttattttagattcaggatgagtaaaatgcatgacagacaattccatgcctgctatacctgcctgccaagaaaagaaagtggtcatttatggtgattacaaaccttattaagtgaactctctaggtcatatcttcaaaagagacaggtagcattgcttgatgtattttcttttctagctccagtctctctctctctgtctctcttccccacatattttttctgttcctctccccaaccctttctctccctaggggttccaacatcattgctacattgctcaggagatgaatccattttctttctgctaattcctcttcctgggaagatggagaatctcctcattgattttgactggggaattattttttttaagagtagaacagacttctgacctttcaaatgatcagattaggatggttattttcacattattaagtaatcaaggaacatatgcattagaaagagtttggttcacaggcaggcctgttggagtctaaaaaaaatattttctactgacaattaacccagattccatttcttcccttgcctatgaatcacttgggaagctaaaatgcattttaacattgcattttgcctaaaggctatcagtaaaatttaattttcttactgcattgatttttccatcataagttgtaacagtctaatgatatcttataagaattttcagtattgaggaaaaggatgcaaatgatttaccaatgataactgtctgggatatactgtgactttgagggaaactttctgttgctttttaatggctgattgtttaaaaatatggtacatttaagaactctgagagagtttaatatgttacccctccttaaaaatagaatctcagtatttaaaaccaatacatgatttttgggcaagaaattcagggtccacgtaaaaggctgactgttattgcaaaaacataatgttgcacagtgaaataaggtgactgaaagacattagagcatggcggactcacctcttagactaggctacatttgataaaggttgactgattttcttccctgctaaacgattgtctcatcactgaagcttcagcaaaacttaaaataaccatgttgagaaaacataaaaaatagaaccagtgtcacagtaaaatcaacagaggattcaatatgccatatgttcaatagctccaagggaatattttaattattatttcactttgtcttaaacacaacagttgattacaaatataaaataaacatttgtgaacaaaaaattaaccaagttaaatacatcattgttaacaagggtagatgccaccaaatggaaaatgtcttaattgccaacactcacccttatatttaatatgttcatgtggccatgtctctagtacttattttcatgcaattttatttctacttttttttttaacatttaaagggcttgaaatagaaatggagaacatctgtttcaaagaaataaattgttctttaaaatgtcatcaaaataatgtagaaagccaatccttttcctatttttaaagctgtaattttttttttaaaccactatgcatactggggtacttttatggaaagaaataaagaaaactgcatgtcttcattgtttaacaaggatatccatttccaagtaagttaactgatatacccatgccaaatgaacattcaaaatgtttagtttcattttataaactaatgtgtcttttctttagtcagtggaaccagaagacatttataattaccaactaattatgatccattcactaatgtctgtcatcactgctgagctattgatcattcatattgaatggtaagtcaaattacagattgaaggcaaatttctgagactgtgatgttaataatcagctttggcttttaaaacctccaactgatattgactggatcatgtcttaccttgtatttatcactctgttctcctgttgagcctccaaaagaattaagccctaccaacatctttcttttcacccagtgggcctcagtttggacttacaaactcaagaaaaatgaaataatgaattttaattgttttatgcaactgtctgtagcaatttgttacagcagcagtaggaaactaacacactgataaaatatgatttaccagactaaatggttaagcacttacctataaattaaaaatcaacatagaacttaagatattttattgattaaaacaagcaaacttacacacataaaacacatatcactaaaatatttttgaaggccttcaaattacaaaaagcaatttacattatagtaatagttcatgtttatagtacaggaacaagaatgagttaaactaaatattccaaatcagtacaagttatttccttttttttttttttttgagacagagtctcactgtcacccaggctggagtgcaatggcgtgatctcggctcactgcaacctccgcctcccaggttcaagcgattctcttgcctcagcttcctaagtagctgggattacaggtgcaccatcacacctggctaatttttgtatttttaggagagacggggtttcaccttgttggttaggttggtctcaaactcctgacctcaggtgatccacctgcctcggcctcccaaagtgctgagattacaggcatgagccaccacacccagcccattacaaggtatttcactgagggtttctcgaatgtctcctaaattttctaaacacaattagatgcacagattataatgatttgagtttaggaagatattgtaatatgtatgtttcctatatatacagaaccagtaaaattcatacttataaaattatatatattatctgaatagttatgttcagttttaaatacctttattttaggggttcttacaaatttttcattcatgttatacaaaaatgcagattaccaaaatataaattatatccatcaatacacgattcaaaaacagaaaaggtccaatagaaactgttgattacctagtcttcttcgttatgctgctatatgagtcatttatattcttacaaataaaaaagattgaccaataactgggaatccagaaactcacctcttctcatagaagtaaataattgagattttgtcatgcccaaaagtattgtgtgaatcagtaacacactacagcattgccactttcgttcatattagttttttttgaataatttcaacttttattttagatttgggggtacatgtgcagatttgttacatgggtatattgtataactcagaggtttggggtacaaacaatcccgtcatccaggtggtgagtatagtacccaatagtcgtgttttgttttgttttgtttttaaatctacattttatcttctatttttattttattttattttgctttaagttccgggatacatgtgcagaatgtgcaggtttgttacgtaggtatacatgtgccatggtgatttgctgcacctctcaacccatcacctaggttttaagccccacatgcattaggtatttatcctaatgctcctcctccctctgtcctccaccccttgacaggccctgatgtgtgttgttcccctccctgtgtggattactatgcagccataaaaaaagaatgagatcatgtcctttgcaggtacatagatgaagctggaagccatcattctcagcaaactaacacaagaacagaaaatcaaacatcacatgttctcatccaatagtagcttttttgccctcccactccccatagtagtccccagtgtctattgttcccatctttatgtccaggtatacatgtttagctcccacttataagtgagaacgtgaagtatttggtttcctgttcctgtgttaattcacttaggacagtggcctccagctgcacccatgttgctgcaaagaacatgattttgttcttttttatggctgcatagcatttaatgttgtatatgtaccacattttctttatccagtccactgttgatgggcacctaggttggttccatgtcttttctattgtcagtagtactgtgattaacatataagcgcatgagtgtttttggtagaacgttttattttcttttggatatatacccagtaatgggattgctgggtcaaataatagttctaagttctgtgagaaatctccaaactgctttccacaatggctaaactaatttacattttcatcaatgtgtataactgttcccttttctccaagacctcaccaatatctaatattttttgatatttttaatagccgttctaactggtgtgagataattctcgtggttttgatttgaatttttctggtgattgacaacattaagcattttttcacgtgtttgttggccacttgaatgcctttcttttttttaagaagtgtctattcatgccctttgtcaatgttcaatggggttgttttttgcgtgttgaattgttcaagttccttataaattctagatattagttttcactcagttctgaaatgtatagaaacctgaacattagagggttaactctttgttgttctagcttaattaagcataaattataacaatgaaatacttcatgtgtgtcttctattaaattcaggagaacctagcctcactcttttttctataaaagtgacaataacacattttagtaaaatctctagcttacctaaggttaaacaacctttcgaagcaataacattggcatcactataagcatttcagcacatcttagctagagtgtgaaataattttgatatgactatgccatttttaaaataaaatattacattctttgtcttgggaatgtgatttgatttcaatcaacagtatataaacctgtaccaatatattcatccttaatgtaaagtataagtctatgtgcctaggcacatatgtgaattcaatgatgatttaaaacactttttggttcttgtatattttcttgtttcctttgttttacatttttaattgcataaaattttgttaatatcaattatttcaatcattttattataagatatgggattgagtagaaatgctgtctggaatttggcagtctaggtgaaagagtattaataatactaataatcataatagtagtattgggtgtaactctcatattctgaaatgttatgaattataatacatgaaagttaaaattataaattataatagtcaaagaagaataaaccaggtctcacagagacaaagtgattgcactgtaaaacatgggtagtacacctagtctcatagtcagagtatctgatccttaaataaatttttatttcaccatatccttttatctgatacatttaaactaccattagacacacataaatcttaatatatcatagacttgcatgtctaatgagaaccaaatagttcactgatttcctcaaatataggaaatgtttgtcagagaagcactgttctcacagtaaaaggcagcaaagcacaggagcctatattgcaaacctgggatcctggctgcatgtgttcccattcttggttctgccacttctcggatgcgtaaccttatgcaaattacaaatgccatctctgggcttcaatttcctcctttctaaaataaagatggacaatatccttatcccacagagctattatgagaattaatagttactatctaggaagtacttataacgctacctggtgcatattaagcactgtagaagtatttgttcaacaaatgaaaaacagtattaagtctcaaaacaactgtcaatcttaaaaagaaccagttatattccaaattctaaagaaatatataagaaatgcaagacaaaatatttttcttgcatctactccacccttgaaaggagactgacaagtttatagactgctcatctgtttattcatagctataaccaaacaatttaaaccttctctttcaacattatgatgaatgtcatggtaggggcagttaagaaagcaaacacttttcaaaaagttcttgaggtaatattcaaagagtgatgagacagaagtattcataatttctgctaatttagaactttgatgctattcccaatgatagttaccaggaatcaaattaatgccagtacacttagcagggtttgtgtattttgtgtacaattacccaccacatgctggaataagacaactcgcttgctgtgttaattgggtaaatcaccatttttatttcactatccctcagtttagtctcagcagtttaggtcatttctgaggaatataagggtattaaatagaaattaaatgatgctttttaacaagtgaagatacttaagttctccacagacagatgctttaaatacaggttcttatattaataatatttatcagaagataagcaccatcaagctacatcacccataagaaagtagaattttcaatcattatcacaaataataaattcataacaataacctagaattaagcatttatgctattcaaggattcctgaattctgaagttggaaatttgggggataataagatatccttttggcagccatgacaagttaagtttttctagaaatttagtcaggtgcttcttggcagtcctgtgctttattctacccagaaattagggtatgtcatgtgggatctaaccaaatattagagttagaatatagctcaaggtgcccctggattaatggccatccggtgaaactgtttatcaacaagaagcagcatgagccattatcagtttttgatcaataaagattgatttctataccggaccttgttttttcatacctctgtcctcatattttccttttctcttttagctctgcctatactgttggtattctttcctactcccaagcataaggtttcaacaaaatgtgaaatcaaagttatgctaatatcaatttagaatcaatgttaaagttctcctcaaatccactttactcagctgtatattttgttagcttgtttctactttatccatattataaaactattttaatttttctttcattttcatttagcaaaagcacagtctcagagttgacaacaccctaaaagtttcctctactacatatctgggatgactagccatctaaccttgaatatttccattttagggtgtatttaatatctatccatccatttagtatacccttatgaagtgctccttatgccttagataatcgtgtaaaaagataaatgcagacctactgacaaaaaaacttatattgttacagaattaataacactaaacaaaaaactacacacaccattgagataaatactgtgcagaagtaattcagggtactgtgaaagtcattaatggtgtaaactaacctagaaaactacgtcaggtgacaaagaagggtttcttattaggaagtaatatttaggctaacatgtaagggaggaataaaagtgaaatgacataggatagagggaggaaaaaatagaagtgtatttgatagaagaaagagcatgaactaatgtctatattaggctaatctataattcagtccagcaagtatgacctttggatgataaagtctgggagtgggtggtattaaaaaaagaaaaacacacacagaggtgaagagttgggtgatgcagcagttagaacctttgttcttttgctgtttatctatctgtttgttaagtatcccaatgcagaagtttcaggcagagaagtaaagttattgtggaagaaggaagttcacgaggagttgggtcagcagaaagatgcacaaatagcgggtgacctaccttttagaagaggacaaaagctaacatgtgagatggtatgcttttctgtgtattgactaaggaggtaagagtcttttttttttcagtcatgccagtttcttggaggatattgggctcttgagactaatgattaagcaaactgaaatgcagacagaggtcccctggttgtggttataaactagaagttctttttttttttttagacggagtctcgccctgttgcccaggctggactgccgtggcgcgatctgggctcactgcaagctccgcctcccgggttcacaccattctcctgcctcagcctcctgagtagctgggatacagcaagcctcctgagtagctgggactacaggcacccgccaccacgcccggctaattttttgtatttttagtagagacagagtttcaccatgttagtcaggatggtctcgatctcctgacctcgtgatgcgcctgcctcggcctcccaaagtgctgggattacaggcgtgagccaccgcgcccggccacaggtgttctatatagttcagtggtattgatagctatgctctttgaaaggacagctgtgttatttcgaagggcagctgtcagaagcgcattaaataatgtcaaagcactgagttaatgtctagaaacctcagagaagactactttaggtaatgtctacctttcttcccactgaaaacatgggatggtataaggtacaccagtaacaattctgagcattgccagcctaaaaggagctttcctctgttagtgaattgtgagtcaataaggagacattttctcttagaaatgtctttctcacattaagcctgagatgaatgcttgtgtgttggcacttgaaatccttacccctcttcttctctctcctatatcacaagtgctctagcatgactggcatgacaattacaaaaaaaaaaaagaaagaaaaaaaaagaaaggctcttatctctttcttccttggtcaatgcatgaaaaagcataagcctaggaactgtatttggctcctatcccaacatggatctatcaaaatacagcttagtttccaccaatgagatgcacttgtacaacacagaagataaacagaattatttctgacaatggcatgaagttatgtggtttcaatacaaaaaagaatttgcagtagcctctagattttcctcaataaaacacctactttggtgctgcaagtagacatgatcactcagtagagtctactgtagttccagatctgggtttcagctgacatttctgattctttgaaagccagtggtgaacccaagaactaatggtagacttctttacattttctcttccagctcttgtaaaggatttacaagcaccatttttcctctctatgatatcttcctgtttaaactacctagatttgtgtcactcaattgaataatgacatatatcagtagaaataagtcgctgagacaaaaagccagatcttgtttacctgttcaaagaagcgatgtacagttggtgtgcagtacacatttgttcaatgaataaatatatgaataaaacataagaagtatctgactccagttgttcaatgcaaggaagcttcttggactatttctgaaccagaaatttgatcccatcactaaagcaacattcatatgttagatgcacctttaaaccatcacccaaactactctcaggccaaaaattgcatgatgtgtaattgaacactttttagctttcagacgataaataactgatgatgacataaagtgccaaactaatctcacctccatttcagtcatgtattgtgattttgactccccttaaataaattgtgaaataggcttatataacacaatattgatatttagtaatattaaatatagtttcccgtcagtggggagaattacacaaatagtgatgaatgggagaaggaagagcactaaaagtagtaataattattattaatactttaatttaatcttattttcataatattgaagtaataacttattttttgtgctcatccttctcttggatatttgctatttgtgtaattctcccattgatgaaagcccatatttagatactatcttatacttcaccttttacatgctcttctaaatctcatccagacatctcattaggagatagccaattaacaaatttacctttagaagtcaaaagacagacatattctccaattcagaaaaaaaaaatcacgtttctccagaaagcttttagaaaatgaatatttcaaacccaaagaatttcagggctgaaaatttggtggggaaatctcacatcatgccatgttatctaaatcagcaataaatatactgaacctaaaatatgtaatgttttatacgttgcttttttaaaaaatatagtgaagggggaaatttaaagtatctctaaattgtaggaatgcaatcaaaggagcattagagaaatagtatacatacacacacacatacacaaacacaccacacataacacacacaagtgtgtggggggaaaagggcccttattaaatactggagactttccaggataatacctgatttatttccagttttgatattttaaacagattttagtttacaaaaataacctattttacacatttaaaaacaacatgcatgggaaagtcatatgaaaataaattccactcagtgatataactaggttagcaagaaaaacctgaaatctaatgttgacaaatgaaaagtaatacagcgtgagtacaaagctataaatctaaatgttgtatgagaaattcatacttaatatatttatttgaagctagataggtaagatgttcttttcaaaacacagtgcagtaaagaaatttacataaaagtaaattataagagatttaagcattcaaaaatttttctgagaatcctgttgttgtttattagacaaacgtctctccacaatctgcaatgaaagatacagcagagagactcaatacgagcaaataattatttttatctacaattaaatggcatgaactgtgaggacaagagagaaaaaatgtgaatcatacacctttgtaacctttacaaagatggtgagaagagttttacaagaaagaatactaaatatagactggtatcatgccaacttcaaattgctatattcagctcaataaaaaagtgaaatagaaaagagcaatcatgagaacgaaaatattcaaaaaagatgtcgaaaagcactgttttaaagaaagcccaaaaattgcatggaaattctctatatagtaccttgtgagactaaatctaccgcagttagtcatgagggaaataaatgacaacgatagtaagaatctaaaaagaatgaattatgttcttatatgtctttcatcaggtttgcttgcgggcataagactttctcagaaagtaaaatgaagcaatgactaaagtgccgagaatgaattattccttcttactatctagaaaagtgtaagttactgtcaatcctgaaatgattcttcaaaaatttgtgtttgcacatacatgctcacttatagacaacttttttttttttttttaccatgcttctttgtcatcaatataattaactttcagattcaggattgctctcattttgtagattttcctttgttttttaaccccacaaagtatttaatcaacacacttttgcttatcattttgcattttacatgataataccctggctatatttatctaaacaattaagggtagatggtgaagacaggctatttcaccatcaagatcctagaaatataacatttaataaatagatcactgttaaaatttcatggtgatatttatcactaacaacaaatcacatgaggtgttattacatggataaagtgaagtggtgaaggtgtaatcatgaaaagacccattgtgacaggtaatacacaaacaagtcaaagaagctgacagcaaaggtccttacattcagctgtaaggaagctgcaaagaacagctcaggcatctgccgccctgcctcctttaggataaatttatcctgggcaggaaacactaaaatatttttcacaaaactatcgtctggataaaattaaattcattaacaagttcaatggacctgataaaggctcaatgagaataattcattgattagagtttaatgagtatctatggcatatataacattttgagtttaattcaaacagaatccatatcataagagtgaaaattaataataaaaataatggcaataataagtaaggagagttgcaggaggaaagaggagaaagggagatgctaatatttaaggaaagcttatgaggagttggttttgttaaaaatacctgatccagattattgcatttcctcatcactctttcagaaaaattatctgagatttggagaagccaaatggccaagagcatatagcttgtcagcagagaaccccattctggtttatacctgctcacttaaggactaaattcatatataacatgtagttggcacttaacaaggtactcaagatgcaaaactgaagatatagtctattccctccacactttagtctagtgaagggacccatagagctcaggagtaggtataagggctgtataaacacagatgatggaaaaagcaaggacaactcatggaaagctgaaaataggacataggccccaaaatggaattaaagcagatctttctgacaataagttcatattcctagtttactagatgaaaatacagctcatatatcagggttatcctcacaaaagataattccagtaccaagtagctaattgatcatagaagacaatgctgtgtaagttctaaagtgttacataaaaagtgttttagaaagggaataagatgactgatttaccaggcagacaaataggagtcccataataataacttgtcagactctattttatgcccaatgctgtacatagtttctagttcaaagagatgtcaatgacaaattaatgagtgctctcagttttatagttgcagttttgttgactccaaggtttgtggtctttgtaaggtagtgcaaagtacatgagtaaaatgatgcttatgacaggaacaaatattctgcaagtacaaattttccacttagtaactatcttacaaactctgttcagtaagtattcaaacagtcaatgtgggaccatgaaggtgtcattttggcttattgtacacacacacacacacacacacacacactcacaatgatagttatacaaacaaaccagaaataaatattaatctaagctatccaaataaatggcccagccatggaatcagaactcatactattgatattagaagatcaacacagttatatttgaaagacatatattgaaaattataaagcaaatattcagtaaaagactattgctcagtattttaaaatttctactgaatattaaattactaagtatatttcaatatgagaaattatcatctttgatattctctaaacaagggtctggaagacacttaaaaggcgatctcttcctttaggtctttagtcaaatgcctctttattagcaaaagtctctctggccccctatttcaaattgtataccctacttcaacactgcctatactccctttactgctttattttattttctccttagcagataacagtatctaatatattttttcttttaacattttacttggtctatttctctcactagaatctaagcctcatctggggaagataacttactgaatgagtaatattgtagaaccttttcgtctcacaaaagaagaaaatgaatatatatttgctcatgacttatcagggctggacccaaataattgcatagagttgtctcatgtatagaatgttacctaaactcaggcttttagctgtaggtaaagttgaaatcatatctaattgaaagtcagaaaacacagtaggaatcctcacattaacctataaaaggatttcagaaatgtctgtgtgggtcagataaacaggtcaaaaagatctggagaaaccttgttatcaagagcaactgaaaatctccttgaaagagaacacagcctataagagggaagaacacaaactgaacttgacccaataacaaagttttagtcacagggaaagaaaggaaattatcagtgaagtgtgggaccagtcactcagattaatctgggttaagtttcacacatttgagtcctgtgaagaaaagagagttgaaaaggagcttataagtaaaactgaagaagctgtttcaataaatgactaagacattagagcataagtagccaccctctagtaaagtataaaagaaaaagtaaagggggagagacagacagaggcattcttgccaaactcaggaatgaattactgtggtaacagctataaaggactccagtgcctcaactatgaaagaggataaaacctttgacccagcaaattcctgacacgagacagcagaaactgatggatacagtggcatctatgagatatcagatattcatagaagtaggcagcagaaggcttagaatcaggataagaggaaagcaagcattagaggaggtcaagtgatagctgatttgacttttgattgaatttacatttgaacaggtgaaatatctgcctggaacgcctaagaatatttagcatgttttacagaaggctaagaaatgcataagctagaatattttaaaaacaaatttaatttgttattactattaatatgactccatttgtagccacctataggacatagaaattcacattaaagaaagaagtacaaaactaattgaaaataaaaataaccaagtgtaataatgttccaagtttgacaccatgtcaatgaggtgaaaacagcaacaatctacaatatcatactttctcaattaaacttctgagcactagtataaagtgataattagcaagattcaaattttattgccttaagaacaatcatacaaattagggtattcaggctgaaattaagtctataatatttactaataacaggtagtagttggaaaatgtcatgtaactattacaagcacttttatctacaatcatgacaatcttttttttacattttaaaaatcagcttaattgaggtataatttatatacaattaaatgcacctattttaaatgagcagtttttcaaacacatatacccaggtaattactacgccaagagatagaatatatttattatcctaaaattaccacttgctcctttatagtcaatcttccacatcttctcctctgccagacaactactgatctcatttctaacactataaattctaatattctgttttagaacttcatattaataaaagcatactgtatataatatgttgtctctggcttctttttgtaaacactatcttagattcattttcattcttgagtgtatcagtagttcattcttttttattgctgtatagtattcctttgtatggaaatacagtaattgcttattcattctccatcaaattcatttttgaagcagtctcctcctctatacaggcactcccccaaaatctcctttaggagtttcacaaatgtaaaacaaaaacccattcattatttctagtagaaaactacataagtcactattagcctggaggcaaatgttatatactgaaaactgaataccttgtataatgcaaattatataaaatatatataaattatataaatatattacactgtatataggttatacctaaataaagctgatttaagaatgtttgaaaaacagatcttcataattgacttttttgtggataaaaatgaggtcataccttgagggaaggactacttacaatcccaaggaaaagactgatgggcagattccaatatggccccaaagatcccagcctcttaggatgctcacacttccttatttagacctgttttgtgtggaccctgctgaatgacccaattctactgaggtcataaaaggcagggtggcatttctttctattgcttgtgcttactccatctctatttatattattttttgttggtgcatgtgtatgtgtgtatgtctgtggtttgacagtggcagacaaatttaaagaataaagattaatttattttgtgtgactgtaaaaagcaccatgcctgtactactggcacgtgttttgagaagacaaatgctcttgtggagctatcttaattttgtcttgttttgctttgagagttgtttgcaggagatgtgaacacaggatgaaaagatttcataaagaattcaaggagagttgtcatctaatgctgcagaatatttaaaacaatgcaaactagaccctcccattaatgtacatttcttattcattgcaagatctattaaaatcaccttgttggaaacagaaaacgaggtcacaccttgagggaaggactatttactgtcccaagaaaaacactttggtgggcagcctccaataaggccccaaatatgccagcctcatggaattctcatactttcttattcccacctgttgtgtgtggactgtgcttagtgactcaattctcctgaggtcataaaaggcagggtggcatttctttctgttgctcatgcttatttcacctctatttcctaccatgtcacaggcagccctagcaagcccacatggcaaggtattgtagttgagacatggatcctccagactgagtcagtcctgacgtggctacagaccctaactcccacccctgacaatttgattgcagccttgtaagagattctgagctagaatcacacagctgagacactctcagaaactttttagttgttttaagtcactcagcataagagtactttgttgcgcagcaacagataaataacagaaggcctaacctagaacaaaacacagaaactctagtgatgagtattaagactgaagcaagcaagaaagttattttgccaaaacatcctaggaattggtctgaactccccaggaagatagctatatgacactcacggaaaagggttaatggaaaggagctgtgagctaagtggggagatgtcctagaaggtcccaggatgacatatgtgagccagtagactaaatctcaccaaatgcagcagccaatttaattaccctttgggtaaacttactcattattatcaccaaaacttcagaaaaggctgtttaaaatgacagcttggtttctccttttgtgaagaggggaaaaaattgtttcgtgatggggagaagatattgaaggacagaacattacagtatctcatgaataaagacttgggaccccagctacaggtaatagccatgtcagttataggtggccaagcagtggttcaatatgtctactggtagtgagaggggaagccagctggacttactgggttgagtggggacttggagaacttttctgtcttacaagaggattgtaagatgcaccaatcagcactctgtagctagcaagggtattgtaaaatgcacaaatcagagctctgtaaaaacgcaccaatcagcgctttgtagctagcaagaagattgtaaaacacaccaatcagtgccctgtaaaatgcaccaataagcaggagtctaaaagtagccaatcgcagggaggattgaaaaacgggaacactgacaggacagaaacggaacatgggcggggactaataaggaaataaaagctggccacgctagcccagcagcagcaacctgctcttgtccccttccacactgtggaagctttgttctttcatgttctttcgctcttcacaataaatcttgctgctgctcactctttgggtctgtgccatctttaagagctgtaacactcaccacgaaggtctgcggcatcattcttgaagtcagcaagaccacgaacccaccagaaggaaccaagtccagacacagtagaatataatacaatgtggcactttgaaaagtggagcaaataagaagaacatagagttgtatcctaaagcagtgcctcttaaaccataatagaaaacacctggggatcttgttaaataatggcgataattcaaacagtctggggtcaggcctgagcttttgcatttcgaacaagctcccaggagatacccatgctgctgtccataaactataatttgagtaataaatgtatacagcacatgtaagagtgattactcacgaggacataaagaaataaaatattggaatggacattactagaagcctcaaattcctacaattaaaaaggtgggaactcagtcataaatatttggatgttattacaagtatgacttcatttcatattaatagactggttaaacctagaagaacaatatacaacatatagaagagattagggattttgaagtcaccagtggcttcagatctgtgttcttgttctaaatatgtctatatttatttaaggctatatcatgaatagtcctgttttaatatatatgacagacttcatattaatacaaagagattttgaattttctaaaaattttggcagacaacattttttatcttgatccagagaaatgttaatgaatgattttaaaatgaagggaaaatcttgaagcaaaatatgtttttccataaaaaaactaagcctatttgtaaccttgaaaaaaatgtctttttttcttattgcatagacagaacacaggaaatctacaatttccaaaatatttcctccagccccaaatggtgctttctcttttcatacaaagcttttctctctcaatgccattacagttttctgctttgtcttaaaaacatttattcagcacatagcaacattaagttattaaaacgggaagtattgaaatttttccctttctcgctataagaataactaaactttttgtgttgtgcttccatcttttctacttattttaaatcatttatttcagttgctttccccttccaaataagttatagcctgttatgtagaatatgcctaaacaagcagattacataatctactttactataattacagaggacactttacttctagttttgagaaaacatttgttttctatgcatttcccttaaatataaatgaaggagaaattatattgcacatgtcttcagtaaaactgaactgtataatgtttttgcagtccttattactgacactagaagtgcccttttatatttcaattttcatttaactaaattcaaaaagataaagcacctatgaaattatgatcaatgattaataccaaatcagtctaaatgcaagcaagaagcttaataaagcaaaaataaagtgatgctatttatacctgagttttcagttaatttattttctttgaactgctgattgccttgaaaggcagatatagaaatgccttcaataaaatgctacatttctcaaacaacctgctatgttgttggagtttaatggctgacagactaatgagaacgaatggcttacaatcttccaagactgacccacttagtcattcacaccatccatcgaatgagagactgcttcagaggtacaaggtcacacccttgcaacaattattctgtctaatgaggtgtcacaagaaatctactggttcaaaggtgtgtggtaggggcagctgggcataaaatatttggtgtccttgcaccgaagtgtagatacacatttctgagcagctctttgtcacaataccatattaaatgaaaaatgctacttagttatggaatcatttgcactttaaagagatagaagtgatacaaattttactttcatgttgtcaaggatttgttggggtggggcaacttcggagacattttccccccaaagctcaatgacaggttgacttaattattcaaataactatttataggcgataattagaccatatgttaatctcagagtttaaaataaccaatttgcttatattgtttcgttcttgtctaactctgcagaggtacaattttcagagtgaaaatgaggcttaggtcaaatcaaagcatccattaacatattattgtgtctacagaaatccataggactgtattaattatctaggcagctgatgtaaagaatttttttagtgttaattgctaattaaagaaaatcaatggtgaaaagtaaattaaaaataaaaagagatgaactataaaagataatgaggcaatttacaactaattgaatagctttacacaaattttccctcaaatagccaataattacttccaaataagttggaaaaatcagtgataattcagtaagcttcttggctctaaatttctgcaaagggaagcaaagtaggaccctttaaaacatgttttcttctcggttggtacaccaaataggctaatcttccatagacaagtgggttctttttggcggctcattttgctacacagatacagagtcacacctatgatttaaatataatttgcctatattatttaatatttctgggtacttttaatttaattgattcacaattattattatatatttataataaaaaattagaattatgtacatatgtcagtgatctgcattagctgttttccaaagcacatcttaaagtggattttaaaataatctttctgtaagctctaacactttactagtggggggaaagaagctaatattccattatatatcagagtactttttcccttatacatttaagatgttttaaaaattaagaacataatatgatatcttacaataagattgtcaagtgtatatcaaagactgcgatctaaaagagaaaggatcagatactgtcattgcctccaccctttaatcgtgtgatttgtagtgcatttctttaaaaaattattaaagctattttcctttcaaatcgtttttcttctaatccaccagttatatacacacaaatagatacatgcgtttatacctacatttgctgtctgatttattcctacaaaaacacattaagttagataataggatgtctgtttcacagatgagaaaatggcagttttctgactctagtaactgtctcacgttcagtaatccagtaagcactgaagctggaacggaaatcagagtttgactacttctaaatctcaggttctttaataagacagaacttacattgaacacacaaaaagtaaaagttgttaaaatttcccaaagaattttatgtctatagtaacatatatgttatacccatatacacacacatatatgttagctaacttactcccatttactgagcccctgtcatacagagacactagattaagcctttatagtcaaataattatgaaggtatattttgttctaaaataatgttttatggttataaacaataactaattgtaaaggcagtataaattaaaagaaacaaagaataagcacatatatttaaatgtagactacttattatggaatggcataatttaatgattatattaattattttgtaataagcagggaattaaataagttaacccatgcttccacattgagtgtaatgataaacatccctaagagctggtagaatgtgaaaaattagaacctagtagtaaagaatgggaagttaaagagaagaaatttactttgtcagggataatatgatttatatatgtgagaactggctaaattctaaggtactagcttcatagttgttaataatatctgcttttaatattagaatagcattttgttacactgcatgaacatgaaaaacgtgcaatacatgagacatgactggtagtaaaaaccaagtcttaggtagtatatgtaattttcccaagttaatcaaataaaacataaatatttataggtgttttttaaaggagctacttccaacagcctaaaaacatgtaactatctttgtgtgatggttattacagggtcctatctaggttatagtcttggatttattttccatatatatatatatttcacatatatatttcacatatatatatttcacatatatgtatgaccaaggattgctggaggaaacaaatgctttattacgaatagtacaaaaggtaagttaggacataaaagggttccaaaaacaatttctctccaaaatatgttacttggtaccaagactgccccttttaattgtttatcatatgcaaatacacatgttactatctttatatcctataataactcaatattttatttgattttatttatcaaaaggaactttataacaagctatgcttcgaatgaatatgctttgagcactgtcagggtttcattcttcaaataaatttactcacttaatgtaatgattcaccatttgactccaaaaagataaactggcattttcttagcattggaatatcaaattagtagaaatcaaaaaatgcagttgggcttcatttaatatccactttaaaataatgcatgacttgaaactttgttaaggagttaaaacagctcatttagattggaaaatatttttaattaacgcattctgcacttcaacagcaggttctataatgtaaatgcagtggtaagcaaagatttcattaacttccaccagaagtcccagatttaggaatatcggctgtaattagaaaaattaaagctacacttcagaattaattgaaattattaaagtatttactgttgcattatttacacctagaatgtcagcaagaagcataaactttctagtgaataattctatagtttatattaagaacataacaggacttccattgaacattgagtctttccaggtgggccttctataagctttcatcgcattttgattatctggacaattacataaaaactctttgctgggaaagcatgacggctaatgcattcttgatggatgggtgtgacgtaatatataggcatttgctgccctcatgaaatctaccagcaggactcactggaaactgagatattcttattggacaattgcactgtgtatggagtgacaagaaagccacagattgaggtccagttttctaaatgtagaagataaaacatgaagagatgtgaattataactgtagagtatcagtgttgtttttgttattatttgattttccttagatattactccgaacttgaacatattatattcagttttacataagtattatacattttgaatttgctagctcgaagtaaacatttcttcagaaagtaaaattagcctaatattaaaattttaagtaaataaaactctgctcatgatttctgcttggaactcaccaatacagcaaatgcagatacagcagcatggaagggacataatggtaaagatatcacagcaacattttagaaaccttctataaaatgttatatgtttaggttattctgtgcagaaaataaaattatccaaaaagccagtcacattccttattgcacagaaagctggactggacgttgtcacctggattctaatttcacctttacttctgagaaatttgccataagaatttggcattcaacattatggagcctcttcttcctcattagtgaattaaatgttttgaaccatttttatatatgtatgtgtgtgtgtgtgtgtgtgtgtgtgtgtggtgtgtggtgtgtgtgtgtgtgtgtgtgtagatggatagacagagaggtaaataggtagaaaatccaaactagagtagataacaaaatatctgaatcacctattacagattcagagagtaaaggagactagtagatgatataaagaaaggaagagaaagaatgtatgacactaccaatttttgatatgatgaggagtaaataggtaaaacagagaatacaaactccagtatctatttttctgttcctcttactaataacagccactctcaaattttagctaggtacacaactaaacagctatgggactacatttcccagcttcacgtgcaactgggtatgaccacttatctaggttcaatggcactgacatggaaattgctttgtgcggcgaaattggacctattttccttgatttcaatttagtccatgatccaaatctgaccctgtagatgaggaccattccctaggtgatgatcgagcaatgtgatggcagaaacctgtatctacgaatgaccatgaaaaaaaccatgtcatcccatcagcctgaactactcaccttacgactgttaaatgattataattgagttattatctgagtatgatgattataatgaccaataattccactttgtttcctatacttgtttgggaagtcttatggttacagtagcttagtctttaacttatacaacaatgaatgctgaatatttaaattataatatgcacttttctactgcagtgtagcatatgggttaacaaatactttaaatgtatttgatttgacattaatcaggaattctgacatatgaccccaaaacttggggacagggtggttaagaattcttagactggctattctatgggcataaataaacaaataggcaaagaaccactgtttgccaggacaaatattgcaacattttcttcaaagtttggtcatgaaaatttccaaactattcttctattcatttggttgttaagttacttaatcagaaaactcaattttaagattttacacatattgaaatgattcaagattgctctattttaaaaaatagcctatttttctccttcacttctcgaagttttcatcaataacagaagagcttgattatttccccttctaatcagaggcttttacgcttcccagttatttcaatctccccaacagatcagcatcaataatcatcatgcttaatcactgactcaaagaagcagtctcccaatattatgggttctttagatgataggaatattttactattgataatattgacattttcataattgccacattatttttggcttgtgacctaaagaaagtgttcatgtaatatatttaaaggtcatttaaaatacagagatggaggttgtaattgtattacttactttattttaccacatagtattcaaaatctggattacctttcctaagacatatcaaaattgatcaacttaaaatgatttgtttaaaccattatataaatcaattttctttaaagatcttttttaattggtaattccatagaaacttggtcatatgttatataaatattaaaaaaagttttctggaatttcttattatcaaagctacactttaaaaaatcatatcatatacactctccctttttaatctgtatccttcttttcaatgtagattttatgttgtacaatgcgtgccacaagcccagaaagtacacccaatttcttaagattgatgagagtaactctatacatgccatactcaacagatgttagagcaacatctccagcaacaaagacctggagctcagccaatctgtgagcaacaaagtacatgtctacagaggccaggctaagtaagaaactcacacagctccaggatggtgagccaaaggtagctaaccacttcagagttggcaggggagacacaacataaaatttagctagaggtcattactttgtatggcagacactggctgctgctgggaaacaacagaaaactgatcaatttgttgtgcagaataatatagtaggtggttcatcatgagcaaatccacaaaaacagaggtccctcaaaagttggatttcatggtatatatgttattaactagaaagaagtctcatacagagtactatatatgatactctgaaatcagattcaaaattagtgcttgaagagaaaatgcatataatattacaaaatatgagacagcctctccaacagagaaaaggcaattataaatcttcattatcacatcattttcatcataagctaactaaattattcaatttaaacttcaaggtgtttttagctttattataaaattctacaggggaaaatagcaagaaataaagatgaaaaggtagtttgcaatttaggtaatgaagattccttgatgtcacaccaagattttttcttaacattaccctacattaaattaaaaataataatattttaatcatgatcatatttgcattttaaaattcccattggtggcagaaaaaacgaatagagtaagtaaggtagagtcagggagacagtaggtagccatccaagtaatatttggtaaggccttgaagtaaagttatggccaaagggaagaatttgatttaaaaaaaaaatgttggcctgataggacttgatcactaataggtatcatttttatggtaggcccctactgtgctaaatgtggaggctaccataaatttgatgagacaacctacatttctaaagtaatatactgtcttacagttgcaaattttgcttattttagctaaataactggacttactacatctgtttgtctgtggagacctaatccaatatatcttgtactatatatactgtattttcaaattatattgcatataatgattatattaaatatctagaatagtgactacaaaacaaaaactttggacctgaattttatatcttctttctttgtaaaaataaaggaaataaaattatattattgctgatgtgttaaatatttgaggacttctttgtgttgcttttttaaccactgctccttctccaagcttttcagcgacagaaggcaaaaactctagctcataacaaacagtttaagagtttagcagttccatgaaggtctccagtggaaaagtttacatcatcaaaaactgctcaggttggcatattttctactccttaattctcatttacaactgaaaattcattgaattttcttaacaagtaatcagaagaccttagggaagaaaggagctgtctcataggggaaaagataatccaattatcctgttcactacgtgtttacatatctttcacacctgaaaggaagagatttggtgctcatgaaataaatgtcacaaaacaactcaactttaactttctattttatatattttaacttccgatttttgtatgtattttatgcatccctcctaatgtagggaaacgcaattttgtatatgtgctttgccatcttgtggtattaattaaaattttaacctgacaaatgtatacctgagacataagaagtgtcgatccaattcgctgtgaaagagcaaaggtaatatttttcattcaatttttaaaattcacataacatttctgataatttcatataacaaagacgtttctcttgtcctttcaaaattagggcaccaggtttcaatcaatacacaggcagcatttctcatatattagaagcccaataaatgtttactgaggattattttattcaactttttaaaaaaatttgatgaatatggagataacagtttcactttcatctccaggtaatctgaagattaaaccatgagttatgttgtaactctgtgtcaggtgagcagccatgctagatataagaacagtgatcaacgtatgagaaagacaaataagaaaataaaagtaatttacggttataatcaagtaaaatttcaacaaatttaatacaatgtgacgcagtggtgtaaataagagacagaatagatggcaatgaggcataggtaatacatagttcaccacaaataattgtaattaaaatgactcttagaaggccaatttttggttttctgcttcctactcatttctttgctgattataatcagtatccttacattttatcttgcatcagttaatcacaacagtctcatttcattattatgtggggcatgcattaaaatactctgaattatagtaactggcagatgggaccctgttgatcctaaatgtcactccactccaccatgagcttatcttccctacctccacgttgctattccaccatgcctctcatatgaggtgaactaactcaaaactcttggttggttcaaaaattgtggcttttggtcatggattatcaagtacaacaaggtgtttaaggagctgatataccataaaatctgacgccaagaggctgtagaggttagagtggtaggaactgaatgaattaatcttcccaggaaaagggacccgagcttgaagggccaccccagggaaaggcagagagcacagcaggttctctttctgacagattggaaatcccaaaggaagaaaaaaatacactcagaagcatttgtgccacgcttaactctcaactttgggaggagatacactggagttagttttccttgatatgatttgccctctgcttctttgttcccctgggcagcacttttacagtatctgtcctcctgcattcacatttgtgatcatttacttatgataacttgtgctcacttcatttgaaagaatttgtcttataaaagcagatccacaatctcacactttttctgcttttcatgtacagaatctagataactgtagcatttaccttccgtactaatatgcacatctgggaaaatacgttattaactttaggcaacttaacctctatgtgctttagttttctcatttataaatcaaagataatgattgtaccaacttcacaggaatgatatgggtataaataagttaatgcatggaaagcacttaaaatagtgactggcagatatgaagcagtcaataagtgttggctattattattaccttctatctgaagatttctcaagaactcatgaggcagtatataagagataaaattcaagaaaccaagaagaataaaaagatcatagtgaccttgaaaccatctctgatttagaaacaaaaaagtgtaattacatacttcttttaatcccactacaagaagtgataaactacatatgagctgcagattattatatggatgagaaggatgaatgagttgtaagagaaatgcacaatacagacaatagtataatctatttaataatgttaataacacaccctttaattgttcataaggccaacatagtcattcctgtgtgtcaccatagctccctatgaagttaaaaaacataggcagaagaggggaacttggcaatagaaacagaaataggaagagaactgatgagtaatggaggaaagaaaagcctgccatggtgaggaccatatattctgacctattctgaccatattctgacctagcttcttcatctctgtattcagcagcatttgattcacaccaaagcattcttgaatatggcctgaaattcctttctcttaaaatagctatctatatctgtatctataataccatcagaatatctctcagaatgcactgatgtaatacttcaaaaagccagtatgaatgtgtcttagtgaatgtgtaatttgttttattaaatcctggcatgttttccaagtgggagaggtgtatgggaaaataggaagacttcaagcccctaaaaaaaataaaaataaaaaggaaggaatatcctcctgaggggcaggaaaatgggagaataaagcactagacttaatccctgagacaattatactgcaagaaagccttgttgcttgcaaccacacaggtataaatgatgaggctaagctattctttcagagctaaccacatatgtttcctaggagaaaacaaatggctagcacatatgacacacaataaatacatctattcagaggagttgccactggaattcttacacactaaaattataagccatggtccattgaaacaggtaccatagataagtgttaattgagaactaattgaatgtattatataataaaataggaaattacaaatgggaaatattttttctatacttgtgatgcacataatttagctttaaaatttacaggtataaaagttttttgaaggtgaaacaatatatcatcttggcactgtttttcaaaagttcctgctgagtagtactttgataaaggttttcagggggaataaaaaaggaaactcttcaaacttaagtcatagatgtttccatgattttttttaagagaaatcaagacgtgaacttagggtaacttattaacttcagcagtatctaacaatcccactacatttctaaacatttaaattgcacttttgccttcctctttggttatttgatccaaagtacacattataagtcctcttataagaatatctcacctcaaaaggtacaggaagaatttcctcatttttctctgtctattctctttcctgagaaaaccaaagcacttctgctattatgctttggttatagctgaaaataacatgagtcttgactgtaactgctattgtattctatgaatttggaaatataagggactggtgcatagactgtaaactgctgcagtggtctggcgatttatttgtgtttttatattgtgtcaatattaggatagtacggcgtatttttatcatgctttactgcctttctagaactttggagagttgaacacacataaggaattagcactggagtgagaagatgatgaagggtgccaagaaattccagtggaaaacagcatagactgcaactgcctaataagcaacacagcttccacctaggttctaaaagcaatagctgtgactcaggatgacagcaaaggagaaggacaataaggtaagtgtagatacgtatctggaaatttttctgtgatataaagggagaaatgccttagggaagagattcctttttctctatggaatcaaaaattttatgataacgtggatacattttataagaccataagatggtcacaattgggtagtttcaaattgctagcacatggctgttttactcagcactccttgacacataggagactcaatacatatttgggactagataatattatatgatttatgctgccgtattatgcatattgcataatcctgactagtgattctgacttgacaacatttacaagcttgaaaatagaagagggtgcaacctctgcaagtagtttgaaaatagaagagggtgcaacttctaagagtagtgcataatgtgaatatggtacctgaattattgtcctatccttgatttctgtagcaaaatcaaacaggaattactatggttcatgaataaactgtccttctcaatggttccagatggttatattgttatcaacagcaaaaaaacggaaaagtgacaagataaaagtgtgagccagacttccctagaaatctgatgaccacctaaccccaaggtgaaagatttatctttcatcctgataaccatttgggtgaagaataagaaatgaaataattctgtctctagcgtgagattaatgagtcactccttctaccattctctaccccctccatccttttccactgagtagaatttctaactttgattataaagatttgaggccaattattgggaaaaaatcccaaggatgctagcttatgtgagtatttttcctaaattctaaatacaggtttttcgtaagtggcctacactggttccactttagaaacaggaaacactccattacttcttctttattttctttttttttttttctgtttctgtgctctaaattaacctttcctggaacttgagataaaatatgaggtttgggttattttctatgtggtataaagaagctatatctaggcctttatcttaactgagcaaggactatttaaccagacaagggaatggaagtattcctatgatacgtatgtcatgttacatgtgggtagtagtaaaaaatgcatgtgaacacaatgcttgcctggctttgttctctgttcgtgtagctgctgaaggagtcccctttttaacacaaactacatttgagaactataactttggacagtttgtaaaatctataattcacagaagttctaatatgatgaatgcattgagacttctgtagctgattacgtaaatatttgcaaacttaaaaatgaattatttcaaaagttcatgaattctgtatttaatcataatactttaattgttcccttacagagtaaatcagatagcattatatatgcaatgattcatacaaggcatcccagtagaaaagacacacatttaatttaagctatctctgatctcatgtgaaatgtatataatcgaatatgaaattattctcttcctttttagcatctaatgtaagtaaatgtatttgagaatatagaggtaaaatatttttgcttcatggttatttcaaatttaaaatatttacttattataatatagtatttagaaaatacatggactcattattaaaggcaacgctttggtaatatggtgtattgttgaactttgatttaagaactaattagagagcaatttgttatgttacatactagtctaagtcatttctttttgactgtttgattattatacatacacttttaaacttttgagtacaccattttcactaagtcctattttgaagagaacagatgtttttaaacacacacagatacataaatgctcacatgcaaacacaaaataaaatgcaattgaagtctctacaattaatcagctatattggctatattttacaatttaaaaaaataagtatagcatgatctcccagacttcagtgatttaaaatgtacatttcatagagatacatatctacttgctgcaactcaaatattcctatcacatatagaaaacaattggtcatattgattttcctagaagaaaaaaaaagtttccaatttcatcagttatatcacatgaattataatgaaaaataaattattggttttctttaagaaaagcaagcatttaaaattaacattgcatatattccttctttgtattcattttccatgattggaagttttgttattacatttttttaaagttaatgtattgtatcctacaagatcaatgaaactattttattgataatgtagttagaggtgtaaaaattattgtctgtgtatttacttggcaatatagcatgtgagatggtactgaacaaggatggaaaacctctctgtgaaactgggatattcaaccaactttgatatcttttatttttgaagttctcaatttcctctttaaaatgcaagggttcaaataattttttctatggttctttctagctcttacagtctacatgtatgtaaggaataatatatatttatttaaattgtgcatatttatccaaatgtgatgctgcaaaatagcatacatagagatttcagagtgggaaaaaggaagaccaaagacactaagcatccccttttacttattttcttctcatatccttctgatattgggtacagtaataaaatccaaaaataattatacatgtaatatgctctcagtggcagcagcatagggtcatttagagaaacttgagtccacctcttcccttccataatctccatcctgctccttcaaaaacactccaaataaacattcaatctcaatctacgtaacaagagtgtccaggcactgctgacctgacttcaggacaatttccttagccctctttcaaacaagatggctgcccctaactcctacaggattctcaaactgccacagtataatctgagaatttgcaaaatgcaacttcagttatattcagtatattagtcacatagcttgaaagactttcaaattgctaagccaatttatttacctgacagaggtacagagagtccagattacctccttagggtcacacttccaattgtagtgatgaaagataaactcaaaacctttgttactacaatcacatcagtgttctcctaacgggtaatgttcattttttgattcttcattaattcttcttcattcagtgaattttaagagttttgaaaagcttgttacaagtacagttaatgtctacattgtttgactgtatcaggagacatttatttattctttacggatgccaaatgcttttgacaatcctaaaaaaataaaacagtgaaccgacagtagtggtaaagaaattgcactttaatacataagaagataagttcaaatggcattgaactgggtacaaaattctacttatttaattttcattataacttttaaattagcattcttgaatatttgtcatatcatttgcattgttaaagtttattaaattcaggataggtgtaagcccaaaaatatgtaactgaaattaaagtgtttcctccaaacaacagagagaacttgaaataatgttatttgctgcattaaatgtgagacatacatagatagtagctagatcaatagagacacatggatagatatatttaattctgtaattttgaaaatcacatttttttcagaattttctaaaaagacattaagtaggtaagtttcaaacatgtaacatgcatttcaggtcacctattatcaaattattatataaattctgttcactcaccaccctctaccataatccagttttagaattgtaaagttacattaatcacacttctctaactgcagaacagtttacaccagtggtaaccacaataattgtcatgtgcactattagtcattcctaaaattttaacataatattctgctaattcttggatataactagcaatattttagcttttcacttactctccagcattattaaagaaaaatgtgcatttgcagaactctgcacctgcatacatttggattcctgcatcctactagtaatacacaggaaagatatcatggcattccataaagaataaagcaaaaaaagttatgaatagctcaaccttccaatatcacatctaattagcattgttttctttctaaattaagtgtatttagtaaatagtaatcatgccttgagttccataaaatataagaccatgtggtcaacaaaatcatctttatgttgctatagttacaagagtaggcttgtaaattttatgttaatattaaaagaaaagaaaaacatgtttgccttcaccaacagcaactgaaagcaaatgcaggtatacagcactttattagaaagaacccctttagtaagcacatgtaagaggaattaatcattcattccctgcagactgcttatgtatttcatcgggccattatctgatctgaataacaagaacaattgcataataaaacacattactgctgacactagcaactttcttctcaactttaaagttgcaactacctctgtacaggacagagagctggtggccaaaaaggtgacaatttaatcacccatcctgctttgccatttttatctgttattatatagagacagggatcaaatgcatgtgcaagctttactagaaacagctttcattcaggctattttccttagcactatgacataattacaacagaggcagaatgtatgtcaggttagttttaatgttacttacaaatatttgctttcagaaattcaaaaagaatgcacaaatctgtcatgtcttctctactgtgtaaaatatgtcctatactaatatatgtaataacatgtttgaaccactgttaaatttgccctacttaggtacaatcttcccctttatttttcaataattaagtttttttttttccaaatatcagatagcctctcggacatgtgaggtcagaaatgagtagaggttatgtgctataatccaaatctgatcagccaagggcttcattttaaatcacttaaattcatttttaaaccaataatagaaatgttagctaagagcagtaatatgtctaagaaaactcatttggataagaaattaaataataatcaagaaacaatgacacatctttctcaaatgattccatatatgataacttcatgtcaaccaattcattaactgttctattgtcctgtctcattaccctaaaaacttatggcccaagatatttagagctttcaacactgagtaatcaaaacaactctaaaacatctctacttttttgtaataattgtaacttagcttactcttataatttctaaaaccaatcccccatgaatacagatgcttttatatactcacttaagtaaataaggaggtaaaaatatactcattctaccattatcaacaattaaatacaaggaagcccttaggtataattaataataagctgctttattgaaagaaattctctgagataagtacttttacttttcaatctggtttttaacttataaggggtttttattaaaaagtatgtattatactgagaaagaaattaacagttaaagataaaagggataaactttttctaatcactattagactctagtcagtataagtactaccatgtcaaaaaacttaggatttgttaaaaatcaggtctgttttgtctaagttgcaactcctactgtatctactgtatatgtaacaatgcaagaagaattagattcagaatccatttggcagtgataaagaaaaaaatgctgaaatgttattgattctctccctcttgtgcaaaacaaactgagtcaactatatttttcctgacataacacaaaggttttatttagatattacaaaatattggcaaatgttagactacatgttttttatatatatgtataatgaacttattaacccttttgtagaaagaagagtgtcctacttctgtaaaaagaaatgctacagctactgacatggtgatgttagccccaagaggaatactgcctgcaaaagtttttgatgcagagatattcagccttaggagacaccttaaacctgtcactggctgctgagccctgtcagagtttataacccgctgtgtcaaagtcacagtctcagccctgccctctccaaagtatttttcacattctctctccaaattaagttcattctaattctccaactattctagttccaggattttcctccaattattatctccttacaggcatgaagaaatcgcaacagaattttcatctggtctttcaaaccatccttattaactttcccttttccgccccccccccctttttttttctagagcttttcagaactaaagataaaacaaccaaccaactgaagtcagagtagggtgggagttagcatggattagggctgaggttgaaggtggcaggagaagtgagccagtagggttagatttttcaagctttttctagataaccacccttaaatcttagaaccaaccaatgtttaacaaagcaggcttccaatagcccttgaacaataaacgtttaaaaatcagttttccagtaaggctgcccatactgatcccatatcgaagtcttctaagggctcttccaaaaaaaaaaaaaaaagaaaaaaatgcttagcgaaccacttctcaaataggagctactgaagttatataagtcaagttattcccaggtaaaatgaataaactgtccacagcattggacattgggcattgaaaagcatcagcatatgcttcactttagagaaaagaaagacagaagcacagtttacttactaaagcagccgctccagtcctccttggaaaccctgaggagtcttctcttttctttcctaccagtcaaataaagaattgtctttctattccacacaggcccagaataaactgcaaaaagggatggcacatgcacagcagcccgtcagggtttggctttggtggggtgcttcgatttctgattgtttcaaaagtgggatcttcttttccggagggagggggcaaaggaagaaaaagaaagcgcgctcggaaagccggcttgggtcctgctaattattctgaaggcaaagtacctgcactctccccgccgaggctggctggcggcgccg

SEQ ID NO: 834 - DNA, 419702 bp, Homo sapiens; identical to SEQ ID NO: 832

SEQ ID NO: 835 - DNA, 419702 bp, Homo sapiens; identical to SEQ ID NO: 832

SEQ ID NO: 836 - DNA, 419702 bp, Homo sapiens; identical to SEQ ID NO: 832

SEQ ID NO: 837 - DNA, 419702 bp, Homo sapiens; identical to SEQ ID NO: 832

SEQ ID NO: 838 - DNA, 741021 bp, Homo sapiens
gttccattagaagctgaagttttattataggataacagtacataaagcacatctaaaattgatgtgttcaatgcacttttaataaaggtaatgtaatattaaaggtacagtttctaagtacaatataacaacattcatattagaatgaaaattggagtatttaaaagacaacattaaatctctcttttttgtacagcttgtatttacaaaatgaatcaaaatattttttttttaaattcaggactcaataaaataaacagctggaaataagcagactagtgtaagagtgaattgaaaagaaaacccaaggtaagtgaaaagttggacgatcctctaataaagatcattagcaaagttttagttcaatactagttttaggattcccataaatggcttgcatttttagtgtggcagaaaaggagtttttacatactgtacacaaaacagacagcatatatttataggtacagtattactgtttccaaacttgcatgtatatttacagaaggctgagtttgtttactcaaacagaagtttgtgaaatttgtgtgcttaatcctcaagacctacacacaattagaatcagcatttcatgtggtctttttaaatgtggctttaatacttggttgtagaggagaatgttaaccgtaaggcttggcttactttgtaaatttaacaaaacaacccaggaaaaacgttttaattggggcacacttgttatcatttaacaattgtcaaatgctgacatgtgctagccattgtgcagacgcaaaaagatacaatctctaccctcaggaagcttaggatgctaaatcgtgctttaaaaaaaaggtttcaatctctttccaagagaggcagttaaggaatgatgtgatttatattaaaagagatttctccctcaactgtagccaatccactttaaaaggttaactactagcattagctctcattaaccacacaattgcatttataattaaggtaacagcaactcttccacaaaaatggaaaatgtctagaattgtggataaatattgcagtgcatggaagccaataatcatggcttgagaatttatcaccttcagttacaaaaagtgcagtaaacagaaacatttgctctacatttataaattgctcaaaaatctttgctaaagatcttacaaattcagtaatattacagaacaattctaatcaatatttaataaggttaactacatccttagttagatatttgataaactttgcttttcaataatgccagtagatcttgggagaatgggtagaaaggcttaattaagctacttattaaataactttgaaaatgaaggtccttcactcagttcatggaactggttgaggtcatactgaaacagaacatcccatgtcgaatttgctttatggcccatgttatggcagaggacgtctccatccttctcatgactcaggtaggaggggaaaggtttattctgccatcaagccatctaggatattttatgtaaatgcccattatctataataggagctaagaatacaactgtgttaggtgccagtaatacaattccttaataagaaaaaaaagtatattactccattaaacaagtttctttaggatcttgaaggcctggcaaattatttttcagcttaggagatatgctgtaaagccaagtagcaaacataaagtaaatgctaataagtttccatatagccatatttataaacaaattcaccctatagatgtcaaatatccatactaaggaagtaattttatcctaattaaatacactctagaataatttatataatgatattatgtatttaaagagaaaagcatgtcccaaatccagcactctgatacagctgccagttgggcataggtagatatatatatatatgtatatatatacaaatatatagttatactcagtgaaattaacaagacccaaaggtggtattgtctaggaataaaagggataatttttgttgttcacaaaagtaacttgtctagcaccacacatcagaaaaacacaaaaatagcacactctagttctaaacagctatgtctaaaatagattatatagtaaaaccggtattatacagcatattgtggatttgataaacagataaatatttgcactgagtaggctgtttataatataacattttcttatctatacagaatgaaagccaaaaagttaactgtatagagatgtgcagaacaacattaaatattatgactcaaaagcagggacaggtaaatttgaaagaagagtaagagagaaaatgtttacaggccgttacaagttcttaagttaatagtaaataaggaatcgattgctcaagttgaagaaagcagtaaacaagagattgcatttacatgcagatgtctaaaatttgtattttttaagtctatgcacaaaagtcatttgttttattgcttgacattcagttatggctagattatttaacctattttttttgtactttggaaacaagaatattgttaaaggtgccataaaaatggacaacactgaaaacagtttgcaaataaaccacctaacactgcagttctttatacatattaaaagccttgtctggggtttgtcatatgttaaatattatttaaagtgggaaaatatgttgtagcttgaagcctcccattggcccaaacatccaatacaaaaacacatctccacaaaaggagcaggcagacaatacaggtacatttatagaagcagccagctaatgtcctaatgtttaaaaatttaccactgtttaatatgagatttcaaactgtgtggataacaggagaattttggattcaggaagatgtatacagtacatatggattttttttgtgaaatcattttcactatattgctcaagaattatctgcatttacatatgcaatctgttcagtgataatcaagttcctagaaatagtattcatccacattaaagtaataatgatgaaaaaggaatcacacatgaacactggagagaatttagttgttcttagagaacaacataatggcatgtgcaacatgtcaaagctaatagcaagctatctttcattagttcttagaaggatgaaagtaaaagaagtgtggtactgctaatgtggcaaagtacattaaatgtaaacagcaaacacagatttcctaggcatctatttaaaatattcatattcactttctcaatataagactccatgttatgttgcatcactgacaaaaggttgtttctatttggattgaatattctgtcattcatttataaataaatgactgaatgtatttattgctctaagttctgagggtttggttgaacatggagatcccccccgcccatctaggatggctacttggtgtgaagtcaggcttctggattcttttaaaaattattctgagagcctgacaacactgatctcacctacacaaacagacagacagacccagaagtgaaaccaattgcactgtggagacattgctagtcagtcttctcatctcttaaaaataaatagcaataggaaggtctctataatacaatctgatggaacctctttactaacattatgtttagggatagaatgaagacctgtatcatagactcttaccaatagatcaagatttactgttgcaattgcgtttctgggcacattatttgatctataatataaagttgttttcatggggttctatatcataactttataagaagtggcaatcacatgttatgtaaaaatgtcaacgtgtgtgtgtatacacacatatacaaatacacatagagaggagagatttctaccattttccatattctttattatcaaaaacaacatggtaaaggtatccttttcatcttacagacatgggaagttttcccagattatgttcctctatcatagtaagaaaatatataaatcttcttgtgaatgtgtatcccaaggtggaagaatcagagccaacaattacattgaacttctctgactttatggaaagtaatatgtggaatatgataacaaaacggtatttcaaaaatataacatgtaacactaaatgttggctcgagttgctgctgtcatacaggcaggttttgttttgtctttaaacattagctcttgtaatgcatcagatataaactacacatgtagaagtaagaattgttttccatgaaggaatttttggtttgcttctagaggagaacccatgaaaacaatagttaattgctggtattttaaaaacatatttcatcttttacctatatcactgtactgataggcaggtctctcctcttattactggattttaaaattttcatccttaatatgtagaatttgaaatagtttttaacatatgatgctatatatatatttatcatgaatattttaattattagagaaatggtaactggaatatgcaaggactatactttgaatgatgctctttgctggtacattattaatttatcttttgaacacactggcataactttgctttggaagttattcagtgttttgaaacacaagactgacgagcacatcaagttctaaactcaacaaaatgagacgagagtaaagagtttacacacacgcagttctatatagttcacttgtgccttggagggatagtattattatcattattattaataataaaaaacacaatttgtcccagtagtactggccaccctgttttaagagttttaggagatccctgagcacattgtttctgactcttaaccccaactccaaaatgatagggcttctatcgttgataccaagatggattgtcattcacagtaagtcaattataaggtgcttatttacccttgtttttcaccagtcagcacaaagaactgtcagaaaataactttttattattatcttaaaataatagcattggaaggacatatgatttaaacaatcaatgttggaaacagtggctttaggattattatctggctgcccctcaacaataacaagtgattcgatcgacattccttagccaaaaacaaaaggcaaaacaaaaaaaaccaaaaaacaaaaaaaccccaaaaaactgtacaaatatgtatttttccctgagggatcaaggtacacccgcaagtgctctatgtacatattgcactagagaggaatgaagaacatgtgcaaaaaagcaacaatgagagaagcttacatactacttaaaccttttcatgaaagatactactaggttgttttgcattttggaatgtcggaacacaacaactagctattccttagtctaaaactaaaaacacacatttctactatggcacattcaatgaaataaaaagttttccaaagacagatagacaaattccatcaagaaaataatacaaagtttgtttgtttgtatttttttttttagaaaattacattactttctttctttgtttcacattacaaaatctttttttctttacacaaatcacattttattgcaggaatatttcaagtgccatcaaatatttatagaagggttaaaaaaatagaagtctctctaaagtggtccagacaaggctttgtatagaataaatctttttttccccatcttctagttttgatttaagtattttgaatacattttcttttccattgacacttagtagcctagaagcggtccgacgcacacacatcatacacatgcaaatcacacacacacacacacacacacacacacacacacacactccttcctcacctgaccctcagcccacccccatacgctcacagataactgggtatccacactataaagaacaaccaaacttagaagcagtgtcttaagtcatgtttttcttaagttagaaagggtgaattaggatgctgaagactttaaaaaaaaatccatagctttaatacacgttaagatgctgaacactttaaaaaaaatccgtagctttaacacaatttgcaaactgtccaaaaagcactttcatctgtacttttgtttgcattgtgaccaaggccaggtttttcacaatataataaccatttggacaccattggaacagaaggtattcaggctttgtacaaaagccttatttgccttatgtaaaaaaattgtacaaaggcattgtagcagcggggctgacagtgatgtggttccaatccttaaaagactattggagactgaagtttaggaaactttaattataaaaactattaaggataattgttctgatatcacccaagtattttatgtcatcacataggtgtttttgtaataatgaagaaaggaaaatgcaaagtttttcacatccttttctgagctccatattttttttaaactgaatttattgtttaacatcagatcccaacttagatccaaatagtagtcagttgtttccttgtttcatggagcatgtctctgtctacaattccatcctattatgtcaatcagtggacttggctcttaagctccaccgctgcttttctttcagaaacacctgggaagaagcatcatattacctatcttggtttaccgtaaaagcaatgtcaccatggcatgactattactgtggttagagcatgattgtttgtaggtacatgcagaatcccttctgggaaaaggaatttctttttaagttcatcattatgttctctctcacccttagagaaattcaattagcttttattatttcacaaatcgacactggaattaggtttagttgctctttaatgcgctagcacctgaggctggtcatattcagaaagctttggttaaaaagaagttaatatactttaataaaaccatccccaaatttagtgaatctgaatgacaaaaaaacaaaacaaaaccaaaaccaaaaaactaaaacacaaaactcaaacaaaaacaaaacaccatttccccccagaggagaaacaatagaaaaaaaatggatgaataaataactgaactaagcttggtactcttttcagagtataaatactactgatctttaaaggaactatgcttacttaaattaaagatttgatttaacccttcttgccccaatataaatactatatgctgacagttagcatctctctataaacacataaaattttacatgcctgtaagaaatttaaaggaatattactcttctatttatggttaaactcttactatgtttttggaaaaaaagttggatgttatttaggcttcatacacacatctgtgtgaataataccttccccttttccaagtccctcaagaaacaagtcagaaaagtcagtggagttagaaacagagtgaagtgctctgggaagcccatgctggtaacctagcatgacgtgaagagctgcaattcctgtagaagattccgcagggaccccaatggcagaggagactatttctcagacataaagggctgcatggaaactcctaccttaacacccatcggagatgttcccttttctgtacaaaatggtctttgaccagtagtttgaatcccacccctagtgcgactaaaatcatcgtctaaatgcctacattcccaaaaggtcacttgtttttaaaatatgcacatctgtttatcagactattcctttccccttcccccactagggatcattaaaaaaaaaaaaaccatgaaattaaacaaaaacaactcagtatttctcacctgaacacacaagccaaataatcttctaaatatttaataaaataaattacagtccacagtttcctagtgaagataaatacaagagtaaatgtttgcagctagcatcaacttcactttaaaggcttaaagtatttaatatttaaataagagaaactggttcaacattgtatgcttccctcaccctcctatccatcgtttttcaaatatggagagcaacattcttgaattatagcatctattgacaacaaatctagaattagttcactctgagataaactcatagggttcctagattataccaagaacataaacattcacaaagtaaatacttcatgtcctcacatggggagtgtgcatttgctcaggatataatctttgggtccttcttataataaaagctagattccaataaatattctggttgttgatttgttctcaaagcataagaattccaagttgagaccgagtccatatttaactactgaattgtgtaaaatgagcttctcctccccctcgcctccatgaggtggcattttaaaaagctttaaaaaaaaaaaatgagcatgatggtatatgtccaccacgccaatcaatcattcaactttgtatgaagcataaacacatctatcattaaacttaccaaaaagcaaagtataatttagggagagttccgtttctaattccaaattcacatgttaaaaaaaaaatccaacgtggtgatttctagatatgaccagccagtctcttaaaaataattttgtaaacagcagcataaatacctcccaacgtaccttccaagccttctcagttaaacttgtgtttctggtgcacatgcgacacgacagtgaacacgctagcatttaatttaaagaaaaaggtgcaaaatgaaagtgccttatcaattcaacaggaaaagctacaccagtaactacattttatattacttaaaacaatatataaacaatatctcttttagctatatatagtcttcatgcccatttaccctgtaatatattataatgctattgttgctactgctatggacccttttcatgccatcctgcggactggcaataatcggtgaaaaaataaaaacttccttcatgaaacaaagagctagttgtgcaaagtaatgccgcaacctccgctatgcacaccagtcaccgattattgctggactctctgttgttactgacagattggtgactctgtagaaagtctgtgggcagtgagctacaagaaaaggaaatcctccgactttagtaccctcctcctgttgtaaacagaggtcaatgatcaagaagtcaagacagaaaaagggtccatatctgtaggcataatggaaatcatatgcatgagaaaaacaagttcaacttttatttgttttcattgtttcccctcctttgcctgaccccgatcaccaaaagatgtgcagtgtgtggcgctccaggtctgtgcagggccatataaagtgtctcggttaatttttttgtttgtttttcatgtttgtacttcagacattctagaagtgcttaggtgataacatttacccatcaatttgcattgctggctcaaattctgaagtgaacaactccttgtataatggaggaaaatgaagtcgcacaatgtctgggtatattgctttaaatgccattagcttttctgtatgtcgtccacataaggctcttaaggtagacaccttgcatattaactgtaagtgaaagaaaggacacaccgtcaggcaagaacaggcataagcatcaaagatcagggaacctgaatgatctttatgacattgtttataatggtgaaacacacttaaagcaacttaaacatccagtagcagaggattggtaaaaataaatgatggctgggcgcggtggctcatgcctgtaattctagcactttgggaggccgaggcggttggattgcctgagctcaggagttcaagaccagcctgggaaacacggtgaaaccctgtctctacctaaaaaaaaaaaattagctaggcatggcagcgtgcgcctgtaatcccagctactcgggaggctgaggcaggagaattgctagaacccgggaggtggaagtttcagtgagccgtgatcgtgccactgcactccagcttgggtgacagagcaagactctgtctcttaaaaaaaataaataaataaatgatgatatagtcatgtcatagaatgccaagtatacattaaatatgattttcaagatgaataattcaataactagaaaagatgttcataagcaaaagttggcacagcttgtcagcagcagactcatacagaacccaaggctcttgacttcttctactccaagatgccttctgctctacttcctggaatcctgccttctaccactgtgcaaaaagatgtctagtgatggagaagcgggtgaggggcagtggtgggtgggtagtgaaggcactgcaactggaagtgatggcatcctctacacattttatccagaactggcactagtcaactccgataactacacgtttcttttcgataaggagttttgcctgtaataaagcaatgctgggtctgagcaaaataatagagtcagaaggcctggatggaggccctagcattgaccatttaccagctgagggtaatgacacaatttgcaaaattacttttagattccaaagcacctcacaaaggcaaactgcttattattttaacccagaataaccttctctaggaaatgttttcaccagatcttgtccacatgttaagtgctgtttataatcagagatcctaatggtactcttgcatttgggcaaagagatggagagtgaagctcctgacagggctcctcccttccacttcccattcctgcccgtttgctcatttaacaggtgcaaaatcaaaaagcaaaacagcaattaacccccagttacccctttctggtctaacatagctataaaggagaaaaaaaaaaaaaacaagcaaacaaataaacaagaaaacaaaaccaaaaacttctcacatcatctcacacaataaaatacataaaataagaaagaacagggctgattgttctaagaccaaatacatactactagcaatggcactgaaggatattagcacatttaaaaaattgacattataatcatatttattgtgaaagataatgattggtaaaaatgaaaccttatgctttgaatacagagtagtgatgggaaattgacaaaaatgcaaaagtcatttactgttgatgactagtgaatttaatggaagtagaactaatattagtatatatggtcatcctgattaagtcttttagtcctttataacttcttcctaaattcaaagattataggctgggcacagtggctcactcctataatctcagctctatgggaggtggaggagggaggattgcttgaggccaggagttcgagaccagcctgggcaacatagcaagatacccatctctacaaaaaataattaataaattagccaagtgtggtagcacatatacctgtagtcttagctactcaggaggctgagacaggaggatcttttgagcccagaagttcagggttgcatagagctatgattgtgccacttcactccagcctgggagacggagtgagaccctgtctctaaaaaattaataaattcaaagattatttttacagtttatgtcagtgcagaatattaactctgctttatgcctaactttgatggaagagaatttctagaatgtaactttttttcctacattgccttattgctgcaggacactttgtaatcaacgatagtaagtataatttagactgaataatgagctgtggctcaacagaatttttttgaaatggaaatttatttctttttagtagcctgttgccttctgatacttttgggaattggtcatatgacttacatgaccatattggcagcatgatttgtgccaggggatagttcaggccatgccaactagaagcctttggcactcacctttgttagtattccatcttctcggtgattcttctgtaggacgtgttgaagagctagctgaattttctgttgcagtttttcaatttttaccttttcttgcagccatgagcgatctaagcataaaaaaatgatattctttagcattcctctgacatggtgtcaggatccttcttctccggattcttttgatacggataattatatcacaatgaatatttagagactcagaggccagtttcactcctctttcaaaatttctcctaatggagtgaaaagtgatccaaggaagttataaaacagggtgttaaacctttccatttttaccaatacttaaaggaaggatcctccccttccaaaggataaacaattaaatatgaggccatactcatatgagtgcaaatgaaaccatcatggcccctcgagacgttctaataattatactttggaatgaaatattcattatcgatcctgctagcttttttgaaaaataggaaagttttcttgtaatctttgtcaactaaaattgtcaatagaattccaactgacttaagggttgttaatttaggataaagtctttatgtctaagtcttccaaatagaaggtagtaacttagcaaaagtgattatccccaaacatgcactactggttgaaaacacagattaaattcagataatctagtggatgacatctaaatggattttaacaaaaaaataggatgtcttaaaaatcttgttatcctggagactggtgttaagacaggcaaccctattccaccacagcatttctcttggtatcaggaggttaattctggactggattttgttcaattctcatttctttacattttgtctgaaaggcatgaggttttctcaaaagaatatatgtttgtgttggatgggtggaaaagagagggtgttatttgaagacttaaaatccaatttaataagggtggagacctctcttagtagctcccaaatattttatagctattaaacgtatgggccttgtaaaaattctttatcttagacaattcgaaaaccatttttatttttatttggttgtcttacctgctgacatcagtacaaatgcagaaaataatgcaatttcatcttcagtcaggtgcatagaacataaactctttccaaattcaaacacaaagctaataaagtcttcacaacctgccaaaatgaaaacaaagacagtttagaattttgattattgtcttaggagaaaaacctaggtcttaggttttcctaaggttctcctaagtccaatagaaggtcttaggagaaaaacatggggaaggtgaagagagatctagtggttgaagatcagaaggaatagtagtaacatttctacagtataatagtttaaaatcttaaaagaaaaatctgtttagtcatcaccaccacttccatcacatcaccattgccactgtcatcctcattgaaaataatgagattgaacttttgttgtgtgactactgtggcaagtattgctctaaggtatttctttgggtttcttcttattttaaaacagctctatgaaggagggattattattatcccaattttagaggtaaggaaactgagacttggagaggaaagtaatgcacctaaggtcacacaggtagaaagtacagcctaagaagaagcaaagctaggctgactgatttcagagcctacacttttaacctatagagtctaatagccatattctaactgatatgttaaattaactcatttttgttttcaactctatttcatctgaaacatccttaaaaatgttaacaaatgacatattctggtggtaaaactattataactatttaccaacctgaaaacacagaatgtgaaagtcccctagaataataatccgttttccaaaagactggttaagtttggtgtctattccttcagatttgcatattttacatataaatgtatatatttaaatgacaatgtgctacatgacagttcattatatatatcatctgtcatataacttttaaaaaaatcactcattttagatacttatccattcttcttaataactatgttcattttatttaaattatagaaatccaaaatttattattaattattctgagacagagtctcaatctgtcacccaggctggggtgcagtggcatgatctcagctcagttaaacctccacctcccggtttcaagtgattctcctgcctcagcctcctgagtagctgggactacaggcgtgtgccaccatgcccagctaatttttgtatttttagtagagatgggctttgccatgttggccagactggtctcaaactcctgacctcaggtgatccgcctgccttggcctcccaaagtgctgctattacaggcatgagtcaccgcacctggccccaaattatttattataaattatatatcatggtttcacttaactgtaacttttatttctttgatatctgcatttcagtctcattaatggttactgtttgagggggatggaagggcaaagcttttgccctttgcttaattttatgtatcagctcacatcctaaaggtcatccgaataatatatcaccagcaaatctggtttcttaaaatctggaagggaactggaaggacacgtcatataaatccctttgattaccaactagataaaatgaaactctacatctttacaagtaatgtagacaaaaaacttttgagctatatgacttttctacagtgactaactagaaagtaaaataggtataaaaccccttaatttttgtttctaaataaagttttcattttgtccaagcagagctttcactcaacccgcatcttttcctatagccctgatttgaagaaaaggcaccttgatatccccttacctaaggatttgaagacgtcggggctggcatacttcccatcaaagtacacggtgttgttctgagagtcaaaggcacggcacattctgataaacaccacctctagagaacctaagcagaggcagaaatggtttgggtcatttgggtcatctgatgttagtgagtttgtttctaagctgctcatgtagagactccttctgcaacagcatggtgggtgtcgtgtgcagtttagctagcgggttctcagtcacatcagctgtctatccaaaagggcagagttttctatgtaattaaaagactgttgtgctgaagctaagccctgtttaactgaagtgagggttgatttataaattacttccttagcactcttctacctcgcaatgcagagtctcagagttgctaggaaagcatttattcatatgtactaaaaccaagaatcaaaaacaagtatatctttctgagttctactttcttcttcctaacatcataaactcggaggacttggagtgtagaaacaaaacacacgtgatgggaaaatttgggaatgtaggtgaccttcaaattaatcttttcacccagaagagaagaaaagtggggggaatgtttcctgaatatatcttaaaacctttgaaaagaactccatttctgctaagaaaaacctgagctattatcattggagaaaaactgttcccgacaccttccttaccaagcatttctttaataagcgggtgaaagcaggttaggaagagatctcaaaattcacttgcaaagcacatacctgcttttagaagcacaatttgatcattttgacacagttccataaatccatcaatgcgtttggcaaactccaccacatactgtatagcttctgtaattttgatggcacacaattgccacatcacctcccgctgctgttaaagagggaaacacattaacatcctccaggaagatgttagcttttgtagcagaagctgcagagttatgaaagcaaagcatgccactgctttagccctgggccacgaagagtggcaaagtgggatcttattttattttattttatttttgagatggagtctcgctctgtcacccaggctggagtgcagtggaacaatctcagctcactgcaacctctgcctcctgggttcaagtgattgtcctgcctcagcctcctgagtagctgggattagaggcacctgccaccacacccagctaatttctgtatgtttaatagagacagagtttcaccatgttggccaggctggtcttgaactccggacctcaagtgttgtctgcctgggcctcccaaagtgctgggattacagggatgagccaccgtgcccggtctggatcttcttttaagtaattattttgccttgggaaatttaacaccactttactttgggggaagggagaaaaggagaatcaactgaatttattgtgcacctactatgagctaggcgctttatgacatccttgttttaattcactttcataagaatattttttctggctgggcacggtggttcacgcctgtaaacccagcactttgggaggccgaggcagggggatcacttgaggtctggagttcaagaccagcctggctaacatggtgaaaccctgttcctaccaaaaatacaaaaattagccaggcgtggtggtacacaccggtactcccagctacttgggaagctgaggcagaagaattacttgaacccgggaggcggaggttgcagtgagccgagattgcgccagtgcaagtgtcagcttggcgacagagtgagactgtctcaaaacaaaacaaaacaaaaaactggtggatatgggagccaggattcaaatccaagcatctctgactctaaaatcctatttcatatactttgttgcttcttactgttttcttgcttctcctttgtagctttggctgctggcattacctgctacctcaaaggcaaacaaagcaatgtgttgctattccccaacatgtcctgttaaattccttttatattcgcactctccatttcagttacagaatggtctggatctttttcgttgctaacttgtttccccaatcttagtttcagactgttcccaccgatatgatggggtggaagaaacactgaattaggagccaggagtcaaggtctggtcttgatgtttcactctccagacatgccagtggatgttagttttcctcaaatgtaaaatggattcacttagataatcttgttgatctgggtgttttacagaaaaaggcaagtagggtactatttgtcagcctcatattgctaggttcagactggagttatgatcacagcttctaaattttttttgtatatactccctaatacaacttccagaaacatgaggcttccttgtcaacttccagaaacattaggctgagattattttacataaacttccagaccttaaaatcttgattgtgatattgagacaattctcaattcatttagacttttggaagctgcttaatctattctcctgttgacaaatggaaggaggtatgtgtatacctagaaagcacaatagaaattatttgctattgctgaaattttgcatctgagttaaatggcaaagcctcaagtacattagtagcttcagaaaaaagatatttaaacagaaacctgatgacattcattctttagtctgtgtgaactcttgaccaactttcctataccaacacccttcccaatattgcctcaatcctaggaggaaaaattcctcagatcataccttgttttgatagttctcaatttcttcctgtaaaaaggtctgccacgttatctgctggagctcttctctcaagtattggcaggtttccagatgcgatttagatatattctgtgcaaggtgttctaaggagaaaacgggagatcacaaacacgaaaagcgaagttctttgaataattggtgatttaatatttgctttaagaaataacaagtagaaaacaatgtgctgtgcgagttttgactgtctttacacatttaaacaagtaatttggaactgttttgtatttgggaacgtgaaggaggacagggactttgcaaagccagcatttgaagataagacctgctgacttcaaagaccctcctgactttgcccttgttctgtgcctttataccaatgtctaggaatgaaaaaatattgacctagatagacataggaaatgattgacgtggtgcttcttcttggcatttttatgaagacacatctgccacataacattgacctgggaaggattattcttattcttgaaaaactagaaaatgatattcttttatggtgacaactaggtatttcttttgtttttcctgcaaattgcagaacaagcattactgagggcctaccatgtggctatgcatagtgtagttgtgaagccacatactctggagctagaccatttgagtctgtatctcagctctgctgcttactagctgtgtgatctcgggtatgttatttaacctctttgtgcttggtttcctcatttgtaaaatgagggaaatggtacctatttcacagggctgccatgagaattaaaagagttgagcccttagaatggggaggattacttagaatgtgctacagaatattagttattattatacttgagcataaggagtttgaagatatgaaagacctagaggccaaagaagttttctctaggagcttgtaatctggtgaacacgtatgaacacactggaaggacaattcaagtctagataataaggtataaagttgaattacagaagaagagaaagaaaaaagtaattgaagctgtcagaaaaggaagagattggctgggtgtggtggctcacgcctgtaatcccagcactttgggaggctgagctgggcagaccacttgaggtcaggagttcaagaccagcctggccaacatggtgaaaccctgtctctattaaaaatacaaaaaaaaattggcgtggtgttggctgtctgtgatcccagctacttgagaggctgaggcaggtggatcacctgaggtcaagagttcgagaccagcctggccaacatcatgaaaccctgtctctactgaaaatacaaaaattagctgggcgtggtggcgggtgcttgtaatcccagctacttgggaggctgaagcaggagaatcgcttgaacctgaaagctggaggttgcagtgagccgagatcacaccactgcactccagcctgggcaatagagcgagactccctcttaaaaaaaaaaaaagaaaattatatctggggaaatggaacaagcagttttgtgcttggtgtattggagcacagagaagctcaggcaggaggaccacatagaaggctgctagaatctagatgccaggaactaacaatttggagcagcttggtaataattgttctggaagggaaggatgattaaagaagtattttttaaaagaattgacaaaatcccatgaatataaaaccatatcaaaaaatgatccctctccctagggttttgagtatagaataggcaagtcattttaaaagaacggtgctgaatgcaaacttggcaacactagggagaatatctttttgtttggaaatttgttactgcttttgtcaaacagaagcagacttgtttgtgtgaaaacagagcaggttcacctaaatggagctggaaaccagaatctccttagagacactgaaacataataaacctgaatggccctacttggcaacacatagacactaaaacagcatgaataaataacataaaaaataaaacacaaataaaagaacaaatgtaaaggaaagaatgagaaactgagagtgagagagagaagccagtaaattacatgtcttagaatcaatgacgctggagaataggtgagtaaagacaaaaataatggggagtaagaaacaagaaaatacataaataaggtagtgaactacctcttttggaaagaactctcactatataaggtcgtttctagaatgtaaaccaatttttgccgataaaaaaatgatgaagatgaagagtcttcgcagggaagtagggggggatgctgtggagtgaaggatgagaagaggctcatatcatttccttccaggttatgtttcatttctagttaataagatacttagcatcttgtggtttcactttgtcttaagaaactgtggccacttatccctacctatttaaaacagccaataaaaagtgagacaacaaatcatgcagtgtacctgacataccagtagagggcagtggttgcattcacaccatctgctcaccaacagcctttcattccaattcatagtcgatttggcaagtgtaagattttagacactttgctatttttaaatctccatttcagcaaaggcgagtatggtcaggctgaataaaattcgagaatttaagcgtggtctctcagataaagtctggaatagtgaaataccttgggctaggagttaggagacctggcttctgtctgagctcagcagataatctatagtctacctcactttgtgactggggcaagtcatgtgccccaaccatgactgcttcagcaatacagccagcgcctcgatacttcagatgggaagtcctcgcttctgagttagtcacagattttcatagtgggaaggaactttagatagcatctggtccaaactgtccttgtttaacaaataataatgacattaataattatgatagcagttaacacatatagcattcactatatgccagtcccacataatttgtgtctatcctgaatatgtatgttttctcacttaatccttataacaaccccaagagaaaggtactagtattatctccattttacagaggaggaaactgaaccacagtgaagtgacttcttcaaggtgtcacagctggcaagtagcagagctatgattcagacacagacctttatattctaggagtagagaaactacagctcgcagatgttacgtggtgtatactgggttgtataacttatattaatgccaggaccacaacccatataagcggatttcttgtctcatgctttgcccagtatatcagctgtttctcctgcgcaaagctttagatatcaattatagtaacaaacctaatttgcacttaaaacctaggtcgtttatctggaatgtctaattcaggtactaattgtacaccaagggcaaaatttcctagccaaggatgaagtcatatttttcactaaaagtaataggttgtgcatactacacttgaaagagagaattggacttaggatgtgttggtttataatttattttcctattatacaattggtttcacttgtttaaaatctgatgacaaagtttagcctaaaatgaagtcaagagtcttagttaaagagatagcaggctttaagccccaaaagaaataccagggaaatttaagtagctttggagaagcagcaacaagacttgggccactttcatgatactcttagctccctgaaacactttgcatgtataaatgggataagagaattagagcccaattatatactttccagataaatgctagtttagttttgggtttgggaattctcctagtgatgatctcatttaatttatcttggtaaataccacaacacctgtgaaaaatccctaatttaaaagcacatagagcaagcatgagggggcagggctcccagactgcactggaaagtgagaccatggaagaggaagctgacttgtccgggagcctcagggaatcggctcagccatttctggccccacttcggtatgagtgcattttttagccaaagtgccatgttcaagggcacgctttgcctaaggcctatggatttatttcaggattgaatatttgacaagcaaacaggacagagtcactagtatttatggtaaggtggaggcaaacctaaagtgagtcaggtcatttttcatggtatcatgtcagctttcaatcaaatccttattcatatctgaaaattgtactttcattacagttctgcttaaggctcagccaaccaagatttcatgacaaaaatggaaggtttttgttctagttcaagaaaaaaaaaaaaaaatcaaacctacctctgctcagcttggcttctagttcagaggtttctctgttaatcaaaagagctgcaatacaccttttaatgctgttcagtggttaaagaccaggcttaaaatgtccctgctcttgaggatttaaatttagacccataaagagatgcttgtgtaaaaaccgtaaagaacattcaatttgttctatttggagaaagattttactggaaatataaattttcacttaaaagatgttttatggggtgcagaggtagagaaaccgtctaaagaacacagccattatttctgtgaactgaggatttctgtgctcaagtctgaacctgctgtttcttttccgtctgaagtcttcattctctccttgtattaacttagtcatctccacagcaactaattgacatatcccaaaggattataaccttgtgtgaggaaccaccaggaggagcagatcaaatttaaaaactacaaaggttcttatcaaagtttttctaataatagtgctgtacttaaaaatcgattaaatatagcagcggatgttaacacaacttcctcgaaatggaaagttgcccattgtctgtgttatcaacatttctaggtcacatctcccaagaagcagtaatgttccagcaataagaaaaggacagttttttgtcttttgcatggtgagccttatatgaattacatcaattttgtcaccaatatccatcatcagaacattttggtaagtaaagaagctgatttctgttgaacatttatactatatatcagagttgcaaaaatgagatgcctacaggggctgtgcatatgatataaatggcgggagtcaggtgggcccattgaaaggtgtaatcccctggctgttgccagttggctgttgacattcacaaatgttggctcagtgtaaatagatcattttttcccctcccacaagaagctaaaaaagctgaacttttgggtataattatccaaatttaaatattagcaactgattcaaaaattttaaaactctgccctgggcaaaaaaatatgtctgtgggccaagttcagtttgtggactgccatttttttttttgtcaccttaggtataaagcaatccttggaatataactaaagtaaaccactaatgaagttaatgtagccatttcctgaacttacagttttctgcagaattcaaagactgcttccgttggttttgccccatttctaatgctgagaggtcaatgcatgtattggataaaccatgggaaacagcagagggtcaaaagcaagggggcagggcagaaaattaagtggcccaaatggtaaaggtgaattgcatcatttagcagaactcattagaggaaagtcagacataccccttttacttcaaagggcatgaatagagcatcccaggagaagcatgcatgccattacctaattctgccatggacacagttggggaagtctcgccgttggtgaacgaacagtagggaaagaagcctgatgctggtgtgtagtcacatattggttctggtttgattccattgatatcaagacctgactggtctggggaaggctgtatgtccaggtagaagctgctgacggcggagtctgccttactcccctcaggggtgtgcccgtcaatgtagttactgaggtcgtcgtgaagttccgtcagcccgttggccgagatgttgtaggtgggcgtcagcggctcagcctctccaggctgctgctggtggtcgcgctgctgctgctgcatccggtgtttctgtacttctgcatacaagctgtctctctgcttttttgacattcggccaaattttacagctggaagaaaaaagccaaaccatactacatacaatgcgcttttcttcaatattctctcctgcgagctttggggtttcctttgaagtctcacacaatctcaatccaaaactgcatgaccacaaaataaggacatattcagaggtgaaaacagttccaacccacacagactcgctccagctccccaacagcaaacacacatcccagagaaactcatgtttcagaaagaggcctggtgcaggtaggaggggcccagagagatgccacttctgtttccctgctgtcacatcccccgtttccactgcgccccactgataacttaatgggcttgttcactctccccccgtgcagctggcttaggctacctctttctctcccacgttcagaccaaggcacagggaagcaaagactcacagggttcatcaaggaataagcagtcaaacctcagcgttcattcagttcaccgtcttgtacgctccgacagttctccctgatcaaatggccacttctgcagcttcattgtgaggtctgaatgaactggatgaggcctctgtaattctttgaattacatcagagtacctgacctaagaagccccctcctccagtcatgggtcatgggtcatggcagcccctgtggaaccctgagacccatctttatttttatttatttagttagttattttgagacagagtcttgctctctgtcacccaggctgaagtgcagtgatgtgaacatggctcactgcagcctcaacctcctaaggtttgagcgatcctcccgccttggcctcctacgtagctgggaccacgtgtgtacaccaccacacccagctaattttttcactttatgtagagatggagtttcgctatgttgccctggcttgaggtctggaactccagggctcaagcaatcctccagcctcatcctcccaaagtgctgggattacaagtgtgagctaccactcccagtaggacccatctttaaacactttctgctgttcccatttagcctcaagtaatcacagcatcaggatttggaaaggacaaatatggtattataatataagatccttataatgtatgatccttgttgggcagatttctgtttgtaatgcttctctttgggatgtgtccccatatttaaagtggagcagtcactataatgaataactttccaattcattcagaatatcaaatgaattcttgtgaaacaccaagataactgaaaacaaaaacacacaaacaaaaaaccctatgatttcctggtctgaattcttccatgaactcacttatttttcagctagactcagtctttgctggagggacttagttctcctaattgattgtggttaaatttatagctgatggggtggatgcattcacccatttgactatgatcgtagttataagagtctagggcaggaggcaggatagatggacacgaagttgggaaccaaggccctcacagtggccaggtggtgaattcttttcttgccaaagaggacgcgctgtccttgttcacagaggaaacaggtgagctggaatactggtcactttccagtttccacaactcagataagaaacttgggtggggctgctcaggcagcaaccaggctgatgtgggatctgaatttcagaaccataatttcttaacctccagaattctttctatgcctacaacaacttgtgctatttcttatatgcaaaattttcagaaggcatactgaaggtgcttaatttttttgaaaaaaattttctaggacactcaaggggcctaatacccacaggtgaaactttctgctgtgactccgcaattatgatttaacttttgtattaatattaacgacagtaattatatcctgtaagtgaaataaagggaccagctcttgagaaaatgcacacacaacttgtgatttaaacttacaaattgatgagatatacctaactttgtcagtttagtaccatcggaagatgaaatctgcagagttgcatgtcacaggaatttctgagaatatggtggaagttctgtgatttgtatcttccaatgtcaaaagcttcacttttgtagtggtgcacagagtgcctcttagaatacgcaggaacaaaagtgaactcgtgcctatgtagatctacaggcgctaagaacatcagattatggggaaggcagactgttggaaagcctgctccgcattctgaagtatttttccacaggctgaaattccactggaggagacattttccttcaaagggatctcttaagagagccagctggtatatttggaaaaatccttaaaatggacccgctgtgctttctgcccagtttccacgtataagcataactgtcttgaaatctggtgttgattattcagtgcacttaagatagttttccaggaagatcttgaaatgttttgtacttgaatggtagacggtctctattccttaaagtagcttcatttaatgaaaagaacacttgtcattgagccatgctttgcactattttcacacattctgtatgtacaaatatttggctttggcatgtgattcaaaatatccagttagcataaaagcggcttcatcccaacctccaatagacttactagtgtaaagcaagtaacagttgtggttcacatttcctgcaggggaaaatgcctagaggagacatctttattaaggccttcagatgacacttaccgtcagtcaatcgacccacctataatggctgaaatatcaaaaatctgaaggtgttctgagcacaagacacttctcctccacaccacccccacccatcagccagccagctgactctgaggatgaggaggaggaggaagcagctgctgtgagttccatgtagctgccagaggagcatggggggcggggcgtaaggtggaataatgaggagggggcaggcggggcagatattggcagatctgagtccaggtttcagaaggcactttcacaaccccgtgcaactgtacaactcaagctgtgagagctcaccatctcgagacatccctacggcaaggcatttctgtaatcgacagtgttggcagcggtttctactggttcgatcaatcaaacagttcttctgacgaggacaggagtaggtggcattgctttgctgacttctcctgaaaaagccctgtgatatggttataaaatataaaacaggttagtgtcagaatgagtggtatgatactaaaggcaggatgctaagcactgagtggcattaatatttaatggagaattaaacttgtagcagaatcatccaggagaccattaatgaaattaaagtcacttctttttccttgagtaaaattgatccccagagcctaatcctccatcccttatacctgcaaaactttctttaacttcaacagacagttgcccatgtaaaaaggcacaggaccaggtccttgttcttggcttctgatgatcaaaagcaatgtgcctgatggaatgatacaaaaggacttacctttagcctttatctctaagagattgtttgtaaaataaatacaaaacacttccctggaatatccaagttaaggaaaatgcagccacaccacaacctagggcactgtgaacctggtgaaccatggtaatcttcactagcccacttcaacacacggccctttaggcgtttctcactccccaagtctgaatctgctatcgcaagcattagataacacttggagggattattttggcagatcagattgggaatattccctcatccctggcagtttagaaataccacatgttcagaaccatggcctttaaagatggaacaaatccagtccaatgctcatcaagttcctctcgtgtcaagtgctgtttgggaaatgagaggggatacaaagatgtataaggagctactgacctcaataactttatttttgtttgtttttgctaacttcctgagctgtattcttagctgattttcactgtttattcttagagtgtcaagttttccttttagtgatgttttaacagcaacccaaaagctttactacgtagtattttcattctcattcagtgaaaaacatgttctaactttcaatagatttcttcttcaatccagatgtgatttagaggcatatttcttaatttccaaacacatgggggctttttttcgggggagggggcagggtcttgctctgtcacccaggccagactcctcggctcaagccatcctcctgcctcagcctcctgagtagctgggactgtaggtgcacaccaccatgcctggctaattatacatacatacatacatatatatatttatatatattgtatttatatatatatttatatatatatttatatatatttatatatttatatttatatatatttatatatttatatatatttatatatatttatatatatttatatatatttatatatttatatatatttatatatttatatatatttatatatatttatatatatttatttatatatatttatatatatttatatattatattatatatattatattaaatatatttatatatatttatatatatatatttatatatatatttatatatatatttatatatatatttatatatatatttatatatatatatttatatatatatttatatatatatatttatatatatatatttatatattttttttggtcgagatgggggtctcgctgtgttgtccaggcctgtcttgaactcctggccttaagtgattctcccaccttggagtcccaaagtgttgggattacaggcatgatccacctttttatctttttattgctcatttatctttcagtggctttgcaagctagggatgtatgcagaaaaaaaataaggtaagtagagtcatttccatgaagcaaagccatgaagggtacaaaagagaattattaccttcaaagctttagttgtgaagatagatgaccccaatgagggcgacactagtggggagaggtaaaatcctaaagaattaacagagtggtaggcaaactgataagggtgctctcccactgaacgatttttctggaggtcaatttggcagttgtatcaaaaatttttaaaaagcctacccactgagctaggcttttaaggaatacacgttaaagaaatatttagaatgctacaaagattttcctacaagggtgttcttcacagtactatctataatatagagaatgtagaaagatcctaactgtccaacattactgaattaaaagagtcatattgtatactcatacaatgggattcaaccactacaaatggtatttcagaaatataattattgatataaaaggtgataaaaatataccattgaatgtttaaaaaaggaactaaagagctaaacatagtataatccaagttttgtggaaaaaaaggacacccatatatttactataaaagaagatttggaaaattatgccccaaattgttggcagtagttggtggggccaatcagattttatttttctttttgttcatctgtgctttttttttttttcccccctacaataggcagatgggaagttatggtgggcagcttgagaagaagtgcacctgccttcctttgtaatggctgggggcctttgtcaaccaagttgatgtatatgacctcagtttccagttctttggaaaatccaacctgggatgggacagggcaggaccctgacttctcactcctcttgctttcagccaaggtgcttgctaaccttgacatgggcaaggctgggggcctcatgtctcagactgtctctctgttgtactttaactctacccttgatcaagtcccgcctcttctgtaaagcaatctctctcttctgaaaaatatctaaagctatgttttttattttattttattttattgtttgtgtgtgtctgtttcccctgtgaaaaggaagtaagaagaagtaaggctttctttgggggcttactagagagaattcaagaaaatataaatggtcacagaggcagataatccttagaaagagataccaagaggtcagctgtctaggtattcattttcccctgagacacataatctctgtccaagctgaaaggtgtttatctctttcttgagactctcccaccgttcatacccttgtgtaaaggcatcactgtggatgcttaaaatcaggaatgtatttgtttttgctttagctgaagttgagttttgtttgcttcacattaagcctgctacagtttcttgtgtgatcaccgaatatgaggaatgtctgaatgatctcttctttttttctttaagtggagctagtacttgagggctgccatgctatttcctagatatctcttctgacgaccaaatcccagcatctgtcacctttctttctaggctcttttccaccttgcatatttcttctcagaatcctttccaatttcttcactacttctttttttcttttttaaaactgaggcagggtttcgctatgttgcccaggctggtctcgaactcctgggctcaagcggtcctcccacctcggtcccccaagtagctgggattccaagtgcgagcccatgtatctggcattatttcttcatttctttcaaaagtctgaagtccctaactagacatagctcttgaataatggttgggtcattaatgaaaaggatgccactttttagtttgcatacatacattaagttaacttccacccaccattaataaagtccaagactgttaacatagaagcatatattaatcatcagttagctctgctttaagggcatgaggatgatgatgacagattatcagtcttactgagtacttgtagtaaccatatctttttattctgtattttggatgcagacatcttcgggctttgcagacactggagggactgcccttgcagggctggataactcctacatacagcaaacaacctgctgtcagccacctctcacacaaaaccaagtgggctagagcccacacccagcacaccttcttcatcaggcccttacgcttctcgccatgattcccctgccctggtcaccctagggctaggtacaagacaattagggacagcccctacctcctagcgccgtctgtaatgattcagactagctacttatcctaatcctgctcatcctgctgcaccttccttcctgtggaaaacaccatggaggctcttggcagtgtttccccacatccctctccccttcactgaccctggcgcttccccatgtgtcccctgtatggtgtggcatgggccctgtctctagggatttgtgagtccagcactccctccttaatcgtcgttttgctttcctcgtttcagttacttgcgtcaactgcagtaaaagaatattaagatattttgagagagagaagggaagcaaagagagaccacattcacataacttttattacagtatattttaataattgttctgtattattattattgttgttaatctctcattgtgcctaatttataagttcaactttatcacaggtctggatgtatgggagaaaacagtatctaaaaggttcgcagtttcaggcatccccatgaggctaaggggggactactgtgtaacaaacttcttccttcatgacagtcatttccagatctgtgtgtcttatggtacctgattaaaacaaatcccaaataccattaaaacagcactgacttcatactaggcactctatgctttatgtggattgtgtcattcacttgtgacaagggcaatattgggcaaatcctatcattcccctggttttaaggctgaaaaaacagaggcttagagaggtgtagtgacttgctcagagtcctcgctgtagcatggggtaaagccaggatatgacttcacatagtttaactccagaacttacactgtcatcttgttttgtttttctgcttctcttgtgtgtcaaaagaattcctccttagttgttctcatatggggcaaccattaaattaggcagtgtaaaaaacaagttatgcagaataaagtagcaagagcaatctactctgaaattagtgttttccctcactttagcacctttagctgacccagcttcctaccgcccagacattttacaaaaatctctctctggagttgcctcctgatctggattaggagtcacataagaaaatcagtctcatgagtccatcatttttcctcatttctgaccagaagtattctgccccatttgcttcaccttatttctaaatcactctagctcatttaaacaaacaaacaaacaaacaaacaaacaatgaaacttactgcaagggcacagaataactatcattaaagatgtctgtgtaattatgccataagttgcaaggcaaactcatgaagcattccgtatgttctttgagcagtggcactgtggctcgaaccaatgtccagcttccacactctctgcttggaagaggattacccttatttggaagtctcagttttgaggatttggggaaagcaggcacgcaagcagacacaccttattctctacagcatcatttatacctcaactaagtcagctgaacaaatgcctgctgaaaagttctgggagtggcatagctaagaaccagaaaggcgatctttcttttggattaagtcaacagagtcatacccacaaggagaactatcaaatatcagatgcgagaggtgaagtggggttataaggtgagagctgagaagggagaaacagggtgagtaaacctccatgactcagacgaatactgaactttgcatttcaggaagaatgagggtttgggttgcttctttttctttttaaaaacctcttcttttcagtattccttggggggcggggttctcagaggattaagggtttggaaaattaaacagataagatactaagagttaaataacacataagaggaagaaggattagaaagaggaagaagaaaagtagaaagtgtggtaggtaccttcctacctcaaggtagaagtagtgtgtttctaagtacagagatagattttgtctgattggggagaaatcctgcaaaaggattaggaagtgagtgagctgagagatgaattccagggattggaggtcatacagagagcaggggaagcacaaaactagggcatggagttttgggtggaactgaggaggcgtaaaaaaaaagtgctgaagttgtgagctgggaaaggtatcaagtacataatttggcaattttgttatttctaaaagataagctaacaaattacttggctgtcataaaagttcactttttatggatgttaaaatacatggagatgttcatttacaaacatggtgagcttgagccagagagccaccatgatacatttcaggtagtatacgtttagtgtgactgtggcgcactaccaccacctagtggcagcagattaccatgcagctattgcaaatagaaaattagaataaaacaaacaggcctttggtgctgaaagactttgagagattatcaggtacagcagttgacatataggtgatgcatcagaaacacccacagagcttttaaaagatacaccttagatatatcaaaccagaactatatatcaaaccagaaacttttggcgatgtcgtccaggcatacatagtagtttgaacaatgagaaattcccatttttataagtcaaaaaagaaaaaaattgtcatttttttttttttgagacggagtcttggtccgtcaccaggctggagtgcagtggcattacctcgggtcactgcaacctctgcctcctgggttcaagtgattctcctgcctcagcctcccgagtagctgggactacaggcgtgcaccaccacaccgagctaatttttgtatttttagtagagacagggtttcaccatgttggctagcatggtctagatctcttgaccccgtgattcgcctgcctcggcctcccaaagtgctcggatttacaggcgtgagccaccgtacctggccacaattgtcatttttatagtaaatattttttaaaagctccccgaagactttgacttccttttgttaagaaccagagattgattcgagttttctgatttgccaaaaacaaaaatgaagtttagaatgttaaatgacttgtccaaggtcccatggctgggactcaatctcttgtcctgattttaagtccagtgccctcttacttatatgtatcttcttcattgtgggacaaacaaaacaatgtcacacattctcgatttcctgacacagagtccctacatatccaccttttgtttcaattcctactgtctcaaagacatctctccagtgttcctcccttatttcacctagcttttcaaaacgccttgtgcttttatttctgatacgtgtcttaccttctctggaaattctattccctaatactttttctttaaaaaaaatgactgtatactatgaatttttcactgatcccattagatgggcgcttggcaaactgggacagaggccatggtgtttaggagaaggctcataccaggttgcaagagctgagtgctaaaatgtcaggaattttgttattaaggctagttattaaatctgttattacacattaactgatgcattcctgacataaaaaattaactactttttaatgattattttactgttatcaatgttcttcaggttgtctacatcaattatccttatatctgaaggtggaaatactataccatgctgtgcatcccttccctactctgtattctgtgaaagagcgggtcgggtggcttgaaaatggccattggtgggattatttacaccacagaaattggcaaatgttacagatcagggtttgatttattattttgctttattgtctagatttaaaaagtgatggcccaatgcagtggctcatgcctgtaatcccaatactttgagaggctgaggcaggaaggtgatggcccaatgcagtggctcatgcctgtaatcccaatactttgagaggctgaggcaggaggatcacttgaggccaggtgttcgagaccagcctgggcaacatagaccctgtctctacaggaaataaaacaattagccaggtgtagtggcatgtgcttgtagtcccagctacttgggaaggtgaggtgggaagattgttggagccaggagtttgagggtgcagtgagctatgattgtaccactgcattccagcctggacaacagagtgagaccctgtgtcttaaaaaaaaaaaaaaaaaaagaccaggtgtggtggctcacacctgtaatcccagcgctttgggaggccgaggtgggcagatcacgaggtcaggagttcgagaccagcctgaccaacatggtgaaaccctgtctctactaaaaacacaaaaattagccaagcttggtgacaggtgcctgtaatcctagctacccaggaggcggaggttgcagtgagccgagatcacaccactgcactccagcctgggcaacagggcgagactctgcctcaaaaaaaaaacacaaaaaaaaaaactgatgaaaattataataatgcagattaaacttaacagtacatcatatccagtgctcccattgtgaataacataaaaagtggaagaaatgttcttctggtatttgaaaactattaactgagtcagcaaggaagtggttcatgtcattgttggcgaatgaatgaagttccaaaatgtcttcgttgtttcactcccttcttagtcattaatgtaaacaaaatatcaaccaacattcatgttggaactagtctttcctcagttgtaaccatgcagatagatgtaggagttcagcaaaaatcatgagagcattcagtgagaatcatttgtctatatgaaatttaaaataaagaatattgtatattttattattgtttgaaaattatgtgaaattatatcaatgagatagataccaaagttatctacatacagatagacactttttgctttccagagagccagttgttcacagcttaccagcatgtggctggcctgagcctcatccttgctgtgtcaccagctctccatcacgttgtttcaatgcttccccctgactttggataggcattcacccaaagttgtggtttggccttctagagcccccattgactttctggaacagaatatatatatttagagatacggtctctgtcactcaggctggagtgcaatggagtgaccacggctcactgcagcttcaacttcctggactcaagtgatcctcccacttcagccttctcagcagctgggaccacaggtgtatgccatcatgcctggctaatttttaaattttttgtagaggagacagggtctcgctttgttgcccagactggtcttgaactcttggctttaagtgatccttctgcctaggcctcccacaatgccgggattacaggcatgagccactgcacccgacctagaagagaatgacccacagcctgtttcccagctgtcctctccagtgttttcttgctcagtgacaggcatcatctttccctcagttactcaaggcagaaagatgggcttcacttaatctctgcctcctccccacccatattcaagcatcaccaagttaggctgcttcttggcaccttcctatttctcagatccatctacttgtctccatctttactgcagttttcttaagtttccatgtctttcacttcttgagttggttattatacaaccttccaattgggacccctgcttccattctcattccctccaatccatttcacacagttactaaagatatctttctaaaacatcaaactgatcaagtcacttctctgctgatgagcccttaatggctccctgctgatgaccaggcaatgaccacatgtccgggcagctcttctcaaagtcatagaatgaccaagcgtaaacttctatctccacagttccccaaagaaactctctccttcccttcaggattcactgagaagacattcggttgctctgggaacctctctgacctgggccctctcaaagctggttgaggggcccctcccatgtgcacctttaagagtcctgtatttatccccctcctagcccttaccttgttgtattattaatgtctaccttttccagggcctgactgccttgtttctttgtttccagtagctaacccaatacttagagaagtcaataaatacttgttgaacaaccagaggaaaaaatggtggcagtgataaaaacagtggtgacgatatgctgagcacctgctccctactaggcaccatgttggacactttgccatcattatttgcaatccgcaacaacctacaattggcaaagtagggatatgtatatctgctttacaaatgagaaagttaaacttaagagaggttaagccgtgtgcccaaagtcacagagcaggtaaggggagggcccaggatttgaattcctgaatcctaggtgtatcttattccaaaggccatagacttcttaatacaccacctaaaaagcaccaagacaaacatgtagggccgactgaataacaacaacaacaacaaaagatgaacaaacaacaaaacaaacacgcaaaaaaacacttttcaatttctgtagtccgagttccctacaatggttcagatgagggagatggcattttatagggtatcaaataccaggtttccatacaggtaggaaagcactcatttgtcagataaattttaaaagcctggaaatatgcctggcacttcctactggagttttaatagttttgtctaagttcatgggctggctggacgctgcactgtgggtgtggctgggaaggtgaacgggggtctgattctgagttgtcccctcctgtgtggggctccttctcagtgaaacagaggctgaaatgctgatctgatgtttggtcttttgacaattttcacttaatgaattgattcctacagttcattaacatacccacttccacttctgtatacacatatgtcttaattagctgctcattggctgtttaattacaagaaaacagctgacagctgccttgctgaattctaatggcagacgctttggaacggctacacacttgcttttgacaaccaagatttattcataactctgcgatttattgtgaatgctcgtatgcctgcccaaattattgtattttccagtacaactaaaaatttggaatttgggggactgctgaagtgggtgtatgtctacctttcattttacgtctgagactaagaaaagtagagatgagaaaagcagagaatcttctatgtagaagcatgtactgtgttgcaattttatttatcttggcaactttctgttgagaatgttcagaagcatgggggtgagaaggaagaaatatctctggatcagtgtgggccaaaagttaattatctggctagagggggaaaaagaggataacttcattttattgaggggtaaacataaagggcatgcatggattaaaatcaagcagatgaaattataaaattaaagttgggtgggggtcagaaataagagtcctcaaagaagcatatgaggaaaaaaagttgttctttagaaagagcaggcggcctcattcacgaaagttagctggtccagccctatactcatacatctggcagcaataaatcacagaaattcagatttcctgagctacgtttttgttcagtagtgactggcctccctgtagaattgtatgcgcaagtggtctctgattaaagctgcccacgtgtcatatttggtaagtgtcgatatctgcttttgactgtgctttgccatactcagatccaatacaagtgaagacattcagcaatggttattcccaagcacgcacgagggacctgccccaagccaggtgctgtgtcagggccctatctacaacatggcttcgagccaggcgttttctgtgagctgaggaagggcagcagttactgggacatgattaagatctaaacaaacaaataaaaaaaaatctgaatcatcttgatgcaaattgggttttaacacagccctaccacttgcgcatttcatcacaggactggaagatttagctaaacaaaaattttcgcttactgcctgtgtataacagaaccgaaactcaggcatcgtaaggatgcaataacagcttgtcctcccccaggtggaattttcattttaaatgcccagctctaatactggggccacgtattaaaataaaaatgagcatgaatgtatcaatggtgaaaagtggacagaattagttcacgactagcaacatttcacaactgagataataatattagaatcctctaaaagataatttgagcctaaaaggaacattcatataaagctgctttttaacctaaacataaaaagctccagaaatggctttaactacttcagtgggggaaggtgtcacttatatactctagatatttttgaaaagccttttttattgtttaagaaaatatatttgttaacgcagagacattgtctcaaattatctttagtgggtagaagaggaagctttgaataagacatcatcttaaatgtattgattggtaagtgtatattggacaaatgaatgccagtttgttcttagtgttatcaagaggaaaaggttttaaatgtaatcagaaaccaattcactaaccccaatactggatcgtgcattatcattaaaaaacttgcagttaaaattgtgtagccaaaatatctaaaaggatatggattaaaaaatgtatgtgtgtcttgagatcaaatgttcaccctcatcatctgagcagccactgtatctcatgatgaaattaggaacagaagttgaatggcaaacaagatgatttctcaaaagcaaaccttaaccaatgattattttcctcctaacacttcatatttttattcactttgaagattgaactttaacatctacagcctctagtgttaccatggccttttcttgtgctggcatggggcacgacctgcccctccttcctggcaggcctgccccagctcacgttatgccccctcatcatgctcacccaaggctgaaactaaattcttttccaagagctcagaaatgtctgtatgaacagaactaaaaaccttgcaggcctggattctaacatatgttcttccgaaatgcaatattcaggctgaagcagtgccaatacattgttccctgattctttcaagagaacaagtaaaatacgtttataataaaaaccttggcataatggagtccttaaaaatttgaggatggtgtgcctgtctaccctcatcttccactagccacagaaagtgaccctttgcttcaatcaaactgagttatgtgctgtcccctaaatacaaccaagactgccctttttctgggcttttgcctctgccattccttgttctccttcttcctcagcacagaatgccctcccagccaccttgactgggaaaatccttcctcagctccagcccacggttggttcctcctcaatgaaaccttgctaggccaactctcctttagaccacctaggtatgctgtctagtggatatgtgcttcttttttctttttttttgagacaggggtcttgctctgttgccaggctggaatgcagtggcaccatcatagctcaccaggagccttgaactcctgggctcaagcaatcctcctgcttcagccttccgagtagttgggacttcaggcaaacaccaccatgcctagccagttttttttatttttaatttttttgtagagacagagtcttgctgtgttgctcaggctggtcttgaactcttgtgctcacatcttcctctcagctcagcctcccaaactgctggggctacaggtgtgagccactgtgcccagcctatatgtgcttcttatgtatatcatagattgtggccttactctatattagttcttgcattgctatttagctttccctacacaggcctcatctctacaactagaccataaactgcttgagggaaagatgtggtcttctatgtctttggatcccttacagtgcttacatagtgcttggtcccaagggagtgctcatagtattcttttttattggcagattctacataacacattgcaaatggtcacaacaatcaagactatatccatagatgtcccagaaataatatctgactatacagagcagcattaccaagccaccaagaagtctgcctagtaatgacaatgataacaacagctaacacttagtaagtgcttgtgatgcatctggcattcttccaggtactttccttaaatgcatgtgacaaccctatgaagttattacaattacagtcctcattttacagatgggggaactgaggcacagagcagtggtataggtgctcaagctggtaaatagcagagctgggatttcaactcggacagtctggttccagagtcagagcagaagcatggcacctgctgtctctctacagacagcaaaggggttggggagaggatgaactaggaagagccagaaatgacagaaagagctactaaagcttctaccatttttgctgttcatgtgcaatgcttagcaactatgtgccaaaataattatttcagcaattaaacaggtcctctagtttcttatggtgtcagcttgttaatttaaaaatgcaatttaaaatacgttcacaaaatgattagctcagaagatgactgatcacctttcttctctcattagatatctatttgatatgtctaatgtgaaatttttcttatgtttaattacactatctcagcaaagttatttacaattgatcatgatagaaccacctttacctggttagaacatgataaataattaacataaaatggcaaaaatagaagtcttttgacttctatttttataactaggaataaaagtgttagttatagcagagagaaattataatggagaacaaagagtatatgtatcaaatataaacatgaaacattgttcaagtccctggctaggcataggcccaatctgttaataaaattatgttttatttattttgtggttttcattggataaagtcaacagagcagaggaacagagccacagataactgaaaaccactttggcactgaggaggtatgcagacaagatctggaagggaatctagaaaaatggcaactttggaataatagataccttttgttttcttatcgcttttatttttgtcatgataaatattaagagtaaaaagaaaattcacattgtttgtgccatggtactcagtcaacttaggttttactcaatagcatgttgttaattaatcttccaaattgttggggtatttcatatgaagtagcccctacccccaccttgtcctttccccagactccattcctagataatcacttctgtcaattcctagataatcacttgccttactgacagattcagaggaagccatcagttttttgggcagaatgaagggacaaatggtgaactggtatccgggatgctgcctagaaccctgtccatttaagaagacacccaggtgatacgcaatgcacaaaaagcactggaactcccagcaggcaagcactgcagtctataaaccctctattgagaaaggccatgacatgtctaccagggacacagatttgggaggcagaacacaagacagggtgagggtgaaaagcaatggctacctggccacgtcagccaaatcagctccaaaaatcaatgcgatgacagtggtcacaggcagatcactctcaccttataacctgggatggcacagaccagacagattatttcattttgttttttcattatttttatttacttttttggagagagggtctcactccattgcccaggctggagtccagtggtgtgatcatagctcactgtaaccttgaactcctggactcaagtgataaacctgcagctgtcttccctgagtagctgggactacaggtacacaccactacaccgggcctctcattttgcttaatttatttaattagtcaactaattttgagggagggcagattttggaagtaaagggcatagatggttctgtagtatgcggaaatctgaagctttgctaagatgggatcaacatgaagcatctgtacatgtacaaattagcaaatgttaccatgactaacagtaaaatgaagaattaaggaaattataaggttaatttccttgaagtctctcagtagtcatttgtgtctataggtgattttgtattttacaacattgtattttctaatttcatgaaaggaaagctaaccaaattcgtggattttattttttgcctcagcctcaaaaagccttagggctgattcaggcctggttgtagcaatcggctgtctcaaaggcctcctgcatgtttaaatagcttctctcctgtttattttgcactgttttatcctgtaagctgtctcgaggcccttccaatataagcatgaggatttaaatcttaataaattgagatttgaataacagaggtaatctgggcttggggggtcttgaattattgggataaacatctctgtttctcatctgcacattatgcatgtgctgtacacattgccccatgaccaaggtcagaaataataaaatagtcatagcagaaataatactgataatatttagagttaaatagcacttttctgtttgtaaggacttttttatgtacaggttctccttctattcttggaatagtcctaaccagtagaaagatcaggtgttatacccactttaaaaatgaagcaactgagtgacaaagagattaagacacattcaaaacaatatggacaagtggaggcaataggactggaactcaggtcttcctgatagctttcccacaattttgccagatgtgttaacattatgtgtgctaacaataagactcaactcagtgacattccaattaaacttactggagatgtctttttataagcttatgacagggacattgtagaagtctggagttagctcttttttaaaaaagattgccacagagattgctcatgagttcaactctggggttgaaagtgataaacaagcaatgctcaaatacctttttgtaatctcctattattttgaaggaaggagtaaaaatatatataacttctttaattgtaatttaacaccaaaatatttcttctatcctgtaatttcttatcattcaaaattctaaggagttgaattttaagacataagtggagacatacaaatcacaaagatatattctaacaaacattaatagaaacaacaacaattaaaaaggcttaccttgcagccttcacatgtaatgacaccataatggattcctgatgatttgtctccacagatcttgcatggaataatttcaatttgagctgcaacagaagcacgcaaccagttaattacattttcttttaaacaccttataaaagtgttccctgatcagcatttgtatagtgaaaactaataacctgctaaacattatactgcattaactattcattgctgaactgtgagggtccccctagagccctggactaaattatggctgctcgttatataatagctttcgggttattaaaatgggtcatttgagaaggtgtttaagaacccacaagaagactggaatcagcatttcaaagccttcaagaactggagagttcgcagtttaggcctcagagcaaagcagatactgaaatgtttcctccaatctcattttctatcattatttttaaaagatcataaatctgtcttggctgagcattacagcttgactgctagagaaaaatacactctaaaaagtcaggtctagttaggaaaatgattcaattcaaaatattaatcagttacatatgataagaattccttgtcttttaaaaaattaacgcagttgccatgtgttaaaaattagtccatttgtgtacaatcagaacctttcaaccatagagttaatatcttgtttgaatttaataatgatgaatcctgacaaataggatgtgttgcttctgagttctttacactggaaatttagttcctggtacagagggcatgtgtttctacccaactgattacttaaagatgcctcatgctggaagacccacaaataacatgtatcacaccaaagttctcaaataaggcaaagcacatttctaagcaaacacattatacctcagagttaaaaagagcataattaaggataaaaaataaggaataattaggcaaaagaaaatccttagatcaactattaaatagaatttatatgtgaaataaagaccaatgctgagctgtatagacaggatgggaacagtcaccagtttacctggaatgtgtcattacgctaaattcattttccatggttttcactactgggtatcatgttagattacctactgagttacacacacaaacacaactgcaagtgcccaagtctatttcatttctgtacagcccttacctagccccagaccttacacagagtaatttctttgtccaaagaatatgtcacatagtgtaagtaccacacagagacacacagcccactctttcttctaatgtaatcccatatcctgggatgatttcacaaccacttactttggatttaaggtgatgttgcattcgatacttagagcacacatgaaactattggatttaacctcattataaaccatgtgtactggtaactccctttctcagggcctaatacaagtactgtggtgacttttagggagtgcaagctattctaaaagctatccatcatttttttagtgcttgcatactgagtttctttgctgtccaaatttagagattgttccagatctcacatccagtgtattttctatactctggaggctttctaataccccaataatggtgactttggacactaataggtatagtttgagttaagcaacttaagcaagttaatatgtttaaggttgcattcaacaaaagttgtcatttgcaagtctgcctcatgttaacacttggcttgacttcttcaagaaaaattctttatgaaatatggtatctaataatgtctcatactgcacagtccttccattatgtttaatatagtcaaggcaaaggtttgtgccacagatctgcaactctagagaaagcgagttacgcctaacatttttcagagacgtggaaaagccaagtggaagtagagaaatcctgaaaggtgctatcagctgagagttattgcctgcttttccctacatgaattgagtaggctagaatgagaaccagcctccttaccctgattcctaggaatgtaataattaggcaccatgaagtccttgaaccacctgttaaacagaatttatacatgaaatgaagaagacctacttggagctgcttctgtccatgtctcacctcaaggtgtaatgacagaaattagggatgaacaaaaacctctttaggtcctagcatttaagtcagcatcaaaactacctgacgctaaacttgggcctttcaagagttatcttcattccatcttaacaatgagggagatcaagcatgtctatttagtcctttacaagaatatgaaggccctgggcagggcatattgagaacaatgagtagaactgcatctggacaaactgaaaatgatatgcagtattcctgtacagtcggcctggactcacagtggattactaattagaagtgaagcaacgatgtttaaggctgtgaccaagatgcctgcctggcacggaggtctgctcatgatgggggtggccttgggagtactatactggccccagcacttccacccttggaatggctcatgtcctggcaggggtgagggtaggggtgcgggtggggagcagttgtagtacagaccccagagtttggtgccactgtgacacaggactgatggcctgagtcaggcttcagcttgcaggggttttcagatctggaggatatttgagcggagacagtcacgagatctgtggaggccaagacgcttaggataaatggactcactgtagattgacttgtatttccaaacaggggggccattcacttagatctttgtccccatgtgtctgtgcttagttccagtgggctaaagaatcagatttaattgaaacaggcttcaccgggaatctctcggtaaggtggtagaagggtttctggatagcaagttgaggtattctgattggttaaactattctcctaggcttcctcctgcttggttctcttatctcagatgacaatttcagttgcaaatgcactttaggaaatgactaaaatcctcctactccaaaagcaaaccctctgaatgtgatctgatcacacgtgttgatattcccagaaagcgagcatttgcagattggagcagggcacttgctcagcccttcatttaacccaacaatgcacaaaagccctctccatcccccattttagtcaatttccagaattcaaatgaatccatgagaaaaaaatgcagtcaatgccttgcaaatttttcaaaaggaggcagtttagttttgtcaatttgagttttcagtccaacaagaaggaggaagacaaaaatccctctgccctttgcctttcatcgtgtaggcttttcagtttcccaccaggtagtgtggtgtcttctcaaaacaatcttcttttaacacaaattatgaatcttggcccatatatatactgcacacattaactcagccagcatttcaaaggatgagttctgtcagacagcactactgtcaacgttcacaagtatattgattaaattagcccacatacatattcatcccagcaaagaggtttattgtgtagtggaatatctggagcaagatgcgcacatataatcatgaattggcttcacaatgaacaatcttgctatgaaaaattctaatttgcccacattttcagccctattgcctaaataatttgctctctcatgcaccctgtgtaattcaagcaggctctccacacctgcagaggcaaatgcagtttcaaggagctgacaacaagtggcagcgggcatcaggaaatcctggaatgcaagggtgctaattaaccaagtggtccttggggctaggctgtcatttagcactgcacttctagaagaagtttgctttgaatttttaattataaaaggaacaagaacttgggcactagcattcttaagatgacatttattcctcaggacctatcttaggagataacatggtccagagaacaatgcccattttcccaaagaattaaaaaaataaaaattgtatgacaggcacccagtacttcattctgtgggtgagtagtgatctctcaataataatctaatttataataataatatctacatgtatttgtgctaataatgtgtcacgcattatatctcactcactcctccaataccctatgcggtaggcatcacttacttaattgttactgtcatcattgtcatcatcatcattgcactcttattaagcaatcactaaccagggctcaaaagacatcccctaagtagtttgtttaaacttaacacactactcaggaattgatgtcaacatctcttgctgggagttatccccgtagtttataactaaaaataaccatcaaccttctaggccactgatctcagtttcacaaaattctggttagaattttaaccctaaaatgaccaatgtcaacgtttgacagttcttaaggccgggcagattacttaacctctctgagcctcagtttcatacttgaagattcaaggatgtgatacataaatgacataccatatatatgatatctgtatgagcattttatatatgtattctctatatatgcccatcacatagttcttagaaatagctggcactcagtaaatagtagttattattattgttgttgttgataagaaatcctgccttatagtgaaatgaaattctttcctccagactttaagctctttccgaggtggggatagagaaaagctgcttatcctccaaataacatgacaggcagttcctaccagctaccacagcaatccttcacaacattgctgcttaactgtttgccacaacacagtggtatgttgcaataagttgcaggagtgtcacagggaattggttactaataaaagttttacaaaattaaagttttttattggttcacataaaaactaaactaatatagacccaaggttaccccaataatatcgttcactctagctcaattgcacaaccaaatattttcttgaattggactgaatggggtggggttactgctggcttgccaggaaacggccaatggccgaaccttgggtacacctatgagaacatgtctgtcatacttatgaatgtcaaccaattttgtgtgtcttgcaaaaacggtcaaaaactagtgctttaaaaagcctatctatcttttacacagatctgttgatggtgtttttttctggagtgcagagaatatggaggacttttcacttgctatgttagatatttctctaatgtttgaattttttacaaccagcatgtattacttttctaagcagaaaaaccaataaagattaaaaagaaaaaccctaaggcatttgattttattttcagtaaaatggcttgagtcctttatggattagtcactttattttatcccctgtttaaaactgccagggtattaaaggcttctgcagctgcctgaatggcggcctggcttgcgtgtcaaggttagccgggggagagctgcagagtcttcaccttattccctggagggacttcaggagcaccaggcttctagaattttgtggcccccttgtttcagggcttctaaagatggtcatgcaggttgtgctctgcccagtgcggcctagctgaggggtcaaaagtagaggttgaaatgcacctggctgtgagccttgctgcagagtgactgcaacagcctggagagaggaaacctttcttcaatctgtctacccagacaagctcccttttttcaaaccctccttccaggggtagtgccccttctctacagtgctaggagtggacagttcagggagcaacatgctttctctccactctgccatgggaggccccaggacaccataagggtttgcagagagctctcattacatctccatgtggaaggggaacagaccatcgacctggacctgtggcttggaatagagtatgggtatgttccatagcacaggcatgttcaatggccatcagggatgagtagagccgagttatagctgcatcctatgcaaactaacgatgaacttgtttggccacttggtctgctaagttcattttaaatataacactaatatgtttccctagtacattattttcttctcttgattttggattctttcatgacagtatttcatccttgctgaacctcaccaaaacaattagatctccaaatagaaagccctactccttcagtaagcagtctcgcagtcatttttggcaaaaatagtaatgcctgagtttttgcagaattctatatagttttcaaagtttttatccttgttagcttgctttgattttggtgctttcaacatccctaaaggaggcagataggtattatcatccccattttacagatacggaaaatgagcctcaggagggttaaatggcttcttctctatgtccagatttcccagggttttgatgtagacatagccacaagaaagagagacttggtgtctctttcctattcaagattatttgatgtgtttagatttatgccatcactgatctggggctctcaagaggacatgacaccaaaaagaaagcactgggagtcaattcagctaagaggtggagttggcccttccaggtctccctctgagactgaactccctgggtggcctcaagcaattcacttacacctccacttcctccatccataaaaatgggaataattcttacctcccaggcaggtggtggtaaatgagtgctcacaaagctctttgaagatgaaaaacctatataaatgggaagcttcaggaagcttgccacatcattcatggcaaagattgcgatgctgtgtcctattacccatatccagctatgccacaaagagaataaaaattacacagtaccataattctcatctgctagctagacttacttaaatgttttttaatcattggtttccaagatgctttcccaagggactgatgggtccagatgttactatcttattcacaacttagaagaaaaagagcacttagatggagaggtcgcctctctatgcaaagtccttgacctagctttatctagggcttgtacggtcttgtcggggcatcatggaaatggcacgattcccacttgttaacataataaacatatatgtcaccctctgacagacatcccaagccttattattaagttgacatctgactcaaatgagtctatcaaattatagccattaaaaaaaatgttctgcatcttactaaacaagccacttctcaaaaacttcaactggattgtaatttctccggaaaacttaatggctttaaaaaaaacatttttcaataaaaagtgttgagtatacctgccaaatgcacacacacacacacacacacacacactcctcaaaccatcaagagatcaaacatttgtgaactaaatttaaaataagacaaaattgaagttttggaactttgacgatttttcttcagtcttttaaagacttagttgtgtaagagttaaaatactgcgccagaatgtcccatctgaattaagagaaagctgagctgtgtgtgcaggaaatctctgaagaataaggaagccaggcacatcttctcatgtggctttctgtgaatatgcaggtggttctgacaatgggaactgaatattaatcctttgtaatatatttccatccctactagattaagctttctagagaaactgactcacattccctgatgcatatgtatctctgctaaaagccaaatccaaatgagcacttttatccctagacagggaaattctgtcaaatcagagaggaaacagatttttcatctagaagaacagtgggtggcttttttagatccagttctctctagaattctcctatcacatagtagtgcacaaactgtttaaggcagttgactctataccttttttggtatctacctggtaaccagtttaaaccttgagtgaaagacctgaacagcaagagaataagcttcctaatacttcatcctactcatccagtgggtcagatactaaataagtaagttctcacccaataaatgataccaccaggatcagcaatacaatccttttttttttctttttgtttttcctctcttttgcctttgtaaacaacagaacgtatttgttgttaaggatttatggggttatgtgatatcaagggctaagataaaggtaattggctatttaaccaatggttctcagttggcgtaaggtccctctaagattctagaattaactacattttaaaatataaagtccttgaagattttctaggaccctgggatcagtaacatttaacaaaagtcctctttctctagaatctctcggggtgggttaaatgtcatttcatatcagcaggaaagagaacccatttattttgctaagtgattagactatgctcaagggaaattcctaataacgttgtttccaacaatggtgtcccttacataattctggataatactagacaaaaaaagtcatctgactcacagaactgcatacgtattttcttgcgatcaacctcactctagataccaattcctttttttctccttaacaggaacaattacgctacatttaggtgaaatcctccttacagctgagagcactggggtcaactctttgctttcattgctcaaggtctgtttttcacaacagaaaagaacatctttaaaaccataccaaatctggtgatctagtttctgctcaaccgaaaacatcagaattacacttactgcattttatgaaacaatcttactttaaccaattacccccaacattctcacacctaagcctacgagaaaaccactccactttgcagctgtcttaacttcacaccaaatttcacataaccccacaaattcttaacaaccattgattactaattccacctgcacaatttccatgaccccccccccccaaaactgtgcggtcacaaaacccagctgcatgaagtaagatgtgcagaaatgggtcaaaataacaagaatccagattaagtcataaaagcttaccaggcaaaggaacccatcatttctttccatgagctccgatggcattctgaagatctgctactgctcattgaatagatgtcactcaagaaatattccccaactaaataaactggattcatggtaaaagattggaaataacttagaacattaaaccttgaaaatgcatttacatccctctatagcaagcccagaacactaaaaagacaacatatttatagtcacaggaacatggtgtcatgacaccaaaacttccttggtccacagatcattttagtgggtgaggactgttaagagaattagcccacagcctgtatttctgctccacctctgtgctgttttccatttcaaaaaagtgtccttagaattaataagaggatgaagctttggatgagagatgagggaaggatccggtttttattaaaaatcacaggcaaattatttaggcttgccagaagcggaagtgtaaatgttttcatattaaccactttaagattgtaagatcttgaagaattagaactcctagaaattcaactagttccttcacctccagtttccaggacatggtcattaacatctaaacaaaaaatatggcaagttctaagcctttcaaatacatcacagatgtatttctgaactgtggctcaatggtatttcaaaaaattctcttttgtaatgcttttctaagacaaccagttcagccaggcatactaatgaccaaacaacgtgaggacttgtttctgactttccctaaatgcatggtctttaaacttgctgattaaagaaacatttccattcttaattacaacatataagctcaacctgagaatggatagcaatatttgtggatagctgaagcacagttatttctgtgcctattcccaaggggaagtggcaggagctggtggctatttcttagtaggaaagggaaatacagaaagaggcagcagagctttggggatttaagtagttgcgagacataaggagaagaaatgctctggactaagctaagagattgtcagatttattttaagaaggtctgacatctgagcatcaatgcacacactataacacctcataaatgtcatttttttccccaagaaaacgaaatgtatagcctctgtatttatcttgaagccacttatttttatgtaagtcatgcactagaggcaaagtaagaacacaacagccatgtaaagatatcaaaacgaggcccgcaccactgtccttcctattccattttcagtttctgctcctctagtccaaggtgcttcttttgcctacagagacaaacatttcagatgacattctatgactgtcctgaaaacactgctatcagctatccactgtttggcaatgtgtgtctctgtcacttaagatagcttgagtgagtgagtgtgacattatcactgcaataagtgaatctttctaatttgcagtaaaagtataccattcacacactttggtacttcagtacggcaaggttttgaaatccatttcacaagtggtggcagcacatttcacatcggatggaaacacactctgattgctaacagctgctgtgggcacagcttactgtcaaagccagagctcagaatagcaggtcctttttaatgccaatagctgctaccatcttaaatggtaacacaggcacacacacaccacacatacacacacataccacacatgcacaccgtatgctcacatgtaccacacatacgtacactacacacatataccatgctcacacacaccacagatgcacacctcacagcacagcacacaggcacacctcacacacacggcacacaggcgcacctcacacggcacacaggcacatctcacacatggcacacatgcacacctcacacagatggcacacatgcacacctcacacacacggcacgcatgcacacctcacacacacggcacgcatgcacacctcacacacggcacacatgcacacctcacacacgacacacgggcacacctcacacacatggcacacgggcacacctcccacacacggcacacgggcacacctcccacacacggcacacaggcacacctcaaacgacacacgggcacacctcacacacaagtctattcagctgcaagtcctgcctccacttgctgagaacctgcatgactgggcaccaaggatacggcacacacacgcacccaccccacatacatacagtccacacacacacaacacatatacaccacacgcaccacagatgcacaccacacatgccacacacacatacactgcacacgcaccctacacacaccccccacatgcttacacatacacctcaccccccacccccaacatgtgggcctacacacgagtccatccagctgcatgtcctgccaccacttgctgagaacctgcgtgactgggcaccaaggacacggaaaggatacacagaacccaccagcgcacctcgtcttgttacgttagcttcactgcataggaattaaggatgaaagtgaaaacttttttttttttttttttttttttttttttttttttttttttaaggaaaaaggagagagttgattatgaccttgaagacaaagtgtagagatttgatttgcaaaatctagagtctggggttgaatctctaccctgacatttgttagctatgagaacttggacactttcttaatctctctgtgcctcagtttcctcacctttaaaacgagccctatctcattattacagggtacacaagtaaagtgcctgtagcatcagtgcccaccacatagtaagggctccataaatgttagctataatcatcatcactgtcttttttttttctttagacagggtctcactctgtcacccaggctggagtgcagtggtgcgatcacagctcactgcaacctccacttcctggcctgaagcaatcctaccacctcagcctcctgagtagctgggactacaggcacacaccaccacacctggcttttttttatatttttttcagtagagatggggtttcaccatgttgcccaggctggtcttgaactcccggactcaagtgatctagctgccttggcctcccacagtgctgggatcactgtctatcttttaaggatgatagtatttggcaggggctgcagctggagttgagggaactatcagaagaatgaaggataggtcactgtattccttttgttgtgtaacgacatggagtttagcagctttatttctaacacagaggcctaatgtgagaaacaacactaaccagggcacgatagaaagaaaccagtgtttctttctagggaaagcccacagtgaggctggcatcttggagaggtggtaagtggaggaagtgggagagaggcctcacacactggtaaagtggggaaaagactgaactacagggttcggaggctctcacaactgcctgtgcagtgagcaaaattcaccaaatgcctgtaacgctttgtgaccctctttctccagagctcagcctcctcttctgttcttaggcatagtgctgcactacataatcttccagagccagtcctgctgtattacactgtgatgtgaagagtgagctgaactctcatttccccaacagggacctctttttatggcaaaacccagcaggtttcatctcgtcagggaaaagggatagaaagtggaagagaattctacctagtaactaatttttcattttcattggtttaggaaaggaaatacaatgaactgttctcttcgagatccagaataaaagttctggcagctagaacaccgtttttatacaccgaacccctcgtgctctccctgcttttttttgttgttgttgttgtgcttaatgttagaaaataacattactactatgaaacgaagagaattttttttcaaaaccatgtcttgccattagagatgagacaaggcaacaccatgctaatacgctgttgatgtaaaaataaaagttttttttcccttcaaagtaaacaagttaattgaacgtgctaggacagagttaggttatttttttttcccctctctttgaaggccactaattgtgcccttttgctttaaatcaatagaggcaaagcccacagcagatagtgtcagtaatgcaaatccatttcctattgtaattcacttttcagaacaaaaccttttccatcagcaaagcattttagaacctcaagctacactgttcccacctgcaactgtctaaggtattggaggtcaaggacagtccaaggccaagtcaaggaccatcaggacacagaggagtaacttctgaggcagcccccggtggtaacataaaagcttaatatgcatcagacaagtgccttcgctgtgagatgttggggaaccaagcccagtggggtggctggcgtcagctcagtgttccagaaaagccaaactgttcaccacgacttgccctgattttgccttcactgctattcaaagaggcctgaagcagttactgaaagcaattccaagaaattgagttaaaaaaagaaaattaaagtttagaaaaaaatcatttgaataagtgcgtagacttacaaataaattctgaatggaacagaatatttggggggttcataacctttggtatatttgttttaaaaaccagccgcacctcaaacacacccaccaacaatgagacgaatggctagcacttatgaggaattattattcatttaaaataccctttaaactatgtcacaaagataaatttgtttagtccttacctgtccccacgcttcaaaataaaccataatatttctattgaagccagtttcttgttcttggaatcagctttttgagttgtcagttaggctagatgagctgattagtatggaacttaacactgtcagtagcaaaacaggtgctctatcagagaaatatcaatccattttaggaatgtttttgagagtgaactgtggtatctatgagagaaaaatcaagccttttccctcttctggtctgctacggtaaatggtgtgacacaaggatgtttcactgcccaattagcgtggtccattttaaagtgaatctgttattttcctttccttcctcattcttgacttttagacactgcaagttaacctcaaagaatgtcttctttgggcataattttacaaatattctttaagatcctttatcacatttcaaagcactttgcgaaaacaaaatgtcctcagtggggcaggcgagatctcaggaatagtgatagaattcattttaaataagtctgtgtgatttttctactgtatcatttcagggactttgcttaaagaggctttaaggaagaacttaaaatggagaaagccaacttttgaacgtggtgatcaggttgccttcagtctcttctacgtcagggagtcaaggggctgtggaaccatccgttccacctgctacatgctttctcacccttcttctaacctgacaaatactatgtggcatctccatcatggttgacattgctaggccctaccttattcaactctaactgaaaaatggggagcaagaagggattatgtaagaaaaaatgaaaaactttgagggccaactaacagatttcctaaactaatgatgtattttaatattccagggatttgatttaggacaaattgttatttggatggatgcttgtctattgagagagtaattgttaaactaaaggaaactggtcacaaatactttagcagtggctataaatgaccagtgggccaaggattttgagatcgtgagagacttctccgggaatgttgtcattcatttcactccagtgtggctcttttcctccatctgcggtaagccaaaacagttcccaggagaaacagatagagacaggaaaataggtagcagttctgtatagtcttcactaacagctcataaaccttaaaaaaatgggattttaataaagcccatttttatatttttaaacataaaatggaataaaatgatagttccaaaggacttcctgtggggaaagcttcaatgtcacaactaaaatttacatccaattccccagcacacccttgtcctcaacccgagtttgcgtaacagaggtttgctgagcctggaaacagggaattctgtgtgactgcagtaaaagcaccaagcggcctcatgatcaaactctcctgcctcttagtgatttctgaactggtggctgaagtcagaattgtccgtgattactatcagattatgacaatgaaagtcaccattctgtgttcttttgagcaggattttccctcgtgttgtccctcccttcagcttcccacactcactgcttgcgtagcattttgttaggggagtagcagttctgacacaaccaaagatgtgtacgatcaacagtggggtaatgtggataactgacacgtactgtgggcgtggagatgctcctatgttgtggtggatgatagccttcgaatgctctttgttgtcttcattgtcatccactctattaatgttctagaagaaagctagtggccaatattttcttccaacaaattcactggctccaggaaccttgacaccaaaatgaggattgagcgtcaaagttcttatgttgtcattgccccaaactacttggagctacttcttatgcagctgctctcagtgccaatgagataagacacagctgtactttatagtccctctcctccttttttttttttttttaaagatagggtctcgctctgtcacccaggctggagtgcagcggcgtgatctcggctcactgcaacctccacctcccccagggttcaaaggattctcctgcctcagcctcccgagtagctgggattacaggcgcccaccaccacgtctgggtaatttttgtatttttagtagagacgggtttctccatgttggccaggctggtcttgatctcctgacctcaggtgatccacccactttggcatcccaaagtgctgggattacaggtgtaagccaccatgactggccttttttttttttttttaaggaaaatggcctggtttggtttcttcacttacctttttcagcatattaactattggttgttttcaaatatcaagctcacttttctaggagaactatggccactatggagaatatgaaaacattgctgaaggaggtgaaagccatttcagaagaagagttatatattagcttttggcagtgacagcgttatgggcacggacattcagcctttccagttgactgctttgaaggggcaatgttcacgtggaagtatacctcctagtatgtttgctaaaataaaatcagcttcattacctaataacataaatgactttgggagaaaactctgagtctcatgttttatttttcctgataatgctgttcaattagggcagactttgtggaaattctgatttcattacccatcactgctgcatgaaaatacgctttctgaagtcacgctctgaaagaaactaagttgtttgctacaactacccctacacagaaattagaaaattatatgagaagaagtttacttcagcctgcagttgggacacaggttattactgaaagtagtcgtcggcatggtttctggtttcacagtaaaagaagacgacttgaaaggactcagtggttttgatgctcttctgaaatgaaaacactcagtgagcacatagcattgggttgtcattaatgtcagccaagcgaaaacactgtctccatgaacactgcagtcatttccccgccgagaccatgactttccactccctggcatttcgggcactgtgctagtacttttccaaaagagactcttaaggcaattcattctagataatcaaacacacacaacagtcttaaatgaataggtggcctgaatttgctaaagtcagccaacaatttccaggggagaatgtgttattttctgagaaatactgtaaggcaatgatgaaaccctcaagtgctgggaggcacgaagtataactactacacttcacggtaaatagcattagtgtatttatttatttatttatttgagacagagtctcgctctgttccccaggctggagtgcagtggcgcgatctcggctcactgcaacctccacctcccaggttcacaccattctcctgcctcagcctcccgagtagctgggactacaggcgcccaccaccatgcctggctaattttttgtatttttagtagagacagggtttcaccgtggtctcgatctcctgacctcatgatccgcccgccttggcctcccaaagtgctgggattacaggcatgagccaccgcgcctggccaatagcattagtttaaaatcatgttgtggataaaaatgtaatcaagtagctttacattgctcttattaaacttgatacacacagtttaacatggtcttgtggaagaaaacaggaaaaatctctggcattctcgatatgttctatgatatgtagcagctcttatgttctgtgtctgtcgcctattttgtaaacaggcaacaaaacaccatacttcatcccaaagttacgagaaacaaggaattaagcatgttgtgttggatggagttaatgatataacgttaaaaaataaccccacagtttccatctactctcttgctctctgcaatcaagctgggcatgagagaagaaaataaagtgattttcttaggtagcgagcaagtgttggaaagtggcatttactatatcaccagggcatatttgttgttgttatttttcctcccccattcattgcccatgaattaatttaagaaacaaggcatcacggaataggctaaatataaaagagtatttgctatgttttttagtgtcaaacactataagaccaaggtactaaactttgaatgagaaaatattctgcagtttctcaggatctcacatgtttgtcatacttcttacagtggtagtatactatttttaatatcacttttatattgccgtgatttttaaacaccaaggtaaattctcacagaaagattgcctggggataggtatgtgtgtgtgggagggaggatctggtgatactcatatggtaatctttttatttcatccattttctctgctttcaaattataaattcaaactataacgtcactctccaccccctcccatctccttcccaatcaacaaaacaaacaataaaattcatattttactatgtgtattgtgaaacagcctacaataggacaccagtgctttttaaagtcctactttttataaagggtctgattttcttctggccatcaactgaattgtaaggacaacatagctcattttatgaaacgaaagtgatattaaaaaactaagtggctgaagatgtaattgtctatatgtgagctgcttccgaccttgaaaaaagtgtagaagaggggccgggcgcggtggctcacgcctgtaatcccagcactttgaaagaccgtggtaggtggatcatgaggtcaggagttcaagaccagcctggccaagatggtgaaatcccatctctactaaaaatacaaaaattagccaggtgtgatggcacacgcctataatcccagctactcgggaggctgaggcagagaatttcttgaacctgggggatggaggttgcagtgaaccaagatcgtgccattgcactccagcctgggcagcagagtgagactccgtctcaaaaacaaacaaacaaacaaacaaaaaaccaagaggcacatttaagacttgaaatttagatggaaattttaaagttttaagttgttcatattctaccccaaacacattcatctcaaaaaataatatttaaagccatagaatttataatttatgcgtcaatagtttctcctttaagtggtcaccaaaaagatatcaaactttttttgctataagagcatatttaaaaaatatcaatgaaagtgttaccagttttcaatcctcctcacttggacattaaagggattaaagttattgtcagcacacacatggatcagctttcaatggaaaaaaattaatgttttttgatgttgtttcttttccttaaggcttaaggacactaggagaaagacataaatagaagtatatattatcatctagatggtgactctccaaggggatgatgagggaaaagaagtaatgctaccctaattctgaaataataaaagctcaagcaatgaatggctgaattcacacctcaaaatttcatggaagacaggcatacaaagataagctttcaaaattgaatgaactcattaccacaattaaagaaaacaaaaagaaacattttgcataactgctggttttgctgctccttctgctaatttagtttgtctggaagagccactgtgtggaccacccatgcttcaatgcacttaaccaatacctttagaagaaaacaggatagctacaaagtcataaaaagtggtatctttttatgtttcagatttccataaggcgatttcacagtattgcagagtgaaatcaattaagaaataactatagctatatagggaatatgcaacacattaatatatttatggagactatatctaggcacatttattttcagcatttgaaaattactggtgagagtgagtaacgtcccttccctgttgttttgataatctcatgtcttttaagcaaaaggaaatgtatactgcaaaatagctttaccactctgacctcaatatggagtaaaatgacagataacaagcagaagccggtcagtttcacaagtaagtgattctgatgctttggctcatcctggtccctgctcggttcccacatcctcatctggctgacttagttaaaacctgccatttctaaagtttaagaaattaaacatagtttgggagtacaaagagccatctttgctctgatctcattaacaacctcataagagttcatttccctcactaactgtcctcaggaatgaaagttaaaagaccttgaataatttttcctaccgccccacaatgatactgtactactgtcctctttcctggtctgaaactcctctggaaagagatgcacagcctctagtaaatcatagtttttgttttgtttagtgtactctaaagagctacatggaaccttttaaatcattcaatgccaggtccataaagacctctgtgattaacaaatcaaacccctttcttttcagtcaaggcacctgagactgagaggtaaagtgactgtcctaaggttaccaagcttgggcaagaccaaggtgatactgccaccatctgttcattctcctgccaccttttcaactggggtttatcccaacctcctcatttcacagagaaaaacagaaccagtgtgaacagaaacaattcacttgggaagagtgagccgaggctcttttatcagtgtaggtggttgaacttcggtagccacaggggacctgactttgaggacacaaaacacaggatccttcgtggttcacagtggtggtgttagggagaggcagtgagccttgcatcataggtagaacacgatgcagctgcaggtgcagagagttatcagggagagaagggcccagaagactgggaaaatgatagtggtgtcaaacaggaaaattacactgaaattacaccatgtctttttacattttcctcagtctccgtctgagccacaagtgcactgcagtcatttcagagatacagaagcttatcttgctttttgaaaagtttttcttaatatttgtcctagggtccacaggaaatgaaaaacccaaggcatccctcgccctctccccgcaagtcacctgctatgaatacctgcattcattctacaaagcctttatcagtccctggaatgccacgtatttattagctgtctccacacattaagaataagatgtatagagcaggaacctgtcattcttctccatcctgtcttcccagtgcctgcctcagtgcctgacacatagcaggtgctccaaaggaataaataaattaggaaatcctaccacctgcttctagcatgtaatatctactaccctggagtggaatgaaagggttattaaaatacccaatgacagcctcaggtctttccttctagtgtggaaactacagcaagaaccaacacaaattaaagtgtctaaaaaaatcaattggggcaggcatcttcttctgaactacatttactagagcctgccacccacagatgtcaaaggaattcacaggattaaaagaaaaggctggaggtgagaaagttaataactactcttgtgacatctagggctgggctacaagtggtcagcacatggacctctccatatatgttgtcagatgtcaaggagtggctttacagatagacagccttggaccccaatgctaaatcttccacttattagcactgtgatcatgggcaagttatttaacctctccaaacctctatttcctaatctctaccacagagataacagtacctacttcacagggctgttatgaggctcaaatgcaagaatatatgtaagcaactagctcaatgcctggcatacaattgtaactgctattactattgttatatgagctattgatatttttatctgatcccagataatactcaataatcaaagttaatctccatctgcttttctgaaccaggaattactgctttatcctgggattactataaggtcaagatggcaagtgagtttcagctcatattccgagtcacatggatttcaagtgaatgcttgggggctggttgagatgcactgtgctgtgattgattgtgacatgtgccaagggtgtggagccaggcttgttggttggttctaatattagaattggtaagcctcttgtagtagtatcacagagactaacagctattttaatattatataataaagcatagagaaatcaaaagaatgggctaagagtcagatggtctaagttctaattttagctctgcaactaactggtgagaagatcagaatatgccaccccaaattatgacactttggcatgaagattattttgagctgaaagcaactgagaaacagcagaaaaagctctctaccctacccctatctgcctataggcagggcatacatttccccttgtaaaggtgccctctgccccaaccccataccaggaagaggagacaacccttatcactacagatgggcactgacttaaatctgctaaaacaaaccttattgaagtaacccttgtcttccattagttcccacatatatttaccttcccacaatatatggcccctagaagcctcaaaccattttcctttatcttgtcacttctccataagtttattgccctttgttaaaatggtatataagcctccagatctgatgaccttcttgggggtattcacttaatttctgtgaggcctcctcacatacatataaaataatcctttttctcccgttaacctgtcttttgtaagtttattttgtggggccccagacactgaatataagcgggtagaggaagaagttgggttttttcctctctaacactgagtaagtgattttaatccagtcacttctctttctctgtgaagttatttcccattgaagtactgtgatttgctgataattgattttttaaaatgtaagtaaagtgaaacacatatagctatgacagggcctggggtacaggatgggtatttgttatgattatttgaaagaaaaataaaagcacaaggctattatatggaagtgtaacagttaaatattttctgtcctcattcaaaaagattgactcttcctatcaatgaggaatatattcacaatgagataaaattgcaatatttttggcactaaaaaaaaatcagcaaatgcttagtaattctccaagaaagacaagactgttgtgaatatgggggctctttaataaccaaggcaccatttaaaaatagctagaattaattacagggctaatgacccattgaaaggcttatttaaataccaaagccagcactgaacaatcatggaaaatatgacttaaaagggctttagagagcagaaaccaggaaccgcagttcaaacaaaaaacacattatcctagaactctagctactttggtgagaaacattcaggatgcgaaaaatctcaggggagttctcaggctgggtaagagaagccactaggatcaacagaaagacaagaagatgacacatacggtcacctgtttggaaaagaaggactgccatttagcattcacccaaagagaagagagaagagcccttcaaaaaccattctcccccaatcatcaaggctttctttcccccacgctcaccccctggttttctgatgtacccacccatttttaatgtaccataggataaaattaaaatttccacagagaggaaaaaatatattgtaataagtctctgtggccactttagagctgcattatctccaagagcttcctgtgtcttggtcctctgtgccctgcatccatgccatcataagccaaagaagaggtgataatcttcagcgtgccctacttgccaggcaaaaatgatgccactgcagttcttagcttctctctgtaccaaaatggcctttctgtatgtcagtatcctgggagcacaccaggtggccagagctgaaacagtttcattacttcattcatgcccattgattaaatgcattactcttacccttatttactgtggcctagacatgccttgtagttgccttgctaagttaaaagtgtcataaaatcaaaaggttccaaagcccttgagagctcaaggtggggaggtaggagagggagtggggcactctcgacatatattggtttcaaggagcaaatataaattttagtataaattgctgttcacaataacgcttttaaaccagcaattgtttacactgtactactcgaggaaccctataattattctgaaagcacttgccaacgtctaccctgtttcataattgccaacacagccttgttcaaaagaattagtggcaatgttaaaattctgtttggtactaggttactgtttgaaacaattagtgattgcacgatgctgggatatgcaagcagaatggggccaataaagtaccctaagaatgaagtggtcttgtgttcatattcacaggtgggaagaaaaggaaggtggtggctgaaacggaaaaaaaactgcttgaatttttttttccttttttcttactactttcccaagaaatactgtcatctgttgagcaaaatgactttaagaaaatgttttttcaaatgctggaaatggtagtgatttgaaggaaaaaagataacccacttctccctcttccccactccttcttgcctggaaaatatgtttctatttccggcctttactcctgatatttgtaagtgaatctgggtagtgattgtggaacctcggcttacacatctcaaaacacccatctgtgcaggtcactggactttgctgacctattttctgctgtttctttctgttacacaaatctcccccacttgaaagagcaatagtccctctactttccaatgaagcacagacagcagagagatttctcactctctgtaaatgcaaaagcttttggaatgtctggcatttcaggtgagtgtttaggaaaaaacggatctcatcctgggtgtctctcccatctttatttcatgctttctcttcttataaacccacaactgtggacaaggggatctgtgttccccatcgccaagtgaaaatacattctaaatctaccctcaaaattgagggtgctgtgcaaagtttcataaatagaaacagggaggagaaaaatctggcatgacaacttctgaatttaagccatttattctcacctccaccccacttctatcccgccttttctcttttatgaacaggtgatataaaagcagagaactaaggcagttacctaaataaattttgtattacctgtctaaatattttagggaagtgttttttctattctgagtgtccaggctattttcttagttctcgtgttcactctgcaggtgaagatattgtcactgactggggaatgtgcctgtggaccataacccaaaggtggcatcttttgtgataaaacaggtataaccctgtttcatgagtctattggccacgaaagagatcctctatgcctggaagttcacggcttcccctttctcttcatcattttctggttctgcgggaggctccatctttgattcaaacctcacttcttcctaaaagccttcgtaaatgaagaaaccttgcaaattacagtggatgtttcccctcaccattcatgtatccagtttgtacttccttatcttccttttgtgaatatggtggcttgccattctgcctccaggaacacttgtttgtccaccccaatccaatgataaaggacaaagaaaagatttatcagagcatgtatttatgcatagcacatccccaaatgcttgaacagcaataagtacccaaaaaagtactgtttaggtagccaactcccactgtctaatttaatcccactgaaactggatgtgtctttttctccttttgttctaaagaaacttgttctactactatttgctggcaggaataattttctgccacctgtagtactctctgcttctgtgaaggctgaacttcaagttgctgtgaaagaatttgcattatccctctatagtcatacctaaaattaacccactgtcttaagttaaataagatatagaatgctcacaactgttatggttatcggagaactagagagtgaggctttctggcactacgagaggatgtagaagatgacacatgtggtttggcctttatttggaagcagcaaaaatcacagaggtggtggttacaagacaaaaaaggccaggggagtgaacacaaagttttggctgagttactttgtactattatgtaatgagatacaagctcggccttgcttgagtttaaataaccataatgaactgttataaactctgggatggaggcattataaacataggaaattctgtacttggtcctccagttggtcaagtctacttgtattcataaggaacacattcccttgggctacaagagaaacattctgcaaactggaaatagaagttactttctggatagttctctcaaagaatataatgaagtaaacccgaacttcagacatctctgtgatcatgtattttagaacatcaccagagcaaacagcaatgaatctcagctgattagagctttagtaagtaattgggatagctgaatatccaaataactggagtgttatccaagtaaacacatgaaaacaaagagggcagttatcataaatatttttaaagaaatatttctaaattatgacctatttcttttctctgtagagaattttgaatcgaatttactttcttgatgataaacagtcatcagaaattttattttaaaatttattagaaatttggagagcaggatgtttggcctctgaatgggaaccttagtagtgccaatgacgaaagagagaattaaatatgggtgatgttgagaaaaccaagatttttgtctagaagtaagcccagtgccacaccgggggaaagggaggcaaacacaagactgggccacatctccatggtctctggatggaggacaggtcaggaggcctttggattcacttacacagacgccagtaagaacaaaagcatcacctgaagacaggatacactgatggagtatttggagaatcccaaaaagttcatccctggaacgaaaatgatagcctatctcaaaaaagctactaatgggcattaattagttggccactgccttgtttattacaaaacaggaacatctcatgacttttttgtgtgtaccataatttaatagatctcatacaccagaattcagatcattaatgtctgactgaatatttttgttgggcagtcctgttaactaagactggattgtggttaaatgcgtatgtttgatgtttctttgaattttaatagtaatttcgattcagtaaatgctatcactgtttcccccttctaaagatatggttggacttcattagtaatgttcaacttttcataaagatggtgaataccaccttaaaacctattggagattggttttatgtttagatttatataactggttatgtgaatatatttaaatacttgggaatttccttcactgtctcagaaccaagcaagagtcacctgtattttgtgttctgttgcctcttaaaggcaaggtctgaagatcaggtagcaatgtctactttatatttttggctttgactgtgccaatctcattagaattccctgtatctaaaacggttccctttacttacagaaaggcattttagtgtaggctttagaaaagtgtgcaatatttagagtgatattatacactaaagtgtaatagttgagaagagttaaatattttttatttgatattacactttggtgtgtagtgtaatatcaaatatactttataaataataaaaatcttataaacaacaaaatctaataaaaatcaaataaagaacatttaatattacacatcaaagtgtaatacgaaataaagagtattttactcttctcgaaaaaatttattagacacttatgaaaaaagtataaaattattgtatatgctgtaatgctctgaaggccttctaagatttatatgacattttgccccaacactaaatggccctggtttttatcctttttatgttttttcttcctccttcatctgtagttttccttccttctgtagtcatatgctagatcttatgaggccctccctctacttgtaattaatattttgtcttagaattagctatgtcttggaacccaaccagataactaagcttgtgtaaaaaccaattataaataggatgtactgggtctaaagagatttcctctgaaatcaagtgcattcactgtagtgcttgaactttgggtctctgttttggcaacctaaaggcctatttgcttacttcctaacttctcagatggtttgtgacagagaaggttgccagaggacagattcatcacaggtgaggtattgctgtagtaggaaggcaaaaaaggtaattgaaagaccctgttcttcaaattaccaagagaaagatgtcgtgcaaggaataggacaatgacctttctgttatttgcattacggcttgataattatcacaagtacattcagtttgagagtttctcgatctcttctcaatgccttcaaatagatatgttacaagacatggcaaattgattctttacctaagcgaggccagtttcatgttccaaaaatatttcaaagccaaatacacataactttataaatttagccactgttttttttccccttgactgttttattcttgactgccatagccaagagttaatatagttgcgttttcttaaggaagcaacataagttctaacaataaatctgtgaaaatgaatttgtgattttagttcatttttggatgatttcaaccaatcattgtagcccatacctggcaaagcaaaaagtttatcacagcaactccttattttgctccctatgagattgtattaaatttagatctctccagaacatttgactcccttcttaaggagatttatgttgaaaattctcacatagccacaaaacgcagtccattttatattaaaatgtgagtgtatttctaaaattttttcttttgttttgtttgtgttctcaagaatgctttctaaaacaaactcatgtgacataaacagggccagcttgccctagttacacccttactatttcattaacaaaggaactgggctgccattctgtttttgttatgcttatgctgaataactgtactcagccagctgccatgacttgtctgtaatcccagcactttgggaagccaaggtgagaggatcacttgagctcaggagttcaagaccagcctggacaatatagtgagaccctgcctcaaaaaaaaaaaattagccgagtgtggtggtgccagtctgtgcctgcctgtagtctcggctactggtcggggagaggggcctgaggtgggagggatcacttgagcctgggtcacggctgcagtaagctgtggcaacagagcaaaaccctgggtgacacagcaagatgtgtctcaataaaaataagtatataactgtattcaaatgactttcttcttctaatgtggctgcctgggcaatttgtccattttttcccagcagcagctgctaatgtttaagtgtaattttacgctaaattttttttaattaaaaaaattaaaagttacaccagcttattgaagcaaatatagaaaatacagagaagtatatggaataaaaaataaaacatattgtcttcactgcagagacaaccaagtctttaaaaatgtacatgtctgtatatacacatctgtactcccacatgagcacacacacgttggcagtgatgttttaaaatgtaagtgtttttatacatgggaagttttaacttgtgttttttttttttttgttttgtttttgtttttttttttgtttttgagacggagtctcgctctgtcgcccaggctggagtgcagtggcgcgatctcggctcactgcaagcgccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcctggccaacttgtgtttttttaaatatggagaatgcaaaataataataaataatgaggcataattataattgtgatgacaagaaagtaataaaaaaaagttaaactctttaactctgaaactaacattaagaattttatcccgtgttgtagatccaggaacacatgaggaagatgctttaacatctttatgttaaagctttaacaacatggctctcaaggtttttggacccccttccataatgtaatagattctgaattgcaaaataccaatacattttgttaaagggtcaagaactatagaaggaaagtacatctcaatccaaaactatatccattgagaaaagaaaaatagctcagaaccatatgagctatataagtgatgcaaaatttatcacgccctgagagacataatatgggacttcagtgacactccccccatgcaggggtggtggtgggggactatttaaagccattttgttcctgactagatgctgcctccattatcttcatgttactggaatctgtgatacacagaacaatagcttatgggtttaacaaaaaaaaaaattttttttctttttttttgagacggagttttgctcttgatgcccaggctggagtacagtggcgcgatctcggatcaccgcaacctctgcctcccaggttcaagcgattctcctgcctcagcctcctgagtagctgggattacaggcgcctgccaccaccacatccggctaattttgtatttttagtttcaccatgttggtcaggctggtctcgaactcccgacctcaggtgatctgcccgccttgacctcccaaagtgctgggattataggcatgagccactgcgccctgccagtttacaaaaattttgttgagacagagtctgactctgtcacccaggctggagtgcgatggcacgatcatagctaactgcagccttgacctcctgggctcagacaatcctcttgcctcagcttcctgagtaactgggatgacaggcatgtgccaatatgcccagctagtttttacattttttttttgaggcggggttgggggggggttgcttttgttttgagacagagtcttgctctgtcgcccaggctggagtgcagtggctctatctcggcccactgcaacctctgcctcccgggttcaggcgattctcctgcctcagcgtcccaagtagctgggactataggcccgtgctaccacgcccagctaactttctgtattttttttttttttttagtagagatggggtttcaccatgttagccaggatggtctcgatctcctgacctcgtgatccacccgccttggcctcccaaagtgctgggattacatgcatgagccactgtgcctggctttgaattttttgtagagataggggtcttgctatgttgcccaggctgctctcaaactcctgggcttaagtaattgtcctgcctcagactcccaaagtgctgacattacaggcatgagccaccatgcctggccaatagcttatgttatttaaatataaattcttggtaaacaatttagaaactgcctcttatttcttcctttaaaaattcacttgtaactgctgttaatccgagtgtacaaggcaacttcaatctattctcccaggtggctatcctcaagtttgggctcaaataaatgctatacttaatcatattttctgaatcttgttacttaaggcggacacgtataagttgaaattctcccaaagtgaacacggagtcagtctaccaaagtaaaatcaaactaaggtgaatatttaaatattcagacaaacatccctgctattgaaaaaaatcacaaatatttgcttagcatccactaagtgcaagatgctgatggtgcaaataccaggtgtgccagacaactgctcagccttttatacctcttggcctaactagacacacctgcagttttccacatggaattcctcttcttgcactttggcctaagcacgcattttttctaatggtggaaaatattaaacagacttttgctttagaaggtatctcacttcacttcaaagcaaagtctaccttgtgaatttaattagggaaccttcatgagattttaccccttatgtatatttccaactattttagtcatcaagaacacttactgttccaattctgccacggatgtggtcaatcttagggaaatttctttgagcctcagtttcttcatttgtagcatggggatcttacccacctaaaaccaaactgagacagcacagtgcttgggggacaggagactctcagtaaacagcagctcttattgttgtgccccagagagtctcttaggaaacgggctccccagagcttcaaaccatggcttttcctgtgtggctacatcacagacattgtttatcagaggacacatcttctagttcactgtggttcattcttggtggtcattggaagtttgctccattacagcaagtacacacacaggtagcgatggcctacatatttattttcaagcaatgttttccagcagacatggcattcagtgttgtatgaaacatccccatacaattccacagacctgcatgcggctttcactttgccctctattgtacagcctttcatgggctgcttgacttgagcacacttctcactacatacttcattttattaggatatgaattttatatccagataatgaatccaaagtctgagaaagatgcatgcttacaattggtatacagcacggctgtggagacatgttgagaagctctgggatgagacacctaaattcaaatcccagctcacacttctgtgtgaacttatgcaaaaattttaacctttttgattctcagttcccctcatctgtagaatggttatccccattatgggttatccccagagttgttgaaagttaaaagtgatcatgcttgttcagtgtttagcccagtgtttggcatagagaaaaaaatgcaataaatggcatcttataatgcaattgttactgattttatcttaacataatgctctttacatttggcccaccaaataagatcatcttttggaaccattttttactgccagtgagaaccatttggtcagaatgatccacactctcatctagttgcttttaacttcacttatgagagagctgactagggataggggtaaactgagggtgacaaaagactattttcctgtgttctaagtctgctgggctatattaaatctgatcttttggtctcatcaggacaatcctttaaccaggaaaggtgggggcctgggaagactacagcttgctagagcaagtcatccttgacatgttgaactttcaacaagtttatcactcagatatatttgggggatagggaatctgagaaaaccctagattaaaagtattttatcagcgcaaaacagtgattattctaagacaattatatgacagcataaaagtattgatatttaaatatctcaataccccaatggcacccgaacgaaaaccctgcaaccagtacaataatagcattattatacatttttgcttcactttgtgggactttaaatttaatgccagaaccaacagcttacaaactgctgtggacaagcagtgacccccttgtgagctcggtaaatgttatctattgtattctaccaatatctcagcaaaaagacagagtgttcctgaaacagtctctaaagtcgtccatcagagctttgaagaagaacactgtcttcttttcatgtgggctgattttaagggacaatagaggtttaacagaggacaacacaattggattgagataaaactgctatattcccaagaattctcccataaaggtaaattccacagataagacatttacttttttctttttacattttttggttttaatttttaaagttgctttttcttgcaactagaagctcaagtaccattgctattcagtgttggtttcagatagtgctagaggtggcaaaaataattctgcaaatgcgactcacagtgtgcacattatatgtaatctgttttcatgtattcattagcagagacatttggaataccttgttgctgaataatgaaataaattgcatttgtccaatatcgtcccatctatatcacatttattccagacttgagcctacaccaatgttattcaacagccaactctgtctcattcataatggatttttctccaaatggatctgtttcatgttaaaattagtgataaagttagtttttaatggaataggcagcaggcaacagcagcttccgaaagtataacctaatggggataacttaattattagccatatcaccctcagagaaccaggattatattaaaactcaatttggtacaaacatatatagataccacccctgttttttctttaaattagctaattatgatgtggcctgaattgataaagtcaacacatcctctcaaagaaccacttaaacacttaaggaaaatgaatagtccttggatgcaaggccaggtatttgacggatttatgaatgtcactcacctcctggcttgaacagaagtgaattctgatacaagtttcttgcccacctacactcttgatgctggtaaactgttaattaagcatttcggtaatataatgcaaagttaataacagagacctataattaacatacactcatatgtgcactctaaaaatagggtatcaaggaaagtcttcctattaggtgatgtgatcaagattaattggttaatgtctatatagcccacctatacataaataagcttatgattattataattatggagagcagagttcaaaatccacttcaagttcaaagaatagtattttatacatctaagtatagacgcaaatatttaactctgtaaaaatacttattttaatgctattccaaatgtttaataagtattactcatcactcaagttttcctttttcttagtaaaaaatcatagatgtttcaaaaaataattcccttttgccgttaataacattttaatgttattttaattttttttgaaaacttggtcataggcagggaagagggaaagtttggtgttaatgcagaaactgccttgttaattaatcacagtgcatactggtggatggataagcagaaggtgatttaaatttactgaaagctaggtttatatgaaaaatagagcaataaagttggcttcccaataaagttgggttcctagcctccaagtcttacacattacttgaggttggggagatgactagatgaatacatggtagcaacttataaagatcataataacagaatataccaaaccagatttcttttagggaattcgggaagattatttgtcatttgatttgggccacagagaatgaatatcgcacttccctaggcagtgaaagttgcgatgggagtgaagaaaagccaaggagaggtcccagcatgaacatgcgtgatgtgttcaaagagaggctcactgtgtctcaagggcagggtagagtggagcaaatggctcaatataaggatggaaagtgggtagccaggttggcgggacctaatcctaaagggccttgaatactctgttaaggagtttggacttattttctaggtgacttaagccttcagaacagaaaggagtctgtttagattacgtgtgagagctcatctgtccaatgttcaaccacacaatctcaataatgataaagatactaacaaagatgaactagccaaaaccattaatctgcttccataacgagctagcctatgagtttttaaaatatgtttctagccattaataaccagggaatttcacattaaagttcagatttatagattctcttaaaaaaaaaaaaaagacctggtgatgacagaccagttattccaaacggcgacagagccaagggaggtgctccctttccaaagcatatgtgccgtccagcggtccaagtgcctcctctacctgccacactcacaccacctgcctaggggcactaaatgtttgggtttgcaccttttcttttagagagatgccctcttttattatcattattattattattattattatttttttttttctgagactgagtcttggtctgttacccaggctggcgtgcagtggtgtgatctcagctcatgcaacctccatctcccaggttcaagtgattctcctgcctcagcctcccgaatagctgggactacaggcatgcaccaccacacccaactaatttttgtatttttagtggagacagggttttaccatgttggccaggctggtctggaactcttggccttaagtgatccgcctgccttggcctctcaaagtgcagggattacaggtgtgagccaccaggcccagccgataccctcttttattagcaagaataattctaccattgcatgagttcatacatactgattatctccggcttcttttggtaatgcattactttccctttttttctttctcatgccaataaagttttccatttattcctttacttaaaattgaagttatacggtgttaaataaaatgtgtttgggttgaaaatgaaaatgaagatgtcatatgtaaggggcctatgatgaacagaaggtagaaagcatgctctgtggcagggtttctcagccttggcactactgacattttgtgtgagataattctttgttgtggctagatgctaatagcactctcgaattgtattaatcaaaaaatctctctagacactgataaatgttccctgggggtcaaaagtgcccccagttgagaaccactgttttatggagagaatggtttccaggaaaataagctctggataggacagtggtgctctgctggaaaatggataggacaatgcttatgtctcctgctgttacctctgcccctgtgcacctttctgttctgccagagacaagggttgccccacccacagaaaggtggaacagccaggcatcctgagggtagtgatgccaaaagaagcccaaagtcctctcctacctgggagaaacttcagcacctccatgaggcagcatggcagtgaaggctttctctgctctctactgctgatgtagttaagggaaacaagaaagaaatttgcatgatctattctcaagacccaaacctccctgtttgcataccccggctcagtgtggtgtcagaatgattctaaggaaggaagaagccccttttctctgacaaggcactggggaagtctagtcgagatctcactggggaaagcaggacttgctgctgctatgggaggcaggaagcaggccaggcacagatcctggaacacatcagaccaaagtccaggacctcctctcctttggctcgaagggccttgacccagagctcactcacctgagagcttctttcacttttcttgtaatatacatttatcttgaatctaagcactgttgttgtattatcaaactgtcaggatggttttatatgttttcctagtacaagtaaaaaagattagttgctttgcaaggacggaacagggagttgttgatgacaaagtgaagtaggtaaaagttgactgaatagttttgatatttttcatatggatttcagtttagatggttttgcgctaaaaaaaaaaaaaaaaaaactcaatattatggcatttcctggagtttaaaatacgctgacaatacaatttacaaaaggcctttttgtggttagtgtcttttcacacctctatcttctggcatttagaatctaatcatttctttgtggtaagaggtattatatatagaaaattggttgaattaaattaatcaacgaaagtgccttgttcattttgcactccttctcaaaagaaaccactgaggtgggaggactgcttgaacctaagagttcgagactagcctaggccacatggagagactccatctctttaaaaaattaaaaaaaaaaaaaaaaaaaaagccatgtgtggtgtcacatgcctgtagccccagctactggcgaggctgaggcagaaggatcacttgagcctaggagttccaggttacagtgagctatgatggcaacactgcactccagcctgtgagaccctgtctctttaaaaagaaaaagaaaagaaaaaacccaaaggattcatttttacaaaattcaagtcttctgaatgatgcttagtaaatatgtagtagatgctcaatacaggctagctaatgacaacagtgattttggtcctcaccataaaggggcggaagggtggtggttaaaagggggaaacagggcaacagcaaagaaaaatgacaattagtctcctcattcagtaaataatgagtaaatgaaatagcagtcactcccttacagtaacgacagctcaaaagggtgaatggcttgaacaggggaggatgaacaatacaagggtaaaagagggatgcagacaaggaaggttttgagtaagttaaacctactggcgacaaagaacgtacagagagcagggccaagcagctgaagcattcttttattcacaaatcaatggaagctattcaagccaatatggtttgatttagcagatattaactgcagctaaagtgatgcaaatacgtcagcaaaaggagagcaagataaacatgagaaacccacactcgttaaaaaggaagatgagaacagagactgacatttaaagatcagattaaaaggataggaaaaacgagagaaaagtaagacaatgtgagcgtgagatccttcgacagaagggaggtgaaggggacagatccaacaatccccctgcttatttgactccgagacaagagagaagatagccgatcacgggccatcagtaacacaaacacagcccgggcacttcataaatatttgttgagtaactaaatgtgcatgaaaaatgccttcctttctggatgtgaagataaactgagattttatatggtaccgtattaacaagtttttgtcttcaggagaatgcttaaaaccatggacagtattatttttgttttgtgtgggtgtatgtgtttgtttttcagacgaggtcttgctctgtcacccaggctggagggtagtggtatgatcacagctcactgcagacttgacttccccagcctcgggttatcctcctacctcagtctcctgagtagctgggactataatgcgtgccaccatacccagtttattattattattatcatcattattttgtgttttttgtagagacagtgtttcaccatgttgcccatgatggtcttgaactcctgggcttaggaaatctgcccaccttggcctcccaaagtgctgcgattacaggtgtgagctactgcgcctggcccatggacagttttaatgatgattttaaaacagctattcatttggataaatttccatgagcctcatcttgtacccctgacacaggtgccgtcatagattcaattagagggtcacagtacagtagttggagcactagactgagagtcaagagactaaggttccaaaattggctttgctgctaagtgtgtgatgctgggcagccacttaacctttccgagtttctgttttctctggggtaacaggagtggcttggaccaggtaactctcaggcctctctcatgatcctacatgtgcaataaagtacattaccatattaatcggctattttgccctgtctgtatcctgccttgtatgcccagtgttgaatggcagataaaagttctttttttttctctcctcattttgcctgctagtggcttgtcaacagtagtttctataatcaattctggaaatgtttacccatctgtattatctgaaggctgttatttactgttcttgctattttttttttcccggggagtgtagtaatttcgatgtgcctcccacaggagaccacagcaaacaacaaggatacattttcacaatactcagcatgaagggacactgttttgctgatgtccctgacacagtttgaattcatcgtaatggtatatttgaagtggtttcctgtgtttttgtgtgtgtgtgtgtgcctgtaaagactaaattaaagctccagtgcatatgagtcctactgtgtgctgttactcttaactagaattagttttttctcttttctgtgaaaacacaaataattgtgcaggccaattaaaccttttgatagaaatgaatagcctagtttttaaaagagttaaagaggcctaagacatcacttacagcactttttggtatcataatattacatctgagctctctgtggcagtcttagatgaagcatgaactatggaaagatcatgaagaggcatgaggggtccctgattttagtccctgccactaacttatcctggcatggtgtttaatctcccaaccacccgattataaagttagcagattgcactagatgactgctaaggtctcttgcaggtctaatagtctataaaatgcccagctagctatgggactgttgtatttagctatgtcaccttctacgatgaaaattttctttcctgctgggaagttatcaaaattcactttttagaatgttaggccaacacataaattgacctcactgcatttctgttacctcattaaaaaagtaataatccatgaaaaagtacaagatgtcagggtgatttatgtaaacagaataataccttaccttaaacacaccagaacgtactgcagagcacataggagtagctcatgaatcccagcactcccagatgaggacagggaggcctgatatctaaattccatgcatgagattccataagtctatggaaaaaatactaggtataccctcatccattgctcactagccatgctttgaatttgggagccttacaattacatagcaaagttgagtagctttaaatgtagaaagcaggtcagtgagtggctttaatgtggattcatctgttggagaagatgtggtcctgcatttcacatggccagcaaagggcaaagaggggacaatcactgagaaatgtgtatgttgggggaaagaaccccataagaaacctaccagaaaatgggcatcatccctcatatttgcaaagcctttcacaactttactaaacacttgaatgctctgggcatagtgaaccataagaaacagaggggttataacccacagggtttaataaatgcatggctattatagacaactggatcatccggcttttaccattggtagcaagaaaaaaaaaagaggggctttttagtcatactccctcctaccatttaaaaacaaatctatacataatatagataacaaaactatatttaggaagaagcgcttattgatgggccaaccacctgaaatgtattacctcatttaacaacctcaaaataatccaatgtggttgatgctgttttcatcctgggtaggagatgagagctgagtgagttaagccactggtcctgtggcaaggaagtcagatcaccactattctggatcaatttgtcaagtttcaagtgtttaccttgaatacaaaaacaacctgagaggcagctggcaacgaatacttcttcacagtttgggcatgagtcctgactaacatgtactaaattaccaagcatatctttaaataaacgtgtaccacagcaactctaattcaaacaacaatctttaatgtaataattacactggctgtgacacgagctcagccgagagtgtatttttattttaacaaggctgagtaagtacatgagtgtgggctgagctttttgctcgatagtcaatacttgaaagctggctccaacctttaatttaagcattcgcttgtagcaccaacagggctacagggtttctagtatcaaagacacaatcctccgtcctttcatggccctacttctgtaagcagcatgattgaaccgcggcaccacagaaacttgttttccctccttctggcagcgttaagccaaaacactactgccccattcatcttagcgacatcataatgaagtccctgaatcaatttatatcaagcaaagtgcagaaatccattgaagactcgtggcggatgcctttcatacatctctcaacaccatacaagaggcagagcggccgcacagaaacccaaatcataacacagaagagacctttgccgcatccaaaaagcttttttatctcttgaaataattaagggaaaggaagatactgagaatatctgattgtttctcgtgtttcttcatgtgccttaaaaatatctggcagcctccctccgtggcctcccggcaccttcagtagaaagaacaactcccgtagaatgagggtgagagcctgtcatagttcagaccccaccggtctcctctacatgccttgtctcctgcagtccccgacttgccttgctcactgtctagctttcaaggattttcacaaactaccatttgttggcaataaccttcctttgcttcaaagctcagctaagccttcacttcttccaaaaagctgttcctaacccctcagtctgatttgtgctcctcctctgtgctcctatcgtctcctgcattcctctgctctagcatttacactatgtcatgattttatttccaccttgggccctccctggcctgtgagctccttgaaggcagggaccacttcttttcatctttctggttccagcactttttatagtgcctggcacacatcagatgctcaatccatttctatgtgtattttgtctacttccattctactgcagtgttcagaaaaagcccctaacctcaatttgcatgatgacctaatctcggaatctggaacaatgtgagtttctgagactccggtggtgctggggctgttgggtcagaacagagcagggttagcccagccctgcgagtctggcagactcagcccccaattggagctatgtgctagccctgtgatcctagacaggttgctctgcgtctctgagtctccgcttcctcctctgtaaaaaggaggatgaaaggctaatgtaagtattaaatgtggtaatccatttcatggtgcttggcacacaggaagcgctttataaatgataggcttagaacatatattactggttacaaatagcagggcttggaaaatgcagaattagaagcctcttatgttatatgatgagaaatttcatgcaagttcttcttccatcagcccccatctgaccagaccacataactcatatgcttgggcactggcaaaggcccctgttaaaatgcaatgtgtaccggctaaggctggatgaactcattaccctaacttcaaacttgaatacgtgatgtgtaccatttaccacgtgtacaagaggatgagaggatggggatgttaataacaacacttcttcagtgcctgccatatgctaagtgcttgtcacatgtgagacattgcattaagtaccttccatgtgttacttccttcttcccaaaaatccctatgaggtagatgttattatcatctttatttgatagatgataaaactgaggtttagtgaggttacatgacttgcccaagatccatcagctaatacgtggcatttctgggacttaagccttatatttggaaaaatttccagatccatgcttgctcttatgcctatgccaactttctgagagtctttcttatttctgtatcttgtgtcacccggaagagccaggagagaacgggacagaagatcaaactactgagtcaggggcaggagaagaagaggaggtctggagattgtactactcgattttttatgtggtgattaggcaactctgccttcagctaaaccagaaggccaccgagagccctaagagaggagatgataaagtttgaaaacatagctccgtttgtctaatgccagccttaacctagggccagaaccttcagcaaagagctagaatgtacacagacagtattaagtcttagaagaccttcctattcctatagcaacgtcaccacatcgtctgattcactttttccttcccatttgactagcaggtcattcaaaagccaatggctataaagcaagaaaacaatcctgtaaaggctgatacttggccttcatgatacggagttacagctttgtacgtgtacttgaagtataaatgccttcagtttccctactgtaaggtcataggtccagtttacctctgtgaagtggtggtacaaaggaactgagaataaacaaaatgtttagtaaatgacagagtggaaaattccaaagtcgagtctagagaatattttcagtactgagagtatatgatttacaaaaaaaaaattactggaatcctcctgccctttggtaagctttttattgaagtgcaacatgcaaagagaaacagacacaaatgataaatgtaagctttatgaattttcacaggcaatactcccagatcaagaaaaaaaaatgtccctttggttttttaaaatagttttccatgcctgggtcaaaatcaccgaataatgcaaaacttagcttataaaatttattgtttaaagttcagttagccagaaaatgctaaaagtttaataaaatacaatgcctaaacatgagccattttattttacttcaaagagaataattatcttacacttctgtttcccaaattggaaagttagaagttttgttttctttttaaccacgaatgggcatgtagttatttctctcaccctttaaacggccagggtttcctcagctgcaccttcccaacaccctctccaagaacagagcgtggcttgccttgctttccttcctcttcactcccatccttcccccacatcaccactgtgagttgttctgaaatggggccatctcattctcctcagccctcctaattttgggtagatccatagaagacaggaggtgctttttctcatgggcagcgtggctgtgggccattgcacaacctctgtttatacagtgagtatgcttcagcctatccctttaactggctaataaaactatgctgggagcaacgtatcccagtgttctgagactgatttggctctgggggcaccaacttctctcttagttataacagtcagaagcaagaccctggaaatgcagaatgtgccaaaacacatttgctcccactcaatggacagccttttgataggaaaccaaatggaatgcaagacctgaatgccccctatttgataataacaaagaggcagatggcccagccacaaagggcaatgtgaatgtctatatgttagatgccaacaaagtgattataaaattaaggacaagtatttgggcattgctttctaactgcatgttatttttcacaagaaatttcagggaaggttgggctttcacatatttaattagtgtaatggaactgattctgccaagtgtatctgttagtcgagggcttagcctccttgtcacactcaggtgctgacagctatctgggcagaactcttcccccttggagaaggtctgagggggagtgaatggtgtatgtgttaaggtgcccatcacttgcatggtcgcaggcctgcaagggctttccatctctacacacagtgataaaattctccaaggtgcctacattcatgacaaaagtttcacatctttcaggagctgggatagctctggaagtggtactaattgtataaaagctttttcctccacaccagcccaaaacaaaaagaaaaacagccatcatttactagtactatttttgctaatataggttgcagatgattaaagataaactgtaaagcctctgtaaaccacaaattttatgcccaggtctttgctatattaataaaaaaaacaaaaacaaaaatctctgaaaatagaatatcaccaaagattctggtcttccactgttatgaaagatgaagacattataaagaaaacgaggattacaaaatttgctcttgaattcatgtttgaaagtgctttctttaatataatttatagctcatctgataaatctgtctgaatttaaagccccttctattgttaccttgtgctttgtcatacaattttcagactatgtctcctacagtaaattgtagagcaagagctctcaaactttttggtctctgtatacttttatgcttctaaaaactgcaaagaggcctggtgtggtggctcacgcctgtaatcccagtactttgggagtctgagacaggcggatcacctgaggtcaggagttcgagaccagcctggccaacatggtaaaaccctgtctctactaaaaatacaaaaattagccgggtgtggtggtgcgtgtctgtaatgtcagctactcgggaggctgaggcaggagaatcacttgaacctgggaggtggaggttgcagcaagccgagatcgcgccactgtactccagcctgggtgacagagtgagactctgtttccaaaaaaaaaaaaaaaaaagctgcaaacagcttttgtttttgtaggttatacatcagtcattgccatattagaagttaaaactgggaacatttacacaatttacttataattcaacttaaaataatagtaataaacacattgcatattaacatataaaaataagtatattttataagacaaaaagttagcatgaagaataccattattttacatttttgtgaatctttttatatctggctattaaaagaagacaagtagattctcatagctgcttctgcattcaatctgttgtgttatgctcttatggttgatgtatgtgaagaaaatctggcctcacaaagatatgtagctagaaaaaggagaggtattataatagccttttcagataattttggatattcttctgtggtactacactaaaactcaacaagtggtagtttcttaaagattagttagaatatggaacctgaagccatatcactgactttttgtactttgttaaattaaaatacaccggtatattttgcactttgagtggatcatttacctacatatatttttataatatcatccatgggtcacttggaaactactggttcactgggttttgtatatcttccagattttgacacatttcattattagatgtggttatatcaaggaattatgttgattaatatcactacccataccatcagaaaagtttttaagtattgggaagctgtcagattcctggggttggatacaagttttccaaaattcagatttttgcctgaatgtatgggcagtaaatactgtgaactgtttttcaggagataacagactcaaagttcatttttgagaaaatatatgaaacatatccacatctgaataattatagtctgttattctattaagtggcattccattcaaaaaacagctagttcagctcttaactcaaacaatgacacaagtacttttccctggagacaaacatggtacttagtagtataaagcagaagtgctttatgcaaacttccaattttgtcataaagaacattaaaaaggtatggacttgagggtcaaaatttaataaagttaataaatttttctgcttcatcaagcacattcttaaatgaaacttttttttttttttttgagacagagtctcgctctgttgcccaggctggagttaagtggcacaatctcggctcactgcaagctccacctcccaggttcaagccattctcctgcctcagcctcctgagtagctgggactacaggcgcccgccaccatgcccagctaattttttgtattttcagtagggatggggtttcaccatgttagccaagatggtctcgatctcctgatcttgtgatcgatccgcctgcctcggcctctcaaagtgctgggattacaggtgtgagccaccgcgcccggttttttttttttttttttttttaacagcaactgcacagtaatgaagaataccatgactgctggtacagcttggcattaccgtcctgcttcctgctaaggtgccagcagttttacccaccaatgctttgcaccattaatacaaatggtcaccgtagtaaaaaggggaaacaatgcctcagtattgttatggaactggtttttatctcttggagcttctgagagggccttggggccccgcagggggtccctggatcacacattgaagaccactactgtagaggatagtatctataaatccaaacgctctctaatctgctaaatgcttatgtccttgtggggttcacgtaaagaagatttaaaaggtttatttctgtctccactctcctgcccttcctgcttaaaaaaaaaaattccattgtggtagttcaacataaactgtgtgtatagaacaaagaaattacagtactgttgatttcatcagcattttctcctaacaaagaaaactagctattctaacatgctattgagaaaactattgaactaccatgagttataggaaatatgacatgctcagtgccccctccatctcacctaagtcccaactctttcccaaacctttcactttgggggtattttggatgagctcttagtagtgtcctcagaaataattggttgtcctaattcagccccatgcaaattaatgctcccctaaagaggccttattataattttcaacccttgatgtctacataatcccctatagttctttaacttcttgctttctaacttctgtttaccgatgcactacttttgtcagctcagtatagcatcaattagtaacacagttgtgtttattaggtctccctagagccttgagaaagctgctttgtatttattaatgactacacagagcactactatttttcaatagcacttaaaaatgagtaaattactgaagatgaactataaaagaactttaaatttcaaaggcaagcaaaaaaaaaagcacattatttaaaaccactcataatacttgcatggttaattttattttcaatgtaatatcaagagagagggaagaaagtcaaacccagactcttcttcctgttctacttttggcattttggagtacacatgatttgagttagagaactgaagcatagatctggtgattaattaagagctggtttaacaggtctaaatttcattatgtcacacacctgttaagtaatgcacacctgattcagcagacatccacccacaaggttaatctcaaaaaattaagcaatcaacaggaaagaaaaaagaggcatactgcactaacttaggtccagttttatgttctcaagcataattccaatccaccaatttgaaatgtatccactttgttttctcttattttgtgaataattccctgtactacattaggtgaagttagagttgcccacactggtatagaattcactactcaaggaaaccagagagaccaatcgctcctgtgatgaatctttccgaaccaaacttaaagtgatgccagcaattatggcgttcatttgccctgcttttatattcctggtcatttatgaaatgaagacgctgatctgcaaaaatcactatgcattcatgaaaggagctctgggagctccccctgaggatctggctatgaggcagaaacatacctcagtgcacttcctttgtcttgtgctccctctttgatgtgcaagtcactggtggagtaagctgtgatcgctttgatgttgaacttctagactttattgttactagcatgcctacaaagagagctgtcagtcatttcttacatctgaacaaccatgtttctttacagcgcctcttttacaagcatcaatccttaaatacatgttttcacattcctgctgattaccacactatctttgttgggggagggctgtgctcaaatataactacagcacccacattttctgtaaacaccctgaggcatcttcagatggctggtaaccaaccttcttcaacaagagaagccccagtgcaaaacatatttctagcaaacgaaaacattctgaaaacactcgatccatcttaacagtcgaaatgagcagtttagccaatatttcccctaagcagccactgaaattgcatagaaacttccaggccacttcaaaagggattctgaacgtaacagcagcagggggcttagaaagactgccaaaaccctgagacatcttaactcatcttaaacaactttgtttctctgcaatagtggaaacaaaatgcttctgttttacgagattttgcttgtggtagaaacattgcttttgaaatggatttctatcaaaccaattgttttgttaaacaatatcattttcaaaagttgcttgatgttacggatgcaacttaagaggaggaggatttttcataatcttgtgtctagggcaaacgtggctgtgaatgcaatggaggtacaatttcttagatatatacaaaataggcggtatgcaaatctttaaagatctctgttgaaaaagatatggctctaatttcatttaccagctcccatcagattttcttttcaaactcctttatcgcttctgaaactgctgaatattatcaaaccccactgggaaattccacacaaggaaataaacttaaggtgcttacatcacaccatgctggtttataatgaactgctgtctttttgaataaatgtttcaatgaaatccaagtttttaaagatgccaggtctcaaattaggaagttaaatgatattttttcatgctggagcttagttctgtttttcttttttataaaataagatggcatcacaagagatacattgtttctgcttgctaataaactgcagacgatacattgggagagactcaatttctttgggttcctggcttggaatatttggtaaagaataaaattactgtggtacgcaatggttaaggctactccatggtttccatttttaaacaactgcccccgccccttggttttaaatcaaccatcaaaaacggaaaaagctttaggctacaatttgataaataaggtatgactgtaatttactagaactaaatctgggcatatttattattaatattaatgaaaacttgcttgttcttaaatttatttaaatagcataaagtaattacctctttctgtcttaaattttcacttccaaaaggaactgattagctgatagaaggacctatagcaattaagggtagagacagggaataaggaaagtaggaggcatttgtttgcctctcccaagtctcaaacaagaaactagagcatgtttctgttttaatagaaacactttcatagaacggtagagatggaaaagatcttggtgactaccaagtccaaccctttaactttaaaaacagggaaagtgaacaactgaggtttaacctgacaattattgcatcgcagatctgggacaataacccatatcttcatcttcccccaccctatgtaggggggtttccactactcaacattgttttgctacactgcggacagggtgactcatgtacaaagtgagggtgttgggcttcagaggtttctcaaccagaattatctgagttatctttaaaaatgtagcaatacttgagctctacaccttgggaccagtaaaatcagaaatctgtaagagcacagcctgggcttatatatcttttaaaaactctttagatagattaatacgcagaccaggttgggagcagatgacctgtgaggtctattgcaaaatgttcaccatcagttgggaaaattttttgattcagttccctgatgttgacccatgaggccataagcatttctaaaccattatactgtttttacattggcctagctgttgttattatctgcatttatctagttcattgatatgtttacttaagtattacctacctctcccaccagaatgtacactcacagagaccagagactgacatgatcactgctgtcccctcggccgccagcatcacatctgccacaataatgagatagatactacaccagcattttcaaaagaaaaagggggctggtgtcgcagtgtggaagcaggcaggtagtccttctccacaccagccagaggaagtctactttcatctatcccaccagactagaatctaagctgcacgaaggcagcatttggtctcccctgtttggatgtcacctccagagcctggacactggcagatacacaccagatgctcagtgcctgagaaaggccatgtgctaaacaggaagcactgatcagcttccagggcactgaaacctttactttgtcgctgaataaagcaaccttgaaaagacatcactgtttccactgagttggccttgacttctgcagtaagactcttagcctgctcctgctaagtggtcacagtattggcaagacccagcccaggcacacagtgaaggctaaaatacattgtgtctatgtcacatgcagaggctggggcttctggacaaggctttatgacgaaaaggagtacagtatttgaaaagtctcacagcagcctccagcaccaaaacagcctcagggttctctcctgtttgggccacttggggtaagagatttgagggaacagtctgcccacttgcttctgcatgctggttgatagcaaggccaaagttaacagaaaaatatttcaagtgtgttaataacaatgccagaaattgctcacatctggcacctcttccatgctgaagggagtgaactaaagagaagtgaatggttaccttaatataatttacctttctgagattccctttcctcgtgagtaagaggaaagggttagccccgagcagtggttcccaaacctgtcttatcctcacaagaggatcttttacaaaagaagattccttggcctcccctcctaggcttttggaagcaggatctgtgcaggtgttgctggagaaaggcatttattttttaaatgcttcccagatgactgtgaagatcaatgacatttgggaaccactagaggactggaggactctgcggtccacctggctctgacaggctagaacagagagcttcacaaagtgaggcctaaggaccagttgcatcagaaacatctgagatgctgtgtaaatacatgccttcgtgggcctcaccccagactgacagaatcaaactctgtgtgagacccagggatccgccttcttaagactctctggagtatgggttctactctacagtttcagaaccactgtttcaggcaggattttagagctaacttatggcttatgtggaagcaaatcatgttcatccataagtatagggtttgactttatccagttacattaacatttcattgcattgtttggcatgtcacagaaatctcctttgttttaaatggcatgtagcttatagcaaatgcaaatgtgtaagtccaacagccataaagcagccttctctgactaagtgtggctgccaacttctcagtgcattttttaaatgctgattcatggcttaagacacttgattgggaggaaggtgtctcagctcctattataaaagcacaaaggtggtacctgaattacctagcacacaataggcacttaagtatttgctgaaacaaatttatttacttattttcacccactgttctacagaagatttgaagtgagatgaacaaataaaaagaaggagaaaaaaaacctttccaacaaccgaaaaatgaaaataacattctgtgaaaaagagaatacttctcatgtggtgaaaaaaaatcacacttctgggtggcgcagtttgtaaaacggttggcttcaataactgatctgaaacttaaccacaagtcttcacttctgaaccactgccttatttctatgatagaaaggtttaaacagcagtttttccttgctttttattttttttcttctttttcatgaaacgctgcaatttcatctttctaataggaacacgtaagcactattatcctttacaagcctggtgattatttgtcattattattaccctggttattctagctcagatcagctttgacttcttcagcaatgcaaaattcatataaacgtgcattcttatacctctgtgtagcaccaggaacaaataacatttaagcaaataggaagatctatattcattcctcagattccgacacagaaatcagattgttttaccattgtttcacacttgttataacaccaaaatccaaatccacaatccacttgtattatctatttatcctaaaaaatatgcaaatgaatgcttgtcgctacctcatgcagagtttctgacatatcctctatcttattttttaggcaaactgtatatacttaagtgaaccaaatgatctaaccataaatcttcagaaaccaaggggttaatagtttttttcatccatgtttaaaattgttttattaccccccaaaagctactgtagtttacttttttactaaatgtttatcatttttgaaaaagaaaagctctagatttaaaaaggggaaacgctgaatttagctcatcaaatgacgacctctttttaaaagatattcaagggttgggaattagaatggagtttgaaacttaaaaaaatacgaggattactaaaaatgtcataacaattgttgactcacaaaccaaatttcacttaaatttaatattgagccaaacagcaaataaatcagctttaagttaaaaattttttttcctttacttcctgccaagcaaacttttaaaattcagtatcccttccacagttacatttctgataaccatgaagaacaacgagttaaacttttgaatctggaatagaaatgtctcattccaattaagaaaataactacaacctttgaccttcccactagcctgatgggaaattcactggcaccattatgggtttagccgtccatgtgcaagtaaccactagagggcagccttatctcatatctgacatgcggcagaaaaatacctgaaatgcttctaatgttcctttaattatttttgtagtatctttgattttcctggatacttaataatcaacttcaaatggaactaaaagtattcctaaacagttcaaaagtccactttcacaaacaatgatatcacaaagactggtggtgagaggtgctagagatacagctagctgatgttatctttaaaattttaaaacaaaagtttttcatctttaagtcatggctgcctctttactatgtgctgggttaagtgccaagtcaattatatcacaactggcacttggggtccatctttggcattaaaatttcaagtggttctaggcaaactgaagtgtgtttgaggaagaaactgaccaagattgtgggaaggcagaaccacacttacagcaaaaaggactggagagggacagcagatattacgtattagaggggtgtgtgtgtgtgtgtgcgtgtgcatgtgtgtgttacagtactagtcttcaaatgacttacagtctttcatttgaaagatggattaaatgtgttctgcacagccccaaaggaaaggatcagaattaagggattaaaagtacaaaggagagagttatgcttgatataaaaagacttttctaattcaagatggagtaacctacctttaaagatagtgagttccccatcgttggaggtgttccagcataaccagataactacttggcagaaatattgtgggcagggtccaaatcccagtgagacattcatctgagtgactttaaaggtttcgtctgagactgaaataatccttatttgctttcagacaaacacaccttaatccagcagtcattaaggccattccccactaagtgagaaatgagatttttcagatctacttgaaaacttttagacttcacgtgattttctaaaagacaaacgatttctcaagaatagatctacaatcatgcccctaagctgtcatgaaaacaaacacgacagcactcacaagcacgagaattcgtaagctttatactacacaaagtcatattaaaattagaagatgcatttgtgaatgttccctttgcctaaggataagtggaacatatagatatatctctcaattctatcataatggcgattggttacacaggttagctgtacttcatggtattctgtattcttggggaaaataatgcttatatttcactcatatcctcttaaaacaagcagacttaatgaaaatcatggttgaagagagctaatgataagcaaataagaataaccccatttgtaccaaactgattttattaaatagtaatttaaagatattaggctcagcaaagcattacataattggatctatttttttcccatataaatgccagagttataatttccactaactagagacaaagttatatccaggacgtttttcacagcttcctccaggggaggcatgaagatagaaattagggttgtagttcttgtttcacgttatcagatggaaaagctaggctataacgcaacctctgtgagcctcagtttcttcatcagtcactgatgggactatcagtgactctctatggaggattaaatgatgtaagagtgtttgtaaaccataaagcacaaaataaatatagattagcatcatctccctatttgtttatgaaatgcctagtaaacttcagaagcagtaacattttaaaaaatgaaataactggaaaacctagggaataatcttgacattattttttatacccacaggagcaaagatttttaaagttatcgtattatctcctgaaaatatgatgagggctaacaaatttcattccaaaaagaaaatccagaaacaaaagatttcagctgcttccttgcattttgcccattggatagtatatgctattatccatctatttagacctcctatctcttgacaattaacagaaaaatcatgttctatcatgtcacacaaaatactgacggatagaaaaagctctgactacgactctctcagttcatgaatcaaaaggttgggatggaagggagttatcttcagtagaatagctagatgggggagacagaacttgtaaatcattcctcagagggtctgtatgtggtctttgagatactatcaaatgtcaattcacacctgacttgtcactggtggatggctccaaaaaaactgttttttaagtagagaaacataaaagtggtgtagctgctgactctgagtgtctaattatggctttaaaattattaaatatgaaatacataaaggcagccttgatttcttactaataagtgctgtaaatagtaaaaatgaatgcagaaaacatttccatgacagagtattcttaggaaatttgttccacataaggggttttgttgatccctataataatttaagagatttttaagaaaactgaaccctacatctacctctgcaaatctattcatccatccatccatccatccatccatccatccagtaacttttctccagtaagtggccatttataaatattattttcctagataccccagagcaaataagaaagtggttgggtgctattgtaggtgctttgcaattatcaccttgctgatctcatccacttttattgtgtctcacttgagtgggagggaaagataggagaaaaaggagactaatgagaattattaatatatttacaagtgtatctactacatattaaagagctaaggtttagatgacatactgtatatttctaaatgactatttctgtttagaaattacattatttcatgactgggcagcattaaataaattatatggttctcaattcaaatcgtgggcaaaagggtttacttgtgcatgctgctgctttgtatctcaagtaacgtgattgaaatatataaaatcaagaggctgcccatgaaaatggtgcttttaaaatactctctacttcatggagggtccaggcttctccctcctcccatggacaaatggattcagaaatcctctttgtctttaaaagaactgatcccttcttgccagataagcattctgctcagtagtggcaaccatttgggttttctcttttcaagatccagccatcaccttctcccaatccttcccatcacaagtaacaaaaatggtacaaaaatcccagtgaagggataccaggcaatgggtccttacagtgagatcagagatcgaattctaatttcatttcgtagaaagaaaggccaagttcttcaaaactacagaatcgtatttattacagttggacatactaccaacacatacagtattttcaaagtggtgaggagtcttgcatttgcacatgaatcaggccggacgaagaatctacgggccagaaattccctttaagcctccctgtgctcttataactccatttgcacaaacacaggctgagcactcatatgaagcaaaggggtatatcatctactgaaactgatgaacgtcttacatttcctttcagtactccgctgccgcgtgacatctggccaatgcacttttatgatgagcagaacaagtgctcccccgattataaatgttatagctggctctctccctttgcccaagaagcaatccaaatggtattggaattttgttgttaattaaacaaaagcaaaattgaaggatgagactagagttactcaaatgaagatttattacatttgagcatgaaactaagcctaaacttatttgacaactaatgcagaggaaggattttcttctttggtgagttcaaagggcctgatttactgatgtttaaaaaacatcagtaaatcagccaacaaagagaatctttcttttatggtggcttgttctctcctcccttgtccacatgcatccacataccaaaaagctatattgtaaacagtatttctgttttgcacgaaaaatctagttatacaaactgtcttacacatggaaccaatttaactattaaaactgagaagcaatagggaagtatttaataagattctaagccagttttttcctctaaatctgatatggaaacatttacagcattcctcacttccccacaaactattttctctttcagcttaagtttgcaccaaagcaagataatcccattaaaattcaggatattatgatattgggagtgaaatattctaattgttcagatgcattctctctccctcttcctctatctctctctctctctctctctctctttcaggcagctgagtttatagaaaaattgcattgccagtacttctgaggcacttttttcaaagcacaatactatgaaactattattttatggcagacagaggtcactccaagtgtgggggtagcgtgtgtgattcttattattctattagcaagggacagtatggaacttcactttgtagaattacaaaagcaaaagcctatgtactaggaaacatcaactttaaatcaaaatattaaaacgtactttccttttttttggtgggtcgttactgttcattaggggagaaagcagtttaaaatgtctcagcctctcgcctttcctccaatcaacacaaagtatattagacaaagtggataaagactggcattgacatcttccaaatagcaaaatcaattttataatttaaagacaaaaaatgctttaactgcagagggcatttaagacgtttcacacttacagggctaatgaaatgcaggactagcataaaagttttttgggggggtgggggagaatagattttttaacataagaagtcgataagaaatcttaataatttttcctcccaaataattttaagtgcttaagagcgcggatcacgggaggtttcctctcttttacttatatgaattacatattctaaaaatgattaaatcccattcccctcaagccacaggggaaaagagaaaatttgctgtgggcacattatatagaaagatttcatctcaagcagctcatcttaacgtccagtacgtttcggcctgttaataattaataaaagagatgccacccaatctctagtgaagaaaggcaaagctcggtgatccgaaagtaaacccagcgcagataccgaactggtgtccttcattccagattgcaacacaaccccaaactagcaaacgtttaacaggcgcttggcacccgcaccggtggctaggacccgcaggacagtctgggtctgcacaattgctgcgcattagggaagccgcgtccgccgcaaacagatggggctctaaatccccaagcctggcggccgggcctgcgaagcagctcgggcagattatccacggcgaggaacctgcgggcgcacaagcgggcggcgggcggcgggcggcgtgctgcgggctgagtttctccggagctgtttgcaaccgtcccaagagcgagtctcggtttctccggcagcacgggcgacttcctgaacacctccaaactttagctttcccatcagaaagttccctgacttgccacggtttctctccttctcacctgagaggacctagagccagtcctccctccaaccaaatccccctcccctcccgcccccggcccggctacggagtcctgatgagggcggaaggccgggccgcccggcaggattggccgcgactaacccgcgcccgtcggccctcaccacggtctaacctccgcccctgcccgcggatcccgtgggctgccgagttcctccccacctccatccaccagccaaagtgtcaagcggggtgcgccgcggctccctgggccgcccagagcgtcttggcacgctcgaggcgcccgtctcgctccggcccgcgcgctttcggaagtggccgcggcgggacacagcgcgggacacagcgcggacctgcggcacttgcccggccggcggccgctgaggcgctcggggacgcaggggcagggcgcaaggcctggggcgctgaccagtccccggggatgacatcgcgacaacgcgcacgcacggccctgcccggccgcggcgcctccccgacctaggccggagctgtcccgggtgcgggccctggggaccggccgcgggcgtccccggcttcctctgaactccgcagaccctccccttcctttccgaagcgcggcgactcccggcaaactttcttttgggagacccgcccggtgccaagcggacccaagagactgacaggagccggagggggcagcagagggggatccaccccgtgcgcctttgccccccaatcggaggcaggccgatcccgtggccgggctcaggtggcgccgcggcggtggcccagaaggccctggcagggcccccgcgccgagccccgggcagtacgtgcgttcgggcaggcgcgcccacccctccccctgcgcgccctcctccccgccccccggagccgccagcccacccggccccggcggggcgcccgggctcacctttcatcgctgcgatcacaaaatacatcatttaagccgcggtgcggagagcgcagggagagcggatggtccgaccccggagccccctctgccgccgccgcgccgccgccgcccgagccacagcagcagctgccgcagctgcccgcccgccgagagccatcccgagccataagaggctccatgtgaccggctgacatcacggccgccgctctgtttacaccgcgcccctccgcttcctcccggggcgggaggcgggaggcgggaggcgggaggcaggcgcgccccagcgccgcgccccgccccgcccccgcgggcaggtgagtagcagcggcggctctgctggcccaccccggccgggcctgccctcccgcgccccgggccctcgcccgggcgcccgccttcccctcgccttcgggatcacctgtggccgccggtcgcttttctgcacgcagcgccccgcggaacgcgcctctgaccactttctgcccccactcggtggggcaagaggctcgcaacccgacgccactctcccgctggcttgccggagcactcgggggcgataaatgcgccagctcgttggtggaaaagacaggtttggtctggggagctacggtcacccgcatttcctagagtgccccagctctaatcggaaggtacggcccacttctgggccgtggagaacgaagccactgggaccgtccggggagtggagtaagctcctccgaagtctttctggagagactcggcctgggcgggggaactccgcccacccaacccttggcaacccttggatattggcagttataccaataaccaaggtcctggtctacacctgtcccccccaacccccttccccgcgtccaagaccactgatacctgcaaggaaagccggaaattgtatgtgaatcacctaaatgaactccagttgccagctgatttgagccgctaaattcccaggctcttccatatctctccagagaacccatctacaagtaggaaaagctatcgttttcataccctaaaaatgaaacactgtggtaattctgacagaaaataaagacctctgaaggtgaactttgtacattttaacatgcgactaagacttaattccctctaaactttgaagcttaattcttcttactgtccttacggaactgtaaatcatgacgttattattttacaggtcaatctctttacaatgaatttcagatgctacatacccagagtctgcattgtttaaaactttggtcagggtgtctatagtaccgagcataacagaaaaaaattctgaaaagccaagtttgcgtacctattgcggttccttcacgaaatttcattctgcttgcttttctgttggtctgttgccacgcacaacttaaaatatcagatggctattagctgttgcattcatgatgattaagcaaggataattctagcatatttttttctccatgtaagtgagttgctcttgcccctgagttgggccacaatttaaaacacaagcaaataatcagcaccgtagaaaacaaggattcatacactccctccccagccccctttcaaggcaaaattgagtcttccaaacatttatacagcgctctgatttagaaggtcaataaagttcgttgtccttcagtcaagccatggctttataaaagtttgatttcagataaattcattctaatacagctttttttcttaaagatttttcccccaaaaaaaactacaaagaaaagaaattataaaaatgtgaacccaagacctacccatgttaactcagctgtccagccatagcaaagtggacaagagtttcaaatgaatcagccatacccactgtaatgtttacaattatgaaattaaatcacaccacgttcctatgatgcaactatatctcccaatgaggcaacgcccctcagttacactgacaccatcattcacatttggttattgatttcccttgtgctaacgactaatgccaagctatcctataagcaggtcccaggtacaattttctttcttttgtatcgttaaaggatggaaaaccatcggagactgcatcctcggaagtatgttcttccctactcaatgcaagtgaacccagatatacaactcggatgattcacaatgctactttaaaacagtatcctgctttagaaaacaatgttttcaaaagaaccaaatctattagctctagcgtgccttgtgagacatctgactccaaggtgaataatctgacatcactagtaatcagtatttatttccagatcatttcaaatgaaatcagtcattgggaacaacatgtaacatgacatctgctcctgcagttataagtagaatcattcattctatagatatgtccccaatagaaatataatctcaagtacttatctgaaatatttacacatttattcaacaaagacatttccagaataatgtaatactgaccttgccctttggagatgtacttcattcacttcctacaactaatgagcaacagaatttcagatatgaagtcctaaccttccaatgtagctagatgctatttgtaatacatgcctctattaaatgtcttcagcttttaacccaggttatattactgttctttatattaacacaaagctctttgagagtaaaaactataggctgttttttttttttaaccactcaaaatgcacattttctatgacattataaggccccaaccaaacaaatcagtcaggagtaaaagggaacatctcccatattgaagggacatctcccttcaataataccaaattggagccataaatgatacattttagcacaaacttttacccactgtatattaaaatacaatcatgtaaaagccgggcatggtggctcatgcctgtaatcccagcactttgagaggtcaaggcgggtggatcacttgaggtcaggagttcaagaccaacctgggcaacatggtgaaaccccatctctacaaaaatacaaaaattagccaggcgtggtggtgcttgcctgtaatcccagctactactcgcgaggctgaggcataagaattacttgaacccaggaagttgaggttgcagtgagctgagatcacaccactgcactccagcctgggcgacagagcaataatctgtctcaaggaaaaaaaaaaatacaatcaagtagaaatacaataaaatattaaaatgcaataaatatgtaggaataatcgtttggattttattaaataaatgcttatgagtaccgactgagggagaacacagtgctaaggaacatattctttctttttctttttaccaagtgttctgaaaaaaaaaaaaaagtaaagtaatattgcttacatgaagataattaaacagaatgggacttctttaccaggaatgggagtttgttatatattaatttgcagctcaaaggtttctgttgactaatctcagaaaaagaaggcacacaacatacttataaacacatgtaactcatctcagagtctcccaggatggtcacagccccacgtggtgttcctgtgtgctgggttccacactgagtctgccacacagtaagaaagtagagagacacttctaatgccaagttgttcccaaaaacacctaggggaaaagatgggtgcatttttgcaggagtctagacggtagtatcactagtaaattggtgccagtcttcctatgttacagtttaaataaatgatacttgactttatgagcgtatattttgtttttcaccacacaagttctgatctcataatttgccaccccaaatcacagatataatgctattggggagaatgacaaaccagtggactggcaaacttatcccgaatctgcaagtggctcctaggacaaaggtgatttcaaagtttgctgatgcatgtgaggcacagcattttggttttgtctcacccaggccctgcgtctctctctccagtgtgcgtctgcttgctaattcaattaattttgttatagctgaacaagaaagggatcagtgaaaggttaatgtggtcctaggcagcttgattcaatggaatccttagccaccactgcactgtgacctttaggagttgagccattctggttgacatagagccaggggaccaagtttcctataaacacaatagggtcagacccagagagttctaaagcaaggatacttgggaagctatggacacatcacaaactaacctagaagagatcacagccttgcttaaatatgagtccagaaggagccagtttctcataaaggaacacttacaaatggagtaacactggtgagacccagaagccaacagtaagacaaggaactctgctgtttatgagtataaagggggacgggacaagtggattaatgtggtttatctgccttattcatgattttaaaatgaatatagatgtagattgaaatatgcatgtatgtatacatatgcatagttcatgaaatatcgtgaaatagactacatttgggtggcaagagacacctacacttttacacactcacacccacccacacacacatacacatatttctcataatcagccacacttactgagtaggtattatgctgacactgtgatggataatcaaacaagaataagacagtagccctgattttgagaaggtcacaaatcagctgacctgtgctctgaaaactgtagagttccgtgagtcggtccaaacattcctaaaggtgtaacatgtctggttgcccattgaaaagatgtttgcgcagcactgtgccactcactaacagttgatagatgactgcaaatcattagtgtggctattagtgtaatgggatgttggaggtgaaagatttgactaaatggagacaatggtgcagggcttctgggatttctggaaccatatatttcatacacctattaggaaattcagaggactggcttatgttttgtaatcaccacaataaggaaaagggtaaagttcacaggcatacagagctgagcaacctccacagaataggtgggtggcaggtgcctcactacacacacaccagtcaaggcaggaaggggagaaatgcaaaccaaggccaagagggacctccattcctttatgtccccatgctgtgtcctcaccccattcctatacctggcagtggtacaggagatacacacacacacacacacacacacacacacacacacaacatatatatatatatatatatatacacatatatatatatatatacacatatatatatatatatatatacatacatatatatacatatatatatatatatgtaagcaaacacaagaaatacaagtgaactcagaatctggaatcctgggtccaggatagtttcacacttgtcattagctttctacatcacatcgggcaagccattttacctttcaggacaccaggcccctcaactgtagcctgatggagtaggaactgactgcaacgggcccctaccactcgaacatcctgtgactgctttcagaatcattccccatccacttttcgggaacactttcttccctttctctatgctgtgccgtatctgcttacttctccaagaagccttctttgtttgcttgaactccatggtatggtggaatgggctttggcattagatgaagttgggctcaaaaccaacctacatcccactcactagctgtatgagcttgagcaaacctttgtttcaccatacgtcaaataaggagagtagagccttgtagggccactaggaggattaaacagtatacagaaaggaaaaagtgatatctctcagtagagcttacaagtggaactgccatcaccaccccatcagcccttacattgttacacacacagcacctgtgcctgacataaaatgttaacccttaatcaaaatttgttgaaatgtttctccgcatgcacttttgctgagcgttctacaattttgaaactcgtgtgtgtgtgtcatgtatataaaacaagtatagttgacccttgaacaacacagatttgacatgtgtaggttcacttatgtgagaattttcttccgcttctgccacccctgagacagtaagactaacccttttttcctcctcagcctactcactgtgaagacaataaggatgaagacctttatgacaatccacttccacttaatgaatagtaagcataatttctcttccttatgattttcttcataacattttattttttctacgttactttattgtaagaatacaatatataatacatataacatacaaaatatatgttaattgattgcctattttattggcaaggcttctagtcaacagtaggctattagtagttaagttatgggggattcaaaagttatatgcagattttttactacaagggggtcagcacttttaaaccctacattgttcagggatcaactgtatttattaagcacctgctaagtattgaggacacaaagatggataagaattaaattgtccattggcctaagaggccctgtggtctagcaggctttttatgtcttatttcctataggagagaaagttctcatccaatgagcaatgactaaacaccttctgtgtgcattacactgtgctagtatgtcgagaggaaaggacaaaaatcaaggtatcagtctatcctccaaggagcttgcaatctagtaggaaaataaacgcaatgcttataatgtaaggcagaatgtgtggcacatactcgaagtgttccagaaataaagtgccatgtaagtcaagaataagagtggttactatgtgcggggttcatctgaaactttaagagaaggaggacttcatgaaggatatttgagctagaccttgaaggccaaatcacatcttggtggatagaagtaaaaatgaagagcctcttagaaggacgatagaacacagttgtaaaagtacaggctgggtgctgtggctcacgcctgtaatcccagcactttgggaggccaaggtgggcagatcacctgaggtcaggagattgagaccagcctggccaacatggcgaaaccccatctctactaaaaatacaaaaattagccagctgtggtggcaggtgcctgtaatctcagctacttgggaggctgaggcaggagaatcacttgaatccgggaggcggaggctgcagtgagctgagatcgtgtcactgcactccagcctgggcgacagagcaagactctgtcttaaaaaagtaaagaaaataaaagaacacagttgtaaaagtacgagacagaaaatgcatttctcactcaaggaaactaataacgagcatttaccagagataaaatacacacagataagaaggggagaaagcccagaatgtaggttgtagctatttcttctgccttccctcacagtgcccaggacagagctctgcaaactatacactttcagagaatgatttttgaaaaaataattggaggtagaagaagggaattgtgcttcagaaaataaatctctttgcagcttgcctatttcatagtcttattgtaaggattaatcgttggtttgatagtcataaagttaaattacacttaataaaacacatagagcaaaagagttccacatcacagcacaccaaggaagaataaaactggaaatggatgttatttcatcagagtgaaaagctaagcagagcattttaggatgaacaagataaatggaatgttatttgattttgtatctcatccatttcagttctgaaaattatctgagacagttctattaatatagatgcttcatatataggccatattttattttttaaagaactatcttaaaaatatattttcaaataatggagaaaagataagcggttacagatggttttccctatttttgtcatgcatgatcaaggactgcagagtaacgtgggcttcattgggaaatccaaatctcgcagctaggagcgttccaggagcaaatgctggcattattttgctttcacagggaaaatatgttcctgttcagtcaagcaaagtaatcaattattctgcattatgaaatactcattttataactattgacatttcagacagttgtgccacatgtcaatagtggttttgatgctcacatttaagctccagcttataggatgggattcatctgggctgacagtgtctgaccagaagtctattctctgctctcagaagtccatctattatttatgtccagtcctacactgtggaagtctgttgtgagcgctaaaacaagaatagatttgggtattttttgttttaataaaaaggttaaaattttctcaatatgttagatccacattttaaaaaatcactcttctcttaaaatctcttcctacattttgtaagatggaggtagattaaattaggcattccagtcagaagttccaaaattcctgttagatttttagtatctagtaaagccttgtgtcctcaaaaataattttgtgaaatcaaaatgggtttccaatcattatataatactgttactgttgctgctactacctctcctactggttaactattccttggaacttcctgtgtggcaagcattgattttatgctctttttaaaaatcatttcatttatggaaaaacattctgtacttttattacattcattttacagatgaggaaactggggcacagagaaattaagtgacttgtccaggaggacagggccaataaccggtggaaccataagaaaaaaatccaggtacactgattctagcatgtgcactcctaaacattatgctgcaactctcaaaaattgaattaatttttccttcaattcagcattacttagtatttcaaaaatagcaagctgacttctccagaaatcaagaagtactaccctcataacatctaggcatgtgtgcaagaaattcttttatcactggcttctataattgagcaaggttagcatgtgtcattatgaattattgcacaatgtagtaaattatttaattactactaatgaggaaacatactgtacatggttgtaattattctgttggaaaacaatgttgccatttgtacatttaagaaacacttgctacataccaaattaactcttgagggaagtttattttgtatttcggaataatcaaacaactctaaatgttgttaatggatgttagataggattacaaggaaactaaaaaatacacaaatcaaagctgacgttcctaaaagactccaaaccaaaaacatctgttaaaaaggtaaaaaaataatgatttcatagttcatgatattctacagaaaaagcacaagatatatttactgtttttacttttccaaattgtttcactgctgctcttttcacagtttttgcaacatatataatatagcagtttgttcacctactttaatcacccaacaaatggctttgatagcttaataatcttaagcagagccatttattttcaatgtactttgagtaaactgttatctacgtttattaagtgactgtagttatgcatagtcttgttatttataaaagaacacagtacatacatagccctgggatgttttgacaacacatcttaagtaaaatattagtaaaataattttcaaaatataataaaagtgagaaagagtgacttgtttgtgttagctacagtatacattattgagaaactactgatatgcattattgaatttgttgtaaagccttaagtacgtaatagtcttggaaagcccaactcgcccattatttcaaaggttaggtacatgttatatggtgaaactgactttcatagaccagaatgtaacggtgatttgatttacaacatctttgctccttgaaatataacagaggtaatgtagcaaagccattataaacagggaagaataaaaaagggaaatatcagagttcaagacactcaaagagggcatttggtaagtctctctgcttccaaggacacgaacagttaactgtctgtttctgacagttgcctatcattaaataatcatattcaagcaagataagtgatattatcatatttgctctgttgtcttgtttgttatattatcccaaggtcagctgccattaaactgggtaatccaaatcaaacaaaagttttgtcctcttatgaataatgcatatattggaatcatattatgatttgcagatttcagcacttgtcaaaaaactagtaagaaactgtttcctgtcaccatgttagatttaggcgtaacaaaacaagagaaaagaaaacatgttttatatgttcagagagatcgctgctcagtttgcagtataacataaattactacatagtggttattttacactaacagtattttatcaactagaactactgtaaaacatatagagtgctctctattttaatggtattttctgatgtcaccgtgtcaaactagaagaattgcactttgattcgtctttcagatctcagctttttaatcttattaaaatataatttacatgttggaaaactcaccctttttaggatacagttctttgagttgtgactaaggcatttaattgtttaaccacaattaaattaaaagacacagaacagttctattcccctctcccccaatattcctctgtgcccctttatagccaaccctccaccccaaatcctggcaaccagagatgttttgtgtccctacagctttgcctttaaagaatattatttcagtggaatagtatattatgcagcctgttgactggtttcttctacttagcataaagcatttgagattcatcccgtgttgttgagtacaataatttgctctgttttattgttgagtaatattccattccacagtttgtttattcattcctcaattgaaggacagttgggttgtttccattttatggcaatcaaaaataaagctggtataaatattcatggtacaggctgtggtgtgaacctaaatttacatttatattggtaaatacctaggaatgggactgttagatcatatgggatggatatatacatttaattataagaaatgcttgatggtttccagagtagctgtgccattttgcattcctatcagcaatgtatgagagttccagttgctccatatcctctccagcacatggtgttgttgaatatttatccattcattgctgattttagttcttcaaagtagttaagttctataaagttcccaggaacactgaattttaaaagacaaaattattcgtcctagaggaaatagagggttaagtttctgtgagtctgtgctcataacttttttgtcaactgatcaatacctaactttgttttatgtgtgtttctgtttaaagacatcttatttagtatgtattgttgattcaataacattgcactggcagccaacagcagtataactcatggctagagacagcttatgtaacacattgtattttctccattaagacatatcacaatcttctcgcgcttgaacactagacagcacttcagcaagcactgtgcttggggatcattttaaacagtgagacttatcaacaaaaagcacaaacagggcggggcatggtggctcacgcctgtaatcccagcactttgggaggctgaggtgggtggatcacctgaggtcgggagtttgagaccagcccggccaacatggtgaaaccccgtctctactgaaaatacaaaagaaattagccgggcatggtggtgcgtgcctgtaatctacgcaggaggctgaggcaggagaatcgcttgaccctgggaggcgtaggttgcagagagccgagatcgcaccactgcactccagcctgggtgacagagcgagactctgtctcaaaaaaaaaaaaaaaaaaaaaagcacgaacattagaaaaatatggcattgaatagactttaaaaaggacacctgtttataatatgacagctgaaacaagagggcagaacatcacctcaatggacctcagtggggaacctgttctaggacgctgtgtgcacatacttgtctgccaatgaccgcatacccagtgttgattttggggttataaataaattttagtgagtatgcaaatttgtaaacacaaaatcctccagtaatgcgaatggactgaccttgtttatctgctttttttgccattctatggtctaagtttaaatgtcactgccctatagacatcttgttcttctctttttgtaaacctgattcgtcactctcttttcaaatcatttattatcttttctgccttcttctttagactctccacactagagtcaggaaacatacctgtcttactcgccattgtattccttatatcattaaggcttaccatagtgcctggcatacatagatgttgagtaaatatttgttgaatcagtgaatacttctttgaaagtagcatgtatggaagaaaaagcactggaattggagttggaaaatctggttttccattctagttccaacagtggctttgtgattggtgacaagttacttatattctttgagcttcaatttcctctcctgtacaactgaaaaactaacacctatctttagagatgtttttaagatcttaaaagtcaggcaataaacatgaaacccattagtatctggcacactgttgatacccaataatcactggattggagtggtttatgacctaccactagacatttataactgtatgagcaatataaaatatactaacaaacagtgtgaacagggagtttatttggacatacagatagtgctaactctccatgtatttggcattatatactcagagctcccaaataattaagataatttttcactttagaagtggatcttttgttattctgtcaacctagctatgttcttcagagtcaaaggttctacacacgatatactatgtacatgtcaccatgaaaactgataatttgtctactccatttcaaaaaaaaaaattcctgaatgtttaaaagcaattcttcgtaatgtagttagagtttgtactctctggaaacaagatttttttttctttcaaacactcctagacaaacaaggacatttagttaagaagcttattatgattctgtctgaaatgctttcttaccaaaacctattgtatcccttaggatttcaaggcaataaaaaccaataattttaataaaattatgtcaatcttcccgcatacaactaaggctaacaacataatctaaatgttaaactatagtggaaaagaaactacgtaaacaatgcataaggttacttcactcaaaatttatacagatggttttcttacaaaattacgatgatcagatatgattaatgatacgatttaagattattggtctttaatagaggcaaaacatgatgactcactgacaaagcaagctaatagcagggagggagagaaggtaagtttgtatatttgattacaaagcaaaacagataagtaaaaccacagagtaaataatgattatattatatgaaactttcattgtttcctaacttacatttatattaacttttctggagatgacgttttttaaacatataaatcgtcattaggaacctgacaacagttctaaatcaaacctagggtttaaaacatcatttgccgacagacatcctccaagtgttttccgcagaggcacatcacttctgattattcccaggctattttaaatgatcttggacagggctactgaatgacttgtcagcgaacaggaaaacattatgacaccacttctccagatttcttcccagaacacgaaatatttgggatcgttctaattgaatcaaggctagcttgaaaaaacaagttaagcttcactttaaagctttcagttttaactggaggaatgcttctaacatatggcagctgggctctgactcacagcaaccttcaaattctggccaaaatgtctgtttcctgagattgtgtctgatatgcctgtgtatccctggtggggcccagcaagcattcagtaaatgctattgttggaacgaatgaatgaattaaagggctcctaattaggagctacaaattcttccagcaacaaaataatcccataggaaagctgcaatgtacttggaattggtatctacgaagagttctattttcagctcctttacaaattatttttatcatttatgctcaacttggtctttcttgttgttgttttttttaaaccaagatgtgaaaagcacagaagcattttctagaacatgaaagaccagtatactttgtagaaagtttcatttgtatgtagcttgtgtgtgataattatttttaaatctcagttaatcatcatatattttctcggagcagactttgggtgaggcactacgtgaaatgtttgaaaaagatagttaaaaggaaaaagtcctattcttgactatgcaccaaaaattgtaactaacactagtagaaggtaagcagtttccagtaaggcaagtggttatctaaagaaatactaaattagaactgctatctcagaagtataaacaattgctataatacttttcaatcagacatctctcacatgaaagccttgtgaaataaatggaagacagaagccgaaaaaacagaaaagaaaaaagaaaagaaagaaacaaagatcagcagagataccactaaaactccaagaaccaaaagtttgtatatgtgctttaaaaagcatccctttgatatttactccgaggcttttttctcttatgtaagacataattctgacaaccttgatgtctgaacttccagtataccggagatattttggaagcacaacagagacttgtgctcataggcgcaaagagagacaataaatattgaaggaagagatttaaaaaatgataaaaagttagacctaagaactcaaaaagtatggcagcatggagccatttagcataggggcaaagagccaaccacacctgccgagtttctgagtgcatcctgtattacagcatactgtacacaccataataattaatggttataatgactttgaatcactaaggacgtattaacccatgaactctaagaagacagggacttacataatatattttgaaagctccccttccccctataaagtgatttagtttaggcacttatagaaatacgctgcagaaaattaattttttatgatgtacctcattttctgatactgccttgaatgtgacatggtatacatacctaaaataataaccctaactatttaagaccttacactcaaggacttaggtgttcttgtttcagtaagctgtgttctgaagcatactggaaaaataaagcgtgttccataggaagctacctgcattatacacaggcattttatttaactctaatattagccaaatatcaataaagtaaaaactcttcaaacacaaccctttccccctatttaaagctagaatgtttttgtaaatatttactggagtgatgagtgttcagggctcaagtttatttatacatcattctgtgaaggtatttgttgcaattgctatttatataataatgtttaacctgccagaattctggagaaagaaagattagcagttaaagcaagttcaatgggaaaaaaagaagaaagccatagacacaacttggcgttgtttccattcagtgcaggtgaagtgacaggtttctaaaagtatgctttatccatgcacacacatgataccgatacctttttcttggctgcaacgattctttttcaaaactgctagcctgtttccaaggcagctgcaaaacgtccgtgaaaactagttaatttgtaagaggcatggaaactgctgcctctccacctgccaggctagatccacatcgtacagactctacaatggcaggagctgagggtcctgagataaattttctcggctcctgcatagacggaggaaagggaagtgattgctgagaatgtcctagacatggacgcggagctcagatgcttttgggtgttctgtctctttcactccacatattgtcctggatgcagaataatactttttgtattaaagtcaccgtggccacctccaaattgcttttacattttattgttattatcattatgttgttgttaatgagaatgcagctgaaaggctaagtttgacacttaaaaacgaccaaaaatccagcaggcaggaatcatccccactcacagatagggtaagtgaagctcaaagaggcctctggttcagcagatcacaccgctgatggtagagctgggacttgaacgggggtttctgactcccactctagtgctcactacatgttgcaagatgctaagtattgaaaactgatttcctgttcctgaagagtttatattttgagaaacacaggttggcaagtgtaaggaaagttttccatggtaggactttgaaaaggaaacaggaggctgttttttatttcttcttcagaagattttttgtcaccacttctatctttctttctgttcatacactttttatattatctaatcattcctgccacgagagataatttacatggctcttcaacaacatgtcaccaataaatcaccaaacacattttaataaatcaggccttataacaatctacagtaaaccggatcatatgatgttgagcatataccaagcctggtcatctgatgggggttttacagtctctggtcctttctgtgtgaccgagaaacacacacagtttacaaagggcccccgtgtctatcatgacattggccttagaagttaagaatatacttgcagttatgtctcttcatttttatggccctgtatttcattaatttcattaagtcttccttgtacattttaatatttcatccattcacatggtcaggaggtctaggcaggctgattcatatttgcttaccaatagcagaaaggaagggttcctatgattaagtctaaaactgacctcctttccacatttaagggattatcatttggcatctctgctccacagacctttgctcttaacaccatttgcttggtatgaaatactgaattcatttagaaaagaaccatgattaggtactagggcttttgaattaaaacgtgaaatacttaattaggcaaaataacatggaacattaatggcagggattttagaggaaacaaaaatgtggcagccttagggttaaatgacttttaaaagtctcaggtatagggaatgacagacccagaaataaaaccctcaacatctcatacctgctcaatgttctgatcatttgtcacactctaggaagagacaataaatatatatctgtggaaagtccataagatggaaatgaggtggcctacctttcatcatttgcaatgatcacagacaaagccatttataaaaatacctgccataacagaagccgccgcatctcaacccaaaatgggaagacacagaagaggttgataaaaatgaaatcatgatacacgaatcctcatcctatcaccaaagtggttgcccaaagaggggtctccacggttgcctgatgaaaagcacaaatcatggactacccactgggaaagtggggacagagaagtgagggaatggcctcttcttcagaaggctgaatggctggactctgtcgaatgaatagataacaccattgcagaacagacagtggagatgaaagtaggagccaatgaaaacagaagcagggaggaaaaccatcaaaggcgtgaaaaaataacaaaagtccagggactgatgtgatcagcacccacatgctaaaattgcagctcgagagagccgtttgaagctgctaaagagatttaatacaatctggaatgaacagaaattgccatcaaatagaacagaagggccaccaagagaccttaaggaagggcaacctaatggaatgtgagccctgcaaagagctcacgtggcaatgtccttttgaacatctcaatcattctaaagtgtcgtgtaagtcacacacacacacacacacacacactacacacacacagtccagggtctgtggggaattttgatgggaggtgctcatcaaaagtcttaaataatgcaaggcaatggcaatccatccgatcttccactctgaggaccaggagcaaagaacagacgcaggtttcatcaaagcagcctctcatctttctagcacatctgcaatgtccatctcaccaggggtgaccttctgagtgaactttgggagagacgtgctctttggttttgtctgggttgcagtttaattcagcaggaagcgggctgtggctgggaaccacagcacaaagaaaatcacggtaaggaggtgaaaaatgcgggactgatcgacaataagtgagatgaaataaatgactggtagttttttatgagaccagcagaagaaaaatatataggtatatatgataggtgatcacttttaaggcttgttccccattgctgttactaagtaggcagtgatagaaacagcacaattgagcaataacactgagatcagagagagagagagagaaggaaaaaaaaccccaaaaaccaaaaggatcagagaggctctttaggactgtgtccaatccagggcgaccatccaaatacaaactttgaatttcattcaagtgccatgtggataaattgcattgtggagataaaatatagagactttagaaaatgattctgttttcatgcagatcattgtcgataactcctcaggactgagagtgttttggtttgtgcaaggtagaaaaatcagaagataataaaaagttcgtagtagataaagctaagaagtcatgtcacctaaagtgtatgggccagtggtctttcctaatttcaaacaaagggagaaagaacgtattctaagtagggacaagttaaagggaatttgcatttggaggtaaataaaatttctattgccgctcaattatcttcactctgccaggctgggtattattacatagacagtggggaatggaaaattctttcctcttgaatgggttcaatctctcagacctcagaagatctccaagggaatctccatagcaggagtggctagacccttgtttcaatatcttctgtctctaacccttggttgttcatttcatatcctaccatgtttccagcactgaatcagccccagaataggacatgagtagaatgaaaaagggattcgatttgccatagctttaaccttcctcaaagtcttctgtgtttatgtactacgagttttctagtgatatgaaaatgcatctttttaataattctattctgcattttctttgtcttggtagaaagcaaaatcaacatgtatctttacctcaaacaatcttgagttttgcaaaaaaaaaaaaaaaaaaaaaaaaaaaaaaggtggagtcttctttgcacgaggagtctagagaactcttagcacctagtaggtgctcaataaataccagccaataggcagggctcctttcctctgacagctggccatagacacaagctgctttgggaaacctgatggagagacccgcctttctggcagagccatcctcactctttcatcactgcactcaaagatattactgatgttggtcctctggttttgctgcttttttcctctgactggactaactgagtctactctgctcactagctgccacttcagaatcctgtcacgcagcggaaggccaaaggacattttcccctaagtccttttaacttcctggcattccgtttttcaaccccacattaaaggtgctgatgtttcatcctagtcctaccagccaatgggtggcctcaagttagactaggcagggcttctatcggctctttccctgttgggcacagggagaaggaacccagagaaatgtttcctcaagctcattttctaatttttccttggatgctatcactgaagttctgagatcatgtattaagaaacagacacattggaaactaacatacaacagatgtcaacctagggccaggactggccagcaagactgattttttgcaagttctcaaaaataatttttttctttttgcttgccttttttcccctgtgcccttgtccaatgcccagtcatcttataatccattaaagctggtataccaattctgtttccttcccaagacaagacctgccaacttgaaaaataaaaatgaacctcccctctttttggcatgttcctccaagcctcaactaaccccgggcagaaactagtggatgtatgcccagttgaagcctgaggttagagtcataatttttacctcctttagcgaacaattccctggtatgttcctgaattgtcattcttagtatattgctagaccaggcattagcaaacccagcagactggcattctctgcagtttggtagaacaagcctgctgtcatacggaagctgaaatccgagacacctctgtacctagaagaatctctctctctctctctctgttttttttttttttttttttttttctctctctctgttttactctgtccccaggggtaaagtattttctgcaaacatgaaattagtttatattttaagggctttggatttactaattttgactaagttaaaaagggcagagcagtctcctagtactctcctgagtgactcaatctgtgattcttgggaagggtttaatggacatattttattttcgttcagggtgacctcactgatcattgtgcaaaatgccttttcttttttttcctccttaaaacaaaataactgcaattttctaggcatttcctagagaaggaaactgtatttttttttttacttatctttaaggccactgttcaggaatttttttttttaattctatttaaagtgtaggtgaaggtgattatatctttccaaagtcagtaaaacaaatgtgttgcataagtcatttcaattcaattaagagaaacaggtcagatgctaaaatattagtaaaatcaattatgagtaataggtctcctgtataacatgtatcactacaaccgcctctctcataatatttgaataaatttacatttgtttcgtatctctgtgtgcctgtaatatacaggggcgtcacttgaccataaaaccttctctatttccttctctttgttacattttctctggtgtgccttggaaatgacatgtagactaaccctttagagtgaaggtttttctaaggagagaaagcccggtgacaaattaaaaagagctctggagtcagatccagctttgaatcttgtcctgtcgcttgtcagttgggcagggaacttcatccttgggagccttgatttcctcacctgtgagggtaatagtacctttccacggggttgttctacgattcaaatacaacaacttgctgtaacatgcccaccagattgccaggcacgtctggcattcattaaatgaatgtctctttgtgaactcttttgaaaatcctaaaaattactaatatataagagaaaataataatcacaaaatctcaatttgatatctgtgtgtgtgtgtgtgtgtgtgtgtgtgtgtgtgtgtgtgtgtgttaggattacagccacaaagtcacctgaaaaaaaaaaaaggtgtcaaagggaaagactttcttcttactatttggtaaaagggcaccctcaaaatctcaggtagacagttcatgggaaggccttatgggacaataaatttctgctgcaacctcagtagcctttctttcagacaaacaactgatatctcatatggggaaattatgtgaaaaaaaaaagaatacaacattgagtctatgccataattggaaaaacatgaaaatgacatacatatatgataaaaaatgaaaaaggaaaactggaaattttttggtaggttagtaaaaaaatggtcattttttttcctttgtaaaatcctttattcttacaggacttttgaacatttaagtgaaaaatagagaattgtgtgattagaaattcatccttttaggctgacaggctacaatgcctgtcggttgaaaaagataatatctcaggaagttaagtacagtttggcttaatggagtactttcctcctaatcgcacagaggaaatgcaagcattggcattgactgctggggaggaggaaggaaggacaattttggagcatgggccatcagctgaggggagcagacctggagatagtagaccctaaatcgaaataaaaaaattggagcagcaaggcaaatcagtacaaatgcaacctctggaaggttctagttgtgtaggaaagagcattaaggttgattcttttggagtgtttctgtgtatttttgaggaaaagaggcattcatagggcgcattgatgagaaagtcccaagaaaagcattcaagggtttggaatgcagttcacggacaatctggcttataaagacatggcttctgtgtcggttctatgaccctttgtggggagggggcagcatggcacaggagaaagaacaaggtcttcagggcttgacagaataaggttcaagcccatctctgccacccactagccatgtgtgctgggcaaatggcttaatatctaaaactcagttttctcaagaaataggatacttaatatttatagtaatcataaggtttaaatgagattatacacacgcacatgcagacagacactgacatgcttacatacatatagctgcctggagcatagtaagctctcaaataacgcaccttttctcaatgcagggagcagaaaagagaagaactcccttaaattaataaagttcttggctgtggctccatcccagtttatgtgctcaagttgagaccagaacagcctgctcagggagctacaggttgaagagctgtcagggaaaacagaacagcgtcaacccacacacagccccctttctgcttcctagaacctggtggtggatcagctgccactatccacagccacccaagtcctaatgctctctcgtgtttcctcatcttagtgctagtgcacttggcagagctgatggctctgattcctgtattttgaatcctgtaatagcccatgctgaccacacttggggtcaggggatatagataaaggggcactgggtggcttctcttctccacggagccttgagatcgagtgcttctaagtcctgaaggtttgcctatcttatctgggaaaccagtaataggaaagaataacaccccagccggtatctctaaccctcaccttgcaacaagtgtaaaatgagaaggggagggaagattcgccccaaagtctcacgagatggggcctccaaggacttatcaggagcttgctaagcaggtaactctgtaccgggggctccagcagcagccggggaggagaaggctgataatgggatttgcgtttacccagcaaaaccaacagggagcaatcttcagtgggtggaggaagaatgtgagctcacgatagcccaggtccggggaagctgctccctgccagcctagctcataaggaagttgtttatgttttctgtttgccaaaaaacctttgtgcgctgctgaaacctgtttatcctgaactcctaacaatcaacgcatggcaaccagttcttcagatgacaagtccttttgttaatgagcaaggaatgactgacgaggccctgctgcctgaaaccccttagctgcatggagttctgtggatggaggttgagagggctgcttcgaaaataactctgctttctcactctccattcacccatgtgccccagctcttgacatgtgagcaacctataagcatgattgttatgagcatgtctcatttggggggtgctgaatttagttcctctaaaaagtgccattgctccaggagaagcaaatgcacctctattggactcttataaaactcaatgtgaagagcattataaaatacctcaaattttgtccacatatatacactcacatgcataaaacactttatgtcctgtttaatgtatgcatgcacaaacttaggcacacatatgtatttgtggtttggggatcaaccgagagcaaggtaaattagggaacatgtgaattggcagtgttaagcaatttgataaaagtgttgatcaaatcccataagggtgtgtgtgctcagggtggtgctatgacgcgtcttcagtgtgtgtgagactaatgccagcgcatgcgtctgccctctcatctctcaccttgttgtctgttaaaatctcatctcccacacctgccaggcaacctcccagttgcacgagggctgtcattggttggtgaggattgagaaattttgatttgtttgttgttttactggtatctgttgtgaaccaaaagttagaaaatattccttgagtccttgtgaaggctcagaaagaaacaagagccgggaagagcagcagaggggtgtttgggggaagttgtgaagaattccaggggtcatggggtttaagaaattctgatcttggaacagaaacagaccccaaacatgtcagaactgcatttcaggaaaagagcttaggaaagaaagtttctcaggtacaaatgaactgattttccctgagtaatcttgtgcgttgcacaaataagaatgatcatacctgcgttctgtggttgaggtacatccaggttcagctcgactagctgcaaggtttgctgagtcaggggaaaggctgtaggaaaccccctggtcctcaaaaccccccttgttctcagaccagcctcacgtctacctctataagtaacaggttgagttctcagagaaaatacattgaagaagacttgatgtacatgcttttactatgatgggcaagattcatataaaagacaatgcatttgggggaagacttgcacaatatagaattgcttctgaaatcaatcaaacaaaaaagcccacaacaacacaatcgccccaagctttctctcctttctgtcctagcacaacttatcagaggcaggggtgatatgatgatatgtattctttactagtgagtacagtaggacagggagtgtatctgtctggctcagtgttatagtcacagaacccatcacagtgcctggtatacagtaggtgccattttattgctcatatttgttgaatcaatcaatcactcatacaagggagagcacccagccccagtcttcattaagtgcttgtccactaattgaggcaaagaaatcatacctggtccattgaaatttgggggccctatttttaccacagaaacacaggagcaaagggtgaactctgtactgagttttgaaggcagcaaggtctgaggaagcaactgcgcaaaaggcagaacgtgacagtgagaattcctcttggagaacatcctatccatagactcccccggagggactgcctgcagaactgtcattggccaatttcaatgcgtgttacagattcatagcacagtggatgatgagctatattaatcaggaaggaaggaagaaagagtaaagaaaaaatacacacacacacgcacatacacacatacagacagagagagagagagagagagagagagagagagaaagagggagagagagagaaacctaaaactgtgagcttcttctcagcctggtcttcattaagaacttcaaacctggcgatgggcagatttgccctgtggtgggaaggaggcctcagttcatccagttcttgataacagttgctaagcccaagtttgggcaggactgttccagaggctgggcctggctatgtcagggtgttgctgtgggtatgggggaaaaatagagaggcagctagggataagaggtgctcaagaagtctgctgtactcttggcaagccaaactctggttcttaaaactaagaagtcatagagaagtgaatggggcttgtaaccgagggcaatttttaattatcagttaggaatagactactacaggccacagataaggtgttaaacagatgttcttttaatagttatccatatctttcttttcttggccagtaacacttagcttggctggttttcttctcctgtgttgctggaggtggggcagaggtgactggggactctaagaatctgacagtaacaccatcctcagaaacagtgatggagtaatgcttgggtaccagcattcaagactcaatcaactttggccaaggccaagggcaacctctgctacattgctctctgctctgacccctgcctacccacacagcccctacagatacatgtagcaggtggtgacacagatcccatacacgcacatcttgaagcccgtcctttgtgttcagtattgcaccccaggcacctggcacacagcagtgccccaaaaatgtgtcaaatgttggatgactggattaaaatattaggaggcaggatacctactttatgttatagttgcccctaccaaatttcaactcactataaaatatgtgaacacaacttaaaaaaaaagtatttattctccaggagctttataagaggcaggatacataggtaacatgttctttatactttgatgacaaaaagaaaaatgaatgtattttctcatttcaggataggagaaagtcatccttcttttgagttttacctcttaaagataatccccttctcactctccaaatgtcactttccaacatttctatgttatgggaataggtgatttctttgtaacttttcctgccttgccatttctccaaatcttgctaatctgctgggtttgaagctcatgcatttgtttttcccatctgccttaacacctccttgctgacacatgcccaaaggtgctcagcataaaaagggagtggtcttcacaaacataaactaggtgttccctgttcaaatgcaaacttgacaggtattctcacagggaatactggcacctttccctcaacagctgtacaaaaggttaaaacttgttcctggcaaacacagttacactaatgcatcctacatggattgtcccttcttgtgcttcactaagctctaattgcaatcatgttggacatcaactgcttactgtaatgtttcataatgtaaagtgcactccaggattcagtggtgctttcttcgagttaaagcatgatcgtggtaacgaaatgactacaaaaattgacacacattcttcaatggatcatctttctttggagacaaagacaagttgtgactcctcctattattgaggattgaatttagttttatgcactgtcagcagccacctcagctgcatttgaacaatttggggacaaactatcttggggctacaaatatggcaacccatagtcacagatgatgtatcatgatgatgccttttacgtcagttcataatcatcagggctgaggaaattttgttttgctttgtttcctaaaatcttttaaaattttattgcataagaatatcataacatataagtcaactgagaaatttagtagtaatcctgtaacactaaacacattagctgcttccctccttcccctcatctcatagcattgaaatctgtctgcatacaagcgggagttctgcctacaagttggtccccacattttctgtattgccactttatcataatgagtcataatgtattatcacacaaggatcatccatcttgaccacttcactgtggctcaggagctgtgaggtccaccaaaccactcaagatttcagggctttatgcttttaagatccagaaccacaggcattgtttgaggcactttctgcagaaggtgtaccgcatctttgcctgcttttgcaggcctcaatggacagacagccgtagttcactaggctgattctctctgttcatttattcaggtttccaagagctccatccaccttctctgacgtcttccccagtcattcctgcccctaagattcttcctgtcccttcaactcctgaaggtcccacggtcagcatctctcactatctccttttgtagctaaagtatagatgcttcgttaccctaaccaaactctgttgctttagagtgaggaatctactttagacttctttggagtcccaggatatctggtgcacagtaagtattaatgcatatttacagatggatctgaataatatttttgagataaccatcaaatggaaagtaagtgaaaataacatagaaaatgtgaaagggaaaaagacctcatggtattagctcaaataaggacagggaccacatctcatcccttaagtgacttaatctctctgtgcttcagtttccacatccaaaaaattgaaatcataatagaacctacttcataggccgtcatgaggatcaaatgagttcttatgtgttaagtggttagaacagtgtctggcatgcagcaaatggtacgtatttttaaatgaaaataaaaattaagtaacatggtaatgtccaaatctagggtagtacctgccacagagtagctgctcaataaaggctgaactcaattactgtctgttttgtgacacttgcaccagcatggacctgggagggagcagcagctgggaccaaggggctggctggtgacagtatcttccaggagaagtgtttgggaaagcagtaagctccacactccagttcaaaggctctggaagttaccaggttctgccacaaactcgtttggctggagtgctcccaggtctgggatgtgtggcttttcgggttagtccaaggcacagttgccgggcaccctggcgctgatggctgctggggagagggggacagcccggagctccgcctcccactagcagctcagagccggcacggaaagttactgcatgtgaacgtggcaggaatgatggaaagcccagggctgccaagtgctgcaatcccgggctgcgtttcttatgctcacaggcaccagctcttcagggagtctagtctatacacgcttcctgcgcataactgtattctttcagcagttactatgctttggcgtagagggaggagacaaaagtttgagggagtggcagtgaggcatgagccaagatcccatacacaatgtcttccttgccctaagatgttcctaagaagaacttataatttcacccactgtattgtgtatctctgaactttcatcgaatatatatatatatattttttaagaaaatacctctttatcaagttcagcccaccagaggcttccatttgtctatttgcccatccattttttaacaaacatctcctaagcatcaattatctgtcagctacccaactaggccctggaaacccagagaagctcatagtccactgcggagccagagagtaaattgttgctatataacatgaagggctataaccggggcacacacagagagctacctggcagagaattatttctgccaggtggggacagcagcctgcacaggcttgcaggggtgccttgttagagctgggctttgaagaatgactccagtggggaggtcaccaggtgaacaagtggcctaattaggctatgatgtacatttatcatctttgtcccacacctgctttttaagcgaggctttaaaaatacaaaaacagattgtgggttggggaacagtattgtatcaatgttacattccctgattatgatcattgtactgtggtcatggaagagaaagactatgttcctaggaaatctacactgaaaaagagtaaagggtgggggccgggcgcagtaactcacacctgtaatcccagcactttgggagggcgaggcaagcagatcacctgaggtcaggagttcgagaccagcctggccaatacggtgaaaactcatctctactaaaaatacaaaaattagccgggcgtggtggcaggcacctgtaatcccagctactcaggaggctgaggcaggagaattgcttgaatccgggaggcggaggtcgtggtgagccaaggttgcaccgttgcactccagcctgggcaacaggagtgaaactgtgactcaaaaaaaaggaaagcggaatgttccctccatgtagtacccatagtatgtgtatactccctctataatagtatatataacagtatttatacatggggatgagaatgataagcaagtagagcacaaggttaataattagtgaatctggataaagggtgggtgggagttagttatgctacacttgcaacttttctataagtttgaaattatactaacacaaaatgttaacaaaaatgtataaaatacaaaagatactaaatcagcttctaaaataccaagatgcaggctgggcgtgatggctaacacctgtaatcccagcactttgggaggctgaggtgggcagattgcttgagctcgggaatttgagaccagcctggggaacatgtgaaaccccgtctttactaaaaatacaaaaattagctgggcatggtgatgtgtgcctgtagtcccagctactcaggaggctgagataggagaaccacctgagcctgggaggtggaggttgcagtgaggcggaggtttcagggagacaagactgcatcactgcactccagcctgggtgatgagccagacccggtctcaaacaaacagaaagaaatacaataccaagataccaatgccttttattaccatcattctgaaaaggatcagcaattttaaaacataattttaaaacaattattttttgaggtgcagtctcgctgtgtcacccaggctggggtgcagtggcaaaatcttggctcacggccacctccacctcctgggctcaggtgattcttccatctcagccacctgagtagctgggagtacaggcatgcaccaccacacctggctaatttttgtatttttagtagagatggggtttcaccatattggccaggctggtctcgaactcctgacctcaggtgatccacccgcctcagtctcccaaagtgctgggattacaggcatgagccactatgcccggccatgtcataatctttgattgcaaggttgcagctacccagtgagaccctggaaaccctgaggaatgccgtgtcttccctgtgtcttgcctcacttattcactcccttctttttttccctgaaaccttgaaatttacagtgtaaaagagccaggatagcagtgaagcccaccacaggtgtgctctgcaaagtccctgaaagaggagggcccaaaagatgttgcttgcctctctgcagtgtagggacccccaggaatctggagaggggtcagtctaaaatatttaaaattctttagtaatgcccaggagggggcagtcagcttagcaaggatttgggatctatcagcaactacaattctattgcacttgcttatgatacatttttaaaagcagaaagcaaaaattaaaaataataacagcagcagctaatatttacccagggctgatataccctaggcacttgtctaactacttaacatggacatctcattgattcccccatgaaagcaccatgaggtaggtactgctaatgttcccatttaacagacaagggaactaaggcccagctagtcaatggtggaattggatataagcacaagtggcctggctccagagccaggctgttgcccataacattatgttgctgtgggctctggttaccgctttatgtgaatatggacaaaggatacagagggggatgaaagcagtatgattagttggggtggcaggaccccagtaagtttacttttattttgatgttcagtgttatttaggtattaaataattttttaaaatcaaaactattggttgatcatttttgacccaggagacgcagtttgagatatgtgtgcctaacatagaatctttatcactaaataagttatagcttctctgtgacttgttttctgtatctgaaatatgagatgatagttgccaacattttcccactaaaattcttgctcgaaggttggaattctgtgtatggtatgtggaggacatggagcaggtggagagtagggggtgggaaagggtggggaggcctatggtggggtgactgcagaaatactctataggacaattactcactggtggaatcaaacattatgcatgaggccaggctgtgctttctatttataaggtattgttcaacattggaaagaaacatcagatctgaattagggtttttattttttccacctttccttccttctttttttctctacatccctctcttcttcccttcctgtcttccttctttcttttcctggaccactggaagcaatgtttggtcatagttatatattttatctgatagaagagactagcagagacttagaccatagagagtcaagaggcctaaagaccttagcatatcttcctttgaatccagggacacgacccgctgatataagttaacctcattaccacatgtatggaagaggtcctcttccatttgctgcatatatatatatatatatatatatatttgctgtatgtgtgtgtatatatatatatagtatatatatatttgctgtatatatatatatttgctgcacatatatattatatatacacacacacacaaacacacacaattattcattggaaatgtatctacaaaaggtaaattgtttgaggtaaataaagggacatgctactatggctacaaactatgttggttagttggtattttcttcctggtcacctttcaggcaatttggatagaaagcacagctttcatttctgtgtaacatccatctgtgttcaaagatgcttttgagagggccaagggaacaatgatttaatgctgtcaagtgctttgagatctcagacaaagaagctctgtaaatactgagcattagcaaccccagtatcattcccctcagtattatcaaggctttggaaaaattaaccaagaaatgggccctggcatattgagagcagcaatcgtttctggaaagctttaaagaccctctacattgggaaatgtagggcttagtgaaaacacttgcccaagaactacttttcttcgtttgcaaattcaaaccaccaaagactaaaacccgctacaatgtggaaaagaaataattagattaaagcttttcaaccaagctccaatggagagagggcaagggattgtgggtgtgcatgtacttaagagacacagacatacagaaagacacagaccgggcttcagaaaaacaacaacaacaacagaaaaaaggcttttgtccatgtttagatttaccacaaaaacaaatctttttttttgttttgttaagtaaaaaacttattcattatgtttggtgaggttgtagggcaacaggcactcacatacattattggtggccacataaactggcaaagtctccatgaaggaccactttgcaacgtccattaatattacaaatgcatttaccattgtcctactattccgcatctaggaatttatcctgtacctctatttgcatatgtacaaaatggttcatgtttgaggatattcactgtagctttgtttgtatttgcaaagcctgaaaacaaattaaaaatttattaggggattaaataacgtctggtgtatcattaaaatggaatatcatacagttgttaaaaagaacaaggaaattgtgtacgaaattgctatggaattatctctaaagatgtggcgtgaattgaaaaaatcaagatgcagacagtgtgtacaaacagatatatttgaatatgtatgtttgaattcatcatgctaacatatttatagaatggattttcggaaggctgcataagaaattggtaactgtggctaaggcataaggcttacacctctaactttacatcctttcgtaccttttgaatattgtatcatgtacctatgtgtcctattcagaaaacaaaataatgctaatggtgtatgaaaccactgattaaacaacaaagtgaaaatatgagctttgtaacattttctagggatgggggtcgacaagttgtgtcttcagagctcccacgttcttccttcctcagcagggacaggcttctcagcacgctgctgcctcagggagcccaaagggacaccaggaatgctcagcctgtgttagctcacgactatttccctgcctctaacttctctagttccccacagttcaacccagggtgggtagcctggtgtctgtttgagctcaacctccccaaaccaggaagcccacaagctgcaccagtcactgtcaaacagctagctgagcatacagggaattcccctcttggaactgacagggaaaatgatccctagggattagggcctccactgggctgtgtcaaacatatttcatagttcctgcaactctgaccagggatcgttttgaaattcgggttttgttgttgttgttgtcgttgttgttgttgttgcaaggaacaaagactcaccaaactaaagggtgattcttgcaagaatgcacatggagtaatatgagtagccgcgttctcatggaatttaataagaattataaaacaacaacctcaaaaatatcattgatgaactacttagctgcccagcatggtgctcagtgctttgcgtggattgtctcctgtcaaccccatcataaacccatgaggctgtcgctgttattacccccatttgataggacatttgggcttgtagaggtcactgtcaccagagtgggtgggccgcacagaaacaggatcgggaaaatctgctgctctcttgctgtccctctcgtgggcagaacagtttctctgccttaaggttactgcctttccctggatgtttgcctctcagttctgatagtaactgactcactcactcactcaccaccattgggctcattcatagactttgcttacttataacagcaccttctacagagggattcacgaccttctccacctcaaatctctgtgcttcagctgctgcctacctgcctcctcctgttcagatttccccaagagaggacttgagagatcacccttctgttggaggccagccacttcactggtcacctcctgacctttggcttgggcatcccacctcgggttcccattttgattcattcctctgtggctgaagggtaacagtcctcatgggcttcatcttttccttcactcgtcagatattcttggagaactgactttaagccagacattgggttgtgggtggtggggggagggtacacagtgatcagcagagcaaagaacttgctctcagtggctcttaccttctggctccttcacctgcaggtgtgggtgtggcagacattctggcctgtccagttcgaagacaatgacccatgattgaccacggcactcttgcctcagtctctaagtcactgtctcctggggccccctcattcatgccttttcctggttacccatctgcctccagaaactggggctgtgctttgccccagtgtactatggagtccaaggtgatcagacagatggctccaacagctgggtggagaatgatggggaggagtatgggggataatgctcagaggccctgtgaatctgctgccatgggcagtggaatcccagccacaaagaatgaggtacttacaattctcccataattgttgactaaattccaaagctgggctcctctcttttcttttctttcttcccttttttcaataccaaatagtttgaaaaaattccaggctttgtcaaatgccctttcctaggctcaaattaaccttttccaagcgtctttcacattcttcaaactcttattaatccctcaaaacccagctccaggcattgccctcctcagtgatttcttctctaaatttgagataatcatgccttcatatggactacttttgtacttggcatacatttttattgttacccttatcatactgagttgcaaatatttgtttagatgtgtgtctcctctcctggagtataagcttatagagagcagggaacatgtcttaattatttatttattttttaatttaaataaactattttaggatagttttagagctacagaaatttgtaaaaatagtacagataatgcctgtatactttattatctggttaacgtattgctttactatggtgtgtttgttacaactaaggaatcaacattggtatgttactgattatttcgctagtttttacctggtgtcctcttcctgttgcaggatcccatccgatctcacattatgtttagctgtcatgtctcttttgcctcctctggtctgtgacagtttctcgaactttccttgtttttgatgatcttgccagttttgaggagtactggtcagcagtgttgtagaatatcccttaatgggtttgtgtgatgtttttctcatggttagactggggtttgtttattttatgtatttattcttttggagatggggtcttgctttgtcacccaggctgcagcgctgtggcactgtcataaatcgctgctgcctcaaactcctgggctcaagggatcctcctgcctcagcctctgaagtagctaggaccataggtatgtttactgcacccagctaatttttacatttttttaaatacagacagggtcttgccatcttgccaggcttggttatttttaaacaccagcactgaattaaatacccagcaggtaccacctagcacagaccaggcatttaattaatgtttattgaactgaatagaattcaagtatttcttcagcatcttccacataaatagaagcctgactgatgcccttggagaggtgaagaaaggaactcaagtcccgtaaagatcttccacacagctgaataataaaagacggtatgcacccaaatgtcaagtaaggagaacccagagaatgacctattgcagctcaagagatgaattaatcagaatgagcaggtgaagtcagcatctgtgtgaaagaggtgtctggaaagggggtgggtttagagaggcccgttttagttctcaagcacaaggagcttttccctgagctaggatctgctcacatgctgagcctgaagtccacaggtatttctacccctcttctctcatggctggcaggcttctcattcttgaggccttggcttaaatgtgacctctgcagacctacactatctaagataggctccacctgccactctgtctcacagcactccgattgttttcttcatagcttttcgatgtttataaggattgactgtttattcttttttttttttttttttgaaacagagtcttgctctgttgccaggctggagtgcagtggtgtgatctcggctcactgcaacctccgcctcctgggttcaagcgattctcctgcctcagtctcccaagtagctgggattataggcatgcaccaccacgcccagctaatttttgcatttttagtagatacgaggttttgccatgttggccaggatgactgtttattctttattgtctgtctttctcattagagtctaagctccttgagggcaagtactgcgttttgttattcactctggcagagcacatagtggttctcaaattgtcttgctgtatcaatgaatgggctgatgttagctgagactgagaaggcatgagacagtgacaagaagatatgtgaggagttgctgtaagaggccctgaaatggagcaagagtgaactgggtaggcagatgggatgctgccaggtcatcagactgatcacaatggtgtcaggtcataccaaatggggtggcataatttgggcaaaggccagcaatgtactaggtgtgggctgcacagatgtacgggtcatccagtgattttccatcttggaaaggccagccagcattcacaggacaaagatggggggattaggaataactgaggtcaagggaggggcaagggctataggagcgtctacataaatcaacactgagaatgtattccatgaatgaaagtaacacaaaagctgttggcaggcaagggtggaacccagcctaacttccatggtgttgtcacaagcccaagaagaaaaagggaactctggtgaatacttctgaatgacaaagataaaatggaagacctatgatttggctattgggctataaaaatggacagccatcacatgaggaaacctagaaaaatgagataatgagcttcagggctcagaatggaaagaaccccatagaaatctttgatcttttccaccatgagttctacactgatgcaaaggacagaatcagaatatacattccctgatttggaaagtatatattttcccatccaagttcattgtgaactgctgaccaaaagggcagtgttttatacagattctgtctagaactagcccagtgggaaaagcctcggaaagcatatggcaaagaaactcagactccagagtatgatttagtaacagaaagagtggtgtgtcttgtctttgtatgcccgtataaataatcacgatggctgaactctgctatttttcatccaacctaagtaacagctttgaaaaaggaagataacaatgacctgtgtgtacagcgtccaagggaaccattagcagtggagctccccaggctcctgggacgaccaagcacatggtccaaccaaccatcttctgacaaggtaggggtgggcagtggaaggcaaaaagaatggctgcacttgtgtttctgaaggtcagaccaagaaaccaaggagcgtgtctttgttatttcaaatctatagcctttgaagtcccagcaggtaagtgggtgagtctcatatacagctcaggaactcctttctcctctgtacctccttagagatatagggctaagacagcccaggtgttagcctgtccaagcccttcatttgcaaaggaggaaactgatgggcagaggacaacacaaactgcccaaagtcacactggtagatggcatttgggccaggatgagactttctttttttttttttttttgagacggagtctcgctctgtcaccaagctggagtacagtggcacaatctcggctcactgcaacctcctccacctcctgggttcaagcgattctcctgcctcagcctcccgagtagctgggattacaggcacccaccaccacacccagctaatttttgtatttttagtagagacggggttttaccatgttggccaggatggtctctatctcctgacctcaggtgatccacccgcctcggcctcccaaagtttgggattacaggcgtgagccattgcacccggccagcagcatgagactttctaacccagctttcttttcccaatcttaagcagcccatctggggctatgtgactgaccgctaaaactgcctctgattccacattttgatttttgctcccataagcactgttcacagttttccccctcatattacttctgtaacaaccttgaggtggtcaaggaaaagaaaaaacaccatccacattcctaggcattttaaggaaatgcacaccaggtatctgacccagactcctacttccctgccaatctccagctcatatcaattcatttccctaacagaaaataggtgtcaactttgtaggtggaaagtaatttccctgcaaatattaccggagaggttgctgacactacttgacagttttattattacttttgttttgcagtaaggtgggggaactctacctttgccaggtagaatactgaaaaaaaaaatgtagagcttttaactttgtattagttttaacatcggaggggaaaacaagaaacaaagaatatgtgtgctgtccgcatgcccagtacggctaagggcaacctcacaggctcctggcttacctcacttctcacccgcgaactttcagatcctggagcttcagtgtgggttagagggaattactccgcagcatctgaaaagccagctcacaggtgggccgctggggcgatttggcagggcctgcttgtaaacactggctatcaactcctttacaaggtaagccaaccaggggcaagttaactcgctttactcttctccgggtttaatagaaggtgggtatacttttataagaacccaataatctaaatatttcacacgtagacaagaaaactagaaagccccaagagaaccgaaagagtattttattaataactatttatgtgtagtagctacttaaattcatgtttcactacctattttttttttttttagacggagtctcactctgttgtccaggctggagtgcagtggcgcatcctggctcactgcaagctccacctcccggattcacgccattctcctgcctcagcctcccaagtagctgggactacaggaacctgccactacacccaggtaatttttttctatttttagtagagacgggggtttcaccgtgttagccaggatggtctcgatctcctgacctcgtgatctgcccgcctcggcctcccaaagtgctgggattacatgcatgagccactgcgcccggcctcactacctatgtattttctaaagggtcagatagacttaggtgtaggttggcccgagaaaatgcagggttcccagttaaatttgaatttcaaatacacaatgaataattttttagtatattccaaataatgatagggcatacttttattcattgttcatcgacactgagtccattaaccagctggtttatttatttattattatttttccccttgcttcattcttttctgaccttctgtggcttaattttaggactcctattagagggtggagggagaaatacaactcacacgcatcgggtgtcctacttatcattagctgaggcacaagttttgggaggggagggatttgctactttgagctaaaaatggtgattatctgcattctctctattaccatatggacagaattagccatagactgatattttccagagactggattttgcaggccagtaaaatccaaaaagaaaagaaaagaaaaggaaattgggaaattgtgagaagatcaatatactgttgccaagtttaaatttgatcaaaaaagggtgtttaaaaaaaccccacagctaccatcttcaattaccattaattcataaaagaaagcaacatttcaataccccaaaagtaggaaggacactctcttctttatttcttaaataaagttggcagctttacaatggattgccctcatttttgtggaaacttcatcacaatctggtgctggctctgagatctgagaatatgcagaccaggtcatgccacagcagcacctataaagtgacagcagcaatgctgcacttttcacaggtttgtgttggtagcagataaccacagagcaccttgcagtaaaggaaggagaaggtgaacgtgtgccagttcgaattctgatgatcttaaattaatatttaatttaagcattttatttctgagatgtatattatttgtgtggaagcatagtgtgatttttctcaaaccacaaagcatttctttaacttataatatatagaaaacgtttttccaaacttcctttggagcacagctcaatctctgaacttttcttccctatctctataaaatgaatgcttcaggaactggataatgtgacgctgaacttaaatagcccccttcctaagagagttcagaggtctttgaaaatacaggtaattgagcctcctggttcctgagagctggcagaatgtgtgacctcagctgagaagagttgggtatttgccaaaaggcaggtgtagttggtagcagtgctcagagaccaagtccccaagttcagattttctatccctcttcccattgtatacaagggaaaactatggtgtgaaagtggatgattgcctgaaattgctgagtaattaaaaggaaccatgatgaaaataaactgcccagcccaaatatcatatgtagtttcttttatcttcctccaacctgagaaatgtatataaaggtatttttaccagggaaatccttctttaaatagggttgaaactcaatttcatatgctgcagagagatgcaaggtattatgtaccaatgatccctaaatattcttttcttcttcacatggctgtgaagttacaaactgagtatccttttcaacggcttgttgaagcaaagaattaaatatacatgtacagactaaaatatatgttagtatattctttagaaatatgaagaatacccccagcttttcacagtgataatctctgggtggggtctttttaatattatgtttttctgtaatgatggagttttaaaataattgtaattgtctattacttttagaatacgtaaaaaagatacacagcatgcacattctcattaaaaatcacttcaacctggacttttgggatgtcctttaaagtcacctagtacttgcactttcccacagtcctctgtccagcctctctcagtgacctgagacattcagtgccacttgtgtattccagacatttgtctttctgagagaagcagtgctaccactttttttttttttttcttttttttgagccagagtctcgctctgttgccaggctggagcactgagacacaatctcggctcactgcaacctccccctcccgggttcaagcgattctcctgcctcagcctctggagtagctgggactacaggcgcccgccaccacgcccggctaatttttgtgtttttagtagagacagggtttcaccatgttggccaggctggtctcaatctcttgagctcgtgatccacctgccttggcgttccaaagtgctgggattacaagcttgagccaccgcacctggcccacttttttaccttctcaaaaccccaactctcctgtaattcctgaagcccaggtaattttccccctagccccattgaatactggcttgttttcatttctctctctttgtcttttgccttactaattctgatgtgattgttttttcagcctcaactgaatagcagagagattttggctttcattccagaatgatgtctcacagaaagtcaactcgtgttccaggtatgtgataaacatctcactagtgaacttcttgctgtttctaagcgattaacggtttggttagcaagcccagagccctgcagataccttttgcctcctacacaagaagtaagctaatgaaacccacggagcacggcctgcccctctgcttccctttaatggtttctgtcacccaggccaggctgccgccaccatgactctgcacatcgatgtgccgcctcagggcaagcagaatgcaaatgacggtggccctcaaattgcaatttaaggatagctgttatatcttcccatatatttctcttcctaacctccaaatttgaggataatgtgctgttttaacttattcttagtaggaagaatgttaaaccttagggtgatggtagtgtattgctgaattctgtgttttggaataaattagatttttttgatgtggagaagggagaaagggggagaactaaatgcaaagataatttgattttaaaagctggagtttcctggttcctgggttctagatatttaaaaaatagccacaattaattatgtaataaattgtaggaggttgtcaagttgtcatctttattaaggtgtttcttgccagacatattcaaaatctgtgtactcagatgttaactgcatttgactctattgattaaaatatactttctgccatcaaaatggaactccaagatgtaaagggaaagaacactttaaaaggcgtttccaaagtcgtcttggatagaggagctttcatccaagggtgctatgtggcattccggaaatgaatcagagacttgggccctccacttccttagaaacagagacacgctgaagatcgttagggtaaatgagtgggacaaagtacactctgcattttctttttaatttcaactaaaaaaaatgctgcactcttgtcttggctggagaaacatcctcagcctgttcatctcctatcctctgcccaaatcaactccaaatttgactgactgaattttcagttcctatattttcagatcagttcctgtattttcagatctggctctctctgtggttgtggtggtagcagtggtagtggttatggagtctgtaagacttgccatttttaaaatgccgaaagctctcttcaggttaaatagtctctctgtgtgattctcaaatgaactccttgaggaagaatgttctgtgtgtatctagaaaccttagttctacaagaatgagagctaaagaagctcacccatgtcccacagaaaccacttcttccctttcctgaacaagaaaccgatgttcttcatctactgtctgtccacccaggcttggaagacaggtgaaaacaatcccatctttctattcctagaaagaggtagggatgtgatgcttacattcccctggcttttacttgcatcaaatgtgggaggaaggaataaaagagaagaggaaactaaaacctgagaaagggcaagaagagaaagtattaggttgatgcaaaagtaattgtggtttttgcaattacttttaatagcgaatccccgccccccaaaatcatctagcaatctgccctctggagtgaacttgaataaaagtaggtaatagtaccactcttggcttagaagtatctgattatccctactaaccagtacaagacatagatttctgaaggaaaaggatgcctaccattggctcttttttgtttttgtagtttgatttttcttattttttaaaaggttctaaaaataatacatatatacctggtagaaaatttgaaacttagaaagaagttaaaagaagcctacaaaatatcaccgcatcatattatcttattagccaaatgcaaccaccactaccatccagggagggttcttgccagtattttctctattttttcgtatgcttttaaaaatcttcacaactaaaatcattctgtgcacagaatttcacatactactttttattcaatcaaaaatattttctcatgtgtttattaattctttaaatattattttaatggcagtataatttgccatcatatgactatattataatttattaataattttcctaataaaggacattcagagtgtttagaattttagccattataaatagtattaaataaacatggtttttgtgtgcattaatctttactttttaaattatttccttagaataatctactggaagtaggattaccaaatcaaagagtatcatcattttcaagactttagtacctatcgccaagaaagctgtatcaatttatattcacagtatattaatgtctttctgaaactgactgaattgattaatgtcatttaaaaatcatgctatcttgttaggcctctgatactttgtatttactggtaaggctgaaaattgtttacagactaatgaaacacattatatattaaggttatttattttgtgccttaatatttgaaaaaatacatcttcttatcagtttgctttttgtcctttttgctgattgtttatgatcttttttgacatacaaaaattttatttttctctatatttcaatgtattgaactttgtattctgtaatttcttctattactgtaaagtagagaaaatctgcctgtatctagataaatatgcagaaatacattctcgttatttaattaatttttcaaaaatatttcttgaatttatctaggatttgttatacggcgtgaaaaaaatttatttttctctgataagctaaaaatcatcatgcacaatttattactttttccccacagcttatatatgtattctattgacacatatgcaagattctttttacatatgcgagattatgttttggggttttctttcagcactttactgatctctttgcctattcatttatcagtagtttctccatccctagtccttttctttctttttttctttcttttttttctaaagttcttttaactattcttatttctttcaacttaaaaggtggccaagatgacataccagaaggctgtctaaaattattggagaaagagaatctttgcctttaaagttttaggtcttaggtgaaaacgatgcagtgttagctcttgtgtctataaagggtggggttcatgctatgacacagaaaatcagaaaggactttcttgacatttgtagaaacagtaatataaagaagaattaggtaccttttggttcatcttaagtaaagaaaatttccagtgaggagattgagacatttaatgttaaaaagatcctctctcttctagggcacgagtaaagatatcaacccatctatctgtagaaaattgccagaaactgtcacaaaataaaaaatgagagaaggcctgaattacgacagtcctggtggggttctacaaggtgtgtgccaaataattttgttttctttttaaggcttgttaacagtggatagcttaaggtgatggggttataggtgatttttttcttgtccttatttaactgtattttcttttcttttttttttttttttgtcaaatggtataaaagctttttttcttaataatggcctgttaattaacatctagaacccagtactggaagcattagtcccaagaagtgcaaagttacaaaaagtggattttctatttcttcacctcttaccttaatagacacagaaacactaaaactcatctcattagaagaggttttgtgaaaatgagacaggacatagctaaaccaagtgcttttcctccgaataagatttcacccaaaatgaggttggggactggatgaagttatgaaaaaactactccttaaaactgctatttctaaagctaataggaattcttttgtagtgggcttttttcccttgacaaccaacgactgatacatcttgcatgttaaaaagcagagggctataagtaagttttcagtggaaataattttttttccctgcaccttccctttttgtgatacagttggcactattttactgtcttaaagattcccattttactttaatggtctctactttccccttttcttagctcttcttaatttttatgcttttcattagtagataattctctctggctgaccaacggggatgagggtcagagtcacgggcaatatactatatctgcgttagtctggcttgagaacagcgaaaccgtgcctccttctctaattagtcactttaagtatcagtgatgggcagtctctgtgacaatgattttgtcatagtaagcacttgaaatacctgctgcagttttttcaccacccccctcctccccgtttcaatcaggcaagtttatctttgttctttaaaccataagcaggtttttgtattttttttttttttttttttgcatgccacattgaaaagaaataaaaaccaagtgccatacatgtcaattaaaggcataaacaattaagagatagtccatttcccccttgaatctttcatgcttattttcccttcttagaataacacttaaaagccatcgaagcttcaacgggaccagtgtctccccgtttcgtggggtgtagagcaaggtgtgggaggagcgtttggcatgtcaagtctctgctctacagtggatctccacgtcccggcttccagtggacagccctgtgagatggggaaaatttccttccgctcagatactgtcaaggccaatgtgcctttcaggagattgtctgagagatttcgaacattgaaactgtaaaaaaaattgagctggacagatccttgccaccactttttctgctaaatatagaaaagttgtcatcgggttgcacaagcaatttccagctacagcacctcaggaggggaggcgggctcctgtctctcatagttaaagtgcatagagctgagccgaccctgactcacgggttgtgaggaacatgggaaggtggtagaagagtaatgagagaaaggcgtccttgttttggttaaatataatgacatgggaagatgtgcagttgatgatggtatttgcttacaatgtcataaagcatcaataatttgcaagaaaagggtagaaggagccctaccccaggagtctgtgctcagagtttctcccctatcattgctttggaaaacactgttgtatcgtggagggagactgtgagatatggagccaaacaggcatgggttggcatcccagctttatcacttaccctttgtttgatttggagttaattacttaacttctctgagcctgagagtcctcatatagaagatgtgggtaaaataatattcctctcgcagcatcactaggattcatgtgaggagtaaagtacatggcactactaagtgctcagcatttgttggcgcccttccccttctccccttttaggcaaatcatttaagccccctggacatcagttgcatctctcttagcaagtcctattggttctacctccggaatatatttagaatttatccacttctctctattgtcattgctgccatgtcagtccaacgtgtaggccgttgcgatgccttcctaactggttttcctccttctgtttttaaacccagtgcaatccatctccacatagcaggcagagagggcattttaaaaatgtaaatcacatcatgcccctaccctgcctaaaaccctcccgtggctgaacttagagtaaaatccaagctcctcaccacagccttcaaaggcccatgtgatcaagcccctgcctaccgctttccttttagactccacttgctactgcttttttcttctataaaattttttttttccggttgtactggcccttttcagtttccagaacactccaagtttatttctaccgcagggccttttaatttgctgtttccatggcttggaagatgcttcttctagattctcctgtgcttgaaaccttctcctaggtcaaatgttccctcctaaaatttgtcatccttgacctagtcactctctatcacagccctaatttattttcttcatagcacttgtcactatgtgaaagtatcttaaatactgtttatctgtttattttctgttttcccccatgagaatgtgagctccaggaaaaaaggggactatgcttttctcttcttttaattttttttgagacagaatctcgctctattgcccaggtggtagttcagtggcgtgatctcagctcactgtagccttgacctcctgggctcaagccatcctcccaccttaacctcctgagtagctggactacaggtgtgtacaaccatgcccagctaattttttgtatttttgtagagatggggtctcgccacattgcccaggatggtctcgaactcctggcctcaagtgactcgtctgcctcagcctcccaaagtgctgggattacaggcaagagccaccacacctggtgtgggactatgcttttcattgctgagtaaacctagaacaatgcctgtacctaggaggcccttgggaagcatgtgaagaatggattctgaataaatacgtataatgggataaaaatatcgtcctgaaagttggtgactggatttgaaaaatctatgtcctttccatttctttttttttaagatggagtcttgctctgttgcccagactggagtgcaatggcacaatctcagctccctgcaacctccgcgtcctgggttcaagtgattctcctgcctcagcctctcgagtagctgggattacaggcatgtgccactatgcctggctaattttttgtatttttagtagagacggggtttcaccatgttggccgggctggtctcgaactcctgacctcaggtgatccgcccgcctcagcctcccaaagtgctgggattacaggcatgaaccaccacgcccagcttcctttccatttctaaagattctatgattccttggacagaaagactaaatcctgggataattttaaagaaacacaattagaaaattttcaaacactcaacatacagtaactcatattaagtttaccaagtagaggcacttcgggtatctgctttaataaaaaaaaaataaggacttatattttgcatgtcaagtatttgtatgtcaaaggatccttctaacccatttaaaaatttggtacctttaagtagcattgcgattctctgagcaaacctatttagagtttgcttagcatgccctttcttcacagatcttgaaaaggaaagtgaccccacaatataacacatctgctgaaagaagtggctcaggtgagctcgggctgtgtgaatagtatgtcctttagctcagggagtcattctttccactgtgctctgtgcacgtgagaccactgctggggccgtgctttaagagggacacggtaaagtggatcacatcccagggaagtaagtagaaaccaagtgaggagaaaaaaaaaagaagaaaatgggaatgcctaacttaaaaaggaggggatggtagagacctgatagttgtcaattactgggaccaaatctgaaaagacagatttggtgccattccgtgggacaaatttggaaccggtgagtagaagctactgaaaggcagagttggtccagtcagtgtaggacatttccaacagtctggcctcatacctaagtaaagccctgcttagaaatataatgagcagctgccttttctggatgttaaaatttcaggcaagtaaactgctagtcagctatgtccttcctacaaggattcctcttactgtagatgggtaacatgcacacttccgggaagctctcagtgaaatctcttcacactgctcggcatagtggttcacacctgtagtcccagtgctttgggaggctgaggtaggagaatcacttgagcccggaagttcaagaccagcctaggcaacaaaaaatttacaaaaaaaatttaaaaattagccaagtgtggtagtggcatgccagtagtccttgctactctaggtgctgaggtgagaggattgcttaagcctaggcattcagtgagctatgatcacgccattgcactccagcctgggcaacagagagagacactgtctttaaaaaataaatacaggctgggcccggtggcagccatttgggaggttgaggtcagtggattgcttgagcccaggagtttgagaccagcctgagcaacatggcgaaaccccacctcttttaaaaacgcaaaaattagttgggcctggtgaagtgcacctgtaatcccagctactcgggaggctgaggcatgagaattgcttgaatccggaaggcgaaggttgcagtgagccaagattgcgccactgcactccatcagcctgggcgacagagcgaaacttggtctcaaaacaaatacatacatacatacatgcacacattaagttaaattaaaaagaaatctttttatgtattctatgttggttaatattctttggtttgcatcaatagtgttctttctactctgtcatgtgtggaatatgataagtctgctattgctaatgacctaggcccagagaactttgaatttcaaaagttaacctagaatctcagagatccatggttttatattctgacttggaagcaagtcactggctatttcctattcgagagatttctaatctggaaggctgaaggaggctaccactcttcttggtgaacaatagtttgtgttccaagaataaccctgggtttgaggatagaagataagaagataaggctggagagtttaagagttgtattagatctccttttaatctgcagcctaggcactatgttattttctacctatgccttccagcaggggtggcttataactccaggcagaagctgaacctccttggcgacaccccctagcctgacccctcttttctccttccttctttccttcctttgcctttcattagaattcctatgagcctttgaatgcttagcatgaaaatgagcccattttatttttggaacccacagaggcagccctgaggggagttattgtgttgcttttagcagctaaacaaaaaggtgtgaaatcatttgctggctgttctagaatgggaaaaaataaataaaaaactgagaaggaaggttcaggacagtgtgtggcagcttggacagaacctcgtgatgagggcttctctgagacttattagtaaccaaagtgactttgggaatgtctgtgcatttctctcaccttcccaggaagttactagaatagcacaggaagccactgggattaaaaaaaaaagattgattttgcaatactatttccatgttgccttgaaaaagacttgaggaggggactaatttgagaaaattccttaaagctctttgtaacatttcttatacaggcagcatgagggagaggagagaggactattttaccaagattttaagactttcaaacaaccagggaaggcttctgtggacaggtatgtgagtctttgacacaggcccctaattatttaaacacattaacagtggtaagagacaaaggcctcaaagaactcaagcaacaagaacttcttgtgaaacttgaggtttttgccccatgctaataacattcattgaaagtcgtctcctgttttggggggctgacggccccagatacgtctcttcttggaagaagattatattttgaaatgtctcttcattagaagggcaacttcattttcaattggaatctttgacatgggatttctctttttaaaaattatggaatatttttaaaacggcaaagtattaacgtgtaaacatgcagagacatggtaaactcatgtccttattcccaaattttcacatctgttttacatttagaccaatctatttgagctcatttcaaaagaaatgaaaggttatggttgtatccttcacatttccatgcctccttctctctcttcccaaagagacaaaccgtgttctgtggctggtgtgtgtcctccttcctggacttttaggaagtcctgaccaagtagccacttggcctaatgaacatgacctttggagtatttagggagcctgatttcagtggctggaggatctctccttgcgggggccaatcactgggcccgtcttatgaaggtggctaagccttctttttttcagtattcaaggccagaattacagtatagtaaaacaataggaaaaggcaatcctcctcaaagtactatttcgttaactgagtcatctatagaataaataatattgattttccctttattgccaggaagtatgccatgtgctgatatataatgagtcacagatgaacaagtagaaattaaaaacactgtaattccaaaatctctcttagggaaggaactgtcccggtttacaaaaattccatgataagctatgaccttgaggatatgagtggcaggaatcaagagactgttgggcgaggaggatcgtggcatgagggagggggaaggagagaaggaaggaggagaggaggaagtaggaatctcagggtgggagagagagaagatggatgagagtggcaaaaaggacaaaggagggagatgaaagggcatgtggcaaaatggctatgatgaaaaaaaaatctacagtggctcagctgctagaagattctaacaacaaggtcttgacagataaatttttttttttttttttttgaggcagagtctcactctgctggctcactgcaacctctgcctcctgggttcaagcaattctcctgcttctgcctcctgaatagctgggactacaggcatgcgccatcacgcctggctaatttttgtatttttttgtaaagacggggtttcaccgtgttgcccaggctggtctcgaactcctggcctcaagtgatccacccgcctcagcctcccaaagtgctgggattataggcatcagccaaggtgaccaatttccttacagatcaattagaagtcatttgtgttaatgtgaaggaagcccattatttactacccatcctcttcttcccactgcagtaaaatgttcagtgaaatagggtttttttttttttttaaaaaattaaggggctgatttcgttatatgttatcatacatatatacagcatatacatatacgtgccatatacacacagacgcatatacacacttctctatgtaaaagatatctggataaactgaaacaaatcagtaaaaagcagaaattccgcaccatatgtgagcatgaaaacacaacttcggggcctcgcccgtatgctctgaaagctaggaattctcagacaccctggcaaagtcttgaccttcatttggcattggaaaagtacattgagggacatctcaaaggacagggagagtttatttgtcaccagagttgagggccaagcttattgtttcatagttttccactgtaagttatagggaacatgatttgaatatgggggtaaactctgaagtcataatttatcaaacctctaccatagctgcccaaatgctctttttccttgcttccaactcgcaaactcttaattcatcttttcagattctatttaaatgtcaccttatctatggaaccttccctgattccccagggagggtaatttcctctcctgaacttctatatttctccagatatctctctattacagcctgtatcacataggatcacatgactttgaaccttaatacaaggtggacctcatggtatcacttttgaattcccattgcctagtgagacatgtgtcacttttgctgaataaaacccgggtatgtgaacaataaagagaaacttaaaagtgaatgcactgcttcagaaagaccagacttccaagcccccgaatggtggcaccactgtcccccaatacttttgttactacttgccatttgttttgccccttgttcctattttgaataagaacccattgctctccagaagtaaaagcaatgtgaccatttgtttatttactccctgcaccaagacccagggtgatgaggctggattgcacatggggcgtgggcatcagaaactggaaagtctcaccctgcccagcctgtctggctcgtatgcttgggcaagtcacatagctcctgtgggactccgtttcctcacccagtgataatgaccggcttcacagggtggctgcggagcttaattaaggattgagaaggaggcagaaaatacaaagtgcagcatacacgcaaatttcccatatttatttttgggctcagtaacctgttggtaggaggtgtttatgacctggaagaggagtctagcaagagatgtaactagctattctcattccaaaatggttcacttggtattgactgggaaatgggccatgtcattcttgcttttgttcgagtacattctgtggcccttcctgctaactttctgggtatagcttgccaactctaggcctcagttttcttgtataaggactttatctatctttcctttatgctcagatatgctgtgatggcttaagctttttccttagtgcttatacccttaagccgcactcagatagaagacagagggaaggcatacacgtttgtgagtgaccccatggggtagttccctgagccagaaaagacagagacttatgaagccctgcataggtgacacccgaaatctgcctggctttgcggatcctggcctttcttctaagtgcttggaagaccttggcagattcagccagcgttttgatcactgccagagcctgcagctttgttgctaattgtttgctgaatgaattgagcaaaagcacaactggtcccaaggcaggagtgaggaggtgagggaaagacagaaaaacaaaccagaagagaggactgggtgactgccttggaaaatcttattattactagtacatttttttgtcttttaatcacaaaggctgtctctgcactaggactaaagaaccagaactgttcagaaagagagaagagcccagcaccttatactcaggagatactgaaaaacatcatataaggtgtttactgttgagagaaaagtacacatcagaggatgcccattattgatatagagccttctctgtatctggatgaacgtgaccaggaagccaccctcagcctgctgcagctgttttcagaatctgtgggatcacaccccagaggcagttgggtcagccgcaggcatcaggtgaggaggaggaagagtgagacagctattacaggctgccggaccaggtggctgtgaagaggtgtggggacaccaaggcttatataaggaggatggagaacacaggccaaaggggaggctgtaatgctgacttcgattggctaacttaatataaggcagactgagggaggaggaggagggcaggagagaacacgctttagaaagcatgacggtgtctcattctgtttgcaagtgagcacgtaggtgccttccaaatatgatcctgaagaaggtgcagataaatgaaaaattggatatacaataaaccacatacctctttatgtttatatatgaacatattaaagaaggttggctttagtagagtatgatgcatattctaattatatcaatattggatgcattgttagtaccatttctcaacttcatttaaaaatcactttcagaaaatacaaaaaataattctgaagattttaaccttaggtgcccgtagatcattttcttaggaaactgcagcttttagaaatgctggacatactttatccaaagcgttataactggtcttccacaagcctaggataaagttttccacagaaacactactacagaaaaatgccacatgccatggattaaacactgaaaccagctaatcacaacacatgagagcaaatgtagcatgttcagagaagtacaaatatgttgaaacatgtctgtcatgaaatctgatcttaacaatcctctgaagactagcctttttgcaaagagaacttatgactaatatacctcacggagggggtctcagtttctaatagagttaattttatctgctttgatgatggaaacgaaagacaccctggaaacatcctcttaattctaagcaccatccactctttttgaggggggagagggaagctttcagtaattcccagtgtgtcttatactgaatatatagaagatggtaaagcagggccaggtaattccaacacttaaactgctacttaaccatccacatattaaaggagtttacatggattgtcagctatgaaagaggtttctcaatctatatcccactccacagtcaactctcctcacaggtgctcttggctgtggggcactcataatctcagaagccgataaggctgccaagttcaagttgccgtgactctgaacacagtataatattcccattccaagccatagcccgtcacttttgtggctgttcagatgagggcccttcttggtaccactctgactcacatacactggctgaagtcatgtagcaggtgaaggacttaagtgtcactaagttggtttccagttgcttccaggaaaaaaaaaaaaaatccccggcatataagattcttgctcctgacacctggcactttctccttgtgttcatggctgcagacagaagatctggccattactgttttggcttcaagtgctgcctcccacacacatattgaggggctctgcaacaaacagaaacctagggacactgacattttggaggcagggtgtagaaaaaaacactgtatgtgtatctgaaaactctgccatgcatgtcagccctgacacgccacttcctagctcttctaacgtcagaacattctgtgttaggagttgctaatcagtccaatatcatatgtagtttaacggtgttgaaacacatttgccagaaaggaggccaaaaggaagggcccctctactgctatcttctgcaaaagatctgatcacttgtgactgcagcccctcactttgcccccaggtgttttctccctgtgttgttcttgggcgtgtttaatttggattgagcatccatggagctgtgtaaacattgaggtcccatgaatattgcaatattaaacagcagtggtaattaccaatagacccctcaaaaagcaatcgaatagcaaactcaccttaacttggcctttgtatctctggcaacggaaagctcaaaatgcagttctgtcatttttgcacagtcatttaccttgacaccctccctctgccgtggaatcaaatctccatgtataaaaataaacctagaaactttctgttcacacgttttgaggtatgtgcaccaaatgacacactttgggaggtaagcacgagtcatggtaactgaccacatcctttatcttttcatcctaagacttagcagaactttatctttacaataaaatggcctttagaagtgggtatcaccaacttcagaatgtgaacatcgttactgagaaaaagcattttccttttaaacagaaaccaacagccatgcattaaaaggcctgaggaaaaaaaaaaaagtggagctaccacaaaacaaacaaatattcagcttggtttcaggaagcttagagaggatcaaacaaggctttctctattgaagttgttcgagaacatttatggttatttcagcttcagtttctatttacgctgctggcttttatgcctcgacctcaggagggcattccaacttcaggttaactcacaagtagcttcagaaaagttggcctgaaaatcccacccccagagtgggggaggggaaagcacgatggttcacattggtttccaaacacctttcaaaccactgctttggccttgagtcgaggatatctcaaaaattggggagagaaattccacggagagagggtgagaaaggtttctcatggtgtgaacattcatatagggagactgtctcttcctgcgggatgaaaccaggagaagagagcaccaatttgcggagccctcgtgaaggtttccactcaggagtttgcaattttctgttggtccctagggaggaagatttagtacatggttgaatttccaagcaaattaacttccagaataaaggaggaactatgccaaccctttgcaaacaatatttttgttttataaatctatttagttttcaattcttcgtgccatttatcctcataaccatgttttggttggtatttttaatccccttttgatggattaggaaattgaggtttagagattaagaaacaagcccaaagttatacaataaatacatagaaaagctaagattcaaacccgggtccttttgcctctaatgtccgagtcccttccaatacgccacacagcccctgaccactcccttccgttaacaatgcatattgtcagcggtggaaagaggaagaaacttttggagtagaatactgaacagttttgattagggagcggatgtgaggcagaggaaatattatcactttggtggttgttactatgtccccatcctttcatggaaacatatggaagttttctcttaaacgtacatgtcagaacttgccggtgaaatttaagtgacaccctgcatatggtgcaagttcatctccgagaagcaagagatgaaaaagccgctgtttccagatgtatcaaatctcatataaataccacacgttgcttgcctctggagaaggtctcagtaaggtttgtccagatttcaacatagagtattcctatttacatatgtcccgctgcatacatacttagctatgtcaatatccacttggcatactctggagcttagaaaaagtttcctgccgaagctgaacagcttcccttgattgctcctttgcaaaccttcatggttttttcattgtaacagatttttgattacacaaaacatgccactattctatggaacaaaatcaagctacatccctttacccaaccgcccttcccccataacatcaataccaaaaaggcttccactccagggggcttctgggagcattcccacaaaccacacagctttctgcaccctccttcagccccagtctttttaaaagttagtacaacatgtccataaaggccactctcccttgcagagttttgaacagccactttagccacctaaatctgagagagataaatttacaatccactttaggtttatgtggggaaccataaatatcaggcttgagccctgagggctagaatttcatgggccgttaagcatgtcaccaggtggaaagctgtcaatagctggatgtgagctacactgagataaccacaggggcctggcttaagaaagtgtagccctgatcaaagaggggtgtccttttaccttgttccatcactccactcaccaattctcccttcccgcctctgatctcaacctctccttcacttcctgttaggtgtcctctgtgctaggtagcagactgcctttttttttttttcctctagagtgaaaggttgggtgacatatggaaagaacaagagacgtgcagttctggcagaccttgatttaaatcctcgccctgctatttagtagctatgtaataatgcacaagttacttaacccaacttagctcatttttccaactgtgaaattattaaagataattaaaagcataagaaaggcataagtagggccaatgggtagagactgtaaaaaaacagattgcctacttagtagacagaagaactttctaaaagccagattggctcgaaaatagaatgggctgccttgaaaagaaatgaagaagtgaatattctctgtgacaggttttgcgcataagccggatgcagggtggtagatcccgagaatagacaggagtttagactggccactgcaaaggatttctaatcttgaaattccatggttctatgatttgcatatgtgtccttccagaaaagctaagataaatcttctcaaatcccctatgcggaagaaaagtaaattggcatcatattttttcattttcattttccttctagaaaactaatcccttccatgttttcccccttccctcaattagttggtagagaatcccatttccatcaagtgcacagaacacatttaaccattttgaaacacttaacatttaacacaaaccacatggccgtaagttttaattagttcccgctatacaaataggtccatttttagaaaaatcaaaatgctcaatgctggtgcttgctctcttcctctccattgtttctctgtttgactagctcagtggcactttcccatcctgccctcttgctgtctgagcccatggcacctgccaataaaagtgatgacaggctttgatgctcacacaggtttgcaacaacagagttcacttcataatcaccagacttcagcccgtaagcgtgatctgagtgacactggattttttacctgagatgttacgctgtgggctttcgtttctacaggttatgaaccactttgaaagtgatttttttagcttgctagggggaatgacctatgagcctgcagacaaatctcaactgattgggcaaagcccaaacccttattagagtgcttgagtttgctgggaaaactggctgccacatatgagccacagatacaaggtcgtcctttggcataatgtgtacaggtgcatgcgtgtgtgtgtgtgtgtgtgtgtgtgtgtgtgcgtatttgaacatgttcaggtcatgaagcaaatcagaagtacaaaccagtgtcttctgtttggccaaagtgaatatcaagggaaaccacagaagacaaagtgcactcgtacaacaaggagtgatgggagggctaagcctagggctcccgtcctcaccctcatcacaaagtgactgctatgaatgactgcatgttgattggccaggcatggaggaagcacatacttataccaacatgttatttattcggccagatattattatcttacttttacggataagactcaaaaagattaaataacctgcccacagccacattacttgtaggtggttgtgatggaagttgagcccatggtaatggacttttcatggcactgtctactttcagaggctttctcagctcagagtccgactgtgtctgcctctcaagccctgtttcagccaccttgtctcattttttttttactctgatatcatatttcctacaaatagtggccaaattcttccttctccatgttggctgtcttatttgcctaatgttatgatttgtgtttcagataccctagggtatcatgtttttcatcttttgagtgtccaaaactacaaacagctttagggtcaattaaaatctcaacaggagcaaggattctatcaggagaccctgacctttgcagccaacactttacatgaagaagcagcttctcttcttctcccgtgaaggccgcctctttagatagctgggatttagcatgcctgtcattttagtcaaaggagctgctgaataaagacttgttgaccaaagcttctcaccggctaaggacagagaagtcttatttcttctctttgcaaatgaagattccaatcttctcatcctgagacaggggtaatgcaactgttttgatttgtaccctaaaatgttccatggtacactgaactgttttcaaggtagagttttagaagaggccgatttatttttgaccttgacacaatttgaatttaacaaacatttttcccatatttcactttacacatttgtttgcactgaaactgcatgactagaataaagcattcaaaacaaagcaggcaagcaagcaagcaaacagaaacccatcccacttctcccttgctatgcaactaggcaagtagacccgaggctctctgagatttgaaatgctgtgttccttaacgcagtaaactgagtaatgtgtccccacccccactccccaatgtccacatcttaattcccggaacctacaaatatgttattttaggcaaaagggactttgcagctgtgattaaattaaggatctggagatggggagattattctggattatctgggtgggctcaatgtaatcacagggtccttataagaagtagacaagagggtgaaacacagaaggtgatgtgaccatggaagcagagggacagaagtagactggacgatgctacgtcgctgactttggagacagaggaaggagccatgagacaaggaatccaggtagcctctaaaactggaagtcgggaagcagatattcccctagagcctcctgaaggaactggctgagtgttagctcaataaaactgggtttgtacttctgatctctggaactttaagagaatagttttgcattgttttaagtcccgagtttgtggtattttgttataaaagccataggaaacgaatacacttgtttaccacttactgcatctcttatgtctagtattgggcttggtatatgagatggactcgtaaagtaatatttgttggatgcactgaaaatataagggaaagatgtcatgagaatggaatgtaccaaattcatggcaactttttaaatttttatttatttatttatttatttttgagacagagtctcactctgtcgccctcatggaaacttttctgatttaaaaaattctctctttcttaggatgaaagaaacattcctttaaggctcagaagggtgtacagttacccagatatccatggcaaggccccagcggttacagagttgtgtttgagcccttcaggcctagcaagctctttcctgggagcaagtaaaggagacataggccatgataaacagcacttagcggccaattgctttaagaatacctgtttagtgtttccagggactcaaagctccagggggacaagcaggaaggagaggcagtgtcaattactgtacaatacaattagcaaataccagcaccttgaggaatgtttggtatacagtaggcagtcaggaagcaaatgctagaatgaatgtcattcagagcgtgtgacccctttctcctaaagcttcctacagtagaagtcagtctcctactacttctaccttctctgtctctttggatgttcattttcgtcggattttactcatacctgctgaagaagggcaaaggggagtacctttcaacctcagacacagacacatgtatttgtcaacaggccacacatattctgggcacagggactgcagaccatagcaacgtacctcaccttttctgagaccctcatccttgttcagtatttgtaagccttttaatttaaagaaaaataaattaagccatgctagctgattaaagaataatttcaaggaatttaacacttagtgattatattagcgatgtacaataacttctcactttggattctttttgatgtattatggaggtaaaaatcaatattttctaccaaactggagaaatttagatgatctatttttgagatataggttcagagaaaaattgatgataaagactggaataactctagttcccccaagtcaacatctgattggcccttagaatcagaatttaggaagagagaggtttgggagaccacgcagtcctgcttcctcacttcgcagatacggaaaccaggcctagctggaatttccccagatcacacagccaggaaacagcaggctcaaaactagggccttctgagtccccagtgcagcatgcatatgtgtctgccttgtttcattatgtaatggtacagcgagtttggaggcatacaaaaacagacagacaccaatcttgccttcaaggcgtttacaatttagcaggggagataacacatgtatataaaaaacttactagacaaagtaaacagcagtatgctctataagacaggtatggattaaaaaggaatctttaagtcattgaaccctgagattctttttttttcattttttaaaacaatagtaatcaaacttgtgaaatagtgaacttcctccattttgcaagattcctcgaaaccaagtacttggaatataacttagttaaggattgcacaacacacaccatttgagtatctgatttggaaaactaagccacagagccagaccacacaatgcacactggttggaatctgctgggcaggtatctccccgtctgtccaggcaagccaaatcaaataaggccctgagttaaaaaggaaggaaaagtaacagataaatctgttgaccaccactctaggaggccaaggcctctttcctccccattagtggtggcttgctctaagataaaaataccacacttaagctgtgatagaggaaagcccgtggtttgggacccaactacaaagtaacagcaaaagagagattattactccctagtgactctctttttggtataattagaagaatagaaagaccactgaagagtgggatttgtgagaaatatgggtcatgtgtctgcagcactagttgcttgcagaattggctatgtgggttggcacacagcaccgtgaatattagaaaccacaaatctccagggtttcttgaacaaagtaaaaggccttgtcttcagattgccaggttggaggctggcttgtggaagaagcccctgggtgagctccaaagctacctacgcatttctgccttctccgtctctttcttctcctcctcctctccctctccccatccctctcctcttattttggatattgcatcttggtgggtctaactgtagctttgcttatgccaatacccccctgccccaccccctggggaagcaggccctctccatgacaactgccgacgcagaatccacagagctctggacaatgggacaaaccatatttctatgaacaaagccaaggtaagtggattcctttgcccctggaggactaaaggagttactccccagtcagattatgctgtaattgagggtccagaaaaggaatgaacttccctgtgtagacaacagagccagttcttaaaaagctatgccagcgtgcagaccctttagaatctcctccttgggagcctgaaatggaaacaaagtacttccctgtgttcacctgtccaatcgttgactcctctgcagaattattctcttgggttgtaagtaagctaagtcttctataaggcatacttcaagaaaaaaaggaaaacataaaatgagtttataaaatcctaaggattaactataccttggacacagataaattgccacgtttatcactgcacttccctttatctcctcctgagatgctctctcggttcctccttcactgctcttcaggttctggaatatttcttagccaacacttcatccacggtgacttccaggacccccagtgaggggtggggattcctatgttgtctcttttcttggcctctccatccaaaatatttagatggtgcattcgtggcctttctctctctctaccactgcctcctccaaaaaaaggaaaagcggggagtggcgggtggaaggagattacatttttctttctttttttcttttttttttggagatggagtcttgctctgttgtccaggctggagtgcagtggcgtgatctcggatcactgcagcctctgcctcctgggttccagtgattctcctgcctcagcctcctgagtaggtgggatcacaggtgtgcaccatcacgcccagctagtttcatcatgttggccaggctggtctcaaactcctgacctcaagtgatccgcccacctcagcctctgaaagtgctgggattacaggcatgagccactgtgcctggcccattttcttctcttatccttggtgctttccatatagtaggaggtcagggagatcaaggggattcctggatgcataaataaaatctgcatttcttaggaatctgatggacaagagaatccagaatctctgcaatgggcagaagagaggaccagacttcatggttgatctccccacagaccataccaacagggcaaagcccttctgtatgtatttctgttttcacatgtatctgcacaaccacgtgtttagaaatcagagggttgctatttgtaaaactcttgaaaacctctcttttaaattgtaaaaattatttaataaatgccaacccaatctactttatctcagtgagctgctattaagtgcaaagaagataacatgttacaggtaagtctgtgcttaaagagctttggccacaaagactaaacagggtccgttctcccatgtgaaggaaaatgtttctatttcaattgtgatgtttggaatttcaccttaaagtagaaaaaaggcactgtttctgtagtgccttttggaaaggcactgtagaagtggctgatggtccttgtggaatcagctggccaagtgtttcctcctttctacctagactgtcattggagtatattgacccatccctgacagaaagtctgtgtaagcccgaggaggaggaacatgccgcaaacctgctgcagagcattaacaagaacagaattaaaaaggatcacttctgggactcatcacacaacttggaaatcatgttcaataaaagaaaagataatttggggccacactacctgaaatgaacatctgacactcagtcactggtctggatttagaaaactgctttgatccccggagggaagattgttaatgagtattttaaaggacaagattggcgaagcatgatagagtggaaaagggtactgattttgaagggtcccagtcttgcttccacttctgtaagcaagtagaactgactttgaacaagacacattacactgccctgagaaaacgtcctcatctctaacatgggaggtgaagttaaccctctagtccatccaacaatcaaatctaggccttaatgactatgaaaacatgggaaaaaatttaaaacaagagcaggtaatgcttgcaccttttcgctacctgaaaggaaggtcagacaaccttagtataaaaggtaacttttcttacttgcatgctaacaatcaatgcataatttacatagcaatgcatacactttatatagttcaagagatcatcgttgactgcctgaacttgatatgcttcatccttgtcatgtcctcctcactaaatactaactacccaaagtgatcaaaccccaaatgtaaaaataatcatctgataaatcacagacaacaaggaggtgaaaaaaagaactcagtcaaacatttttgagttcataaaaaaattgaatagcataatctaccactatgttcccatccccctgctaaaacaatattttatcactctggctttatttattcccagtcctccccaacatacttattttctggagcattttaaagtaaatcttggatatcttgtcatttcatccacaactacttcagtcttcatctcaactaataaggattttttaaaaaccactaccacgacagtattatgcctgacaatattaaaaaattatttactatcatctaaagaaccaatcaatattcaaatttcatcaatcatctaaaaatttttttttctttcagtttttggcttgaattagcatctaaacaagctaagaggtgaaactgatttcacccaattcacaatcctttgtcttttaaatatttcttttagacgctgacattacttagacacaatgtatctggaacacagataatgtgaaggtcagcttcatcgcaatattatttgaaatgtcttattctatgaatcagatataaatgtagttaaaggctcagaactggaaaaatctcaagtaattctcagttttcccaaatgcataaatgatttaggcaaccttaatggaatgctttaaagatattttgctaaatcttacaccattcctaggaagaatacctctgacagactttagcagcttttattttgcccatataaaagctggatttcttagaccgtggagcagcctaacagcacagatagtattttcagttgtagtttcacctgcaccttaaaaagaaatctacctgcatatgctggcaacgaggacatctttgaaaacagagctaagagcctcaaactgtcaactccgacttttgggaagaagggaggtgaacagtttctccattcagcttccatgaggcctctctggtaacacacaggcactgctgtgactcataaccagaaatactgttttataacaccagtctgtgttttgtaacacacactgaaagaaaaaaaaaactatttagaaaccaaaaccaagccctacatctgggcattggtatcaagatctcaagatgtcagagtggctatttaattcagataaagtaggcaagtccttatccctttccttggcaagaaagtggaggcttcctgcctgctgcacatgcccacaggaggagcaaccatgaatttaattttcttaaaacagaagcattttcagacttgtgttttcctggacagctgcctagtggctgtaatccataataagggcgtgtaattgacagtaatgtgaatcactcactgaaattctggcaaaaaaaaaaaatagaggagttattttttttttttttcaggaaaaaattaaagagcagattcatcctgtccattgaaaatagcaattactttacatttcagctcattagctacctttatataaaaaaatcactgtaatttgtactaactatcagcaagtgttgtaaagaagtggtgcagttgcacaaggcatgcaatcggatgtgctgggccaggcacaatctgtaaaatggcaaatgtagatgagttacttgatatagcatacatgggattcctggcccaagagtgagttacaggacactgtcctaacagtgattttgccacttaaaaagctgctatctgcctgggaccttgtaattattatggtaatacccagggcagactgatcaagctgccattgatgtctatgggcagtttcagaattcctttcactcagacacagggatctccaaaagaatggttggggattttcccaggtagaagctgttggaaccatggaaactttgagaccaggtaaagggtttctcccatctattaattctctttgaataaggggaagaataatctcaattaacttcactatcaacctgaaagggccccctcttttccaaggcagaggcacgggaactaaacactggaaagctacggaagatttaattccatttagataaaccctgactccatcagaacccgagaggttcagatatttttctgaaacttcagcacctgtgaaactagcagcccttgtccagaactacctggtatctcaagcttctggtcccagagggaacaggggtattttgacttgtgaaaatcccacgaatgcatggagaaaaacttgggactttagaatgctgaggtctgtgttaggaagatgtatattgaaccaaagagtggaaacacttaacctctttttctcagtcaaccacactctatgaagaaggcttggatttattttctcctattgggatctcccattcttagaagaaaaatggaagtcagatttcattaaaatagaggtaatgttgggattttgatgaatgaaactaaaattcattttgtgctttatcattaattatttctgagaagctttttctcatatgacaacagttgggggatggtattattagcttatgatggttcccatctttgatagccaccactaatctcctacttaattctggcttaatttgcaagtagttgctaacaggcaaaatgagggtggagtctcataaaccactaaaaagagagacttgctatgcatataaataggccctgcaaaaatatttcagatactgtatctcaattattagacagtagcaaactgtcaaaatctaaaaagtaacatggaatatgtataactagttctttgcaggcattctttttgttcctatatgaatacattttatgtgagcccaaatggttggaaatgtattattcatttttataattgagaaaaatgtgttaacgctctggaatgtccatgtgtggaaaaataaaacgttatatggaattgcacacacatatgatttataatgcatgcttccaggaccagaaatcctaacgaagaaccttattcaacagaaaaaaacatttttttttcttcagtatgtgcaattctggtatactgtaatgctgaggccaagcatatattttattagtttaaatcctagctaagcaataaaatatgtgtcattttaaataaaagaaaacatgtttttcacaaaagctagatttcttgtccatttttgtccccctgtagtggatgctgtggtgtgctgcataggtccctccctttaggatggaggccctcattcccctggggccctgagtgttgactgccagtggctcatagctgaattgcttcctgagatttgtccttagctaaagtggagctgccttgcccaaggttatgcccttaggtgcagctggcacccaatggctgcctgatgcagagtaaaagatgcagcccccttgcttcaatttggtacatcactgaagggccacccccactctgatctccctgtggcatctgctgaagcctatattgcaactgttcaagttttccttctgcccagtccagcttccctcactctctataggcattgtccctataagcacactcccataaactttctgtatgacaatttcagaatctgagcatctattctctggggaattcaatctaagataccttcgtttatttaaggatactttagtggagtgattagctgggcgtaatgatgaattttagatcagaatatggtagaacttcactttcttcaatgtgagatagacccaacttagcctttatgccaagagggttagttccagaagtttttaaaaaactctagcattgcaaggtgagctaaattaatggtaatggtacaaaatgagactttttttgttgttgctgttacggagtttcactcttgttgcccaggctggagtgcaatgacgcgatgttggctcactgcaacctctgcctcccaggttcgagtgattatcttgcctcagccccccaagtagttgggatcacaggcatacgccaccatacccggctaattttgtgtttttagtagagatggggtttcaccatgttggtcaggctgatcttgacctcctgacctcaggtgattcacccacctcagcctcccaaagtgctgggattacagacatgagccaccacacctggccacaatatgagaaattttataatgaggctttgctattgaaaataatagaagaatcatgtacgatatgtagatgattggtcacacacagaatgtgagaagttggctcttctacatttcagtggcataattaacccaactctccagaattcttgtaagtaagactctgggatagaacgaggaagaactcactgaccactaaagagtaggtaaagcactaggaaaatctgtgagaatgagtcccatattggtcattttgttcattagaaatctaacctaagagaaacgtatcaacagaatctcaggtgaagcaatttagggcaataaaaacatattctcctaaatgatactgtccctgagtggctcccctagtgaaaatgagaacatcttcctgtctctcaaatcaccccaattatacacaggattaggtaacttccacaaatcaggccatggaaagttctttgatttagagataccaggcaggactcttttttgaggggtgtgggagcaggaggagaggaggatggtggtgaggatgtgtgtgtgatagtaacagtttttccttttccaacatcaaaaaccataggccttctaggacagcttctactttgattgcacttggctgtgtgaaagagcagcacaaaatgaagatagctcctctcactgtgctattaaagactcccatctgagaaagaaaatgggtgaaggaggctataagagatggcctttctatcaaaaaatcaacttcagaagcctaaaagatcttcttccttcatcctgttctcatttagcttgctaatagacgcctcatgagaaaagaattattgtgaagctgagaaagtaagatttaaatttcctaagaagagatggactttacgttacaggcaagggacatttttttctctttttacaataattccaaagtgctttttgaccttggaagaagaaaatcagtgttaagatagaattggttaggtcatcgcctaaggaggcataaaaggccaccaggaaataaattaaaattaaaatagattcttttattgggtcacatctcatcctctcatttatgagcaaggcttccactcaagcaattgatactgcaggggataattttgctcctcttgttttgactcaagaaaaagttacaaacaaaagtagggaggaagctgcatatgaaggctaaaggacatttttaaaagaattccaaggaaaagagcacagaaactgtggttgtgtgcagccactgatgaggtggacaatagttttgaaattattggttcctgctaaactaaggaaacatacttacattctagaccagacaaacatagcaagtcacgtgttctgaccttgaacaaataaatgtcatttctttccagaatttaccttaaaattcaataagtaatctgggattatcaggacatctacttcagaaactgttaaacattttaggattactttttcttctctagactggacaaatacaggatatttcccttgataggatacacccttcattcttggaaaggtcagccaattctcttttctagtaggtagtttcctactttgcataaatgtagatgccaatggtaactgaaaatggtccctttaccttttactctatagattcgatcatctgatttacatggataatgcaaacaaatggtgttcaagaggtcactcagaaaattaacacattcttcatatctagaaagataggcaagtatttttaaacctctcgataagattctgacttaaatcttacaaactgcagaaagaaactttaaagctatcagccctaaaatttagccctaatactgagactcaaaatgcatatggtaaattgccagatgtcaagcagccctttgaattatagtatcagtttccaaactattataatgcaaatctcacaatataatttcaagtaataaatacctattctttctttcttttcttttttttgagactgagtctcgctgtgcagtggtgtgatctcagctcactgcaacctccatctcccgggttcaagcaattctcgtgcctcagcctccctagtagctgagattacaggcgcctgtcaccatgcccggctaatttttgtatttttagtaaagacggggtttccccatgttggccgggctggtctcgaactcctgacctccagtgatctgtgtgccttggcctcgccaagtgctaggattacaggtgtgagccactgtacccagcctattctttcttatagctgttaacaatgaaaatatcattatttttggccaaactgaaatgagcaacaagagtggtcataaaattgtgtatgtatacacacacatacagacacacttatttaaaatctacgggtattaattgagcacatagtagatactgatcactctgttaagcccaagggatacaaagataatttttttttttttttttttgaaacagggtcttgctctgtagtctagtctagagtgcagtggtgcactctctgctaactgtagtcttgacttcctgggctcaagcaatcctcccagctcagtctcccaagtagctggaactataggtgtgtgccagcatgcatagctacttaatttctttcttttttttttttttttttttgtagatacctggtctccctatgttttccaggctgttcttgaactcctggactcagcaatcccccctcctcagcctcccaaagtgctgggactacaggcatgagccaccacacccggccaaaaaaattaaagaatatctagtaggacaaagctacataaacagcaactattctgcaatacattttatactgtcaccttaagaatgtactgtgggggctgcagcaattaacaaggtggaattggagaaggctttgcacggcagatgctacttgtgttggcctttgatggagcaataagactttataggtgcagaagatgatgaaggacattccaggacaaacaagatactacagatacaaaggcaccgaggtatgcccatgcatggaatctcctgggaacagatcactgaggatggcaaacactgcctgcatgggagaagtcctgaaaagagcagtggaaagattaagaccagattgtaaaaggcctcgaatgccatacttagaatttagactcctcaggtgacagaaaaccttacaggaggttgaatgagaagattccaccttgtttctaaggaggtagaatcagaagattctagagaaggccacagtcaaattctagagaaagccacagtttttctttttccttacttttcttttttattgtgcaggagcaggaattaccgaatgtaaggctggtgttttctaatatacctcatctcagagaatagaatttagccaagacagatttttatcacactcttagcacacagtgagtcttggtaccactagacaagactgggctctcttccctaaaagattcacaatcgtccctcttactgttggtgttctgttgtattcacactgcaaagcaaaacaagtgccaagccacaccttgagttctctgctctgcaggtttactgcctgacaagccttaaagttagaaaaatatttcaagctgaatctgtcactaacaactttatatggtttgttgtttcctgtgttgcttgttgagaatgcctggccactgagaaacgaaatcggaggcagatatttctgacagcgagcctccctgccgggtgctttatcattctttatgttaaatacatcaccacatctaagcccttgcaagccgagaagttaaggttatggtgtggacaataaaaaaccgatttttctcctaattgcctacatgtattagaagtttttgaatttatacaggccattggtagcagagagtatagttcgttttttgtttctttttgtttttgtttttgagacagggtctcactctgtcacccaggctggagtgcagtggtgtgatcatagcttgcggcagctttaaactcctgggctcaagcaatctttccacctcagcatcctgagtagctgggactataggcatgcacccccatacccagctaattttctttttattttttggtggagatggggttttgccacgtgcccaggctggttttgaactctgtggctcaagtgctctacctgcctcagcctcccaaagtgctgggtttacaggcatgagccactgcacccagcccaaagagtatgattctattttttttttttaaatttaattcctcttcatgacagtctcttgtggcaggaaagtggttagtttatagatagaagaaatctaggaccaaagagatgaaataattggaaatcattgttttgatagagtcaggggcagagtttgtgacagcatgacagcagcattccttggctgctgctctcagggggaagccctacagccttgtttccactgcagacttaactgtcctcactccacgtagatcagttcgattcctgagcccgaatgacaagttgaactaccaataatgccttgcacaatgtttgaagcgacataatcagccggagagggacttgtgtcagttagattttgtctccttaaaaatcaagagcaagagtggtaagagagaagttttttaacaaggaggaaaaccctagacagttgtctctaaggttcttcaccacagcttcaaggacaaccaggaaaagagctgctatttgaggcaacttcattataaaatcatttttaataagcaatcttaacaaagagagggaatactcttgtggagaaaccctccagggacccagaggctgcccagttaagttattaggaagtttcacacaagggaccaaacagctatttcattggcctcgggggacagagtttagttttcacctgttctctagaggcactggtgttatcctgtctactaacagcagagactggtaacaatcaattatcccgacgccccaacctggtgagggaaagtgaattttcagttttgtcgacacaaaaagacatggtgtaagagaaagagagataaattaactcaatatgattcattatactggagactaagaacacgcagccaatgaaaatgcctcatcaggaccttggtattctttaagtaaaacgacagaaacatattctaaggaaattaagaaatatccataatgagaaaaggatgcttagttgtcctcttaccataattgtccagctacatgagggaaataattctttgtgctgatgaaaaagtaatagtcactgcagttgactttgcctacctaaggagtgagcaaggtttggaatttggggtttaaatttttataaagctatttgtagctgagtttaaaagggttggaaagacagaggctcccagggtagcagagtagcctgcagccaattagcagctcgaatgaaagaaagcaaggagaaccattagccgcaaaattcaaagtgcttatgtatttttcaagtttcactgcacattccatgcctctgattttaatgaaatggcaagaacgggtcttacaattagaccttaacaccgtggagttagagaaaaagtgaacatcctttttctttaataatcagaagagccttctcttttcggaccagatctctccttcccaataagcgtttttttgtttgtttgtttgtttgtttgtttgtttgtttttttaacgtagttggtcacaggagcacacacagaagtagttctaactaaggataaaaatgtcacctgggttcagagaagggactggagcagggaacatctgattcacataaccctaactaaatgactgtggcagaaaaacattgtttataggtcactgctttttttcacacacattctgtggctccacattggttatgagagaaagccaaaacctgctctctgttcttactggtctcccttttccttgttaatactctactccagtcagaccgatctacacaatcatccctgatcacacctaattcttgctacccttccagagcaagctcagctcaccacacatgttcccaactcatacagcatttaaacacatattctattaggttggtgcaaaagtaattgtggtttttgccattgaaatggcaaaatttcatagccctgcattttcctgcaattctttcattactgaaagttcctcaaatgtgtgtgtcctttctcctagatacagactaaactattagacagggaggaatataagttagattacctatactgcaatgtgccttacacaatgttaggcacagagcaggggttaaaaaatatcaagctaagaaaatctgcctggctccctgccctatctttccataggtatgaactgcagtctactttccagcctctgttcctcagaccccgatattacaggtgtctggattgcctagcatataatttccttcccctttcctctaagaagaaaatgtaaaataaaagatttatagattaaggcctttccactgaatccaaaccttaatctagtatatcctacctcttttttttttttctttttttttttttgagatggagtcccactacattgcccaggttggggtgcagtgctgtgatctcagcttactgccgcttcggcatcccaggttcaagcgattatcctgcctcagcctccctagtagctgggattacaggtgcacagtaccacactcagctactttttgtatttttagttaagatggggtttcaccatgttggccaggctagtctcaaactcttgaccttcagtgatccgcccgtctcggcctcccaaagtgctgggattacaagcgtgagccaccatgcccggccactcctcaatatgccttctaatcagtatccttggctattaactatttaagacagtaggagctggagttgatgcctaggagacatacaaaatcaagaagggaaagagctatcactcctacatagaaaaacatgttttcccagaagtggaagtggattgggtggagaacattccattgcaagggattttggcagtcaaaggaaaatatttaattgaatagcttaaaaatcttcatccttataatgtatagatgtggatgtcaattataatccaaagggccatgtgactacaaatgcactaacttcctggccacagaattgataaagaaatcagtgtaaaaaatttagtgtcatcactgaaagtgaatgtagagtgatcactctcttcttgttttaaacacattggcatctctgtttcttctacgtttttattcctctgcgtacagattgcaataaaaagagaagctgatataagtgtaaatccagtcctaagttcagatatgcttaaacatcctcaaaatctagatgttaattttcttatatctcctatatatcccattgatatatatatatatatatatatatatatatctgtttcctgagcgttctgttagcttccagggtttttttgggtttggataggtttcaaagaaaccactgtgtccggaatcatagtactgctttgtggcaatgaaagttataaatgaattactaagttggtctaacaaaaaagtataaatttattataaatgtcattaatgtccgttaaaggctttgtttcagaggaagatgggtttgtgctgtacgaaatatatgtcattactggtgtggggtacatagctgtcctagaagcagaagtaaccactttgaacaattgttttattatggaatcagttgtgttgtatgacattaagtagacatcagttctttgatgaactaagttaaattgttaaaaagataagtaatggtcatttaaagtaagaaggttggctaggcgcagtggctcacgcctgtaatcccagcactttgggaggctgaggcaggaggatctcttgagctaaagagttcagagaccagcctgggcaacatagcaagactctgtctctctcttttttttctttttgagacagactctcactccatcacccaggctggagtgcagtggcgtgatctcggctcactgcaacctctgcctcccgggttcaagtgattctcatgcctcagcctcccaagtagctgagattacaggcgtgtgccaccactcctgactaatttttgtatttttagtagcgatggagtttcaccatgttggccaggctggtctcaaactcctgacctcaggtgatctgcctgcctcggcctcccaaagtgctgggattacaggggtgagccaccaagcccagccagcaagaccctgtctctacaaaaaactaaaaataaaaaacaaattagctgagcaagtcccagctacttgggaagctgaggcaggaggatctcctgagaccaagaggttgaggctgcagtgagccacgcgcatgccactacactcccgcttggccaacagagcgagtccccttctaaaaaaaataataaagtaagaacgctgtacagtttccagtagactactttgtttaaatactttttttcacatagtgggaataacattcccctttcttacaatcagtttgttcttcaagcttagaagcctatggaggtagcatagttgtaaggtaaaaggaaaccttggtcaattgtaagaatgactatgttgcacttggctttcttcctatactttagagtggaagaaccactctgaaaaatgaagctcttcattttaaaagcatttaaactggggattgcctttacatcctggctccaccacatactagctagttgtaggaccctggacctcggttttcatctgtaaagtggggatagtagcaacacctacctcacaaagttgcagtaaagataaataaatgaacacttagaaagtgcttagagaagtgcctagcactcagtgccccacaagtattagttaatgttgatactggagataacggtgtggctcttatgtgtgcacaagggggcaatctactctgttttgactccaggctttgcccagctgggtgagctaacgaggtttttcacttctctaagctacttgtctctcatgtacattttcttatttaaaatgcgggtgcaagcagtacaaagctcctaaagctgatgagcagattaaatgaaataatgcacgtaaagcattaaacacaatgcttcgaatattcagattgcttggtaggtggtgttcctgctattgctgctgctgctactacaagtaatggtactactgctattacttctgccattattactgtcaatatgaaactaagcatattgcaaacttatgtcatagacatctagcgctttttaaaaaatcaatctaatcatgtctaactaagcatttatcaagtatgtaataagtctatcaagtccacaccaatccctcgtaggctaggcatgtttgttttctccctggtagtgattatggattttaaagagccaatcaccatctcaacacaccctttggaacgtatgttatgaagtgggaatacaaatactttttgtccaaatgcaattcatgaacctcaagtctactaactgggcaaacttgaatcaactggatgttgggatggaaatgctcaggtaactattcagtttttctatggagttcacaggtcctcgccatgaactgtgggctttaagactatgcaaatcttctactttggaagaactgactggcagggccaagtgcaatccatttatttttaatatgatgagacagagaaatcctgttaagcttaggagggcttggctgtagctgagcaggctgactctaaacaaggcaaacgcttccagacagtacagagggatttttactttctcagactggctgatttgaagaaactaaatagatgttactctgtaagaatgggtggagatgagcagcggggataggttttagcacccagggttaaatttttgccttttgctttattgctattttatgcttggatcacaatatgagaatcctcgatgttttctctagttttcttttcctctcccatacttccagcttagtttgttttccagttatgagcgacttatggaactggtacacctggcatttgtgttttcagattgttttatgtgattatgcacttctatcccaccctatcccctatcttgtctccctctagtctttacttacaactagtctgtaaacgcctggaaggtaaaaagcctatcagcgcagagtaggtcctcaatgaatagttgtcccttaattagcccttaagaggccagcacctgtattttagtcatgacccactgccaacaagcttgctgtctgagatagctggtagccttggtaagctaagcaatgaatcttccagttactttgtgagtactaggttatcccttttcctgactatttgtcaatgggcagacaggatctggatgaaggcctactaaaagaacttcagcgtggcttcttctcacatctgtcctaatggaacaccctgccagcaacagaaattataactgccgtgagtcactgtgagtcacatgggttgccacggaaacctactaactatatcaccaaagcaccttccattagctttgccaagaatggttcctgagttttcctggactgtgaaaacaatgtgggtgagccccaagtttggggttgctaagagtctacaataaaaaagtatggcctcaaggataggaaaaaaaatgagaaaataaggttattctagtttttggatctcctgagtaaatggcaacaattgtgacaacttgttgggttcattttgtgatatcaatgaatgcctatggagaggaggttgaggcctcaaaactaattttctctaagtcaaattcaaagccaagtctctggggtgaaaagtgaatacattaacctattccattttaaatgattgcaataaacactttttaaaatggatgcaaaagattagttctcaaagaaatattttgatttgtgctaaaatattttactattgagaactaaatctttttataaataacacagtgctttaattttatattgtaggtattagcctgctacaatcaaacatttgaaaatgtactagattaccttttaatggctattcacgttaactgaaaatatttccgaagattcagaggcgtatcttgtttgggtttttattggggaaaattaacaactcaagttgggagtaaactgacacattttcctgactgcttccactgagtaacctgcacctttcagaagcctgtatctgtccctcagtgtgggagaaagcaggcagggcaggctaggacaagaggtacaaggactgtaaacaaggatgagaacagaaggaagcagcaatggtctgatgcctctggaaacggttcaggggcctaccagatatcttttgggtctgtgttgtggtggctgtctgatatatgtcctctgaggttaggactccatgatgctaaactttccagtagctggaaagagctaggatgatttgttgcatcttttcacctccatatttatcctcttgtaacgttgtagcaaatgcagaactatccaagaagaattagactaagaattcaggagtgaatgactcgttgtccttggcaaataataaaaaccaacacagcagctgattccgaaaatgatacttatctgcatggtggctatttcagcaggaaagagaccagaacaaacttgtgaaacaccaaagcaaagcaatcttgaaggggtccaaccaaatacatgtgctatataatccccaggaaaattaaattgcaattccacaccacagtgtaaaattgatctaatattaaaaactctcttttatgtttgcacaccaaaaaccaacagcaacatttcctatcaacaattgaagaacatcacaaatataagaattccttgaacaatttgggcacgagaaacactagaaattccaaagcttgtcttctcccactggccaactaaacagaaaacaaacacttaaggtacccttctcagaagcttaggagaaactgagttctccaaagactatgtccatgggctcctctgaagcttaacagtcaaatttcccttcatgggaatttctgcctcaagtcacccaaaacatttattttttttaaaagaaacaatacctgtgctttccagataacaaggtggactaaaatactatctggtgtcacaactattcaggctcattttgcagtatgtgcacctctgtcttgtgtacctgtgagctgacactctggtctgataatatattctgcagctgtacatattaatttgtaagttgaacaatctctccgtgagggcagttaggaaaccaagattgaaattgctaatgtcgggtgacttcagctgtcgatgattatgtagtcaagtcttgactaaggtttccagaaccctggctaaaaatggaagttttgagacggtacaaaaatgaattcatacacttcactgatagtgaaactttttgaagaacagatgtcaagatgatttaagaggagctggaatttaacatcttaaaaaaaaacgtataggcaagttaggacagttcagttttcaagaaaaatccaacaaatgctaaagaagaagtaatttgggtgactgttattagagaaaaaactgactgattgtctttctcctcacaagctgtgggccctgtggagatgctaagatcagaaatacgatgggctgtctgctgagctgggtgacaaaaacaatctccatgttcaagtggcatggaggacttccactaacatgtaacttggacaattcaatttctccttggcatatgtaaagttttgtgtcaactgtgttttcaggtgctattctttccaattttgtcattcggccattttttattctgggccctctcccccaatcatgaaagtaaacatcaaccaaaacaatatcatttctgatccaaatctttctgtccattatataaaaggagctttaagtctttctacattgacttcaagcttaatgcctaagaattttcttgctgattttcacagttagaaaggcactcaaagtccaccctgtgtggctatatcttgattttgcattaaagccagtatagctgatgaaattctttaagcctttgtggaaagacccacctggttcaagtgtctgtttttagaacaccaatttttcctctctagccaccactctcatgctgtcatctaagtccctccatgaatttaaactcaaccacaggttattgtttctgcaatagcccaagaaaattattctcagggatgacagttcctcgaatgtctctctttatatggactgtctgtatactaggtaacatctagatttctgtctatgttatcttattagttgggatgtactcttcatgtccagtggagctgaagtagtggttttgttcacttatctaagagccaagtcataatgcaaacagtcagtagctttctgtacattgccaggtggccaggagtccataccccaaaccaccataaacagtaggcacaatcatcagcccctgttggggagaggcccaggactgagctagcagaaagactgaattacttaccacctctagagtgggtccctccgggccagggacgagctcatgggcaaggctgtgcaaggaagcgctctgtaccatgcctgccctgcggatatacagaggacttcagtctcctgcactgtcaatctctcagtcatcatgagctcaattatgcaccgacaacagcaagaacaagaacaacaacaacgacaaaacaacccccaaaaagctaagggtcacagactaccctgatggagggacagccaactggaactgtgcattgagagatggaggtgccatccggatcatgtgtctagtacgggcctgaccttttcattgttcctcaagcaaacattccattgaaggccatgagagagccacgtggagagactgcaggacagggccctcagagtcaggcaacttctcatccaatttgacgttttttggttttttcttttttttttttttcatttttgttttctacaaatacagatagacagacagacaaacccaagagcagatttcaagaatcaactgaggcacaagataaactactttgatgtaatacagatgttttcccccaaacgtttcacatgaaataaaaaaatttaaagtgtaattaggaaaaattgggggatacatccttgttgtccctgtattgtgccataaatatctccactgcttgccttagaagaatgcccaaacatatctcataggtagcacgtatccgtggtctaaaatagtcatcaaattctaatgacaccattaattcaaagcctaaataatatgctggtcaattacagtgaaagttgactgcctgcatcaatgatgtcttgtttcatcctgaggttcaaggcacagtcaaacatcattgctcagattgcaaatcacaacaccttacattgacgtgagtttgtaacttatggtgtagttcaaatgaaggcaattgatgaaagcagttgaacctgagaagtgggatgaatacagagcataaatccagcacacgtttccacatcaaactaccgatgccatttatcagggccctcgcaggccatgcccgtggtcgagcgacagcgcctctattcccagtcagcatctctgctccacagacatgagtacgaaacggcctaatttgtgaactagtggtgaggaaaaggagaccaaagcttaaaagaaatcaaggtgatgtttcctagaaacataccagctcttctaagaaggatctaggataagggtgatcagtaagtaattgatcctcctggctagatttcatgatttttctaaagcttcatggctggaaacactggaattcatcagaatatgtctctagcctctctcttcaacacacactcagtacaaacaggtggagatgtgccacttccgaccactacagattgaaaaaaaatgacctctgttgaccatggatcacagctgaaacattagtatatacttgaagggtcacagcagccagacatatgcgaattccaactcttcagaaaactttggacagaaaaaaaatgcattacttacatgtatgtgtcttcttcgttactgagatacctggaagagaagaaacaataacataggttagaaagtgccctgtgtgtgctgctttgaatgtccgtcattcccagtgtgctcaggaaggcgtttagttcagatggggaagtggaagcaagaccagttttaacattgcacaggagtgtcactagacctaccccaaaggcatgcaaccgtgactgatgaggcagcgaccatcacctcctggtttaagaggttctgtggtaaaagtggggagcatggacaataactaaacagggttaaacaggacgcgaggagactcttattttttattttaagtaggggagacaatcatgtttataggcagagtgggaaagatgtaaggcacaagagagcaatgccagcctactcagaccagggtaagatgagcaacacggcaattaatttgctatggccattggttctgtgtttactctttaatgaaaacgacccttcctcctcccatgaagcacaacttttaatggtgagggggaaatacatccaccaaatgtacctatgtgtctgtactcattaaggtcagaaagggaatcactgctacttctctaaaaatggcccccaaatgtttcatacagttgaaacacaactgaatgaaatgtatgaacacaaactacgaaaacacgagcgattcatgagtcagcacccttgatatttcaggatgatttataggtagcaggtgacaaatagaactaagcaacatttggcacagaagtcctgataaagatagcataaatgtatgctttgatgcaaacaacactatctccatttcagaattactacattttgaatcctttatgctgcattcttcttgggagacgttcttgagactaagtaggctcaaagtcataaaactgttgaaaacatttagcctgtgactaagaactgtggtaaaccttgaaatttttttttctttcaagttattaagggaactatttaaccctcctttggaaagtaaaagttgttgaaaaatttggcagccacatcagacctattacttagctagggaacatgtcgtacggggaagaaatctgttgtgaaaatccacggcagacattttttaaaaagttggttccgaagttgtgagccaagaccaaaatcacacacttgctccccccaacactttccaaaggacttatttagggaagttgaaattacatagcccaactcaaattcttctccccgaccccgcaacttttattgaggaaaactattgttttgtttgtttgtttgtttgtttgtttgttttaaatcatgtttgagttggcttcacaaagtgaagttagaaccttctaaaaaaatccttgaagactgtctcacatgaaaactacaaaagtgttctagaattttttgaaataacctttatcgtgggaagggaacttcccccagcagcagcagggagtaaagtttaaaatctgaatacaatttgcaactccagctcatgacaccagcaccaataaattgatacattagtgcactttcagcattatgagagatatatgtgtattttccttaggaaatagtgctttctgtaaaatcactttgaagagaaagtgcttaggctgtctctcctgattattcaaaacctccacacaattggatttaatacagcccaaaacgacctatctatattcgctgagtgtggaactattttctcttgacatccaaaggcctgatgaaaataccactgctttgacttttctacttaaatttattatacagcgtgatgcagtgttctcatcaaatattttcatgacgattacattgataatagattttgaaaatcttcccaagaaagctgcttgatctcggaggtcgcagtagctggcatggagctaaaacttttcattatctgtctccaggaggaagcatgactttggcaacaacacaatctctcggtccctcagttttgtttaactgtcaattaataatcaatataaataactgggagctacacttatattggagttgccagatttagtagataaaatacaggctacccagtgaaatttgaatttctgatactaatttgtagtttatcttacattcaaatttaactgtgcattctgtattttatatggcagccttaacctatacaagaagaatgtaaattatatttattatagccaatgaagatataccaatcaattaataaacacatttttatggagaaaagcttagaagacacactcctgacacaagagcaatatttgttaaaattgcattacaactgcttaattatggagatacgactgtgcatgatatttaattttttttaacctagccattctgaagacagaagtctatttccctagagaaagtgaacaaacaaaaacaatacaaacacacaaaaggcaaatttaatgaaaaaaatcagaaaatgtattggaattctctttgatcctctgaaacctaatttctccatagaagctctagtacttcatagtaaatgattccatagaagtaccaaaaaaagcagaaaacatccttttcatttcacagatggggaaactgaggctcaggaaagtttaattggcataataagacatttctctgtggaaagttatattaaactggaagtacactcatggcaaatctttaaaaacactagtgtagatgtaccctcaaaagagtaaatactcaaaaaagttttactccttggagcataccactcagcagtcagctctgtaaataatttaaacctatgggagtgccctcagccatatttaaaccaggaagactcatcctgagtttgggtgaaagatgtactcagatgctgatgcaaacacacagaaaccacagtccctactactagaagagcatattgaattgaatctagaatgttccggaatattctagaacatagtattctgccaggaatccagctgaccgaattacccacacttgcccaccttaggccttcattcgcagcaggcatgtgtgcctgggtttgttaccagcagccattttctcacccttaaatgagggatgggtctccccttttctttttctcattttcctagaggttacaagattcctgtttttctcaccaggaggagaggtcagcctcagtgagctcatagcagtcatacattgccagtgtttttcctcaagtggaaggagaaaggccttcagaaaaaaaatcgtatgcaaacctagtgctaccaccagcagtagctctgaatcgagatttttgggagaattaggcttactaaagataaactacaataagtctcaaggaagcaaataattctgattctaatgaggaatccaagaataaaggcagctcttaaggtaactagatctggagtcaagctgacctgagcttgcgtgtatagcccattttcctgcttctaggttgagagaccttgaacaagttacttaacttttctagtcctgaatttcttggtttttaaaattgtatacaatcatgatgacacttaaaagactgttgtgaaaattaaaggaaataaggatgtatgaagagctttacaaattgggaagtgtgacacaaatgactttggtaaggggtgagcaactcacatagtattagtttaaccaaactgaattaccatgtgatagtgaaagctatgccattgctactcatgatgtccctcagtttcatactgactcatggcctaggactctggttttcagaccaagtactctgactagaaaatatcctcatatttgatggaagacagcatgagacggagaaccaagttccttaaagtaagtgtactctattctagatcccaagctccattcgctttactctctaaagtctagagaaagagcctggtatggtggtgggtacccgtaatcccagctactcgggtgactgaggcaggaggatagcttgagcccaagagttcaagtccagcctgggcaacacagtgacacccagtcttaaatttaaaaaaataaacaaaaggaagctgcctactcactagcaagtggctgcattatccaagtgggctgctgatcagcacaggcaaggactttggtccccactaccgaagggcatcgaaccaagtccagctgttgtgcaggttttgattcacttccaaatgactgggaagaacaccaagatccttccccagagattcacaaacagaccacgagcagggtaatgctctctacagagatagggacttgatagaattgtggtgaatgacggggtggaaccaagtttctaaacctaaaatacacatacaccctgcgcccaaagtgaacacggtggatgacttgggcaaataatttagcttctctgggtcttagttttcttatatgcagaatgaggtagtcagtgacattttttttcttccagacaggttctcagtgtgttgcctgaactggagtgcagcggcaccatcatagctcgctgcagccttgacctcccaggctcaagccatcctctcacctcagcctccctagtagctggaactacaggcatgtggcaccatgcccagagaatttttactttttttgtagagatgggggtcttgccatgttgttcaggctgatcttgaatgcctggcctcaagcaatcctcctgcatcagcctctcaaagtgctggattaaaggcgtaagccaccttgcccagccaacatgatttcttaatttcccttccagttcatcaaccaatggctccttgccctgcttctaagctatcaagccaaaccacatctttccaagcaacaggctgtcagatctatttctcactgtaagaaatccaatgtggctcataatcaaaggtaaccccctgaaacttttttcttcttgcctttaacaaccaaagaagaaaaaagacagtgcccacaaaaggttatataagtaaaagatgcacttttcttgggagatctttaaaaattatctgggctagagaaaaatggcaccttttgataaagctgtaagactccttctattttacccagatacacatacacacacacacacacacacacacacacggcaggtgtatttccagatttccaggtaatgcttgagcacaatttctaacttaacaatatgacagaagttttaaattgccaattaaacccctaaaactaagagggctaaaaggccccaaaatattcggtccaaagcaaagttgagcttctaatacagcaaaaatgcttgactctctttaactggccatgcttcaaagtaaagcaaaggaaatgtcatgaaaatatcacagatttagccctgccatggttatcagtagggaagtttcattatagtcatcccagaacagagcacttcaggaatgtaagctggtatttcccgtcagtgccaaatcttggaccagttaactttcttgactgacttctaattgtctcttggtttttaggaaattgtctgggtatccagttaattttacttttttttcttttttttttagtaagaggtggcatttttcctcttcccaaattttgcaattaccaaaccagcatttccagaggccttgtatcctggacaaggccctagacttgatgccactctgccactttgccagtattcagcctgtgtgtcttcttttgtcctcttttgcaacgagaaaacaacttttgagatagagatattataaacatgaaaaaattctgtgttagcattaaaaaacgaacaggctggtcatggtggctcacgcctgtaatcccagaactttgggaggccgagatgggtggatcatgacgtcaggcatttgagaccagcctggccaacatagtgaaacccacagtctctactaaaaatacaaaaaattagccaagtgtggtggtgggtgcctgtaatcccagctactcgggagactgaggcaggagaatcacttgaacctgggaggtggaggttgcagtgagttgagatcacgccactgcactccagcctgggcgacagtgcgagactccatctcaaacaaacaaacaaaccactcaaaaccatgccatgtagatttccttttattttaaaaatatgtcaatatttttactttgcaagtgaatgtggcagggaggaagagatgtgttgagtgataatgaacaaagtcttgaattggcccaactcatgtctctacaccaggcttgcacattgactcctcctttaattcctagaaaagcagggctccaaatctgaaggctttcacaagatttattctccctccctgcaagatgtctgagttaaagaagacacctattatttaagctatgagcgcttgggcaaatatagcttaacttctctgagcctttcttttcttattccataaaatgggaataaaattcttaggactaggtttatagtaaaatgtaagataattcacgtggggcacaggatatagtacctctttcctactaaagtatgtttcttattgcatacaccttgtgaatccactttatattagacaaacagagagacaacccttgactggacataggcaaaacccattaatcctgttattaaacgggataatccgggaaggcagcattggagagctaaggaaagaattttccaaataaaacccaaacacttaacccactccctgccacattctcaacaagcatgctgcaaaggctgtggtctcctggatccgctgtgctctccttacttctttttgacttcctcattgtgaggcgctagcagttaaaacggcaaatttacacgcagtgcatgaacactagctaagaaacgaggcctagaatttaggcttcttttttgaatagctaataattgttttctaaagaaaaaatatcactttgtgctggccttatgtccccctcctcctcaatcctgagttgtcccaggagactgctccattctacacatagtcaaaaagaaaatctatgcacgaggcggatccggaacacagcccgagtagggcctcgccaaacaaaatgatgttacaaaacaatgtccttgtctaggacaaaagaactattaatgataatcagtacatattactgaaagtgctccaagtaatctttggactttgtttcaaaaattcttaatggacactaatgcttagagttcactcaaaagagaaataaattatgtgccagggttgcagggaccaaggacaacacgtggaaggcatcaaagcattagcaatgttacgacaatcaaacattttgtaattgcataaaaagcctttaaaaatcatttagatatactaattatgaacattaataatactataatgggaggtttcttttatgttcgatttgagcctaggttgagctgtttcggcaataatatttcagctcttttaccaaccaaggtgctttggacgccatgaaaaatattccattttagtttgaaaaatggttatgggaatggataagaggaatttttcctgttttttgaattcaaaaaaaaaatttgtgattgctctccatctctaggtcatatttcctgacattagtgcccagaaatatcttttaattttggacaggcagaccagaagtatgccctctttcaagtcctgcctttatctttaacaaaacagttccaaggacaaagcctcattccgggttccccagcaaaggcaacataaagagaccatcagtctatcagagaaagaaatcttcagacaaaacttatttgggaaacatccctcttctcagagattactattcaatgcactacgaaaagtccatatgtaaggagggcaatttctcttgttatttactcgtcccaaagtatgattagtacttatgtatagtaagaatcataagaagccttattttttcaaattgatttccttttattgagtgtctgtatggaagatgatgctatccattcgatattacctggttgatttaaatttgatcttggagctctgagggcagaggtgtgaactgatatcaacactttcagcttagccttctagaattgagcagttttatcttctaagtgaataattcagctcaggtaaacatcagcagcttacaccatgcttttccagaaatgctttactttatgtgcctctgcaatctgttaaatctgtttatctttgtcactcatatgggcaggtacggaagtgaactgtctgtgggtgacttgcctggatgccggctatagctgcagcccccaaagtcgaagctaccagaacaggttggatgaggatggcccaaagattatggagttgctggccccaaagcaagtcagacactatgggaagtttgcatgaatcatgcccttggatagacaacctaaatcatacctcatcgagcatggatcctggtcagcataccaagtcaaggcaagtaaagactgaagaaatatcacctggtctgcagctccccccagaacgaagtctgctactgatggcagaagcatagatagaccaagggtatcactatgtaatgatggaagaaggaaaaaccccatgcattcactcatgtcttgaatcacctagagaagagagggaatctgccaaagtggacacaatagaaattcagttctaaatttggaggaaatgaggcccactctcagataagatgaaaagtaaaagccctaggatccaatggggtattaaacaaatatttaaaagtagagaggtggtgaccagttatttcctgatatatagaataccatgggtccataaagaattttttagagtatcaatattattaacactttgaagaagacatatgaaaaactgattaaattataaattaggaaatcatagatcattactatttgtagcctctctactcccctctgattacagaactttaggcagtttgtctggattggtgattgctggataaaagctcaagaaaagaaagtagccatcaagatacttctcttgggaggccgaggcgggcagatcacttgaggtcaggagtttgagaccagcctggccaacatggtgaaaccccatctctgccaaaaaataccaaaaacattagctagccatggtggcgcatgcctgaagtcccagctgctcaggaggctgaggcacaagaatcacttgaacccaggaagtagaggttgcagtgagcagagattgtgccactgaactccagcctgtgtgacagaatgagactccgtctccaaaacaacaacaacaaaatacttaccttgcattcacagattttatgaagaaaagtttggtattgttagattagatgtacaagctatgttcccatatgggattttagaatcaggaaatctggattcttttcccagctctgccacttaccagctatataatttggggcaagatactctctccgatcctcagtttcctcatcactaaaaggagaggaaaaagatttcttctttcattctaaaattccaccactagaaattttaggaattaatcatgaatatacacaagagttatcataatattatttatatcagcaaaacattcaagggaacacccaaatattagcagtagaggatggcaaataaagcatgatatgtttaccaaatggaaggcgctaccatcattaaaataaagaaaaataaatcagagacaatgatgttccagctgcattatgagaaacaaaaaaattcaaagtcccaaagcatagtatatcattttgtcaaaaaaggaaaaaaaaatgtatagaaaaaagacaaaaaatacatacaccaaattaatgagagtgattatgtttgggtggaggaattatgactgatttttctttgtctatgttttctaaaatttctataaaacacctgtacaaataaaattataataataagaaagaaaagttaatattaaataactattccacaaggttactgtgaagataaaatgaaataaagcaaggcaatgttgacctaatattagtttttaatattgcaaacatctctctgtgactgttaggagacccagtttcctatggcaagtactaattgcattatcctttctagagaaccctatgtgaagtctgaagtgaaagtgtgatagcatagctggctactttcaggagtgccctatggtgatggataatctgataatacttgccaaaatggtaatcataaccaatatgctgataaaggtctgaaaaataaggcttgcttagtaccatgtattttacacagtgctcgagaatgcagtgagagacccaggggctgacttgggacaacttttgactcctaggaaaaccaccaccctttagctaccacacaggtgtttgcctaagccaatgactatagggcatatgactacagtgtcaacacataccagcaaccaaaggcctgtggagacctctgcagtacaggtgctacctcagagactgatcacaaaatcctcaaggcaggagtgagccctttcatcaggacctcctgataaatctccaggagttagtgccctgtaatacaaagaggatgacctctggagtcagaaagacccaggttgcaagcccagtttcacctaccaactagtcgtttcacttgaggcaagctacttagcttgagcctcagtttcaatatctgtaggatggaagtaaggatacctttttcatgaggctgttgtgattatcaaaaggtataggcagtgcaaagctgaaagtggtcagctgtcagtgaattctattatctaagcaatgttatctgatggcaatgcatcttacaggaatgcattggaatgttccatagagaaaggaaggaaaaaaggcccatatgtccttgggatgagacactaaggtggccccgagcttcagaataaactatgggttcttttggagattgacataccttgttatattttgattgatttcaactagcacagttcttctcttttaaattattctttttccatttgtctttttttaaattttagttttaaaaaggttgtaacgggttgagttgcatcccccagaaagacatattcaagtcctaactcctgatacctgcgaatgtgacctcatttggaaatcatatctttatagatataattaagatgaggcaatactggtccagggaccagtcatctgaatacttagactaagtatttagatttagtctaaatttaattactactatctgtgtaagaggaaggagagggagatgtgcattcagggacacagacaacacatagagaaaaaggccacatgcagatggaggagggattggagtgacatagctataagctcaagaatgccaaggatttctagcaactaccagaagctaggagagaggcttcaggaacttcttccctaaagccttcagagggagcaaggctctgctgccaccttgattttgggacttctagcatccagaactgtgagagaacaccaccatcctttagctaccacacaggtgtttgcctgtgccaacgacaattggcgtaaaacaatttctgttgttttaagccacccagtttgtggcactttgttaccacagttccatgaaattactacaaaggtccaggaaatgttatgagtgtaaggtgtctggcaataatactctggggtcctccaaaaacagagtgcagttgttttcttgctgccccaccaaatccattctcccattcctccagggcagtcaagttttagatggacacatagccatccagttagaggctgtaattcccagagtcccttgcagctgggtatggccaaaagactagattcttaccaagacatgtgaccaggaggggtgtgtgtaacttccatgtcacttaaaaggaagctgttcactctggatatcctttctctctctcttcccatggactggaacttgcataaggccatgacccagctccagccatgtgggcaaggccacctttggagacaggagagagcacccagacaggacctgtgagcagagcttccttggcagcctccactggcttcaataccacaggagagagaagccagcttctacctcatataagtcactgtgttcttgagtctctttgctacaatagttttcaacctttaccctaacaaaaacacagggttaggaaataactagtttatagattaaaatccccaaatgttagatctggaatagactaaagaaattgtacctttccctgaaaaaggacagcaaactgggactcagagggattaggcaactgttttcaagtcagccagccaattaggagcagagcaaaaagtagcaccctacacaggagtggctctgtgggctctgaggcctggacgcgttgaagtcttcctgttaccatacaggacacctcaactggacccaggaacaatttcactagccttacttagaagctccatgtaagccagagtgactttttgaactataaatccgatcacatcagtcccctgctcaaactccttccacagttaagagggtcctacatgatccggcctgcctggttctccgacctagtgtctccctctctctctgtctcacccatctcattcttccacactagccatcttaaattttctctaaagctctaagcttgctccagactcacatcctttctgtttgtagttccctctgcctgtatcactttccctccacttctccgcaggtctccttcacatccattcagatctttgctcagctctcatctcctgctagaatgcttcccagccggcttatccacattcgctctccctgcccccctctccattttgctttactttgtatcttcacaatagttccctcctcctgacattctatgatacagttgtatgtcttcccaacaatttcaattcttgaagcagggacttcccatccttggtataccactgtatttgtgatgcctagaatggtgcctggcatatagatactcacaaaaaattgttaactgaggatcagaaaaacttgttaagtgaatgaagttgactccccaaagccacacatctagtttaccaatagtgactccaaagctcctggaagtgtgtagagaagacaagaggagcatagagggtgagacaagtgctaactgagaaggtcggggacatctaaagagaggtttgcacagctgaagagaaactggaaggctacatacaaagagtgagaggggagagaacacacgctaaccccaggacccaaagcaaaggtcaggcaatcaatagaaaagttaaaatggcactgttaaacacttgtgataaaattgatttggtcattaccagagctgaacacagggcatgcatgcctcatctgttagaaagatctttatgatcttgttagcagatccccaacccagaagctgtaaaggttataacccaacttgtaaaactaatctcatattggctctgggataataaagaatctgcagaaaactttttagttaaccatatgctacatacagcaagaagccaggcttgtgtggctggcttctcctacatggcaattcaggataactctctcatttctgagattgagaaaactattttggaaacagtgatttcaatatgcatagttcttagatacaacagcttagaggttaacttgagtttaacaatttctctcctattcaaagtgattttataataaaaagtcagcatgccattcccattgaattaagctgggatcagttggaatagtagtttggcaaaactgtttttgccagatttttaaaaaaatacactttatttttaaagatagctctgttttatatttgcataatcccaattgtaaatatttagtttattattattattacttaatctgtgaattttgggtcattcttcctaaataaaacaatgcagcatcatttcttgactaatactcttttggaccacatggcaggtctgtggggtagtacagaaaggaaaaatgagttcacgctacatagcaggtccagaaaacagaacacaatagcaatcacaaaacatttctaagcagccttgtaaaggaaacaagggagaatgtgagagcactgggcatttacttttgagcaggatgcatgctaaaatatgtaaagatgaaatgatatgatgtctgggatttgctttaaaatgctttagcaaagggaaacagggatagataaagcaagtgtgacaaaatgttggtaaggctgaatctgggtgttgggtatagggcagttcattccactgttgcccctctttgcattcatgtttgaaattttcataataaaaaattcaagccagtaagggctggctggaaaactttaaaaagaggttcaatctctctaaaactgtgtgactgatcccaaccaaaagaaagcccaggaccagatggatttacagctgaattctaccagagctacaaagaggagctggtactatttcttctgaaactattttaaacaattgaaaaagagggactcctccctaacacattctatgaggccagcatcatcctgataccgaaacctggcaaaaatacaacaaaaaaagaaaacttcaggccaatatccctgatgaacattgatgcaaaaatcctcaataaaataccagcaaactgaatccagcagcacatcaaaaaacaaatccaccatgatcaaattggcttcatccccgggatgcaaggctggttcaacatgtgcaaatcaataaatgtaattcatcacataaacagaactaaagacaaaaccacatgattatctcagcagatgcagaaaaggccttcaataaaagtcaacatcccttcaggttaaaaactctcaattaactaggtgttcatgggacatacctcaaaataataagagccatttatgacaaacccacagacaatatcatgctgaatgggcaaaagctggaagcattccccttgaaaactggcacaagacaaggatgccctctctcaccactcctattcaacatagtattggaaattctggccaaggcagtcaggcaagagaaagaaagaaatattctttcaaataggaagagaggaagtcaaactgtttgcagatgacatgatcctatatctagaaaaccccactgtgttagcccaaaagcttcttaagctgataagcaacctcagcagtctcaggatacaaaatcaatatgcaaaaatcacaaacattcctattcaccaacagtagacaagcagagagccaaatcatgaatgaactcccatgcagaagtgctacaaagagaataaaatacctaggaatacatctaagaaggggagtgaagggcctcttcaaggagaactacaaaccactgcccaaggaaataagagaggacacaaacaaatggagaaacattccatcctcatggataggaagaatcaatatcatgaaaatggccatactacccaaagtaatttatagattgaatgctattcccattaaactatcattgatttttttttcacagaattagaaaaaactactttaaaattcatatggaacctaataggagcccgtatagccaagaccatcctaagcaaaaaagaacaaagcaggaggcatcacgctgcttgacttcaaattatactacaaggctacagtaaccaaaacagttggcagcatgttttcaatctactttctgatttcctcatctccctctgtgaagtaagtagtgaagatactgttggatccattttgcagtgaggaaattgagtgtcagaaaggtggaggggcatgtttaaggtcaaatggtccctgtaaggcagagctgggccagagctcagtcaaaggtttttgtttcagtggccattaaacttatttcctcctcctcctgacactggcccagtgatttaaatgctcctcccatgcccacatcaaaagtcaaaggtacccggcaaaaagcacggaagatgagcatctgaattctggctcaagagctccctgtggtctccatgccttgcagcgttaactctttcaccaataggctctcctagctttacattctggttgtcccttctcatttcgtacagtttggatttgacaaatgagagtttcgatggtgtattgttgtgcacataactgcccctccgttctacccaccttgtatttgtgagcaagagatataaccaggactggaggggcctcgcccaaacctcgaggacactcctcactgccagggtgacagactggacccttatgttattgtattatccaaatgcatgtggatcaatcctgccacacacagccaagtgttcccttgtctttgcttttccccacataatgtaaaaccagcactctcaaggcctttacaaattggtaaatcaacccatatgcagcgaggtcactttagttacctctaatttcagagctgtcactaattggtcccagaatctctttaaattcaggtctacagggccagaaagaagcttgaaattatttgaatacctcattaatggacaacgtatgaacaatttgatctttcagcgcaaagtgggatttatttgtctatgaaatctcaggcttgccatctacccccggttgactgcataattgttcttgctctgccccacgttagtcaggcactatgttaggtgacagggaaacaacggcagacaagatagtaatgatccctgtgcccatggtgcttaggaggaaaggcctatgtatgtattctagtaccagccaaagcctctgcttagtgacccaaattccactctgcccatacatgttgcatcagccccacccacgttcctagaagccatctcttctcccaacactgctcttcatatccacaactttaaggagcaaaaagtattttagggacactgaaaaaattcaggctacactaacttagcccaacccttagcatgttctcttttcgtctttgtcacttgagaccctgttgacttttttttgagggtgccaatatccatccgagtatgtacatgccagggacctcttcttggcttatacatttccttctacaaacatcttgatttttttttttcacttgcatttcaccagatcctgttacaggatctaaatattccaaataattcttacaattgctatatgatgaagagaacggatcctgttactctttatttacgtacataaaacccgtgcctcagtttccaaggtaacagaacaaagaaaacaagtcatcaccctgatgccaatacggacgaaggtcagacagctttgatctcagacaccaggcacttttcagccagcgcaacattctcatttttcatgattcctgcctcgcgcccccacgtccccacagctatgcttcctgtggcttactgaagggtgctttaaatatggctcgagaaagtacacggaggaagcaagtaaactttcaggattttagttccagcaaatgaaggcaaaagtgactaatcagagtgaagaggactcagtcaggagcatcagtcgcagaatgaatcagcctcagccggcaagtaatggcacaaagcactgttcccgcgaccaccaagccacagataaaccaccggcgcttcaaagaactcctacatcacttataagctgacagaagtcttattattattatatattatgctgaaactctgagccttactgtaagtcatcattttatatagttttcacaatgacagtaaaatcctgccacaagtggcactgtcaacttttctatgagcactttcttttcctcacggtgacattcaaagttcagagtctccttcatctaaaggagctgtcctatcagctcgctaatgggaacaattcatttaacctgcactccaagtacagccacggagccgagtaaaatatgtataggatccagggggaatcggtcctcccagctggcccctcctgccatttgattcattgacgagagtcccactttctttccacttaggctgatttacagaaaaaaaaaagacattccagaaaaattaagttaactattagccaaatcccctctagctgctggcttggattatataacaactccctaattccagaagctaaggaacagaaggccagcattttctctgatttcctatagttttaaagcctttccactctaccctccttttctcccagcccaccgcaccaccacatcaccacatacgcctttgacagtctacatggctcatattcctcatttactttaattatattgggtgcttctgcttacacactgcaatgtatcctggcttcataaaatactcactttatatgacccttgcttgctgcctttgacccactcaccgtgaaacacttgcggagccaaaattctaggaaaagcacctgcagttattaatgcattaaaccagtgttctgaaatgactaaatgcattatttctgctgtagaagaaaacgctgaggtgaggccagagcaaaggtaaaagacctggttttcctaaaatggatatagccttagaggcatttatattctcggaggacacagtcctgattcttctgatcatttttcaaatcgacttaatgagtgtgagatggcctgctcattaaactgatataataggtaaatatcacctgcatttagggtgggcaacagaaagagggcaactgttttctgggattgtaaaggatttgcaaatggagcaaaaatgcgggcctggtttctgaacgaggtttatgttctgctctcacttttgactggctgccacaatacacagggcgagagatttttaagctttcatgaactaaaagcaacgccaattgctatggattgctttttatagaatttcaagtaatttcacattacaaatgttacctctgcttatgacttccttaaaagataaccaaatgccaagcccattggaataaacatctagagcaaagagctacatgtaccccaacaaactgttttttcaaaagccacaagcctaggttagatgctttgtctaccacactgccgctcaagtgaagcctcccttcttccatcttccaagtacagccaaaaccctaaacacaacctttttaaggatcctttacaaagtggatgttaaaagtgaacaaaacctcattgaaccatctattcttcttgctttaacctgcagagtcatctacatttgctatttccttcaagtctacttttttttttttttccaaacactggaaacttcagagccactcacacattgcagtaattctgcctgcttgctctacataaaataaggcctgctcttgggttcacacaatcaggccggttactcagtagaatccgtggtctagggtaactctgaagagacgtaaatttctaatttttatactttcctcaaatttcatatgttatttttgttatttcaaaatccagtgctttataataaatttatagggtgcctaagggggtctccattcatattacatggtatctcattcacggctcctctgggagagaaacacagagttatacctctcagtcagccaacaacacttccgcttgtgaagttcctatataataatgagaaacgaggctcctgtgggtatcccacacatgtgtgtaaaataaacgcctacaaagtgaaaatgatgccatgctacacttaaagcaggatcatgtgggtaagctggaaaaaacacttccgtgtctgtagtcgtgaagtgattctgtattttattgtagacattgtatcaagtctcagtttcaagtgatttttatatatactccatgcttcagctgagatgtcttctgttcctccttctttccaggagcgtcagtagctatagtcaagtttcaagaatggggaatgctgtgggagtgtgcaggcaatggcctaaaaacaataaaaaagccccactaaaagctggcttgcttttgattattactctgtcctgacaattcttagtaatgtcagtgataaaataaattactgggccgaccactccctagcctgcccctcgttgacatggcactgtgaaagcactccaatatctttcttaagaaggatacattatgatttaaatactgaaaatactatatattcactgtaggacatgtagaaaaaaattttaaatgttttaatggagaattaaaatttacattaactctaccacttattgataatcatagccctttatgtcataattacttttttggttattaaaagtaattctactataaatatccttgttacatagatttcttttggcatttgtgtttttttttttttttttggaagtacattcttgaaagtttaacttttaaaaagcattgaatagatatcatcgtgtcctgtaaaaagtgtttaccaatttataattcctagattagtgtacacctgtcccaatgcagaactttatcatgaaaaataaatcctgataatttaactggctaaaaaggtgtccctttaaaattgacatttctttgttcatttatgatgttgttttgtctgcatttttaaaaaattttgtttttgttgtctaagtttcttgacttttgtatttcctcttttgttaatcgcctgttcataatctttgctcacttttgtattgtggtattagtcctttactacttactaatttataagacttctgtatagttaatcatatgttgcttgtctccccagtttttcttttaaattttgtttagtttgtttcttgtatatgtaaactagctctaccacttattgataatcatagccctttatgtaatttctacctttttggttattaaaaataattctactataaatatcctctttaaaatatccaatctagtaatcttttatttatggtttctgcctttccttgcatgcctataaggactttatttattgcaaaaatatattcacctatacttaaaatatttttatgattttactttttatgtttaatttaaaaattcaaataaaattatctaaatatacttttttcttgctctagtttagcttgcacagaaattgtttcactccacttctcaagatttgaatctaaacaacacaccaactatcttatgtctttctttgttctcccgagaggtatgtcactgtgtctgttgtgtcagaaaaaaaatcaggatatcaaaaaggcttagagccaaattctagcccaaaacatttacatgtagaatctgagttagctcacctcttctttagaaaataaggccaaccattgagatttggggcatctacttcttaaatttgtttttactgagtaaacctgggcaagtttcctgacttctttgtaaaatggggattctaataagagaagcacagtactgtagcatctatatttaacactttctgtaacagattactggtataacaggaagtttcacttttatctttattgtatttagtttttgcctgccacaataactacttatgatattttaatatttaccaagagttttccaaatagggctgattctattaaaaaaaaaaagaccccttgtgctatttatacaagcttgtttagattaggattatattcctgaagctaagagggcttcatttgctgatttcagacaaagtacgcataaagaacatgaaatgacactgctgagactgttccactagttttctgttttttgtccggaaggaaagccagggaggtcagagagacagaaatttctttgcagagaagtccaccctgcccagatatgggaattgtgctcattaggagaagtagtgggggagaggacgcacatattttctgaaaaaactggagcatgggaagaataatgtgcacactggccatcaaatgagatttgaataacaatttaccactctattcaaaagtgtctaaaatataacaacccctctttattactcccttttgccaggacatttgccatcccagaggtactaagggacaaaattttcagcagcaatgcattccttaaagagaaggacagcagggtagttgaccttcgatcctgtctgaccataccccaaatccttgacatccttagctttgcagaaactggaggaagcagagccaatgtgatgatgcttaagggaaatctttcatgccactgataggaaacaggaatccaaaggacatttttaactcattcctcaaagatatggggatgagtataatttacattcatcctctacttcatgacggggaaagaacagcccagtagtcaaagcaagaaagaagtcaggaatcttttcactggtgtatttcatcagcaataaacgtttccccaacaaaatgctgtattcaaggcatcaaggaagttacttaatgaagaaaggcacctggcttctcagcctttatagctctccaaatgttccatgtttttaaagacctccaagcttttttctgttccttcttctagggatgctctttcctttttcttgactgagctaattcccatttatccttcaagatccaaagcagggcttcactttgccatcacacccagagtatattggttgtctctccctagcacatccttaatccagcctgctgtggtctgttgtgcaggttggtcacagtccaaggtcatgggtgaagggatgggtggggacatgtttcattcgccgactgccaagccatgtgccctggtttgggtttgcctccaccccgaggaaggaggcaccttttaaaaatcacccaaaggcggcctactcttctctgcacttaccattctcttgtttacttgtctgtctgttcactactcccaccacgtacattcatccctcactatcttccctctcaaagaatatagaacatcactccttccaattaagtacacggacaatatcttttatctcttgatcctaagcccctgccattgtgtctggcacataatagcttcttggaaaatatctcttgaatatttgctgaatgaatcaaatgtgccttcaggaaaggtacagctttatgcaaacaccttagcttcctagaagtagtgtaaaaaaagcttcacatgggcaagaaccaccatggatcaaaggggactgaagaagttaggagaagtttatggaggaagtgagtcagtatctcacaggatctcacagagaaacttctaactggggattcagtttctctcaatttagtgtccggtgaacaaaggatttggaactcaccgacgtactgcctctgctctcccctgtaactgtgagaatgcattcactagctcaatcactcaccgcaatatttatccatcacctaccacatgcagaactctgacaatgcccaggccctccacccgcagcacaggctccggggagtgccctgtccccgactcggtctgctgtgatttttcctgcccttgtccttgcgggcccatgctgtttctataggagagagaggaacggtgctcctctccttccgtattgcaaacatgctcaccagtgacctcagaagtctggagggaagagtgatgaggcagtgttttaaaagggctgtgaggttatcagagcctgttacatcagtctttgactcttcaaaggcctggaatactgtaagacaacagcaacttctcataaaggtcacatttctgtaattccctcttagaccctcccgaggaacgcttaattgatcaactaacatgcaggaaatgctctaaaaggcagttttcacaaactggtggaggataaagacaagatctttctgagagaggtagtttaggattatagctgagagcacaggcagatgatggagtttgaggctgggatcagtgcttaccagcggtggaacattgggcaagtcacttaccctctcaaagcctcggctttctcttctgtgaaactgaaataatgatggtactcttctcatagggttgtaattcggcttcaatgatcttttctttttttgagacagagtctcgctctgtcacccaggctggagtgcagtggtgcgatctaggctctctgcaacctcaacctctgcctcctgggttgatgcgattctcctgcctcagcctcccgagtagctgggattacaggcacgagccaccatgcctggctaatttttgtattttcagtagagatggggttttgccgtgttggccaggctggactggaactcctgacctcaagtgatccgcccgcctcggcctcccaaagtgctgggattacaggcgtgagccaccgcgcctggccagtttcaaggatcttatgtctgcaaaccatcaagcaatgaccagtgtggaatgaactccttcaagggtatgtgaataaccttaggaagtcacatcacttataagccagtattaatattaatgttacctagcttggaaaattttacaaggattaactgaaacaatgcatgtgcaagtggttgtcacatggtaggtcctaaaaacggtagttccttaagattactggcatgagatttttctatgatgctatgtttaaaacttcattcttgaaggctgactttaactcggtttgtttgggaggaagccctctccttccatggtcaccttgtgtggaatgggccttttccctcttgccattttcattcaaaatatctgtggcagtgctgcggaatattccaatacgtccccttgacctctatccataaacagcctttctcacaatgagatgttccgagtttaggagccttgctattttcaacaaagaattaattgcaaagtaattaagtttagagcaagggaatagatgaaccctgtctatcataaaggaacagtgtggatggtgacataatggagcaaggagacgatgcttcagattaacacacacacacacacacacacacacacacacacacaatctcttttctaaagcacacaaagaaacctcccatcacatatattgacaagataaatctaagctgcttaaagaagcacttaattttgttctcattaagtcgcagggttaagggctttaccctcaacgcccatggaagcaatgttaggttttcaccttggaaagttctctgaggccctaagtccattgacaaatatagcactaagatgtgttacagaaaattgcatctgaaagccagttgctttgctggcctcattcccacttggctctgtgttcttcaatgaacatagaacgcacagagaacaccagaggggcacacgtgttcatccctctgccttaatgcacacaaattatgatcatcccactgtctgatcagcagtggatctaaggtgggagggtgtgcagcttagatggggacagtcacaagccggttttactactagagctaggaggcttaatcttcttaatagcgattaagttgatgccaccctaacattttctctggttatttcagggactgagaaggtgccagctcacatcacacatcctttctgatgatatgaatggagaagtctatgtcataatttaaggtgcattcttacacatcctgtgttctgattagagcaatatattgccagatacctcatctttgcacctgaaaacacagtacctgggatttaagaaatatttgagcacttgaaaggaagaaagaaaaaaaaaaaggaaagaagggaaggaagaaggtctagaaggacacataccaaaaatttaactgtgattgtatctagtaattttcttcctttctacttttatgtcttttccataattgttatagtgagtattgttttacttttatgacgggtacaataaaatgaacttgattttgatcatttactaaaactgctttcaaaaaacatcaattctaatacaacgtgctttaaaagtcttcattaccctcaaggaattttacctctgactctaggcaacacagccgtgacaaaaatgcgccactccaagcttcaatagacgaagtctaaagttaaggtttctcccgaggtgtttacatctcggctcttctctggtgctttttcatggtttggtttggaggtgagttgtaggaggggccacaccggcatgcggttgcaaggagagaagggtgttgctgccctcccggcatcacacccatcctaagagcaaacacaacccacaaacttgggtgtcatactgcctgggtggctccccaaaggtgctggaggcacactcctagagggtggggccgaggaagctgagatgcaaaaaaaataaaaacaatggccagggctctgttgggcaaggttttctgttgtcttctttcttcttgcccctactgttcacagtatttggctaggttttgcttaaatctttcagagaggagtgttaacctcccaaaatgaaataaaatataaaaggaaataaaataaaagcttgaaaaagatgaccaggaatgccatagaaagaacgtagagatagaactaaagtttagggtacttcaaatgcgtaatctaggtcggacgggcactgattcacagaatactatattagagaccctcacagcaagccttgttggttattgattcagttccagaccatggttacctttcggtattgtacaatattggcttgaagtgctccacgtttgcacccctgactcatattgctctggatggtaaatgagcttgcacacgacatcacattgctccccactctgacctacattatgttttgctgtgaatgagtttaatggattaacatctgattggcatgagcttccacgtgtgactgccgagggttggcaatgcttttcgtgagcccacagaggcattgcagacgtttgctctgagttttcgtctcgaaaattttgctttgtgttttgttttgctttcctcctagtaagagtatcgttctcattatgacatttttgtgccagaaaaaaaaaaagaaagaaaaagtgagcagttccctacctacacaatgaaaaacctaggtggtttttattgttatccaaaacacagggcatgctgaactggtttcatttgaaggcagggcttgtattaaatgccaaataaggaatttttacacaatgtggaaaatgaggcaaatacaaaatgaatattgggttgagttttccctgaaatttctgtggactggagtttggatttaaaattttccactcataacttacattatcaatttgtagactatcaccacaagtatgtgcataatgatgaccctgtgatttctgaacagttacttaactacaatgggatttaatcaaaggattcaacaattgtaggggcaaaaggccgtaaaatgaacaaacttagaactgtagagctgtctttactatgcaattatgataaaggtcgagacaaggccattttctaaaagcagagaggtgattgtagtgtctattttctttggtaactaagaccttaaaaacaagcttctgaagttatggttagaattagaaatccatcccattcccttcaccaaccaaccaactgacatttttttattattaaaattttttaaaatatatattctgttctatagactgtaagaattaggaaaactgggagataatttctctaaagggaagtataatctatttgcttaatgatcctacaaggagctaataagtatcatctctcttagaaataataatactttgcttttatatagaatctttctccaaggagtgcaaagtatattacagataatatctaattaatcctcttagggtccccaggtgaaagggaagtggcaggtattatgaaggttcattggcaccatcagcatgtctcaggtgaggaaatggagctatagaaagcacggtaaaaagggcacacgcatagttatttaggctagatctgcgtgacctcaaagcaccgaatccacccattgacaagaagaatcaattgagtttgagcaaaaaaacaggatcgtttgactgaatgctttgccttttccaccagctgggctcatgtagcatgagttttagtaggtttgccagtgaaagaacccacattacctgacttccagcctggtggcttcttcagaaggacagcatgggtagtacggattgcttcagtttcccatttgctgcttgacacagcaccctcaagcagcacatcagccatgtggctgtggtttggtttctcattgtccttttacgtttggttgcctggagtctgtccattgttctctgcaaagtgggtctgtatggggtattttgggggtggggcatgaaggaaggtagtatggtaagaaaggggcaggggattgaataatctgttttggtagcttctatctgttgaagcaataggagatacactacaagtctacatcttttgtatcaagataaatcacaacctgagtcttgagagagggaagtatttgtcctgctgcaagtgctgctccatttcacttttaaacattccatgggccaaattcagcttcccattgtcacaaatcctctctggagacagaagcccataccactgtcttgatcaatacctgatgaacaggaagagagtgcttctgcaaagagggagcaaaccttaaaataaaagccgaagtagcacttcctaagcttgaaactcttccactgacaagctctctgcagagttggggctcagctaaaattacctcccaaaaaggaaaaagcctccaagagaaaattcagtcaaattaacaaactagttgcctctgatgtgaactacatttttgacaggttgagataataaatagtttctgattcttacttacctagctcaggagaagttgatagtggttttacaagagaaagacactaataatgtcacttgttgtgcaaatggaggcatacaacatgctctgagggaagataccactttttccaatgttggaactcaacaagtccatccgatggccctcaattggccactggaatctgtaaccgttggtttgccactagacaggtgagcatctactgaagcttctcagaatggaaaagcttccattctggctgttgcgaagagaagaaatctcacccagtcccctgaattcactctagcctgctctctgactctagcttgcccctcatacaagtacgaatatttccctttaagcatccatggtcatctatttctttattttatttatttatttatttatttatttatttatttatttatttatttgagatggagtcttgctctgtcacccaggctggagtgcaatggcgtgatctcggctcactgcaagctccgcctcccgggttcacgccattctcctgcctcagcctcccgagtagctgggtctacaggtgcccgccaccacgcctggctaattttttgtatttttagtagagatggggtttcaccgtgttagccaggatggtctcgatctcctgacctcgtgatctgtccgcctcggcctcccaaagtgctgggattacaggcgtgagccaccgcacctggcccacggtcatctatttcttgaagccactcaactggtccttaagtccacccactgacataaatcctcttttaataacctcgttgacctcttcctctcccacagctcttctctgtttccatgaagttcccatttgtgtccagttcttggctggtacactggccatcctccagcctggaatatcaccctactctctaagtttagcctctccccttatttaatactggggcacatactaagttcttccagatctgcttctcatcctgttcctctcagccaccctgtaggatttgtatagaacacattgtatacatacttgagttcatgtttaccacccatttgcaggccttttttgtggatgtatgctcagcctctccttccaaactaactgtcacctccttggactgaggcttagagtttagggttttcaggatagagagcttatctgttaggtcctttgaaccgctccctagcattctggcaatagaggagccctctgtattattcgtgttgatagcccaactaggactctcctaggtacctatcttcttttttaaaacaaaatgtagcctgaccaacatggtgaaaccctgtctctactaaaaatacaaaaattagctgggcttggtggtgtgtgcctgtagtcccacctacttgggaggctgagacaggagaatcgcttgaatccaggaggcggaggttgcaatgagccgagatggcaccaccgcactccagcctgggcaacagagactccgtctcaaaaaaaaaaaaaaaggaaaaaaaaatgttaccaacatcacatccaagtggcattcaactctggcttgcattagaagttgagttctttgtcattttatgcctgtatgtgtgtcccagggtgggtgggagaaacacttacaaatagcttctattgaataaagggctatgaaggaattttccataacacttgcacaaaaattattgcatttaactccccaggctcttcatagaaatcctaacatcttcccctccctcccaagccttttcagttccctacactttccccccaaccctgttcccagggtatagcggcaatagagcagctaagtctgtttggtattcagttagaattatttatatatcagagctcaggcttgtttatgcagtagaatgctgaaaaggaagtgaatcagatctattccctaacagagcatccaggggtcagggtgaaaacaaatactgatgataaggtaaaatccatgttctacagtcagctttattatgaacctcaaataccacagccacgcaggaccaaggccttgatgtagtgcctgcatagctagcaaagaatacgtgagcagctagtcattcctatcctagggaagctcctgagcccatgagcatggggaaaatcccagaggccttcaggaaaccattgattttccatcccttcctccaggcctacacatcccaaaacttatatcagaaagatccgtggtgggattctacaatataacacaccctagcttgattaactttatgtaaacatatctttgaagtgactacatttaagtttttcagcagcagtaattaacagctactaccattcactgagtttctactatgtgcctggtattattatacagctctcatttaattctacaacaactctgagaaaccattagcattactctcattttattgattaagaaactcaaagatgcaaaatctgatatctatgaagtaacagactgaggattaacactcgagctcctttgattctaaagcccattgttttcctttagatcaggggtccttaacccctggtactggtcctgttaggaactggaccgcacagcaggaggtgagccgagggtgaaccagcatttccacctgagctccagattctgtcagatgagcagcagcatgagattctcaaagaagcatgaaccctgttgtgaagtgcacacgtgagggatctaggttgtgcgctcgtcatgacaatctaatgcttgatgatctgtcactgtctcccatcacccccatatgggaccatctagttgcaggaaaacaagcttagggctcccactgagtctacaatgtggtgaattgtataattatttcattatatattacaatgtaataataatagcaataaagtacacaataaatataatgtgcttgaattgtcctgaaaccatcccccaacactcctgccccactctgtggaaaaattgtcttccatgaaactggtctctggtgccaaaaaggttggggactgttgctttagaccaccctgcctctgtatgccacatgtgaggcagtggctgcatttagaaggtgggggctgaaagttctgctgaggagggaagtagtaacttgaatatcatgtgtctggtctgtcaggagtttttaccttggtttcactgcctcagaaacactcagggctggaggcccgataggagagagactggattcttatccagtttatgccactctggacaaagccctatcttgccttgcacttagacttgggaagacaggtttctccttatgttaaaaattagttggccaggtgcagtggctcacgcttgtaattccagcactttgggaggccgaggtgggtggatcacctgaggtcaggagttcgagaccagcctgaccaacatggagaaaccccatctctactaaaaatacaaaatcagttgggcctggtggtgcatgactgtaatctcagctacttgggcagctgaggcaggagaatcgcttgaacccgagaggcggaggttgcagtgagccgagatggcgccattgcactccagcctgggcaacaagagcgaaactccatctcaaaaaaataaaaaacagaattagttatattaaaaaatagaacagacaatgctgccactgtaagtcttcaatcagagtgcagataagtaacccgtctaagatgtggtgcaggatatgttcaagtctcaacccaggcaagagctctgtgatgagaagttgactattaatggctgggtggccttcacctggcatgcatttactcacattctcatggctgcaacccaatttccttcctgagcagtgggatgatgttggtgggctttctggacagctcctgtggtgcctctgaaaagcagggctctgcttactacactggtcccagggcacagaagagggagggagggccccgcatgaagaatcccaggcaaacctccaatcctctatgctccagagcacacaaacaatcaggacctgtaggtctttcagcagaaggggcctcagagatgatccctccaactccagcacttagaggtgggcagacaaggcaatgagaaaggaagctccatgcttaacactgctgggaagtggtgtgctgagactagaattctgggctttttaaactccacatcatcagagcttctccagccttgctctgcccctgcagcccaatttgggcacatttatcccaaaagaggttttgcctctgtacggcctcataaggacgggtcactcctgtccctgctttgagtaactcccaacacagtctccgtgccctcaaggctatgtgtatttctcactttccctggaactagtcactcatggacactctgcactcctacttctaaactgcatacttctgcaggcccaggcctacatatctttctttcttagctgccaacttctttttgtccaagtagctgccagcatagaacaggtaatcaatacatatttattaaataaatgaatgtataatgaataaatatcaaaaagttgcctacagtactcaagaagatggacagtttcaggcagcagttgattagaagacaacttcagtaaggggtaataaaaggtggctcttcttccccatttttgcatccttccttcctcgcactcacactgtgaaccagaagggtttacctttagagtgctattctatggttgaagaggaggctaggctgagggtctccttcctctgtcttgtcagaagcacccctaatggtggctaataaattcgattgcatctatccttcagttttctaaccttctgtctcttttggtcctaccttcagctcaagggcttaagaaagaagatatttcttttggggaagatgatttaacctttgattggacctccaggtttctcaaaccctgtcagcaacccacctttgcatccaagacttactaggaaaatccaacatttaaaataccgctactgaaacaaattatatgataataaaacagcaaattccttagccttcccacagtcaccctcaagatgttataaattataatagaagtggtttcaattctttttttctgcaacagtataataaaactattttgtgatacgtagtctaataatacacagatttttttaaacaaatgaaatctgaattgtcagtgacagtgtatttttcttctatgaatattagaaatcttagcaagtgtggctgatactttcaaatgggactcatatcctacataggacatgttgataatatcattgcattaatttggggatgatgaagacttattccagaggtggtataccagttgttccctacatattctatttggattacaagtgattgtctaacatttttaaaaaagttgaagtatattccaacatttaaacatctagatgttttctttaaaaaggtgtgttttgttgaatatagaaaataggcaatacaaggtctttgttcctgcattatacaactaaatttggtctaaatgagtgactgccatctttagccaggacacaaactctctggtcaacataacccacagcactctctattgtctagtggaactaaggtcatgtgtcagttgccatttatcactgggtttgcatgatggtttggatttattttggcttatccttttgatatgtacccagacagcttaaggtatccacctaacttctgcagtcatctgcgataggacccagtgtattgcaaggcattacatgacggactggacccaattcaagctctggtacttgttcccgaggccagaagacaagcctttcttgcaaactgcacaagactcaacacagtcctactgcttccaggaaggcttttgtgactgctggtgctcagcttttctttatttccctgacgcggggttccccagcagccagaaccaatgacaccacttggtgagaattcacattgttgttcagttgcttgacttagaacagatttgtctttctatgggagaaaaaccctgaagatgaaaatactatctcttggacaagagagcctgacctctctctgctcacagctattggacacatatcctattcaacagagcgaatactttgaacctgggttaagcagggaaaaaaaaacaacaatttaggttaccttaatcagcaaggcaaacagacttttcatttcctttactttttttcagactgtggccagggcttccctggcaataaaagatcataccaaattgttctaaattatgtagatgatagttattaatataatcttcttccaaaagaaaacaaatgtcataaagccagcaatccatgccagagaagcccaggaatgttcccccttagtagggtgtccggctaacctgggcgctggcaagtcattcctcccttcacagtctgaggctgaagaggtcacttggtttgaggaaatggctcctcagctcctcctacccccactttacccactaagaaaaccaatggcgccttttatcagtttggcaaaaagacaaagggaatgtttaattctgtacttaaaattcttggttcctactgtcagcattcccagttctcagagaacactgaatggatatttgaagagttttgtgaaactgagactgaacagtggcaacgaggaggaaaagatccaaaattaaaagaacatttaaaaatacacgcccccgtacattccactctcctcacttttctctcctcctcaaccaagtcatattcagcccttaggaatattcccacaggagggaggtgatgtaatatcctcagactgtctgtgttccagtcccaattcaccctacctagccatgaggacttgggtaaggaagtgaacgtctccatgccacagtccccatgacagtaaagtgaagttaacaacagtgccaagttctggaacctgtcatctatgaagggctcaatacatataaactactatcatcattttaattttctaaggaaagcacctgattacaacaggatctgcaacgcagagtaacagctgccaactggcagactgctgaccctagcctttcaagctaagactttgcagggtaataaagtgaagctctctagtcatttcaaatgagtgaactgttctcacttggcaaaaccggggcctctagaaatccagaagaaattgaattagcaccttcttcattatctctctctctctctctcttttttttttttcgagacagagtctcactccgtcgcccaggatggagtgcaatggcgtggtctcagctcactgcaacctccgcctcccggattcaagcaattctcctgcctcagcctcccaagtagctgagattacaggtgcatgccaccatgcccagcaaatttcttttttgtatttttagtagagatggggtttcgccacattgaccagcctggtctccaactcctgaccccaggtgatccactggtctcggcctcccaaagtgctgggattacaggcgtgagccaccgcatctggccaattctttttatttatttattttttgagatggagtcttgctctgtcccccaggctagagtcaatggtgcaatcttggctcactgcaacctcaacctcctgggctcaagcgattctcctgcctcagcctccctagtagctgggattacaggcacctgccaacacacgtagctaatttttgtatttttagtagagatggggtttcaccatattggccaggctggtctcgaactcctgacctcaggtgatccacccgcctcagcctcccaaagtgctgggattacagttgtgagccaccgtgcctggtcaattatctcttttaaagaaggatttttcttcttacatagaaaatttgtgtttaagggggatcttgggatgtcaaaatgggctctgccttttcaatctgaaaatatactgatgtgatgtgtgaccatctaagaacattgctgcacttgaaatgtggtctataaattattttatagactgaataatgtaatcatcctcagattagaaggccagaagaggctgtatgaggccctcttttcacagaagagccatccaatccctgagagttgagagactatgaccaaaatcaagtgaggggtaaagatggggctggaattcaagtcttttggcttcccatcaaatgaatttttcatctcaccaagctaactctgatagctaggttggatgactatgctgttggaaagtgctgggccttgtaagactttctgattctagctctttttgtgagagaggatgagttttaataactacacaaacacccgatttattctcaagcagcctgtgatgcagggccttggccatacctcccaatgtgtcatcatttccatgggaagacctacaaggagcaggaatccaacatacaaggacatagtgagaagcaaagaggcatgaaagtggataagaatcttagtggtggaagttcgaaaccactgaataatgagaaacttttttgaacacaatgatgtggcacagtcagctgtaaaacatcttcttcctttgttagctttcttccaaagtgtcccagcgacaggctggtggtcaactttcatggtgtttctccaaagaccttcacgtggtgcctcatgacagacgttccttggagattgtctaaggagaatagaagaagcctggacaaacaaagctatgaaaaccacaacttcattcattcctgaaggtttgcattcacaaaaattgcacaaattgttctgcacattgaaaaataacaccaaaatcttatttttagaaagggaatataatgacacaattggggttcctttagctttccaaacagtgcccaacagtagtttccaagaaagtcatgagctagcttttttctaattgtgtacacagttgtgtttgtgtaaatgtacacaactgtatgcatgtacacaaacacactcaccatttaatagccaaaaatccctctaaaatgttaggggaaggaaagatccattttctagttcaagtcatcagtcttaaaattcacagttgggagaaattctgctacaatgaattatgtaaaaaaattatgattcttcctctcaacctaatgtaggagaattgccttcacccacaaatgatcttacgctacactagaactactcagtcagcatctttaattatcatttcccaccagcctctaggccagtgcttttcaaagtttaatgtgcatacgaattgcctggagatcttattaaatatgctaattctgattcagtaggtctggggtgggccctgagattctacacttcttatagttgccgagtgatgccacaacttccagcccatggactaaactttgagtagcaagattctagaccaagcccacttaacactgttctctcactagggcaagaagtgggctacagccaattttatggctaggatggtagacttctgtgaggtgccatattccctgtgaatcttcccctccttcagagataccgccttttgtatcatctttcttccttctcttctgaatgcacttgcagttgcaaacctaaaggagacagcctgttgcactggtccagggagaaaagcatgcaaacttgggtttgaatttcatcaataccacttacaggccaggtaattctctctgagccacatctgtaatatggagctaagatactgtggtgtgatcatatatattggttttcatccacagtccctggctcataactcccatatcctttgttacagtcttgttataatgttgattgtgtgaggcctcagggacaggtctctgatcttctcctgccctacagtcacctgccccaaagcaggactctactctttccccacctttctgattgtaggttttaagaccctcctcagagagagtcccaccctatactctgaagagagataatgctgatatcatgacgcttccataaaaacccaggagggctgggttcagagctgaatatgtggaggttcctggagaatggtgccccagggagggcatggaagctccgttccccttcccccatacttaaccctaaacatctcctcatctgtatcctttgcaatatcctctataataaactggtaaacatgttttcctgagttctttagactacttcagcaaattaattgaacccaaagagagggtggtgggaccctcaacttaaagctggttggccagacgttctggaggcctggacttgcaactcgtgtctgaaagcatggggggcagttgtgggaactgagccttcaacctgtgggatctgacaatatctccaggtaaacagtgttagaattgaatggaagggtacccagatggtgtctgttacttggtgtgtgggaaaaactcccacgcatgtggtcacagaagtcttctgtgttgattattgttgtggtggtatgtatgcagagggaaaactcagtttctgagaatttttcccaaagtggaaatccacccctgagcttgttatggtagataaatgagagaatgtacagcacccagaacagtgccttgtacgcaaccattcaacaaacagcagcaccctcttctctttcttttcaagtatcatgccccaagtcagttcttcatccatggtcccagcaggaaagacttgagggcatagcttgtaatacctatagcatgtaataaaagtcctatggcactggcagttagaaggcaaggtacaatcttcctttcttggcagtaagttataaaacctttatcatgtttttttgtcttctgtcatcactcctaaattggtatatttggcattgtcattaattaactaacacattttactgagcccctattatgtgccagacaataaataaaaaatacagatgaaatctccaaatgcaaccagctcccagattagctagagtttaggtagaaaaactctggataattgattaataaggtcacatcttcttctttcttttttctttttctctttttttttttttttttttttgagacattgtcttgttctgtcacccaggctggaatgcaaagatgtgaactctgctcactgcaacctccaccctcagggttcaagcgattgtcctgcctcagcctcctgagtagctggaattacaggcatgcagcaccatgccagctaatttttgtatttttagtagagacagggtttcaccatgttggccaggctagtctcgaactcccgacctcaagtgatccacccaccttggcctcgcactgggattacaggcacattgcattttcattctaagatttggtgttctacggataggaccttcgtaacagcaaagttatgtcactatggtacagttggcataataaaattagttcaacatataggcaaaagaaatgatggtctggacatcactgggcagagtttttattcttctaagttcatcagttactggtagaaggatcgtgctagaatgctcaagtttcccatctcatccctgatgctgcattcagaagcaaacaccacacctgccaacattctaaaggtggttttcttgttggggaattcaaagtgaaggtgacagcagagagttaaagacattcacttagaaaatggtcactcctcacttttaaaaatgagtccggtaaatgaaaaaacgttagatttacaaattgaatagaaaaaacactctataagaaggttttctggctaaatgaatgaaaggtatccgtctgtggtttaatcacattcgattgaataacggttgttagctaaatttgactttcctgtcaaaattgtcaccatgttgcaaactgactttaaaagactaactagagccagagtggagtagtgagaaattaatacacaaagctcgggtaacaaggaattcatctaaccatccatgtcttgacctctttctaacccaaagtacaaaacttggcaggaagcagatgaggaagtcattaatatgtggaaaaggatctctcaaaggcacatcaagaccctgtgcctttcactgatgaaaatcaaaaggaattgtacaaatatttaccacaagaaaataattctaaaaggtgaaggatttccacaattgacacagagctctgtattactacctaggcaaagtttctggttagtacaggctcccgtgccgttctgaaagtgaggtgtagaggtcagagttcaaggactggccttgagctctttaaaaagataatcaatcagctttgtgtgtgtgtgtggggggggtgtgtgtgtgtgtggcatttctagttaaagatgcaaaaggcctgatgaaaactgtttgggtctttacttgatcaaatcaactgtaaatttgaatatggactcaatattatataacattaaagaattattaattttcttttggtttgatcatggcattatagttatataaacatatttaaaaatatatacagtgaagtatttagtgttgagatgacatgatgtctgagattttcattaaaatacttcggcaaaataaaaaaatgtgtgtgtgtgtgttagcaggaggggtaagtgaaacaacgatggtaaaatgttgatggtcattgaagctgaatgatgggttcactggagcactgcactttctctcaacttgagtatttttggaaattttcacaataaaagattaaaaatccaaaaccacaaaatatagggtttcttaaaaagcactaaaaatagtttacacaacaatactgactcttgccgtgaaatgcagagaataggtgcaaaaacccgagagcagtaattaatggccaatcttatgtgcattcctttaagcacaagcagctgtcataaacatcttaatttaaagagttggggtttggggaatcatggcactgcaaaaagctacgtcctgctgctgctccacagaactggtacatatcagacccttaaatttttaaacacagctttcatgtttttgagagctgaaaaacctttgaaaagtcagcttgttaggaaattcaccttgcagactcctacttcaagggttggtggaggtgcttgggtaccggaaaaattgattttgggatgggggtggaggttcacaggtaaacatgttgtgtgcttcagaagaagctagcttgctctaaatatacggggcgtagctacattgcagtgttgcctttcagcaatgcaaaatataccacctggctagagaggtatttcaagtctacaaagccccacctcccagcctttattgttccttttccagtctttgtcataaaatagaaagaggcggcattttgaagacggaagaagcactaaacaggaagcaggagcctaaaatcgagtttctcatactgctgtgtgttactgtaaacactaggccatgacctgccctaggtgcttcttctgtgacataggatcagcatctcacacccatgaaggtctcttgagtcccttaaggcctaacacacctgaatacatgggctgtgatacgggagctagcctgatgcctccattcaccccacaagatgtagtcctcgccctgacggcaagacggcatgcgagagtcctatttgggttgtaaagtttaatgcgagcagaaagaggcagacgatagctaacataatctaagttaaccattgaaaaacccagactgtccaataaaaatactggaacgaacccagtcaccttttatcaagggtacatttaaccatcctcattggtggctacttccattcatggtcacgcccttccctcttgcctcaggaactcagtatttgtgtgtaaataaggacgtgttgtggtattctgggtgctgatggttccccaggaacttagggacacctgtgtgcagggctgcacttgacaagaaacaaagttgccggcagcacaggacaaggcctcctattaatttctcgaatcgatcctggcagtgattatctggtccaggaaagaacaggtctttgttcatagcaccagatttgaattttttaaaacaacactctctattgcccgtaagaatgactaataacgggcggctgtaatttcccagagtttgtgggtatgacttcttcagctttccttgcatttgaatttgccatatttcgactgggggcttcctagggctttcaagcacaatgtaaccaaaacccccagccagctctcggttcagcctggagaactttgtggtactctcgaacttactacttcctgcccccacacctgagagtctccccgcacactgttttccctgcatcatccaccatcaatcaaacaaacagagaaacacagaaacctcagttctcaagtgcaatcaatacaacctcctttcctggggtaacgatgccttcgttttaaaggtcatggaatgagtcaggggcagaagagagaaacagaggccgtgggttctttgactaaacatctcgcagagagatcggtggatccacaaaaatgacctcattaagctgcaccaattgccgggcggggagagcagtccaaattaacaaaaaatcagagtgatcagaaaacagttttgttattttacacatggtctcaagagctagacaaataaatttgcctagtgtatgttctaagtcacaaatagataagaggaaattgaaaccacaatagccaagcacctccctgaggagaccaaggctgggcttccattacaataatattcttatttatgttttctcatgcacattatttaagtatatatttatttactcatacagaccagatttgttgagtactgctatgtggaattcacagtatgaagtgccgtggggcaggcagacctgggtaccctcaaagaacttggtaaatagctatttcttaactgctagtaaacaagtttctcttctagtaagaaaaaataatggctggaaaacttatttacaccttcaatacacaaggctattttgcacaaaccagatataggaaacatttatatatggagcttttctaaaacagataaaatcagggctcagtcttctttatgaaaacaaaaagtaaaacactttgcaatttgagcaaagattatttctgcagagggtcatctctagtaagaggtgcctgctcctcagaccaagtctgtctctttcagggccattccttactggatggtgactcattttactcaaggactcgccctagacggcgtgcaaccaaccctttagaaacacatcaattgtttaaacaaactatgcctgtattcatttgcttagcaaatcattttgtcacagatttagcccagccagagtctaaatgatcacaattactgaaactataccaataccttttctactgaaaacctatcaaagaaataacatcagttcacattatcattattgattcctgcccttttctcccttaactccattctcttccctttcagtttgttatttattttcttatgttctgaatttcaagaagacttccatgtgttgtcaacatatggtacatcattcacataagtacataaaattctctatatgtcattaaagaactgagcttgtgttccagtgagtgaaactgaagaggaaataaaatcacaaagataaccccacaaattaaggtgcagctaaaatagcagcacccttcccccatcactcactgcactatttcttagaacttttatctttacatatgtacaaataaacagagtgtttctgttctgccttatttgtgtagaggacttacgtgcagctctctgaccttcctctggctctgattagcccctgagggacgtggatcacccacatgcaacaggctgctgacaccagcagaaagctgtctttcagaacaatcaagagtcccacctaaggacatcatgtccacctgctcttctctggttcagctgacttccctggacttgctttcttgttgccctgatctgtgctccgtgccagatctcacaaacaaggctggactctgcttattcctggccagtcttgtcctgtagtcatccaagaaaaatactggaaaggaggaccacaaccttggccagtggagaccctgtcattctgatgaacatttctaacacaagatgtgaagaccctccttcccatttctcatccttccctctccacgtctcacaaacaccaagtctatttcccagagaagtggtcagggtgcagtgagtcaggcagccaaagtaatcctgcaggtgagcatgttgccactgacccttgagtttaacttcttaccagatctctgcaaagatagaaaaaaactagcttgcaagaaaccccagctctctggatgatctgtccttaggctgctgagattttcaagggtgtgcagacagttgaacttcacttattttcaataattataaaaatacataagaattttatgtattatttaaatgatacatagggactccttatccaagaaagatattgtcaaaactagattttataaaaaggctaaccattatacataaataaatggcttaacatataaagttttattttagcaatagcagctacccttagtttcgatgcgcatataggttgaaaaaggtttgctgaaagagaaaaatagactgtttatcatctcaaaactggttgagattgacaaatgtgatcctatcaaaaccattcccccccccactcacataaaatggccatgttctttgaaaatttgtggaaaattacttttttttttgaaaattattcccctcagggcacataaggcgcagggaaaaagcaaaggagaaactaagttaaactagttgagtactttctcagtgtaatgatttgaaacatcaaatccccctaaataaaataaacaatagattatctgcaaataatcctccctggaggttttcacactaaaacaaatatggaataaactcatgagactttatcagagtcacagttaggactctagccaggagtacacacaactccatccatccatcctgccatccacacatccatttattcatctattcaaataacaaatcaagaagtatttattgagtgcttactacatgcaagatcttgctcttggggcttggaggctacaagaaggaccaaggcaagctctcaatccacaaggagggtgagagaaaggaaaaagtttggagtatgtgcagttgtgtagaggtttcttcagtgcaccagagacaagatggatctgtgtggcacggtcaacactgtagcccttgaccttatcttagagaaactaagtgcttgaggtaaagatgttaattcccttaaggcttagcaaatgtaccaaatctgatagtgtgcaatctgtatactgactttacctctggcttcatgttatgattcctacctttgttttctttccacccggatttattcatgaatttttatcttggatactctatgtggtattataagccacctcaaatcctcttgggaaataaaggggtctaaattcttaaaggataaatacaattaccctgctagatcactaacaatgataacaaggatggtaattcttattatcacaggtaactttcattgagggctcctatgtgttgagtactgttccaagcactttacatgtattttcttgtttattctttataataatcttttgagattgttacaattattatccctatcatagtaaaggaaaacgaagcacagagagcttatgtaatatgctagtatgtggtagaaccaagatttgaacccatacactttgaatgtggagcggctccttgtgttttatccaggtgttcgggctctccaggtctcctgatgggacagaagcccattgcttcctgctcggactcagtagctttccctattgtttgactttaggactccgatgctgtgtcctacctagtcttagggaacttcttgaatattggccccatcttctctgatgctgtggccggtttaataggagctcccatatctgagtactgtgtctctggagggcgagctccttaagaaaagagtgggtcttgctcactttctaattttgagtacctggaggcatacatgagccatagcaggtgtttaagaaaggctggtgtgggttgactgaatgaatgagggtcccaccactttccggtgaatactgtgcctgagatcttctggccaccctcccagagaggtgctcccaggtcctggctccctcctccccgctcctcacactgggcccttcatgatagctctgtagcttcatctgcctatgtttggtgagttctacctgtctaggtgacgcttctaaaattaaacaactattaatctgtgaatggtaaagcatatgcattcagattttatcaaagcagaaagcacattttacaaggaaaaaggtctttctgattagcgattataaaattgacttaatttcaatctagtttaccatattcagaagtgccacattcagaattggaatggacacttttaattatcttacgagtttaggcatttcaatgtcttcttttcccccgattcagcttagcacaatgccagcacccctctctttcccactctcacatgggtctttctctatattttctgcgctcttattacctggactatttacttgcttattaatcatgtgtaacttagtgatatgcatcatggtgctcaattgttatttaattcctgctttgttagttcatggcacccatgtttctatcgcccatggaaaaatttttttaatttttaatttttatgagtacatagtaggtgtttatatttagggggtagatgagatgctttgatacaggcatgcaataagtaataatcacattatggaaaatggggtgtccaccccctcaagcacgtatcctttgtgttacaaacaatccaattataatcttagttcttttaaaatatacaattaaattattttgaccttagtcaccctgctgtgctgtgaaatactgttttattctttttgttcttttttgtaccccctcccatggaaatttcttgacaagagatcattgtgacttgtgcctttcgggatctagtcacttgagaactggttccatggtgcttcagtaaaggccatgaaatttcatcaaagactatgtccctcaaataaatctaattaaatgtcctccactgggtcagtcatacgagtgaagtggaagggaggccatatagagcagtcttcaggcagaattctggtcagaattgtagaaattctggtcacaaggtaaaggcaagaaaggcaaggggtgaatggtagtggtggtggtttggggggcacacaacattttttgaatcaccacatcaactaggtaccaggctaaatgatttacacacctgatttcacttaacatctgcataaccctcagatgttgacataatgctgcctccccttctacccataattaaggccatatagctattaggtgatgaggttggggtgtgactccgggtttacctgactccaaaatgatactctttcccctatattgctttcagagtcaccttcacttttcactgcatgcactgtccagaatccccctttaagctcagaatgaaggaaatgaaggttaataagaggtcatgctggcaagtctaagaaatgaatggggtcaggaccaatggagaaggaaagtggaaatgtctgcgttctttgttgtctcgggattgcaaaaacaaaggaggcaaatggtcctaagcaggtcagtaaaggccagtattgagcacctactgtgtgcaaggcagtttgccacagcacagggcacaaacagaattgggacaaggttgtattacccaggctccagcttacgtgaaagccagctgggccagcaggactcatttccctttcgttgctgctggaaaatcagcatccaatcatctcttgaaagaccaaaccaaggtagttcctcagctttgctttgcgtaggccccgcctacagcctcgtctgcatgtgtctcccgtggggctgcagacgcgccactgtgtctaggggcgggtgggtatgcggggagactaaaccagacttcaggcaagcagggggttaatagctcataaaataaaaccctctaacagaaaaatgttattttaattgtattacattgaggagccctgagggtcgtggggtagataatcaaaaaggacaaggaggaaattaaaaaagggaagaaggcaatcaaaaaggccatttaggagaggcccttaatcctcaatagaaagaacactaattatactacagaatctccttataattaaccctgatataaagtgttttttgagcagtaataactttcacattcacaatcattttgatcgcaaactcctgtgaacacctcacaaacagcagctcacacaggtttgctggtttttgtccccagcaagcccagggattacactgctgttcataaccaaaaagacaaatatttctgccctcagctaagtccactgcttcattgaactcacccattgctttcattttttgttgttattgttttgttttgttttttggcaagaatagctcaaaagtcaaccattcttgtgcctccttccccttctttgcaattgcttccctgtgctcgtttttaacctttaatatgacttggaatatcccacggttgcaaaacccactgaattcccaacataccttccttagtgaacagacccctgcttagatttacctacactcctagggcacacattgctgtaatagttcttaacgtttccagacaaaagcaaggattcagatggactctgctcaaatcccatccacaataagagcctcacattcctctcgctgacagctgatcccttatgaaccaaagctctaaactgtcaactagaacattttaagcacagatcagaacaaggaaagaatgcagacagttatagatttcaggggtcccagggtatctggaggcaaagcaactgggaccagtgcacgaagggagaaggtcctggaacaggttgtttgggactttaaaaaaaaatggcgtgaaagtgaaaagaatctgtccctgtccttacatgaaccggccatcgctcttatcccacctagtaagagaaggagcaggatctcagatcccatgagatccctggggagatagtttcaatggggcacctgcctgccaagtgaaactctaggagaggttcacgggcactcactcctgacattcacagcgctctgaaggtattcgtctcctctgaatgcactcctggacctggcttcacctcctcctggcaaatacacagtggacgtatctgaaaggtctacctgctcacaatgggctacatccccactttaactcggagactgggacaccaaggtttgtgaaacactgagcctagtatttttcctctgtatcaaaagaacgaatgccaaaggattttttccatttttccttgcatgttattggaactgaaaaccttacttctacttcccatccgggtgactattcttcatgtagaatttaacaagataagaagatgcttcctttttgcttttttatttatttacctttttagaatcaggtctcattatgtcacccaggctaaaatacttttttgctttgtaaacagaatccataaccaagagacaaatattctcttaccgttcaacaatattaagtatctgcaatatacccatcctcccaactcacccttggacctagacaatacaggataggaattatattgaccctgcttgtgtagggactaggttgctcctcttcagttacctattcagttgaatagcaagttacagctcattaacacagaaaaacataggacattagttcatttccacttaaaaatatccctactaagtaaatcatcattcgtttcatccaaaatacctacagagacacacaattcacttataaagttgaatgaggggattaaaaatgaagaaaagattatgtctcccatttaaaaaatattataagtaaaatgcatttaccagtaaaacacactaaaaggatctgcagaaacatccctgctccattcattaatgcaacaagtatatgccaagtgctattcatttctcaacacctaaaggtgagccaggcacagatcctgccctaaaaaaaacttaaagtgtagtaggggaggtaactcacatttacatataattcaactgtaagtcagagtgcgaaaagtactataagaaaggtgcagatttttaaaaactttatacaataataaaattataatataaatgtaagatattattaattgcatctggtagaggtctccccttgagttatcccatctgaacacagagctaatacgttgttatatccataggcgggatatttacaactccctttgttggggttttattctaggtgtaattaccactagcaggacaggagctggaagccaataggaaaggccgaagctgatgctgatatttacctccccgtttttggtgtcccttgctttgagaaggcaggccccaacactgggttccctctcacatccccccaccccaccccatattctgagttcctcccacctctgttctgctccatcaaaacttcattgacaaagagcctcatggatgccactaaagaggacaacacattaactggaaatgctcagtctttcgatcactttccttactccaacctccagtgatacatattttaaaagagtgtcctggagatgagtctttagccaaaagaaactccaccttaggagaagtggggacaacagagtcaggagtcctggattctagtcccagattagtcactcaatgtagtaccctaggacaaatccatttatgtacctgagcctccattttctccattgttagaattcaccaatagcagactcccaatgtcctgagtatgtaatatgcaatataaagctctcatgaattatgcaaataaatttaaatacaatcatgagagggaattttagtgaggtgcaagggatctttctgacaggaaccctgtctgtattaccttgggtagggtaggtttgtcctgaggcaagacctgtgccaacaaatggcattgaatccaacccaactggattgtaatcatttatacagttgttagttgatttcttcttctgtgtattaaatctaaaatatgaagtctaatccaacttatactttatgtagtcagggttagggatggtattttctatgtaatatcttacctctctgctttaaggctagttgtggacaatagatttagtttttttaaaaattgctagattccttcttttctggttccatttctggaaatagcaacattagcagcactgaatcaaagtggttcttctcacgacttgtcccttgtccctttttacatttatctcctgttacgccagcacaaataaaaccatgaacaagagtaaacagcgaatgttggggaaggagttttcaaaagcagaccttggtatcacttttaaatagtccacagttctaaatgaggctgcaagcatcttgtcttccttcagttgactgcaggagaagatctgtactagatgatgctggaaggtcttcctctatacaggaagacggctttcctcccacacggtttcaggtgtgcacacatgacactcggatgtgactgttagcagctggaaactttgaggttaccaaggaccgtaggaaatgccattcttctcattctgaagaactgaatttggccaaatggtcttaacctttcatagcctgatttcttttgtggttgtcttatcgttcaattaatttaaaccaaccattccttctttaaaatacagaaataatacatgctggctggaaaaatcttaaaaaatgcagtagtatgtagaatacaaatcaaaggagcttttcacttcccctgcattccttaatccttctcttctcttttgaggtcaaacttttaaatataacattttctaggctactttctgtgctttaaatatatgcttaaatacagatgcatgtatgtgtgtgctcacttgtatttctctttgcatgttttcctgtgatcatttcattttacttaatactatatcatggattcatttccaagtcaatatatctatatttggttactttctaacactgtttagtatttacaaggaataaatagaaaggtatgttacaatatgaaaactttatgtctcaacaaaatctcagtgagctattcatataggaaaagaattttttttttttttgacagacaggacagtattttcattgtttctttttaaacatacttttattttaagtccaggggtacacctggtttgttacatatgtaaacatgtgtcggggggttgttgtacggaatatttcatcactcaggtattaagcctgatacccattagttattcttcctaatcttctccttcctcccaccttcactgcctcttaataataatctgtcatatattgaggctaacccagtaagcaggaaagcagcccagcatctttaactcaagaaacttgtgaactttggtgagccatatggagtaaacaactgtcagtgatggtggataaggtcatttaagcaggtgtgtctagaaaagaatgatgccccaaacccccaaacaatacacttgaatttcaccaataaaaattcattcctttggtctaaacatggccaatactaagccttctctttaaacatgcatatgtgtttgggattagcaaccatttagtttgtgggatgctttcctttccagaaaccatgcttccatctgaaaacactgagtgtttctggtgaaagaagattctgacactagggagaggcagacacaaaatagagaagatgtactgaaggaagaaaacagaaaaaagtcaaaacagcaaggattccaaattagccgaagaatcagtcccctgcctagagatggccccaactgctaagaggaaaagttaacttcaggtgaataacattatattttttagaaaggtaagtggtttctttggtgaactagaacagaggaagcaagtagagcaagcacaccaacactcccactccttgtttacagcagacatcactaatctattgtggcattcttggtactccaggcagccactaccagttgactgctgttagtgcccaaaatgaaatacagtttgttattcagtcatgggagtcatcatctccattattagcagccatgagtttgaatttcacaagtagacatgaattgcataagcttaaagttgctgtcagcgttctttttcagccaagtatctgcagaggaggacacgtcccagggaaaataggaggtctctattagctaatgaattaggatcctgccataccaggctagaagttccgaataggcgaagggagagcattgagtaaccagcctcttagaggctgagttgaatggtcatctaaatcaactgtgctatggaataggatgcatctctagcagatgctgggtacacagagttttcaagaatttaaaaaagacgttgccttaaaatgtcttgtttggatagggccatttctgcatatacacccccaaattagattatttttaaaaggttctattatctaaaaatactatgtaacattttaaaatatagtaaccatcaaggaaaacagagactgaatctaacaggaagaggatgtgagtgtcaaattgttggattatataagatggaaaggtaggtgcgggtgagccagcaccttccagattcctgagaggcagcaaagtcagggtgcctgtgcagaagtcaggccaaagcttttctctctgtgggaaatcttcagcaaacagccagttccctgagctcaggacacaccacatctaccaccacatttcaggaggcttacttggagtttcagtgtagaagttgtcctcaaaaaaattaagcaaattaatctagaaagccttaacctgatttggccagcttagttcaactgtgtcagagggaggttgagcaagcccttccagcttgtctgagatgtgataatcattctcattctctctctctctcttaatcactcgtacatatccacccgtggacaaacacacgtgtacacacacccccctttacataaccaacacatgaacacttacacaaccctacataccctgacacgtgaacagttaaacatacttacaatcacacacacacccacatacactcacatacttacagctacgcacacacacgtgcacttacatgcttctataaagactatcctgttatcacccttcagagatgcagattcaaatattgccccataccccatcatagtattttctttcaaaacaaaaactactttcttttgacagaaatctccgtctttgaaagggacactctcataaacattaggccttggggaccgtgtggaaaataagcacacacctgctctgcggccggcccctttattgccaagatggcattagcttgctcctctggaggaattctggctcagaactttcataagttggagactcaattatgcttcttatgagttccctaaatttggaaatggaggtaaataaggaaatgcattagtcaatgtccttctcaacctcctcccctactcatatttcaatcttctccccctgctttcttggggtgatttctttgaattagtaaaaactaccgactgtagaggccaaaaatgaggcacaatattgagatgggaataaggacagtggaggacacaaatgccaatcttacttatgagtatgaccagtctgtgtgggtaaatccccagggcatgcagtttttgcgtgggctgaggcaactcatgtcatgccagacttcactgaagagtgagcagtgttactgtgagataccaaggaaataacacactttgacgtgagatctttagattttaattaaaatgcaaatattaatgttgtcaatattgggggattaaagaggatattccccatgaataagtactgaggaagaaaaaagaccatgatctgaaagttaaactgtatgatctcccataaaaggggatggcagagatatgcaaagtcactttactgagcttctggaaggcaaaatttgactggaagctgcctgaatttacaaatccatcagaaggaggtatgataatcaagcatggccatgggagcagagagaaaagagttatggaaacaaacgtgggcaatggcctgctaggatttttcaggcctaaggacccaatcagttgttcccagtggatgggaagttgagttgcccaacttatgtgtatccaactatctgcacacaggtgagcggttagaataggggcagagagagagagagagagagagagagagagagagagagagaaagagaaaggaatgagatgggaatgaggaaaggaataagaaatgaaaagagggcaacagagtggcagagtgggaggagagagacagagagtgagatggagatgagagaggtgactcttaatccttcatcagcctcttgagcttctcagaagatgaacatctctctgtgctcagcaggatttttagtgttaattacagctgctgttcattcaatgtgacccctaaatcagtgttctccaactgaggtctttgagccaacagcatcagcatcacctggaaaattattaaaatacaaacctgagtctctccccagtcctactgaatcagaaactctggagatggggcctctcagtgattctgatgcacgatgaagtttggggaccactaccctaaacacaagccaactaccacatctggagctccactgaaaaaacagctggagaaatctctcttcttaaataaacactgtaatattctgattttaacacaggaatgattattttatatatcagttttgagagcttgagagatttgagtctgctctctcatctctgaacactgcaaagacaagacacgtttttgagtctgtggagctgaaagtttgtctttgtaaataggagacaggcaccaacataatggcccactgttagatttcttgggaccccgacctctccatgtcctgcgtgggtacttctctgttttcacacacttaacagaaaagtaggtttccctgatttgagagagatccacaccttgataacatgctgcagaaagatacagtatactcttccaaaagactattcagcatggtgtaaatgtaacggcaatcatgtagagactttgaagtgacagatggggctagaaatctctgtgatacttttggcaatggctaactaaactgttttcctgcatttctaatacatcaatctgttatttgtttctagcctgcttttattgtttcattttatctgctatttgcactcagacttgacttgcagacaaccatgggcagcacagttgggtataaaagagagttatttaatggtgttatttaaggtgtgcaccttagccatgcagtttacaaaagcaaatctctgtgaagtacaaagcatcagagagcaaaacaacagtcactgacatctcttcagaggagagaaagaagctgagtcactgagcctgcaattcaagagaaggcaaatatatcacagaacaaagaataaacctccaccctgggtcacaggacatctgcctcagagatgttcaccaacacagaaagatttgttgcttatgataaaagacatctgtgacaagacatactgaacaaaggattatttgacccctaactaaacatagctgctgtataaaaggttgtttttttatataatattgccaaacactatttctgtagctcttttaagaagagggagaacagcaagtgttattaaatctgtggtagacatcattctaaactgtacctgggaaagcatatgacacctccatcgtaactgcctaatttgctacttagggatagaaactaatgctacttaattgaaataaaaccagatgcgctgctgagagcctaccacctttagaattatgctaagcatcacagggaaaaaaggaaaaaaaaaaaaccaagttgcacttcggcctccagaagagacaaggtaaacagaaggtgagttcaaaaatgtttgtatttagagaactccatgtgaattggaatgtggcaggagaagctttcatagaagagatgaactttgctcagtgggtaaaatttcacaaggcagtttggcaggaaacacaagcaaagcagcacaatggattcaaggctcagtggttttgaagataaaattcaatccctcacttccatttgggatgaaatattgggaagcagcaaaagtgtcaccagcaggaaggtcaactcaccattggagacagacttattgacttgactggccaagcccaatttaatcctccatccccaattctaaacacacagtagactagatgtacccatgcccttcacaacacacgtttcagctgttacctctcccaattatcttgcttacctgtcaactttaaggcgtcatctagggatcaagcagatgccttcagaagccaggactgagtctaggggaggggctgaacaggttacagggctgggggattctcactagggatgtcagttcactgctggctaagagtggggcccagattcagtcttctcctttttttcccctggtcccaaagtatcctggaacagtgttttctggttgggctatgagttttcatggtggcaatctcagttggtacaggaacctaaggtagacggcagaggtgctagcagcatggcgggaagtcagagttattaaggaaaatatccgaaatacaacccattctgtctccctcttccaactagcaataatcaggaaggcccttcagcttcagtaatatttgagaaaggactcctgcacccagaggaaaacctttgcataggccagcattcggtttaagacttttggccttgtcctctcagttcatgaactctgatttgatattctgttacctgaacaaactctgatctgatatatatttttttcttcctgaaaaagaagtgcattggaggtatggtgatttccagagcatctctgaggaagtgtaagtctgtttgtgtggcccctgtctaccatgtattataatgatttatgggtctgcctcgctgtcccctactagagtatcagcctcaacactctctaccttgctcagtctaaaaatttatactggggaaacattcaataaacagttataggcatctacggccatacctccctgaaggtgcccgatcttgtctgatcttggaagctaagcagagccgagcctggttagtacttcgataggagaataaatagatacaccttggctaaaggaacatagcggtgagaattcaagttcttgccaccttcccaatgcctcgaagacagaaaactgaggtcttgctagacctttatttaccaccgctccttaccactatgtcctttcctagagcccaccggtgcagctcttcctaaatgcctcagcatccaagtgtactttcagacctgaacccctgcagtgcctttatcctggaccattctgctacaaccatttcatagctgtgcatcactagaggggatgccagtgggtggttagggaaggtatcaaattgcatggaacaggagagggtacaatcaggtggatcatgttgtcactgctgttggacggtctcgtggtccaactgcacacagcccttctggaaaagtgatgatgtctacttctacctatttccaggaaaggaagttctataacttcaggcagacaattcctatgtctaaaattcattacgtcccctagtaattgcaggatggtgctcttggaagagcaccacctattggcaaaaagaccaatggaaggttaacctctagactagtgcttctcagggtgtggcctctggaccagcggcatgggcagtacctgggaactaggttagaaatgccagttcttgggtcccatcccagactgactgaatcagaaactctgggcatgggctcagcaatctgtttttaacaagtcctccaagtgattctgatgctcactcgtttcagaacccctggtctatagaatgggggctataagcgtcatgtgtatatatcagttgtcaatttagaattacctgtttgtttggctcaggtttcttctgtttattgctgcttgttaggaagagatatcccctgcattccatagattgtgtgaactgtcaactggagaggatgggatacaattttcacaggccactgggctcctggaagctcaggctatttgacttcgaagaactacacacaagaccctgattaataaatttgtcaagagctgctcctttttgtgacaattctagcagagacttcggtgacagccgtccacttttatggattttaactgagtaattaataggataacagttacaagtgcaagttaagtgcgtattatttctcctggattgggtcataaataagtaatatagcttttggaagtgaatgggaagagacgcttgaaaagaaagacctattgggagctgaatgagggagtccagacttaatttgaagctctaccttctcattttagtgaagcaagcagttccacaagggataagccgagaccgtagcagcttctgtttcactttgtgcttcagctatagccaaacatcgacaatgtaccaaatggagacatttttgaaactgtcctcctctcacagatattaaaagcaaaaacaactcttcaatatgccagaggtaagaagaaaggaggagcatcagcaaagactgaggaatattttacaacacagttacacagactattacacttttatcttttcccagatccccgggctgactcctgccccaaccacaaattcctgggctgctctaggatgtaggggccactcacctgttccaaatcaattcagggcctcagggccacatcacatcttttgtgggccctgggtgcttttggcttcacaagccctttctccataatcaaaaaataagtaaaaactacattttatgatatcgttggtattaagacaaatataatccaggctggatttcatcattatgtattcattattcttacattcatttttgtccttctgatttgaaaagaaatgaaaattaaaatagttttgttggtccctaaaagtcctgtgggcctgtggtcgtttcctacgactgctggaacaaagttccactcactggtggcttacacagaggaagcgcattgtcttacagatctggaggctggaaggccaagatcaggttgctggcagggccatgcttcctttgaaggtgctaggggaaaatccattccagtcctctgtcctagcttctcaaagtcctctgtcttgtggcaacataactctgatcttcacaaagcattctccctgtgtgcatctgtcttcaaatttcccccttttataaggacaccagtcatgtccgattaggggcccaccctactccatgatgacctcattttaacttaactaattgctcggaacagccttatttttcaaataaggtcacattccaaggtactggggattatgatttcaaaatataagttttgaggagggggacacagtccaacccataacccagggctgtggccttgtatctaatgaaaaagtcacttctttcaaggacgttctctgagattctgaaggcaacgtagaaacccggggtcttcagtagcatcagaaatgtgataaacacccaggggtggggagagatacatttttggtttggggctgggcgcagtggctcacatctgtaatcccagcactttgggaggcccaggtgggtggatcacttgaactcaggcttgagaccagcctaggcaacatggcaaaatcccatctctacaagaaaacacaaaaattagccaggcgtggtggtgtacacctgtggtcctgctactcgaggggctgagtagggaagatcacttgatcccaggaggcagaggctatgatgagccctgatcgcaccactgcactccaggctgggtaacacagcaagaccttgtcgcaaaaaaaaaaaagttttttttaaaggaaatacttcaccacacttccaggaagattttgtgtggaccaactcagtctgggggaaggtgaacttctctcaatgccccacttcatacaagtgccctgcctcggggacctcccagtctctgacttaggagcaaaccttcctccaccttgagcttttcatcctgcacatttaccgcttgtctctgggagctgagccccactaggtattgaggaaggaaacgatttctttttttaaagaaatctgattttcatggaggccttgtacttctcgtgctctttttcccatgttaactttagcttttttcctctcctgaaagaaacactcagcttgcccctgggtcttaactgacaatccaaaacagaggaggaagaaagagaggttccatccaaagaaagagatttgtccatctcccctggacaccaacctctcttctcctcacctgactcctctcttctattagaaaggagagaaagggagcgggggaaactggaaaggggacttgagattatcactcccttttttttagcttcagttttttttaagttactatcagtccatggcaacaaaggcctctgaattctttctgtctgtggctcaatggtttaattatcaaaggattctataaaccccaacaacgtgtgggctacccagttcgttaccccccgcacttcagaagaaaaatcacctcacacaaaaacagccaaataaagttgcacagtccgagaaggcccatcaagcgagaactgaaacagtacatgaactctgcctgtccatttaaattgcaaaagctccagctcattcgcagacacagaattcggtctggcaaaaccattcacagtcctggatgtgaactggagcctacgacattaaaggcaccaaggacaatgccagtgaggctgtgtccaaagctggactatctccatgaaatggttctctctgagcaggcagaggtaaataacagtaattccttcgagagtgtgcatgccagaaatgaagagcttgaagtttatgtggaggagctgttgaaaccaccccaggaagactttttctctcagcacaaattataataaaaaaatctcagtggcactctgagctgtaaatctcttaggttaacttttaaaaaaatgtgacattgttaggtacatacgcaggaccaaatgaggtatttcttttaactgttctgctcttcatagagcctctctctctctctcacagctttggtggttttatgaccatactgaaggagctagcagaatcctgttgctaccaatagagggtgggttggttaacctaacagactgacccaaaaggttgggcaaaccccagtgagaaagcagctgtggcactttttgaggctgtgcaattggttcacctgtatttcccgtgtggtgttgaaacaattgcaaaatataagcctaggcattcttcttgggcagtggcaatgctgtggtttagagtgaatggacatcccatgctccaagtcagtgataaaccgcttgagttatccccaaatcctctccaaatgcttcaagcagctaatgttacaacactgaccattaacaaataatgtgggacaggaagagaaagttcagtgaaccaatgactcaaattcaattcccagccagaaacttcatggtgcacagaggacagtgtcctaaggaacagtggctcttgcttaatatgaccttcaggctttctttaccttgcaggggctgcgtgcgctcccaggcttctccttccctcaaaggagaaagactgtttactctgttcatatgatctctgatgataagagactcaacaggccatgggcttcaggggttctttcttgatgctatgaaaaccaagatcaggggaaagtgagatgggtctatgcctccttgggtaagagcttctagagaatggaataaagcagaggatagggtcagacagactgaaaattctcagagggttgtgttccagggcagagactgctgttggctcctccctgtctggccctggaaatgtagaggtttacacctgggccattagtaaatgccccataattcctcatagcagatctagttccccaaccttactgcagaggcatgggagccgcacctcattggcctaatggactccagggagttggtcaaggaggtgcagccctctccctggaaatttagagtctcagggaacttctcactgtcttcatctcttcattattcaagtgggaggcctcaacaaccttgtcttctttccacacttcctgcatggccgcatggccacagctgatcccctcactcgcctcaaaccaaccgtgcaaatctccttgggaagcaacatgccactccctgccaagcctcctctggacagcgcctgcgagttccttccctctccactggacaaaagtttctctcacagcatttctgtaacttctgaaacccaacctcctccaagaagccattctagattgattagagagaaatgcaaataattcctgtgactacaactggagatatatctatatctatctatatgtatagatagatatatatgtgtatgtattgggagttattatcttcaacagccaccaagtttcttggtgtctcctcactgtcatccacattgaatgctgttattcttttaaaaagtgaaaataacttcaatgtttgagtgattataaaaatgttatatgctcacttaaacaggtagatatgtaagtgcagaaatctattcagaagaatgtgaaaatcacacaaaccccactacacacagagtaaacttttctttatctgagaggtaaaaatggtatgtgtctatggtgtacaacatattttgatatatgtatacacagtcgaatggcaaaatcacagcaagctgtttaatatgcattacctcacagacatcatttttgtgatgagaattcttaaaatttctgatggcaatttgtaagtatttattattattaattgtggtcactacgatgttcaatagatctcttgaacttattcctcccgtctaattgaaattctatgtcctttgatcaatgtctccttgatccccccaagcctcagtctttgctaacactattctcctctttgcttctatgagtttgactttttaagattccacatataagtgagatcatgtagtatttgtctttctgtgcctagctcattatttcactaatgtaatgtcctctaggtccatccatgttgttgcaaatgaccatgacttccttctttttaaagtggaataaatagcattccattgtatattgtgtatatataccaccttatctttctccagtcattatttgatggacacttaggttgatttcatatcttgactattgtgaataattctgcaatgaaaatggggaggcagatacacagaaacaagttatatgatatccctatttatgtaaatgcattcattctatttttttttttttttttttttttagtctcactttgtcacccaggctggagtacagtggcacaatctcggctcactgcaacctccgccccctgggttcaagtgattcttgtgcctcagcctcctgagtagctgggactacagatatgtaccaccatgcccggctaatttttgtatttttagtagagacagcattttgccatgttgaccaggctggtcttgaactccttacctcaagtgatccgaccgcctcggcctcctaaagtgctgggattacaggcgtgagccaccgcacccggctgtaaatgcattgactcatgactgatactggttctatgatgctggcaaaaattaaacttaggctaatttccatagcaaaggttaagtagctacttattaattggccctgtttacatgcctaccatgaaagaattatttttaggcttaagtggaaaccttaagcttgactaagaccatcataagaaaacagtgaatagcatatctacttgaagtggaagatgagtgagcttcaatcccattgtcactctgctatagacactgataagtcttataaaggcagaaaacactagtttgagtgaaagaatgactgaggttgacaaaagaagtatccacaaggcatggtgagtggatctgccaatctctctgcccatctccagacagtatgactctgattctaagcccaaatttagtgggaggctctgccgccacatcttatgtgctgctgggcttggtgaaggttagcagtcactgtctcagttacatgcatatgtgacaaggaaaaagtgatttacagcttctctttccctcttgtcttctagggagaagagaacttccgtccaattttatcctgggccttatttttccaatcagagtcatggaatggggatgaaggagaagaataaaaagaagcaagaccatttggttggtttccattggagaaaccagactcacaggaggggaaatgctagatctgtaagataaggggtgggtgagaaaaatataagaatcagaaagcactagggttgaaaaaaaaaagttctgggaaacttcctttttttttttttgagaaggaggagtgattaaggcagctgtcatattatgataggtggaattttgaggagatagatagataaagagatttttcagaaaatctgccgtaagctgtggatggaactcttcctttagcattttctgaaagactgtaataaagatatacgttgcttttaaattatttttgaaaaccaatgtgtgcttctttgggaatgacactgtgctgacacgggggacatgaggcagctccatttcatacaaattagatagaaacagctgtgtcgtttgcttagggctctcagtttccagaggacagactcccatacccatgtagctgattcggttatatccagggaggcatcttgccatagttacaaaagctctgaagtaggaacctgaagacctgcatttgagtcctggttctccctcttaccagctgtgtggcccaggacatgtcacttacgctccctgagttcagtgtcctcaccagcaaactggggggcaagaatggtgctatgtgcctgcaccctggacttccatgagaatcaagtaagataagggtatgccagcttgctctgaggactgtgaagagccacccaaatcattactgaggaaggccccttggacagcatgatattcagcaacttactgtcctggtgataacaatggtggctgtgatggttctgagactgattctgcccagggccattaacaattctcctctactccttcctggtatcttctctgagtcgggagccagggaggaataaactcagtcctaggaaacctactgggaactggacaatttccccacctcatttcacccggggcctccaccactgattaaatggaaatgctggagggcatgatgggcccaggccaggattctcttgaatccagcctatgcctggccaccgcgccctgtgctgatggtgacttcacccgctggctcccatctcaatggacggctctttctgaaaggccattttgtgactcgtcttgggagtgcttcattcatgctggctgaagttctttgctcaaaattaactctactcagcccaaagcagccaaaaagaaaccgaatgagacagcagggagtgaagacctcgcacactctaaatttgcttccaggggagttttctctgctttccaggattccagcagaatctcatccaacctcagaggcaacggctaggctgaagccaagagcccaccttctgtgaagtcctctccccatacgttcccgtcactcccaggatccgcatcttcctgtgcaaaagtcatcagacacatgtccgggtagctacctgctgcctcagaagcagatcttttctttttgtttttagttgctgagaccaaaaacttggccgattctgtctctggtctgaggcaagagtccttgcatctgattttcctaagaggcagcccagaggctggtcaataaggagctggcctgctttccttggcctcggcatggccagagaggccagggcccaaagcagcaccaggatcttgaactaagacacaggcaactcatttcactttcctggccgcctcaacacatctgtcttgttggcctgtgtctaaacctcttgagcgattccagctgctgagccatgcctgtagacatggcgacatttggtttctgttaaaacagaacaggtcagtgtgttcacctgcttcatttttttccctcctgcacaaggacagggacagaggcagccaaaaactgatgctgctgatttggagatctcccattctgtttcagtgacctcatgccttggactggatgccgctgggtcttttaaagccgcttaatttcctgtgtatttccagcactcagccaaaaagaatgtacactatgaaaaaaatgtctactacccctcaattgcagaccctctggaaaaaaatatctggaaggcttttaaataaaagaaataattacaacctgctgagtgccttacagaatccatgaaactcgaccttttccaaaatatcatagtatttcctgtggcttctgtaggctaagccttcgtggatttataagtatgtgtccaacacagtctctgggctccattttttaaaatccaaaagtcagagttgaaaagcacaaatccatactcttggaagacagcatcccaaaaggtgttaagttaaaacccagctgtaaaaatataggctgccagctgtcaggggtggtgggccatgtgcattttttttttaatttaatgaatggaggtttgatcttccagcttgctgcccagttgcagcttttcagatgctgaacatgtcaggtatgccctgcaggtgtgtatagtcaccgcttacaactacatggtgggtggagagtggtttatgagccctgagattcataaattctagtctttagaactcgcaatataaggatggttaaaaattggaaagggagagaaaaaaaaacattctgaccttcaactacctgtgatcaatgatgcagactcctggtagccggtcccaagagaaaactgaaacctttgaaagacaaacccaaggagacagaagtttctattaactttccagaagaggtaaagattctaagcctgggttcactgtacatgactgtgtcttgctatgactgtgtgtggacagacaagatgaactagagggtgtacaattacatggatacttcgtcttgcatagaccacctcaaatatgtggtcataaaaaatatctttccctaggtgtttttgaaaaataattcagattattatttcaacttcatgctgtaggttgcctgccttagttaaacccgaggaactagggacttcatttccagtggggaagagtcgaattccatatcaaattactctgaataaaatagtgagtagaaactcaccgatcgactctagttagtgtcagcctcaggctgaattgggaactgattaccatttgtgttcacagtcttctgccctccccttttgttcctcttaacccccaatgttagagaccctctattaaagcttggcagcaccccaggctggggaatatccccctgctcaatctcttctctaagaaaccaataaagtgattttggttaaggtgagaacagctaagtatggcccacctcccagataacagcaatgttttaatccttaagggagagttcaaaaaaagtcaaaattcttagaaacaaggcaagctggtgaggaagatctttttaactgggagatgggcatgttcaatgcttcttatccaccagcttcaagggagtatgagaacactgcctgagagatgggagtgtacagatgaacttgatttactccataaatcaagggtagggttcgagtgactggaagtagagcaaagatatcgaaacagattttttaaaattggcatctctttacttagcctcgatctattaaatagaagaatacatacaaatatttttatacagaaagaaaaattctaacatgctccaatcacctgccagagacactttataaacttactaccatttggacttgcttccaccatttcagaatttcagaataggtgaggctttcccatgtggaccacaagaatgactactgtgcacaaggagaggcggttttgagatgcacagtatgtgattgctggaggacacaagcaaggcaaggagcagaatatgcaaacaggccatggtaagctctcagatgaattgtcttgggctcccagttaagctacaaatctagtaggtagaacctttcttgtttctacgcctctattttagggatctaattcttagtaaagcaactcagaaagaaaaaaaataataatgcttctttgtttctaggacttggccttttgttttataattaatatagattcccacccaatgcataaatgtttaaagcatcatttatattgcattgcccacttgttaaagtttaaaatgttgcaaatggccaagagtctgtgcttcagttacaagcaaacttgctcgccccatggtcttaatctccagcaaacagtggcataaatgaacctctgggtcaactttgtgtttgctgcacatcctttgccattataaaataagatgaaaagatttgcttttaagtcaaagcctaatttaaaatattttaagtatggacataaatgcgctggcctaaaatgtgtgtgtttgcacatgtgtgcacatctatatcatatagtttacatagaaatggatgaaaaaagtagtcctaagccaatactgatataattagcgaaaaaaaaaaaaaaaacacacacacataaggagacataaattagtgccttcagacatagggattattttgttaacaagggaatgggtccagagattgaaccatctgcattcaaataaagtaagaggttcctcctcacgtggttcttatatatgttaatgtttcacacttctttgacttatatgtcaactcacaggtggattgtgcagtggcttcaaattaaggcagcctcttagtcaacttgtcctgagctgggttcttaactaggttcctgaccttatgaccttatgaccaacacagctcctggttcagtaactgagtccttgttcagttctatcctggttctccttctaggcctcccaggtctcagcctggtttctttgaatcccactcttaccaccctaatttttaggcagtatggatttccattacagggttataatgcaggaagcatggcattgataacgggaagttggggtatgtttcagcaacacctccctgtttaagggggagatcagtctgcactagtgggagtgtttgtattctagaatatttttaaaagaggaagctcgagtgttttccagtacacggaggaactctagatagctgtgaaggagtttcccggttaccttaatcaatgtataagtgattgtcaatattttgtataatagataattataaattttagtaaatataagaatcaccccgggagcttgttaaaatgcacattcctagagtccatccccagggatcctgattcagaagtcgtggggtgtagtttatgagcagtggtctttccccctattctctcttggatggaattttgagaaacatggctctatgccttcattgaacaacatccacctataaattacaaattttaatttcatacagactattattgttataaaaatatttactgtctttaaaagtttagtacatcccttacaatctcacttgcaccattaattcttccagtaaattatttctctaaaacatagatgtaaaacttaacgtagcctgatccagattgaattactgcaaattgctctaagcagggatgaaatgtaaattaatgggatttctgtaaatgcttatttttttctaactaatattctatggtggtgagttatgatatgtagtcaaatattgaactgttttagctattttaggagattaatttacactagctaagagagggagaataagttgatgatcaatttaagtaacccttacattaatggactaaactttgtgggaaaaagtaaatgcaaaccagaattgcccaggtaaatgttgcaggctgtctgttagcacacttagacactgtctccttttaccaggggatatgatggagagaaactctgttccctgattttaggcacctaaagatctaaatctaaataacaaaaacaataacgataatagctaatattagggctgggtgcggtggctcatacctgtaatcccaacattttggaaggccgaggcaggaggattgcttgagcccaggagttcaagatcagcctggacaacatagtgagaccccgtctctactacaaattacaaaaaattagtctgacgtggtagtgtgcgcctgtagtcccagctactcaggaggctgaggtggaagaattgcttgagtctggaatgtcgaggctgcggtgagccatgagtacaccagtgcacgccagcctggcaaacagagcaagactctgtcttaaaaacaatatagctaatattaatcaaaacctttctatgtgccaagtatttttcatttattatttcatattatcttcactacatccctacagatggatactattatcagctccaatttacagttgaggaaatggaggttcaaaaaggttaagtaatttgcccaaagccatacagccagaaagtggcatagccaaagtctgactccaaagcctaggagacccaggtcatatctacagctgagaaaggactcactctccaccatgccactggtctcctcaatcagtatttcctttgttttaggcataaactagctagctaaaacctgcagtttgaaaagttcatgtcaaatgaagtgacatacagagaacaattgtgcagataattttctttagaaaacagaagcagagaaagaatcccttttaaaatttcagtttcaatatatttttgcaagcatatttttgtcccagatgctaccgtgttcaaccttgtctgagtctggtgaccaaacctcagtgagcgttctgtccaggtatagcagctgttttgggcagcctaataattaggctctctatgtatataatctttcaaggagagaggacatcaaactgagattagattagaggaaaaagagcaaaagaggaccatggatagtaatctattcccttttgtgatcagcatgtagaaaacagtttcagaaatgtattttcatttttcacttaaaaaatatttgtattttaccttcagggaaggtattcagtattctagcagttgcttcagaaagagggaattggctggcactgtgccatgcatgcttcatagacaaagccacctaggtccataaacacagtcatctgaggggcgaagggcagggaaggattcaagcaccttagttccaactccaggttggatgtccctctcgttaccccacggtaaaaggattatttcactccactgtgaggacttggctggcagaaggcattttcaggcaggcagtgaggagagcagggaagaaaggcaggtggggagcagaatccaagacagtgcagagggcctgggagaccaggagaacagggacagcccacagtcagaggccctaaggagtatgtctcctaagagccttcagctgaatgtcctttccctccccatggcggggcatctctctctacaacctgtccatggttcactttgttctgcctccttcaacagtgattctaaccctgttgtcatgtattgattacttatggcaaataacatcaggaggaattggcagttgcgtgaagatcagtggtgggaataagaagtgggactagcaggaaacggatcaccatcattagtatcattattatttaattaagctttgctattacaacaataaataataacaatgagaataataataatgacgataagctagcatttagtagaccaggcgctatgccaatcattgaaaatatgcatgtttatttaaccctcaggctattttgatcagtattttctttatcccactttacaaatgatgttgaggtgtaaagagataagtaccttgaccaaggtcctgggcagctgagtggtagtgctggggcccagatcccaaattctgactgcagactctgactccagcacctgctttcttgaccactgcgggcctggctttcacaggtgttaccttcctgcatcctctcggcaccaggttgagcttggtgtcgctatcccttcttatagatgaagaaactgaggctcagaaacagtaaacaatctgcccagggaggaggaacagagctgaggaacaaaaacaggcctctaagctcctctaccaaaactgcatagaccactctgtaaaacactccaagtaaggatgggactttatttctcacccctatgactccatgtctaggtagaagcagaagagtttgggaagagatccgacaacatgtgtgaggagatagggaagctgtatgcatttaacctatctccagggtccccatcacttgagagaagggccatcaataaggaggtggagaaggatcatccgagctaggctgagtcttctttgacttgctaaaaaaaaaatggggagggagaaggcaatgggctagtatgggaaagaataaagaagagagagggcagacatcaggaaagaacatcaggcagagagaagcgtcttagagcagtaatcacaaccaaaattttgcgcaccaacaaaagcccattgacgctcagacacctctgactttccccatttccttcccgatggcacaaatggaagctctgatttcctctttccttttccttctggctgatgcatcctgacaaatacagtatgtaaagcgcagggacgtgtgaaaggaaagtgtggcgacggttgttttccatctcccaataatagcgtttcaatttggtacctaaataaacaatctattttagtggctcccctttgatatctccaatgttcccttctgttatttctggcagttcccaatcctgtgatgtgattagagaggatgattacacttacataacagcatcaaattaatttgccgccgagaacaacagcggtaggaaatcattggagttctcaaattgctccccccacccccacccgcctcgagtttatttaagtgacatcaagggattagagcgaagtcggtcagtagagcactgctgggaaaacaaccaaaacatcgactctgaccttgtaaacgaaagaggaacagagcaaataatgaatagcgctggtcccaggcctggtgcaggggccattggatgaatcagcctcccaaacacacatttccgtctgtctgtgggagaaagaaacaaactgtacctttcagtgcagattagattcattttcctggggctatgtccagccatccagggactgtcaaaaccaaagatatttgagattttgcttatgtttctttgctttgctttttggccccttttcaaaacaacaagaagaatgtaaaagttgacttgaatttttttactctgtgagccctgaacaaaagtccagaaaaataaagcagaggcaaatattattgcttctggttttctaaaagatatgacaataacagctcagaaaactgtagcccatgattccaccaaaggttagaggttcagaacagggagcagcacgtggatggcgtagaaaagggacccctttaagtcctactcgcagtttagttctgacacgaaccttcaacagttacttcaactctctgagccttggttttcttacccaagatagcagatattaccgtctttcatctctgttacagggtgggtgttcacccatccgttcattctgttaatccatccattcaacaagtatttatcgaacaccaattctgtctcaggaactctgctggtaactgggaataccaatggacgtggtcagccctaggagcttatgtcctagcggaacagggaaataaaaacagccagtgtgctctgagggcctgcatgggcaggcactgacctctccacccttcatcccttatcacatgtgaatttcacaaccaccatgcatgcgtaggtatctctgtctattttacagatgaggaaattgagcccagatgtgttaaataacactacgccaaatcacactaggaagcaatgagattgaaatccaaacctaggttttcagaatataaagccatgctatatccctttatattttttggaacctgacaagctctgaagcactctgcaaatacaaggaactactttaagtgtgtttgcacaagctgttcatatactagacagacatcacaaatgcatgaatttctattgctttagtccagtgattacagcacttgattctttttaaagcaaatccacttctattatcccgtttgatccttgtaacagcatcacgatacatgtggagcaagtattattactcccactggacagatgaagagaccaacattaagcaactggccaaggcccttgacccagacccggaacactggtccgtggctactcacttgctcttcttcctcaacctcctctcaatgagtctgaataaggatgatgttttcaattttggcctcaatagaattatggttacttcctatattgtgttagtcttttgagtcctaatggcatccctttttgggtagaaatccatattcacaatatagcatgaggtatttttatttgtctgctttgaaaatcatcggctgcttttccaccttgtgagaacgtgtcacattttcccatcatcttttgtttacatcattgtttcactaccatggaggtttcgttgtgcattcttctcacttagctcttttagaagactgctcttaacaccaacatatggggtttccaaagttgggattactccagttagatgaatttgaccctttgttccaaacaaactcttgctaattccagctgtactgtagcatccatatcatctgagtctgcttgttcatacttctcttacttcataaaatggacatcaaaaaattattagggctgttttagtctcatggcttaattccttcctagttcttctacctgaaatgcttgacccccaactttgacgcccttccctcattcttcagggacaactcaacttccacatccttgaggatacatgtccacaatacctctgccaacattgacatccacctcctctgaatttccaaatcccatagactgtcagaggtttgctgcacaggcacattggaggagctctggtcctagtcctttcttatacagatgaggaaactaggacccagagagggcaaatgactttccagttggtggcaaagctggaaatagggctccattctcttgcttcttgaagctagcacttcccttcgactcctttctctttccttctaatgtctgtggaatgtgggttgtgtatgctcagtctggaatggatatctctcttattatccccgtaaactcagtgcacttcttgaagatgagagctgagtctttttttttttttatatatactttaagttttagggcacatgtgcacagtgtgcaggtttgttacatatgtatacatgtgccatgttggtgtgctgcacccattaactcgtcatttagcattaggtatatctcctaatgctatccctcccccctccccccaccccacaacaggccccggtgtgtgatgttccccttcctgtgtccatgtgttctcattgttcaattcccacctatgaataagaacatgtggtgtttggttttttgtccttgctataatttgctgagaatgatggtttccagcttcatccatgtccctacaaaggacatgaactcatccttttttacggctgcatagtattctatggtgtatatgtgccacattttcttaatccagtctatcattgtcggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctggttctagatccctgaggaatcgccacaccgactttcacaatggttgaactagtttacagtcccaccaacagtgtaaaagtgttcctatttctccacatcctctccagcagagagctgagtctttttcatctctgaatcccatagcattttccacaaacccaacacatagaagctgttcaagaaatggttgtgggatacatgattgttcttcatggaaacgatctgccttttcacctacaaggttgtttgctaactcatctcctgtttgttccctctcttgttcttgcagcagtttctctcctccatgcaaatcatgtccactccattccatacctctgcagaaaactctgacttcggcttaacctgcattcattcattcactcattcatttattcactgaatatctgcaaagtgtctgtgctgtgccaggcaccgtcctggtacaggggatgtagcagtgaacaaaacgaaatccttgcccttgtggggcttatcatccctcaatatctccaccttctcctaagtgacagctcccaaactgagggaaacccagggtttcacaaaaaaagtttctgcaatgttcatatcattaaaggtgataatagcagatattttaatttctacttaaataactggatgaatgtagtgaataattacatatggttttcatttaaaagagcagagtttggcatcacctacctgtgctcatgacttcgtcaccctccaccattgggtgaggagctgaatgttaccagttattgtggcaactgaatgacgaggcaatttaaaatgtttatttttggttaattgtttaattgattaagttgtctgattcttacccacagcgggtttttggtaatgacaaatagtagaagaattctgaagtaaaatttgaaaagtttataaagactgtgcatctgatgataactttataaatatatgtcaaagtattcttcactggatttcagaattgcatttacctgtcacataacccattaagatctctccgttaagttcaaaaatcaatgttaataatggaaagtttggtgttgcttatatccagtttggcttttaattttttgtatagatgtgtttactaatagcagccagaaatcctcttttatttcactagaaataaacaaagaataaaaataaatcacatgtttttacccaaaatgtaagcttttctagcattagttgtaaaggcagattttgtctgtttttgactacttttgatactatgagacacagttaaatttcaacctacagttcaatatttatttagttgccaaactaagcacactaatagatgtcattttaatgtatgtttcataaatggtcatttcttacataattaaagtaaattaaaccatgggaatcactttttagatggaactcattcagaatttattattataatccatgaatattagtaaatactatattcaattaattttgtaataaaatctttaatatacacttatctaaaatgacgcatacattttaaaactttaactcatttcattttgcattacatgcaaaaccattagatgtttaaaaaaatgttcaaataatatatattactatgaaatgagtgcataagtttagaaatggctggggaacgctgttctagactctttatatctgcccttgcccttaccatctttgcaccttctctaaaacaaccgtccttctcagcactgttgatcatcttttctctcccttgcatcatcagtctttccttttctactttcttcttttcctcaaatccataaacattatcaggtctctctattctacacagccagccaaccagctatacacaggttcaggaaaactccttcccagtcctgtcttcccctcaagctgccaccttacacagtcaaacttctgcaaagagtatttttctgccattttctctgtctcagggcctttgcactagctgttcttctgcctagaatgttcttctcacaattctttgtatcactggctaagtcctgccatacaggtttcagctcctgtaagagctgaccaaccatgctacagtgcccaaacaatccgtcttctgattctgagtatttattactatctgacactttccttgtcccaaaaacagagcacatccctggatgtgactccagggtgtaaaatagtgcctggcacatagaaagtgcccatgcttacttgttgaataaaggaacagacaagtaaatgatgaaccctttcagcctcccttgctggtttcttccctctctcccgacccccaaatgcttgctttgtgcaggagtctgccttttaacctcttccctccttccttttcacactctcactgggttatcacagccacccgtcaccctcagaattccaacattcacccacatggagatggcaaacacagagcacggtacagcccagcaatgcagacattgctagcagatctctgctctcttttcaggatagtctagtgtgcatggtgatccaagacaggatcttccaatcaatgggaccggcacctctaggtgaaggctatttgctttctttgacctatatgtcaatgacttcccaaatctatgtttgcagcactggaattttcagacccctttgtcaaacagccttctggacactttcatttgttcacctctaccatccagcacaatgcctggcacagggtgaatgctcagtaattctccatgctacaataagcatgtattcagtgacacgacccactcagatagtctctaccagcttgctaggtataaaagggaggctcacctatttgtgcttctcttctttcagagttgtggtggcaatttgccaggtctcgagcacagtacccatttgtaacaagttacacgttttggccaatagttccacaatttcacccttgagttccttcaaaactcttgggtggctgccatcagttccggtgatttatttacacctaggatgtcattctaggacatcctgtccatttgccacaacttgttccaaggctggagacctctctgttttcaaatacagttggggagtgggaattttcctcttcacctccatggtaacagctaatgccaaggatttgccacgactctctcaactagtttttgctcatttttaaagtggtgatgatcaagtgagtccaactgatataatggtctctctcattttttccctgccatcggtacataagaaaagaatactttctgattggcatagaaattccctgcaaagtcatcctcaaattatctcctgaagcactgtgccaactaactctataaagttccagctgataactcagatggattcaaaagctttcacacccaccagatcatttaatctgaattaagaattctgaaagattgataagagaggccagacagttaccattttacagacaaagaaactgaagtccagagtgatccagagatctgaatgccacatagcaagttagcacctgagctgaggctcaaaccgttcttcagatttacaatccagtgggttttctccttgctacaccttgattcagttgaactgcatcaacctattctaatccaatcaaatgctgaatgaatagtcattaggacaactggaaagaactaactgacgtcaaaatggttgattcagtagccacatgcatctatggcctcatgtaacaaaaatgcactctgctaagaaatattccccaaggagagcctgagagaacacactgaagagtcctgccttacagaggccagcctggactatgtttgagggtggacaacacaacacacataaatacatacatagctttgtgcatttcaaggcttaaaagttcttgttgctggattttatcttgagattaattgaattctcactataggatcctcaactggaatccaggttgagggggacatgggggccaactctagcaatgaatacatcatcaaacggggggcaactttgagtcagtagcaaccacaattcccacaagagaataatgaggaagctgagtagttggaaggattaaatactggcatttcatttttaggatcacattttgcgtgcaaccacagctccagacctgaaagactggccgtctcagatttgcccatacacatagagaaatctgcctctaatgtaatctgacatcgtccctactctctgattaaccacttttgggtgggcctcaaagaagtgcgtgccaaatgatgccctgtggatctcaggagctgccagtttcattttcccttctacctactcttttcccaagtattatcttgccagttgggaagatatgatggaatggaaagaaatatttaaccatctttgatacaaagataggagggggaaatatgatttgctatcctattttcccccattgaggagataaaaagtactttgttagatttaatttctttggtacaaagattagtctgagagtattttgaacttgtcagtcattcaactcagtattttaaattttttaaaagcataaccttgaagtatatgtgggctttttttaatagttttaaatttgaagcccctgaatattttataaaaagttcaatttgtatgtgtgtttttttaaaaggttttaatttacttcattagaagctctctgagctttaaaatatttttttttttcaatgtttctgagccttcctttggaagaataaaatgctcttctaagaaatgtcaattgatcgttggggtggaggaactgtgcagaggatgaatgtgggctaaacattctctggcacctagttgatctctcttccacatgaagcgtatttgctaacgaagggagcattggtatgggaccgaagaaaggattcccttagtctgttaatttacttggaataattcattagctgacacttttagctatgaatttagctggtaaatcccagatcaccccaatattatgtgtaaagaggatagttcagtctttttgtgagaactttgggaggatggattaaagccctttctcccatagttaccctgacataagggagcttgttaataaagagctctttggatcctttcctttgtacaggcaccgtatgaatatttatggaatatttcatctgtaaacagcattaaaatataaacagagcataccaagaaataggaaggccattttcacctaatgcatagcagtgctgtgaaaatgctagggttccattcctggttatcagctaaggaacagcaaagaaggaaaaagttatttgtttaacaaatcagggggcagcaagtcgtgtgatccagtggagctttggtattcttgttaatcaagtcttctgggtaattgaatgacgatgcatgtctatacatgcagacagacacacacacacacacacacagacacacatacaggtgcctgatatttgtaaccactgtgactggtcatatgagattgttgcttttgtagataaaaagtggtcaaatatcagagtttttgtatgacgctgcctaattagtgccaccctaagtttctggcccttctccttttgggcacagggaggggtgggaatatgaaattgctgttcacacgtgggctcctactagcaagatgagcaggaaagggaggagagggaggagttgaatgaaaccttcacagagaccaacttctgcagattccatgggcgacattgcctcttcgaagcagcaggatggaggacgtgggggtgccacccagcctgtacaccaaagacacttcccactcaccagttgtggctgtgtgctcttgattgcaaacctctggtacccatcacagatgtattatcaattttcaaagggattcgtatacaataaaatacactcaacaagaaaaccacccagaacgcaatgaatcattctttgatgattcagaaggcactttaggatcctgtagtgccttaggggcagcattacaaacatcaattatcttatggtaaatgtgtagaacagctagttcacaagttaagaaagagctgggcaactctcttttatgatatgtttttttaaaaaattatgttttatcccaggccttttctactttcaagctcttgcccagaatgttgcttctatttttgcaaaaatggctcacttaccagcttggagaagtacctctcctatggtgtgcctgagtaagtaaaactgaagttgtctcattttcctatgagccatttctgggggtagacttctgtcctgtccttctcccctaaccatttaggtatgcctctaattaaattcaaaacactatatgagaattttggtctgacaaagatgacaaatatttgtttagaaagctcagtcaggtggcacacttatgcacggttcagtttcaaatgttccttaaaaccaggagggtgtgtgattctattgaattcaggccaattgcaagctaagtttctccctctttgcaaactacagtagttggtaatgaaaaaaaaaaagtctagtccttggaaatcaagttcttgagcacttttgaaaacagactaatccaaaacatctgcaagaattttatctttaaaaacccaggtgtctaaaacataaggggaaaaatatacaaatgagactttgtcaaccaagtttttgaaaaacaggtttctagcagaaaaagaagcatctagaataaaatgcagctggctttatgaatctttattttccatggtgattcttcctttttggtcttcaacaaagaatggaatttctaggtgagtcttgtcagattttccaaaagtactattaaactaaaacgaggggattccaggcaagataacatctctgggaggctcaactctggcttgaatttattaaaaacttctggttcttaatttaaattttaatggtggtagacccaaagcagccagacacgaaggttatggtatcagatgtgaataactgaagacagatgtgctgtatttctatcaaaccagaggcctgggccttgccccatctatggtgaaaggtcaccagaattcagagaaaggaggacatattacagccaactgtgtgcctttaaagaagtgcatgaaacacacacagtacacacacacacacccacgcacacacacaccacacacacagggaataaaggagcatctccaggttgcttatacacatatttactcctactattacaaggtgagcctacacatgatctaaagaaatgtcattttacttgaagctactgtggctttgtagctacattttcttacaagttcaatatcatctaaccgctaccctaaaattatgtctgcaagggggactattggtatttcgtaaactgctgctgcttctcctctttctctgttagacatggtctaatgggtttagaaaatgacattcaagatgctgctttgccaattagaacttccgctacctgattcttgaaggacatagcacgcctaattgtgtgctcagacattttattaagttgttttgagtgctgaaagtcttttaaccttcatatagacccatattcataaacaaaaatgttttcagggaaaaaataacagggaaaaaggcatttaattacaaataaaagtactgtttccaatatgcacagatttttttttttttttttttttttttttttttaaccaacctaccaaagcaaaggcaggctgcagatggtgaaaactgagttgggaaaactgcacagatattttcccaaaacgttctcagcgatgctgcaaatgccattctgggtagccgagaggaaaagacagcaagcatcatcttgccaggggcagaacctattcccaagccactttgagagcaggagttgaacaaatatgatttagatgtttcccccgccctggaaacatggtcttgggttaaccggtccttggacaaatttaagaacagtgtctcctaccagggaaattatctcatgcaagaaaaaaagttcccttaagcatcaaattatttttccttaactttcttttagaaagtttccttttcaaagtttaggaggttacacagcatgttaaactcttgacgagatctaaggcagaggagcgaggaggttcgctgctgccagccttccaagagaacccagtcattaaggagccccaactgtcaccaatcatacggatccccatgtgggacacactttagcatgaacacaaccttgcctcggaaagcatacgtgggaaaatatgccaggggggtagctccccaattctcctgcccaaagatgtttgccatagactacgctgactggcccattcaggagcccctcgggtttccgctggacctacccttctgatttgagatcatccacgtgttttcccacctccggaggcttttattttctgcttcctcccttcttagtacagtgccaatcactgctctcccccgccgcccccctccccaaaggctctctgaggctgctccctttgtgattggcatctcattaatgaagaagggctggtgtctctcattacagttagagtgagtgagaggacctcagaactaatttacttgctctcactagggaagacacttgcctccatcaagaacttcactttcctgctgcctgtggcaataaaagaacccgttttgttttaacattaataaggtgagagaatagagaatttccaaaagaaattaagaaaggcaagagggtaggtgttggcccatggaagtttccctaaagcaggtctgatggcggagttcagtgagaggcctttgatgcggcaacatctggaccacatgaaaaaaagcctagcaggcaaatgagagactggccaagcagagaggctggggtgggaagcggggggtatgggttctaatcctaggtcctaagtccctgagtgaccttgggcgagtctttgatttttctctggtcctcaattttactatcagtaaaataaaggaatggaataaaatggtcttttagggttctctcagctcgaaaattttaatattctgtaaatggggctctggactatttaaaacttttttcatgtttggagtgagttttttttttatctctggcaacaaattagaaattcctccagaattaaagagcatggaatggaaatcatttggcttctccagctgaaaaggtcaactagattcagaaatgtactccaaggctgcactgtctgcatggaaacctaattagagatgatacttcattggctaaaagggatcaaacttatctgagctttcatctggatatgtatttttaaaaaattactctgagttactaattcatttatctttctacttacaggaaattccactcattgataaagctcggcttcgacgcccctgctcacaatgaaataccttccttgccaaccacattgctttatgatcgtgcccctttaccacattgtacttgaaatgccttgtcatttaagaaaccataaaaacgacgtctttaaaaatgggttcatcatttagctggagatggcttctgtgcctggaaccagaagcctgtcctctcggtggtatgcctccacaaaaggaagcgagctaccacaaaggacagcatcatgtgttgccttcattgctattgaatcgggaagttggtgcccagtttcaacatggatgacaaagtagtgggaatctgaaatgcctacagtagaagtaagggtgtctttatattgggaatatcctcgatcccagggcccatttctaattcccccttctctctttccctgatacaggctatttttgaacgagaaggactttggctcaaatcaacagtttggtttcttactgtttacatctatgagtcaaagtagcttgctcccaggatcccccaccaaaccgaatgaaaataaattcaatgtgtgcccactgagcctggcctgggagttcttgagatcaactcagaatcatggtctttctgtcactcccaaaacaatcctacctaattctacttgttcctaagtattgccttaggatactgacagtcttttctcctacttacagcttttgaatgaaattaaagctaatcctctctggcttggtcgggtcttgtgtaagattcccacaccccacaatcaaggccttgcaatgtggtgttagaagagatagccaagttaccacacctgtatcacgattcggataaggatagtattttttgccttccatgagacagctttgaaaacctgagtcacagaagctgcttcatgcaaatccttccactttcctcctcactgccagtacattggcacctccttcttaaaatgagaagagaagcataaacaagacctctgtggacctcagaataaaatgtaagatcttcagatttccatcgcatgatttcaccaggccaaggcagcccagcttcatttttacgtgcactgtggttctaagtatttacagtggtgtaacccgctcccccacctaaccccccaatatcggtactttactcactcagcttctagtgagaagaataaacaaaaagaatcaaagagaagaaggcaagaaaccggggaccaattttcagctcatcctttccttcttaaaagaaggaattcgcctgcagtgtctgtaatttagaaggttttaatgaatggcttctaaattatttattacgcatagaaagctgtaaacatccctctctgaaccattatgatattatctgggcaggagtcaaaaggttcaaacatttggcacttttcactggactgttgttgaaaatagttctgctctgtgaatgtaacttctctccttccttgttatatggaattgtgtgtgagcctgtgagcctgcgagcctgtgtctgtatcattcacttgagatcgtcaaaaggcatcctggctttgtaatttgctcttttgcagactttcgacttaataagagattccaaaattagtaaaaaaaaatataataaagtaaaataaagccaatttaaaaagccttcgacagaatatacaaactggatattcaagcagaagtgtttgaaatgcctcagcctcatttcaaagagcttcctgctgtcaagcccaaacacccagacaggtagactgctgtgaaatatgtaggcgatgcctgctgcctgattttcagatggcgaggaggcatttgaaagcatcaaagttccctgtatagatgtgtgtacattaatccctgcctctgtgatctctgcactcgcctattgtaacttgctgtttaatagattgccaaactttgcccttcacagactgcactttttttttttttcccaaggatctgctcctctcccaggagcttcttgctggggccgagttttaaaagttttcattcctgggcttgtgctatggcattgggtcactctttgaattctgcacttttgaacacctcacttgttggcttgcttttcctcgcccctggtgtcgatgtctgtatgtggctaaagtcagtgccctccaaccatgaagcatctgccatgagccagccctgatacgaatcattaacaaccacagcactagccctgtaagagcctgtaatgtagtgggagagaagatagagatcaaaggctgtcaactggcagcccacaggttgtgtatggcccaaagacatgtactgttttgcctacactgtgttttaaattcagattagtaactaacacagaaaagatgggaaatttcacttagaaatctgtgcttcaagcttctcttggaaaattggaaggtgtgattaaatagggcttcctgcctgcatgggtcctgttttagttgggatatatatttttttctagactgaggtggtggaacagttaccattaaggacctcagccttggctttcttgatatcttgatgttacctgctgggacattggccttttgagtctgtggtccatgataaggacacacacaaaggcaaatactaactggaaaatttgggggataccagcaggtactctaaatatgtcatctcatttgatcttctaaacacatctacaaatctgccattataatatccacttcacacatgaaaagttgaggctgtttttaagtaccttgccctatttcacacagctgacgatagaggagttgggtgtggaactagagctattagctttgaagcatccttcttttcaattagaaaggcaagaaagtccccaggaagggtgcaatatgggctgccagatctcacattgtcttctcccactgaaactcaactctgctctagtctaaccacaccacacttctcactgtacccgaggtattcttggtcatttgatcacttcttgtgtttgtgtattctattccctgtcctcaccttctcttttgtacctgcaaactcccttcttgctttgcaaaaccaagaataattgttagttcctttatgaagattttcatgacccctgggtcagtttgtctaacactggggctcctagagcctccatttctactcaggtgtctcgtggtaaaaggtccgtacactggtggcttttcactggactgtcagttccttaagggcagggccacatctcgttcatcactctacaccaccatgcccagcacagatgcctgatatgcaggaagtactactccatgcagggtggcctatgggtggagttttcctggctgaatcacacacttatcaagggctccttgggggaagtgaaattgaattggaagggtcaacagtaaattctatctgtgttttcatttgttttctcatcccccatcatgacaccctcgcttatcctccaaactttttgcttaacaagactttgccgctgcctcctcttttgccagatggcaatgcactcactacttccaatacccagatacatccatcaagcaacttcaaatttgaaacacatcagaaacttgctgggcatggaacaggtaatgaggaaatggcatatgtgcactgtgggatcgtgatggggctgtaaagttaatcaagaaagaaacaattccaccaagagcttgtgaacgtacctgaaaggatgggcaggtttgtccaggtgtgagccgtaggctggctgaatgtctctttctcatgtgggttatgggaaaccaatatgcctccaaatcactggctggacctcaactgaactttcagtttttattttccactcccatactatttttgaaagcgttaaataattgcctctacagctaagcactaaaggcctcatttaacaaaaatcaatatggagcagtacaagcatggaataaaccaaaccagaggccaaagcttaaaatccatctcacaactgaatcataagtggtaaaattaagagcaggtgcactgacagacagaggtgaaggctggcctgataaaatggatttttgttatttctaatgaactcatcacatgcagacaatgagaaaggactgaccaggtgggagggaggagctgactttggcaatgatgtgtcttctccacacaatgattatttcaagaaaggatgcagagtagaggctgtagtacatttaggggagtttcaatcggcattatttcatttctcctccctaacaaatcttcactgaatgtgtactgcatgtgtggttatttttaaaacgtgcacagtgaacacagcttgtgaaacttcggtcaacatcctaatcaggcaactaatgccctattcaagattggtgtacgctagcgaccacattttagaacgattttacctggtgtgaacagagagtaaagaagggccacccctttcccttaataacaggttcttagctgttagtcccaggaagtaaagcaaaggcaaatgaacttccatgataaatatttaagaaaaataatctttaattgagttagaatgaaagtaaatgtgcaaactgctatttgagataactgtctcgataagcctcttgcaaatataatatgaagcagaaaacctgttaactctttttgtctcgtctttattcaccagggttaggtgctcttacatggtagggggaatctggactagtaatatctcgatgaagttgcaaaaagaacaacaaaaaaaacccatttggttgagcactgtgagctgacatatgcacctgtaagccaagataactacagagctgctctgcaaatttggttagggtttaggggataatcttagactaataaaataaaccatccttgaatgttctagtcaccaggtagcagaagcctgcttaggtctcagtggattccttctttctggtctcattggcagttagatattgatgttataaactctcatgccacgagtgtgcctctctgatgtctgatatccatttggaatcacctcggaaaactcactattaccagcagtttcttcaagcagaccaccctctatgctcctgaatgttctctgaccaggctgggcctttcttttcctctaataattagccacccattgtccccctccaatttcttccaaccctgtttcctaccccttgcatttttcttgcttctttcattttccctgtgtatgctgactgcctagttcctcttctactaaattatgctctattatttccactgcctgaagaactcacagctgaagcattatttctaaccttattttgtattcctagcatgtgctataacctgttttgagttttatttgcagccaagatgctgacacagctccaattttgttttcatattttgattgggtaggagtgttcattactgtgggtactagggtagggaagaaaagtcattttaaaaaggcacaatttacaccttcgttaaagggctttttgtttctgaatgctgcccatttaaattctaaaaactacaaatgttcaaaaaagatattcctttttttttcttggagaaaagagattttaatgaaaattatagaagtccaatgtaattttcctattatgtttttaatgttgtgcctattatgtctgatctccttttgtgtttcttaactgaccagcacatacaggcaggtgtggaaagcctagaagtcaggggtttgtaagaaattatgttttcaaagcccagttcagctctacattaaccagccttcccagggacaactgcctcatttgtgacattattgaattcatggttcatattaagcttatatctcataaccaggtaattcatgagtttcagctacagggaaccccttagatggggcataaaatttccaatgagctttcccataaaggaaagtgtaggatgagtgaggtttcgtgctcctttacgtttgtttgttttttagagacccagtctcattttgttgcccaggctggagctcagtggctactcacaggcccaatcatagtgcactgcagcctcaaactcctgggcacaagagatcctcctgcctcagcctcctgagtagctgagactacgtgaatgcttcaccatgcctggctagttttcacggctcttgatgtatgattctcaggctcctttttggaagagatttaatttcatgggactcctctactccaaaatcttcaagaactccacagttaaggttgtcaggtaaaatgctagatacccaggtacatttgaatttcagataagcaccaaataatatttttgtataagtatgtcacatgcaatatttgggacataattatatcaaaaattattctttgtttatctgaaactcaaacctctctgggcatgttgtatttttatttgctaaatctggcaaccctatccatagcgcataagggaacaagctttaactcttaaggtaggacttctgggtcccccatagactgactctcttttctttctgccttattttctgctatatccaactccccctaccctccattccactgagtttgagttactttcccatctggaatgcctcctttccttctctcgccctggattattcaagactgcctcctcagggaagccttccctgaacactcagccaaaagtaatctcttggtctttttagaccagtgagctcgttctgtgtggcccattcattggtacatctcacacacttgcctgggagcttagctatcatttcatctctatactgtattctttccaagaggacacaagctcttgggtagcagtgaccttgccttatgtttctttgtgcactttgcagtgtccagcactaggcctttcatatagttggtgctcaagggatacctagtgatagaaaaggccactattgattgtcaccgagctgctctcttttgcagcttcatgtttctcacacttctttccctgcattgagggaaggctcaacctgttctccagaatgttagcacgaaccccatacatgaacttcatcatatacctcattaaaaacttgatagccaggttcatttcccatggacaagtgaataataagtaatacaaaacacagtcttatgtgggcaagccacttgttctctctgtagatcagttgtctcatctgggagaagggcctggttcctcccctacctctcaggatcatgaggatacacgagatcttggaaaaacataggtagcacggtgctgcagtgcatttagtgatgaggccaagaacatggaataaacttctctaagtatattctgtttaaactggatccttgagttgctcatgagaatttcagggtacatgccagcaacaaattttcaaatcatggctgacaaggtgggatttttattttattatttatttttatttttatttatttatattatactttaagttctaggatacaagtgcataacgtgcaggtttgacacataggtatacatgtgccatgttggtttgctgtacccatcaactcgtcatttacattagatatttctcctaacgctatccctcccccaggcccccacccccctgacaggccgcggtgtgtgatgttccccgctttgtgtccaagtgttctcattgttcagttcaaggtgggatttttaaaatgacacaattggagacaaaagtagctggcaagcaggtggcaggattctcttgctaacctagggtactaagtcttggtcactggaaatttatatttaaaaactacctcgtgattgcctggattttagaaatatgcaaaaaataaatttctagggaaaaataccacagagtaataatgtcagctttaactttctttaaaagctgttttaaatgtttctctttaaaaaactattttgcttttcctcgtatgggtacccacacctaccttgtgtgagtcatcatctcatgcaccagggctttcaaaacgtgataagtaaagcaagacgtctactgtatatcttgttaggaacttgctttgcctttttgctcctgttgctctacagaaaagatggagcgttcatgaatggcaaggtgagccacacgtagggggccgtcctagcccagactgcccaacactcctgcaaaacctcatttcactgctggatctacaggcaacccctgcactgcgattcctcctcctcacacccacattccaggctcaattagtggaatcctagtcttatatccacaccatggcagcacattaaaatgtctccgattaagccctggattagcatgtgcccagactttatcttaattgccgattaagattaatcccgccagggagttttccagggctgctttattaccatggggtgaatcattacatagtttgagttgcaagttccatttagctttctttgactaaaatgggagacccagactctcttggcctctaaggaaggggctctttattgctttctgaaaacctcccttgacagctcatttgcacctgaaggttgtgaggatgaagccttgatccatcttgacaagtctatgaaaactggaacacagggagtcacaggctttccggcgggctcttggctttaaaaatctacagtgaactttgacttgaagaatgatctttatatactcggtgctggctttatcattcatagtgatttactgaaaaccttttttttctctctttctcttgctctacatggatgtacatatttgttttctgaaccgtttgaggatatagtatatacatggtcctttagctctacatacttcagtgtgtgtttcccgagaatgggaataatttcttacgcaatcacagctgagttatgaacttcaaaaatttacattggtactttttaccaatcctgattttaccaatacttttactaatattgatttactccaaaatctacttcactaagtgataccccgataactattaagtctggctacaaaagagagaattgaaagcaagagaactctccatgttagaggtaaagtgatgagacctagaaaagagaaataacttagtgaaggtcacacagtggcagaagagtccagacaaactcaagaactcaggggcaacttctagccactgaattgatacgcacataaagactcaagaaaggtcaggtcagtatcgactctggaaacatccagagctaccgggccaagcagacttgacactaccctacctagatatggaaatttcccaagggcagaggccaagaactctgtttttgaaaaggtgtgcttcacatttatgtaatacataagaaagacttgaggatagctatacctgtttcactgaaatacttcttttctcccagctttaagatgctaattgttcatgcaattctgtttggctgtctggggaggcataagtcaggagcattcagcagcagtgtagagatcactaacgtggcacagctgtgagaccctttgacaacagtacgtgcctttggcctgactcagactggaggacctggcggacacccacagccacggcttctggggattcctaaaagggcagttccctgctttctacctcagggaacctgatcatgttatcgctctgaatgggttggcttttgtcagagcatctgggtcaggtgagtctgcgtagtacttttcaatgtcaaggccagtcatgatattcatcgtcaaatctgtggcgccattctgtgatgtctccatctcagaatctgtcctaatccaagagccaacaatggaaatggcttcatcctgagaggccatcaacagagacttcagaaggatcacagaggcccaatctccttcacagatcctccaccagacatcccttcctaaggactcttcctcacatggctgtgggtattcccgcttctgctagtagagtgtatgccaagaaaagagaaagcccgtctctggtttccctaccctgcttactgccctgggcggctaccagtcttagtggtatttgggagtcctaacggatgcacccatatctaggtaacacaaatacccacagtctttatcttcctttacactaaactcatgagatacaccacattggccactggtatttctgaatggacagaagtcatttgctggtctctttctaaaggctgtagtctgccacttccatggtaatttcatcctaaagcagagcctaagaattgaggacgaaagctttctcttttgttgaacccacagcataaccatgttccttagattctattacaaaacaaccattggctttaactggaaacttgaaaatttagggtaattatagtatcaattcatgattactcaacacatttcctcaacttcctttgtgactgatattttgagtatgttactgtaacattcgttgaagaaagtgtgttgtcctgaaacaagtgaggcctgagacaccccacacgtctaagatttcttacctatgattcatgtggctgccagaatatcttttaccttctttcttctttcaacccttctctcttaagttccgtaaacttgtgtcgggcttcctgaatttgccttcagcactagtagtaacgtgactctaaatggatgggttttccatgttattctggtccaagctgcaaaagattagattccccaccgagccctgatggtggtattactaggctttaacttgatgggactgacttcgttaatagaattctctcttcagttgtttgactatgttaatgttgctagaaggaaaaaaacccctgattttcctatatgtaagctgttttcaaatttgcgtgggggttctcttgaacagatctgcagttttcttcctatggagacactacaattaacacgttcctttttctctttataaaaactaatatcttgctaggcactccgccaggagtactgaaatttagttctgataaaaatccttcttggatatttctggtctaagctttaagatctcttttccttctttccctctttgctcttttcccctccctgattaccccctactcaaggcacgagcacacacacgcacaattcatttatgcctaccttggaacagatctgagccaacatattccctggggggaaacaacggtctcttttcctattaatgaacagtatggtgttgcagattcacggagggcttaatttaataaacatggaaagatgaatatgcttatgggacatcaaacctctttaggtttaaaattactgacatagaagaattgtcttgtgaagcaccccgtcctttcatggctgggtcattatggaatacaatgcggcaggggaaaaacatctcctacctggggcttcgactccttctaccctttgactccatctcctccatccctaagtgccagaggaggcgtcagatgtgcagaagtcagcaataactgtgtgtgaactagttcaacctccaattctgtggcttagtccttatcggtaattcgatgggaacctgaaactttgttgaagggaaggtattttgctggctcggctagaattgagtgtagacagcacccacgatattgtgatgaccaaccagcttgagatgaaggcactcatgaccagcttgcaggagcaggcctcgtcccaactcctactccctttctctccccgccactcttattagacacacttcagactgaatcttctgtggttcccacctcactcttcccattcttgagccccttccccttcatcttggactagtttgtcagatggctaggtaatctggcaaggtcttcaggagaggagggaaataaaacaggcggaactctgtccaggcatttaaagacgcaaaaggctgcctgctggggagcaaaggcctgggaggctagtgagcacctacagagagctgggtgctggggagaaagaaaggaaggagcatcagagacttcacaaccaggctttctttaagtacacgtgctcttctgctccttttaaattatgcaaaccaaactgagataggcacagcagagcgtagatcctgcactaaaagggtaagaagcttgcaattgagccgtggctgtaaaaggtaaagacaaggtatggggtccccagggtttggggtccaggtctggttaggggagtggagttcttgtaaagagtccttaaatctttctctaaaccaaggactgtctagacatggcatcagtaacagtgcaattaccgtctttggatttatgcagtcctatccttaccattctgtttaaacctgcaacctgcctccctttttccttgccctatttttcctccttcccttagcacttatcaccttgtaccactatacaatttatttatttcttgtatttactgctaattgtctgtcttctctctgcagaaatatatgctcctccaagacatgagtatttgtctgtttatcttcattgatatatctctagtacctggagtagtgcctagttaataataggtgctgaataaatatttactaaataaatgaatgaatgttattactccttacaagctgtcccatactctaaaacaccaggagccctttaagacgagcaaaaacagagccaaaataactatgcagaaacaaagcataagaatgttcacactttagtcttctctaacaaagtatattccaattagttaagtgaaaagctgaatacaaaacaaaataagacccggaacattagctcaggaagaaacacggatacggagaaatcacaacgagcagcctcatggtatcatggaaaattgatagcctagatatcacgagaccctggttacagtcccagctttgcataaatctgtgtgaccttaggcaaatcaccttgcctctctgggcctcagtttttccagttaagtttgattcaactcaaatatttaatgtgtgctcatttcatcacttctatctctaaaatggcataatcttacctagtcccacctgatattaagatgctaaaatagcctactacctaaatgtgatcatttctgcgagagaaattaagattgcatgcccagccccctatcactgtgggctgcagtccccagatggattacaccttcattttaacatccttattcagcacggtaggcatttactctaagaggtgaagtcgaaagagtcccctcatgcagcagagtccaggtgctcacctctagtaaccactttggagaaccgagaatcaaaccgcaatctcggcagcacagggaatgagtaaaatacccatagtcgaggagcgtattgaactgctgagcaaggggtgtgcaaatactatttcaaatggcttaaaaagcatcacagcaatgtaagtgggttacggttgcctcacaaaagcacatctggaggatctctttgctctcttgcatccttgaatatcgaacccagaaaaataaattgacgtgctgtttaatccaatagtcaatatgagcttctagtgtatagactcaattgacttaaaactcaagctatagcctccggcaagaaaaatgtaacacaactgcgcaggcttggtattgatacatatcacaggtagctgtttcttcagcaagaaacaattatccaatgctcagtgctgagggatcaatgtgcttcataatttctgatgtggcttactgaacagctgggctcaggtttttgtttttgtttgtttgtttgtttgtttgttttttaatctttacgggtctgatggctctctaaagggattaggttattgtgattttttttttcccatgcaaaaggacctgcctttctttccctgttctaacgaaagggcaccccccactgagttccaaagagccgttgccccttaaagtgccctctgccatgcattaccttaggttatgtggcaaacctaaccccatactacagcccagttacctcggtgcagacaactggctgtatttgattgttttgctgttgacaacaggatggattagcagggctagaaattaaagtatattgagtattctttaatgccttatgtacaaatttttctggctgtcagattctctgtttggctttctcggggccttgaaggtagggggtcaggaactaagtgttttgagaactgacagctccctttagcgaaaaacagaattctcccacccttaccccttcccagttcaaagaactgcttcctgcttctttgcatggaagatagttactgtttttctctttcccttttgagtcaggatccctggagagccttataagagcacagtgtctactggttaaagggtaaccattttcagggaatttgcattaatctgattacattttatcttccttcagggtgagggagtgggacggactgtgaggtttcctttgagtttcaggtttagacacaccccagaactcaaagtaaaaatgatataggcttaataataacttcccaagaagccttttcaagttcaaagtggattgtaaacattaattaatcaattcctcctcccaacactgtgtgaggtatgaattactcccattttatagacgagaatgtttaggtagcgagcataaataactcgtttcaagcctaaattggacttctagtcagtaaggcacaagcaatttggattgctgtgcaaagtgaaggctcatcagacttttctcattcacaaaaattaatgaaaacccgtcctaggaacccaaggctcgttgtctccctggagtgatccgagtggcctctcccaggttggcccaactcttatctttttgcatcctcagttttctggccagaaagaattgccttcctccaacacaaccacaaggagttcagatcaaaggctcaccaatggtccatttaaatgcccagggcagtctaatgcatctctccataagactccctgaatggaggcttgggttttaccggcccagccctgccatcgaagtcatttgcaatccaggctgctcactgcacctgctgctgtggaagatgtaataggagcaggaagcaccatagaaggggaaatgctgtttggcacaagtaagtaaacagataggttaacaggccaacacatcttgcagcctttcactatatgaacctgttggctaatgttagtaatccacacttcttctacaaaagtcaagctggtggtcactttgcaggaaactctacaaggtttttctcaagacagtcctagcaatgaagcttccaacaaacttaacatggttctacatttccccaggaattgctgtaaactgataagcactgatattctttccattgactaaaacatcatgatcagtcaactgaggcctgggaggaatgatctttgtggctcatatgcaccaaggaggtttgcctcaactcgaagggtggagacactcagatttcagccttccctcatcagaaacacatttcctcatttggatatgtgttttccaaagcacttgggggttttcagcaaatctttatacatctcatggaagtaagaagaaaaaatactcatacttcacagaatacatgtgacatgtgtctgttaggtggggagagggtggggaggaggagttttagctgagctgtaatgaatatgagaaattaaagataaatagagggagagaattttctttcttttttgccacgctgggagtggaaaagtttggcctagtggatctctaccctggctgcttatcaaaaccatctggagaacttttggagactcttatgtccaattcagttctactgcatttgcttctctggaactagggcctatgcgggagtattttttaaaaaagttccacatggactggtgatgtgcagacaggcctgggaaccactgggctggtctagagagcccagtgtagacagtgaacatccgcatgtaagatacatgacctgtcagagaacattcaagagggaagttcctttaaaaagaatcaggcgagcttctcctcgcctaatagcttccaactagcatcagtgttcaattaataatgtagttttatttgatgtttcatgtgagaaactatttaaaaacaagaactctttcattctttttttcatttaaatggactcaaaagaaacaatttgcttgatagatgagcacaatgagggattctatgaccgtaaaataactgaaaatgaaaaatgattaaaacaacaaaacaaaaaccacacttctccatctgcaatccacatccgtgtagccatgtagtcgtaaaatttattgagggtctattgtgtttcaggaactatgcatgaatctagcagtgccagggtgaggcagacacggtccctacatgctagtgtcacccattctagcaagggaagggacaaccaaagagaaaaagcactctgataaaagctgatttttacttgcctcttaccaggggtcatgcaatcttccaagtgctttttgttccatatctcattttgtcttcacagtaactttagtaggtggattctattattatccccatttcacagatggggaactaagacttagaggacttcagtaacttcttgaaggtaacaaaacctgtaaaaaggagagctgcatcttttggactcagtagatcaaacatatacatccgcctccttctgcttcttaagtgcatagaaggtatgctgaggctggctggtcgtgctagggtggagtggggacgactgagcctatccttgtctcttgttaagtcactgctgctccaggtgagaacaaactcatctctggtgcccgcagctttcagggttggtgttgaggaatccccttccccttgaacttgcatgctttatggttagcagtgcctttgaggccacacacataagcgaggaaggaaaacataaccagcccagagtcctcgtgctggggcttaatttggtacctgagagtcattcattccagttcccggggcaggactctgcctggcctgcttaccagtgtttcagcagcacggaggggacccagccagcccacagagttaagcgcagctgatctgtaactccaagtcatctatttatcccctaaccgtgctgctccacgggcaagtgcagggacggagaacgcacgctttgccacagttcagtgagccgagtgcaagctcccttaacttggctgtggtgtcaagtcacagttatataacccctgggctgagtgcctccctggggtggggggtagggggcgggcaacgggggagcaggaaaggcattattagtataatgttaagaaaacagactctgacatcctccagagtttgagagtctggaactgtttgtttcccatttagtttgtttcccactttgttctacaatcttcaaatcccagattttggagtctgggcagctgtgggtggggagcccagcagcgtgaactggactcagcccctttcaggcagtgggcttatttagctttaagaaatgtcccaggccgggtacggcggttcacgcctgtaatcccagcactctgggaggccgacgagggcggatcacgaggtcaagagatagagaccatcctggccaaaatggtgaaaccccgtctctactaaaaatacagaaattagtcaggcgtggtggcaggcacctgtagtcccagctacttgggaggctgaggcagaagaattgcttgaacctgggaggcggaggttgcagtgagctgagatcgcgccactgcactccagactggcgacagagtgagactccaactcagcaaaaaaagaaaaaaaaagaaatgcccgttgcacgactgttttcagaagaccaatgattaagagcacgtgaaaattaatgcacaaatacagctaaggaagtgtaccatatagcttttgcaaccactcttttgctttgaaagtgttaaagtacacaactggaaagatggaaagacctgagattgacggcattgtagatacttctggaaacttttcaataaggacagcagaataaacaaatatgttctcctttcacgatctttattttggtaagtccgtttctcttggccacaagaattacaaccatcttttcatttttttaactgcaaaggcggtcatatgatatgaagtcactccatatcacagaaatcagttgaagttttattcatggagactcttccacagctgccatctgcccctccctctatgagaagcaaagtttcccgaagacaacccctctctcaaatgtggccctaaaacatttttaatgagtagtaagagataagtgaacatgtgggaaaatgttcatccctgctagtaataaaaaatgcaaattaaagcaactttgaaaaggtaacatttcagttttcggaaataataccctaatgctggccaagctgcatggaaactgatagactcaaatgctataggcattgagttaaaccagcataattcttcttgaaagaaatatggcaattggtaaccaaaattataaagatgtgcatatcccgacccagcagccttctctgggactatacgctaaggaaataatctgacagaagcaaaatactacacaaattgtactactgcctttaatgatcaaatctaatcacagacatacacacaaaattccagaaggagcctaatgttcaataatgggggatggcttagcaaattctggtatattgataatggaatagtaaaaaaaagaaatcaaactgcaaatacaaagggggtgcatgtaagatctaatgtcactggaatcagaggatttacttgaatgtttttatcttttttttaatataccaaagaaataaaggcttttgtacagactgtactaggaggcccttaaaacagctgttttcttgtccacctcatctctgcaaaggggtgtttatttcttttctatttaaaaattaattaaattttattgacaaaaattatatgtatttattgtgtgctacacaatgttttgcaatatgtaaacattatgaaatggctaaattgagctaattcacatatgcattacctcccaaacagtattttttgtggtgagaacacttaaaacacaaaggggcttttattaaggattttgaaaatgaaaataatgaaatacagagggtcaccaagatcacgctggatacaggaagaaggcttaaaacgtcgcatccttgagtctctggtctaagtcaggtccttggcctttgagtctcacctttgcagaggacctcttccattttcccacatgggatgactttgaaaggtgctaaaatggggccccactctcctcatactagccacatgagctcacatccattcaggtcctggaagtacctccagtaagggcctgagaaaactttaaatgccagggtttcagaacctttcagatcaacaacctgtctgttagccaccctgaaatgaaggaaacccagatccatgtggctaatcatcttttcaagactggcaaagaagagaatttgtacgcatgataataaaccattcccacaattagtttaacacaatgatttctggtcaaacctaggggagccatccctcctttacatcaacggcttccacatgctggtcagtaaacagtatgggcaggcccatgctttggttctcactggtctgtatctaactggggaaaataaggataacataataagtttccacgaagctaaatatattcaaaggagagaattattccttactctaagataatgtcctttctattttttcagtccccaaagtccactttttaggggaaagatgacaaaaaatagatggagttattttgttgttgttgttgttcatgttattcctttgcagtaaaatatagggaccctgtattggcctccccaaatgttactgaaatcatactgcttcattaagcacattaaccttggatcttccattcaatgggggagatggagattctggacattccaattgggtcactccaaactgtgtggcaaaaagttctggtcctgctggcatttcaaactgtgctgcacaaccattatagagctttgattccatcactgtgtctgtctgtctaccctacctggctgtgagcatctttgcccaggaaccactgcctgattcacccttctgtttctggtgactagcccagcactgagtgtactgttgttagactgaatccatagttggatgtacaatatgggtgaaatgcaaagaacagctgtaaaattgaagagaaagctttcagtgttggttcagaagacctaattagcatcctggttctgctatttaacagctgtatgacttgagcagtgactctctctcatactaatttcttttctttaaagtagaaaaccaacctaacctctataaagtagaaatgtcgcctatgcccttcaccagtatcctagctgtgtccttgtgtgaagggtcatgtgaaagtgcctatacatacatgttaatttcattcatttctctccattttattccctgaccagatgcttctcatatttagatgtcacccctgtcccagccctggcgagaggaaattacaaagcaaaaagccagatcccccaacccaaggatgtggaagtccagaggcagctgtcagcatgcttcaattaaagacaaaatcaaatacaagcagcatccgtttgcatttactcacgattattgtgtttgacaagataacctgtacccacttgtacattcattacagagcttctgaaatgatttttctttgtctgtgaacataggaatttttaatgaacagtttcagtgtctggtttcatgcactcgaaaagtaaacatcagtgagcatctttctaacaggcttgatccatgccctcagatggtctaccaggaggcagacttgtgtgggtttgaaactttcttcctgaggtcactgatggaaacaaagaaggagaaactttcagcatcccctttccagtgataaacattttaaataaatgaataggtaaacagagaagggatctcaattttaattgctagtaagtgaggcataaaaaggaaaagagagagttgtaactgccaggacaatctcatgcattcttttgaacagattcatctacaaatgaatgtggcacaaggaaatgtcaggtgttctgcaagcagtagctcaggaagctcaagtcaggtctctcgtctgtccctccagctagctacatctcacatcatgcttcctcacgtttcagggctgcagcctcggtagccttcacccagttcctcaaatacataatccttcctctatccacaggacctttgcatatcacactccctttgtctggttcagtcctattcatgtttccgatcatcgcttcctcggggaagcattcctcccctccatattgaggctaaagtatttccaggggacaaatccttcattgcgtttgtcactgttgttgttttacattgatttggtggcaatctgacaagctctgtctcctgcagaagactgtatgctccgcacaacagggcctgtgtctctgttctccatctcatctctggcacctcacaaggttggtactcagtataactatttgttaggcactaaatgaatggaatgaatggatccctgacaaataacttcaccaaaatcttttattaaagacttgcctttgcaaggaaccctgtggaatacgccaaaagacatggttccaggcctctgggggcttcatcagctgtagatgtcatgtttatacatacacgacatcactacggttgagagttgggctgtatcagtgtacaggagtgctctggataggatgttctaccttggacaagccactaaatacatctgtccctccatttccccattgatcaaatggtgacaatatcagtgtgctccttgttgaaaggtcaggggataaaacaagataacagaaacaaaaatgcctcaaaaagataaatattactaataccttttacctaaaagtatccacctccttaaccaactctacaaagagtcttgagcctcgctagagaaacacgatggaagctactctctttgtgagatgcaccttgcacagcaggagtgggctgggccaagttgggggcacagtccaggcaggtgggaagacagagatggggctactctagagagctaaaggacaccaaccttctgccaccagggccagccagggttgacagtggatcacgtggcctccctgaaatagggctactgagcagcttcgtgatgcacagagacccaggggaaaggagcaaagggccagatcctgctgcaaaacacactgcccatctgccctgaggtctgtcattcctccagtggtccttgggccctgtcttgcctgggactggcaaacaaacaggaggcctcctccctccctgatgctcacccgactggatccacacctcactcagcaacagctgtgcgagtgcaggtaaagtctttctggagtctcagctcgtgataggcatttagcaaccttcccagcggaggtgtggagcagacgaatgatcacagagtgagaaccatggcttttctcagggtcagtgtctcaggaaccatggggtggtgtgtgagtggaatcttgtcagtgttttgtgaagatacctaagactttcagtctatagctctgagaatgtcatcccattttacaaatgagaaacagagaggttaataagcaaatctacagcaagtcatttaatgctgcaaaggtgtagtccatggaaagagatctaacaggaaaactcaagagaaatgctggggagcgccatggggccaacagaacagaaggccctgttactgctcaagcagctgccaccaagcctgcgagctcaaggatgctgggctggctgagggacagatgtggcaggcatgcacgcgattcaacaatgcaacagtccctttcttgtttgtttggaaaggttgtacccgcctcgaatgctagcagcaatcacgaaggagccactaactgtggcatttcttcacaacatttcccctgcaactgcggtcaaggtggagggatggccacaaccagtcatcttttctgagtgttcctctgcaaggggtggagtggggacagcatacgttagtgggctaagaatttgcttatctaacagaaatacagcttaactaaccaagggatacatacaattgttcttacaaattctgcaacccatactgagcacttataaaggccaggccctgtgagagatactgaaaatgcaaagctgaataaggcaccttgactgctttcaaggagatctttcctaattggctaggagaggatataacccaaaatttacagctgccttttggcaagcctatcactgcaatctacaaggtgctatgagaacttcagggaaggagaaactctgtgggaagagcctaggaaaccttccccaaacaaggcattgaggaaagagtggaagttcatcaggcatcagaaaaaccattcattcatgtattaacattcaacaaatacttaagaagtattgattgtgctgggcacccttgtggctgctggggatactgcagtgggtgaaacagcccagttcctaccctcatggagctaagtctggtggcagtgataggcacacaaatagtgaatcacaaacttggagaggtctatgaaggagaagtacaaggtgtctgaaaagtatctatctggggagctgatcatgtctgagaggcagaagaagcttcggtggggatgtgacatttgagccgagacaggaaggatgctgaaagcaggggtaggctgaaatttccgggctgagtgagcatcatgtgcattcatccactccactgacatttatgaagaacatgttgttgcaccagggtccctgatgatgcacaagacacatctctgacctcaaggagcacacagtcgagtggggagacagatgattgcaatagaatgtgctaagttcatggctggtggggtggggaatgctttcccattagagggaacagtgtgtgcaaaggccaggaacgcacagctcaagacattttagtgggaagttaagggttccaaactcccctcgattgactgctatgtgacgtgtgcttgacctatcatctttctttttcttgcttaagaacgaaactcctttctctactaatcacggtgttgctgcaccaagaagaagccgcctcagcaaatgctgacgcatgcattttgcagtgagctggaagtgcctggcctagcttggcctgtgcctccctcctttcctccccaggcaggatccacacagtcatcagcaccacggggctgattgcttaaagaaggcaccctccctgcctcattgctccaagctggcctcagcccaggtacctcagccacacccacggcccatccaaacctgctgtctgagggtcagagcccccttccatgagaaagcccctgtcccgcttaataacattttctctctgcctgtctaattaactccgtcactgtatctgcagtcagataaaatgctcatttcacaccacattaatttttatcagctgaacattaagcaacacaaagctatctatgcttggtttaatttacatactgacagacctacaaagcgttacccacagtggctgcgaagcaaataagcagaactggcatcaaacaaggctcttcaaaatgaaatattgatttgcaaggctgacagtaaagaagggttggagggctatgggagaagaagcaaggaatagaagagtgatttttccttgaagaacaattattgatgttgtcaccagtaggcctcccaaaggccaaacagaggagccagctgaggccaggatcccaaggatcaggtgttcccaaggaacacagccccacagtccatactgctccctggaaaaggactctcttcatcctggcatcagaggccatcccagcccgaaggaaaatgccctcaaacagcaaagtattttaatcacatacacaaacacttaatatatcttgcttctgtaactttgctcaagctgtttctctagaagagtcttccttctattccatggccaaactcaagcaccacctcttccaggaagacttccctggacaccctgcttccttacaaatgtgttgccagaattcccagcactgggtctgcattgcaccgactatccataccgtttcttgataatctatatgtatgtttctttatcccacttgttgtgagctctttcagggacagatctaggtttggggcagctgaagtttaagcaagttaggggattttctttaagaagaaagaattgtaaaatatctaacttttgcaaatattacagaaacctataaccatgaaaataaattactaggggcattctcagggctttaggagaggccggtgcaaatgaagggtcctgaagtttaagttttatcagctttgaagtgggtctacttctggtctcttgagtgcaattccttgcttgtaacaagcattcaataaatataggcagcatgaattaaatgaataaagaaaaaggaactactttggggtgcccagtctgtgataggcacagccaaataactttgggaaggatattctcctctaagcagcacagcagcctatagatgatacaaccgataagtgttgaagccagaattgatttccaagactcaccttcctccatctgagaacctatgacccaagagaaaaagaagcaataccccaagtgaaaagacaagtggctcacacaggttaagtctttagactttagaggtcttagcactcataatttcacccagaccagtggttcttccacttttgtgagcatctaaatcacctgactcacttattccatggcagattctctgacctgcaaaccagagagtcgaatttctcatgtctgtataattggagtggagcctgagaatttgtattttaaatgtgtccactcacaatcttggtgcaggttttcgaagactacactttgagaaaccttaactcaactacaaatgttgatgttgaagggaagtgcaccaggagaattaattgggtgagcgctgatggagaggctagtggaaagctgtatttccttcaagaagctgggatgtgactttaacatggtgtggcaccatggcctcaggaagactggggactgacagagaatggaaactgcaagtctagaacctgatgagtaagaaggctgtatacatattttaaagtgcctaggcaagccaccagtttgagaacattcctcgtctttgtgtgactttcaacctgcagatgttttcaactgagtcccccatgaaggagaggagctgaagaccttctcctaccacaggggccaatgctggctgagtattctgctttgctatgttaagaatttcaagaggtagctcctggatatgtaatgcacagcgctcttgtcctggttatatatggcttctcatgaagaaaacttctggcctagcttcaatttcacaattatgcatgctggggcttgtaggtaccagatggttccagggttaccacaggtattttcctttcaacaccatcatggtaacgtttttctcttcagaaatgtctatgaccttcagaggccctagaaacgcccccccattgcccccccaaaaagcttcaaaatccaggactgtctattgtttcattgtcttttgcttgtttggtggtgtttattgggaagaaaatgcaatagatgctttggtatcaaaaagtctggctcttttagaatcaaacgtacataaaactgattgtagaacgagcccaggctgatgtcatgggctctgagttcaggcctgattcagttactacttgggcaagtcacttaacttccctaggtcatctcatctgtgatatagacttgataatattagttctgcctcccagagctgtgttaacggagacaaagtgttttgaaatatctaaatataaatgtaagggctattggcttttggtcataatctactaaccccttacagataacagttaagttatctacacacaataatttttaaaaaccattttcaaggcaatggaatgcagtcaaaagtccaacaggaactggaagggagtctgtcccctgaaacatgaaccttcaccaagtaaaatttatgaatttgtggggttttgtctgggagcactcccaagttagctttcagctctggatagcttgaactgtcagagaaataagtcagaaaaggaacaagaacataaggggagaaattctggaaaggtgggaactgcagaggcagcaagctgcaaaatctatgtacaaaatctgcccaatcctcggctggctgcaaaaatatatgtgcatgagggagactccaagggacccaatacgaagaagcagctggaagctaaaagaacagaaaagtgactttatctgctgtcgaccgcaggaacaacagagctggaatttgagtccaggcaagtcgagtggttgctaaagcaaaaattattttcagagaaacaaacagaatctagggtctctgcaacaatcatttgttttgtctattacccaatccaaagtctccatacatgcaaataaagagtaaaatgtaacacataagaaaaaaaaaagcagtaataaaaaccaaccccaagaatactcagataatgcccttagctgataagtactttaaagaagccattataaatatgttcaacaaattgaaggaaatatatacataataaatgaacagatatgggacttcagtgagaaacagaaactataaaaatgaaccagatagaaatcctagagttgaaaagtagaatgaatataatgaaaaaaaatactactgtatgggcttaacagcagactggagatggcaggaaagagtcaatggacttgaagatgaattaatagaaagtattcaatcttaagaacaaagagaaaataatgaagaagagtgaacagagcctcagtgacttgagcattataaaccatcaaacagtatacatatatgaaatagcaagttccagaagaacagtagagagagaatgaagcagaaaaagtatatttgaaggaacggctgaaaatttaacaagtatggttaaagacatcaacttatagattcaagaaactccgcacatcctaagcaagacaaatacaaagaaaacaatatctagacaaaccacagtcaattttctgaagtcgaaagataaagagaacatcaaaaaagcagccagagacctacagcagaaacaacaatatgaatgatagctatttctctcacaaatagcaaaggccagaagacaacggaataacatctttaaggtacagactgaaaaacattgtcaacccagaattgtatcttcaggaataaagagaaaataaagtcctttttggataaactgagagattcattgccaagagatctgtactaaaagaactggaaaagaaagttctgcagtcttaagggaaatgacaccaaatggtaactcagatctacagggaggagtgaggatcactggaaatgttttctcaaagatgtaagaagttattaatttttccagtgggtagcaaatttataccatataatcatactttgccctatagtaaatgacacattgcctctttgtcacaaaacccctaaattctacaaatactgtctttcctgctcccttcctccccatccccaccactccctcaaaagagagagagagagaaaaaaaaaaagagaaagaaaacttgattttattttctagctgtgtgaccttgggcaaaaagttaacttcttggtgttttagtttcttcatttataacaagaaaaagtggagtaaatgatctcaaaagttccttttggcctgaacatactgtgattcagactaaactggtgcagtatgttaggagtagtcttcatttaatttttactattattatggttacagtaactaagtcttagtcttcatgatcagacaaactcataaaattcattcaagaactaataaggcttagaagtgtcttacacaccaacatcctttggagtctcatcacttaaaaacaacaaaaaaatatgctgccatggctgaagtaatcaaatgaggtaagccacaatacatgtgctctgcaaactgcaatgcccaatgcagacagaggtaaggtggtttgattatcccaactgccagattccctttcacattttcaatatattgatgctggatgccagtttcttaagtcatctcaaacaccaaggaactacattaaaccatatcagaatgtgcttagtcaagtgcgaaagttcactgcacaagtcttgcctgtgtgagaagcagagagtaaggaagccttgagcctccaaggactgggaacagttaattaaatattcagtgtgtccatgtttcacttgggggagaatttatgaaacttcaaagagctttctggtgatttgccacagagatggacttaagccaggctagactccaaggcttactggccaccaaatcctgggaggctgccctggggtagccttcctcagtcctgatgctctgtgacatttgagccgtgcaggctttctctcccgcctcagtgcctctgtgattctgccggattaagcaagcagtgggaagttcctgactcagacagtgcactctagaacgggttctttgaggacctgggtcccagctggctctccaaggtgacagggaaaaggtagaaaaatacagtcccttctttggcagcctttttacaattctgctgagtgccgtgtgttcaactgtttcttttcttccccagaaaacagtcactgcaaataacatgctgtttggtaacaggtctacttaaaatgccacattcatataattatttacaaatactggcataaatgaaataaaggtctgactaaaacagaaaatctcaaagcccaacactattgctttaatgaagagagtagagaaaggctgaataatctgctgtttcaccgcgttcttgagaaaccttttctccctcctgcacacatattccatgtttaatcttccttttttaatttgctcccattacccaacttatagcacataatgaagtatacatatcacctgtgttttcaaatggcttttagatagatttgaacatggtcaccagagaaccattacacctgtgtgtatgctgccctttggaagaaaaacgaccataaagtcctagggaaaaatactgggtgcataccactgagccaaagcttgcttttagatatccaaagcttgcttttagatatccaaacctccactgacgtcaccagctaactgagtccccaatatccctatgagctgcctgcaggtttccgacagcaaaatccaatacatgttcaaaatggcaatcattaatttctaaacgattggccactgtttgttgaataacagtacttctattctgatagggtggagttatcattcaaccagaggcagagaaaaagcacctggcttccttacttgctttctgtttagaagggtgctgtgcctcatgcgcccatatcctagggctcactgctcacaagcaccgtaggcctggagttctgcctgtccactttctgtccttcaaccacacaaatgtggaaaatgggtggtgctgagattctgccctcagaggggttcatttcaaaacaaatcctggaccttagttgctaaaatgcgacaccccttcccactgcttctcaattacataaaaacctcaagaaacctaccataagcactggcatttataatctatcaccattttgctatgcatatagggtgatatcaggtatccaaaatccccacacactagatgtatgccacctcaggaaccgggaaaaagagtccttacctctgaagaaccaacctgaagtttgtggttggtggtggagacagccatagagagaattcaaaatggcaacccgaagtcaatgtttcaaatgggctattcaccttctgtaggctggcaggagctcttcacctttactcctgtgctcaccacgaaacaacaagagcagcagcagcaaataaaaccccaactcaaaatgggctgcttgagatgtagaatttgcttttatattcttcttctctaaactgtgttggaaagggcagccaaaccccgggagagtatttttgagctaagaatttgacaactgtttagactggaagctccctgagggaaggctcagtctttaaactgtatttcgctgaggcacagtttgataccatggtggtatatggtagctaatatgatgcaatgatgaaggagggatctcaaacagccactgatctcctaatatcacaacttcaaacagcttcctgccctccctccctccatggtgagtaaggcagaaacaacaggttgatttgtcaaccacagacaatcagaggaggccttccttatggcgcctccctatatatggcaactcccctcacctagcccaccattctcccctcacctccatccctaccagatgtgacatgccttgtagactgtaaggcactgcaccaccataaaacattacataagacaaagtaatgtaatggagataactttgggaaattacccaaaaggcctcatgcctcggtttcttcagctttcaaatggggatcatactacctgatgtcttgcctacattacaggatcattgtgggtatcaaaatgtgtaaagcctatgcaaatataaccatcatcattataacattttcttaacctttgcatcctcaaaaaagggaagtgcaaagtgaatgtgtggttcttgacagaactgaaagaagcctgaagtaggagtgagacaggccttagctgtggttctgccacgtctcctcctgggtgcgggaaccaggctctctgctctcagtgcctctctgtatcacagtgagggtggtattctagctctgctgggagacacagaatgtatgctggaacaggcttgagctcaagagcttccccatgcacacgactctccaggcactcacccttttgacttccccacatggagaagcctgattctaaacttggagaggtaatgagacctagcaggtcaggctgggccagcccatggcagtgaccaggtcggtataagcttttcacctctgaaaatctttaaactatttgggaaaacaaattactctgaaagaaaatcagacagataccactttatacccactaggatggctatccaccccccgccaaaaaaaaaaagaaataaaataacaagtgttggtaaggaaactggaaaccttatgtgtacatgctggttggaatataacgttgtcactatgtaaagcaatttggtagcccctcaataaatcaaacatagaattatcatatgatcatataatccagcaatttcactcctaggtatatacccaaaagaactcaaagaaagtgttcaaagaaaaacttgtatgcaaatcttcataacagcaccgttcacaattggaaaaaggtagaaacaacctcaatttctcatcaactgatgagtcgatagacaaaatgtggtacattcatacaaaagaatattattcagccacaaaaaaaagaataaaggacccatacaggctacatcctggatgacccttgaaaatattatgctcagtgaaagaagccagtcacaaaaggccacataatatattattccatttatacaaataccatgagtaggtttatcattatttatgtctaaatatattttatttatatatttatataatatataattatattatctatatatttattaattatatttattattattattattatttctgcacagaggcagaaagcagattagtggttgccagtggcagaagggaatgggaaatgggatttccttttgggataattaaaatgtcctggaactagatagtgtcatggttgcataactttgtgattgtcctaaatgctactgaattgcacacttaaaaatgattaaaatggtaagttgtacattatgtgtattataccattaaaaaaaagatagccatacataggtgggaatgaggtggctgggagaagggacagttctggagctcctgtccaggacagccttccaaagccatctttgctgcactgtgtgtgcctttccaagggcctgggttgtacattaattgagaaatgattcctaataagtcccaagaagccacaggtcttttccttacaaacaggaaacaatcacatctcatggcagctcattacacattctttgggtaccatgagttgttttaaaaccgtgaaattagttctggcagagtttacagaaaaacacccatgagatgagactgaatgagttatgtaagacttctcgcactctgcttatgagatattaactccttacgggcccagccaaggacaccggtgtcatttataaagtagtgagcacaccctggttcccaccaagaccagcacgcggttgacaagaagcagcagtggagccctagatctggatgggctcatcgagcaattgccagcttcagcagctaggtacttccttctccacaagaggccggtgaggctgctagccaggtgaagggacttgctcacacaaactggctcaactaaaagttccagtcttttcccaggagttaggctgaccttttggggtggtgcacggaaagctttaaaatcaaccagatgtgtagaagattaatacgatcatcactggcctacagctatgccacaagaccagccccaacccaccaggaagataagtaatctgatccattgagcttgaactctggcattaaggagacacatatttcaaaagtttccgtctggcaatagtcactaaattaattattatacatgagaaaaaaaaacttaattaatgtgtgagccccaaacaatgaaatgagctcagaagctttcctccaccccttccccttcatttccccaacagacacacacacacacacacacacacacacacacacacacacacacacaccacctgcagtgtacttacaaaatatgtatggaatattttacctatgaaatatacttcataatttatttagaaagtagcaaagcattcaaaaatgagtttaaaaagcttgttcaagatttgtctcaggaatcaagtactgaacttggagaaaccttaggactctacttagaatccatggactcttattttagaaataacatgcttagttgtctggttcctgagcactagctcattggaagaggagacagggagcactgcagcaaggtaccctaagcaagaagcaagtattcaccaccagagtgggaagaacagagaggactaaaggcaagcagaagtcaccaaaaaaatggcaccatcccaagcctggagccatgggaagtgccagcaaaccctctcaccctaacaggcagcatggtagcggggaggggacacaggcttaagtatcagacagatccaggtctgaaagccagaccttgctacttattagctgtgcaatattgggtaagttacttcccctctctgacccctaatttccttctaaaaaggaatgatatatccccactctaaagtggaggcaagcatgtgtaacttacagggactttgtgaaaatgggataagttatataatgagctaacaaaggcatctagttattgctcaataaaggacttttttttttttttttaaactcaaggacagtgtattatggcgtgggctgattattcatgctcacaatgagaaccttgagtcatgccgagagggctgacatatagctgtgtcctcagtgagagggcagggaccttccctttaacctaccccaggatcccaatacctcaggcctccgtgccctcgtgctggtctctggaactacactcagactctctatctctctttgaaagctacttgcagctaactattcttctgtaagttatccaataaactaatttatcttaaggtgtcagtgttcaataatagcaaagttttcatgggaatcagttagcaagggggaaccgctataaaccaacagtgatgtttcagcaaaggtgacagactgatgaggaattcacttggggtctgggggccttcttggcgtcctctcaattagactttgtaagcagtttcctttttatggctagcctgaaacattacaatatggagtcgagacacttcatggggcccaagcactggctgttgctgtctggcacgtctttataagagttagatgttgatacacatccactcaaaacacaatagctcctcttctgatcgattcatatttatttatttaattaatttataaactgcattggtccaaaaacattgcgggggagatgagtcactaaggtaaacaagttcagatgccgaaaaatcccaccaccaagatactaagtatatcacatgctacatgccaagatgcactgaaaaatcaaaatcatttatttttctttgtcttactttcccctgcaatctgatgttcttctaaacacccatgtcccagagactgcaatagcagagaggtagataacgagggaggggcacaggaagagacaaatggctgaagcatttcagaatttatcaagatatgtagataggaatggatcagtctttgtcttgctctctgtttctgtctctcagtgcctctatctcttcaaaataataacagaaatattgctaagatcaaattaaaaaattgtctctggctctgtttcctatagagggctgcagccagggctgtgttattcacttgtctatctcctgggcctgcagccatgtgctacaccaagtctgcctctcctcccaacctcgtattcagccaccctcacgttggttgcccaaaactggctacggtgagagtatttacaccacagaaattggcaaacttagacatcagggctttttttttccttccttgctcagtagaacaacttctgtagagttaaacatttcccagcacactactgatacaaatacttgttaaataaacaaaagaagaatgacacgctgttccacttaattcaatcatttccaacacctctctggccctaatcatgacaaacccctctgtaagttcttctccacaacaggatgacatgccctgggattcagttatgaagcagagaaggaaatgccaggaagactaatttaaaacaaaatttcgttttggtaacagcgtctctgactcagctctggtggaaagtatcaaccttataaacccacaaggaagaggtgaagatttcacatcgtttcttcctttgatgttaaaaagagaaccttcttgaaggctgggacagcactgtgagaggagggccaccaggctagcagagagcagtcccttatagcagcctcctcttggtgaactcagggggcgagagactttccctgagcccgagtgtcctggctatagaccagtaactattatagcacctcctctgtctaccccacacagcatctacctcccagccccccaaactcctatttatcctccaggacccagttcatatgccgcccccacctctttgggaagaggcctgctccctcagcatgcaggtctttccccaggtccttcctgtctcaactccagcatttactatgttgggctgcagttagttcttatcgatttggtcactcctctgtccctctgtgaccctctcaagggcaggggccacgttgagcctgcattcccaatactttctgcagtgcttggcacacagcgattgattgctgcatgcctattaaagtgaaccactgaaaaactagacgtgaagggacttttaaactggaaatgtaatctataaagtataaagagttattaccaaaggcagaccacaaaatagagtggcacactactgccaacccttaggaacagcccttacttggcgcagaccctattgaagcatttaatcacctcaccactaggtaaaattcgtgaaaacacctggtgaacttgggtggaaaggttcaattaggaattacagaaaacattctctaagtagtggcctccccctcccccctccttcgacagctttatcccaggtttccacaccctccctgcccacagggctcagaggtaagaatattatataaggaacgaatgctgccttcatttgttttaataaagaaacagcccatttaaagaaacacagactttagtggcttagatatttctgaatgtgaatatgacccagaggctcaggaatacagaacggctgtcttgagaatgagcgtttttttcctatttaaaacattctggaaaattgctctgtatccccatgccaagatgaaaaaataaaaaacataagggctatttggaatgtctctgcattttacagatgactttaatgcataatgttataaagacatgaagctctctggcctcaaatgcccccagtgcagccgcctgaaagcccgggagaggcacgccacggtgtggaatctgtgagcagaccccacaaagaaaactcacggtttcagatgagctttgtggttgttcgtgggctttttagcttacagaagtctcctaagaggatgcaagcaggcttgtgtggaataatcccttaactgtatggtataaaatttgttaatataaaatgataatgatgatgatggtggtgtatctcagtgtaagaagctgttttcacatatatttcatcttgttttatttgacattgcaaccacgttagctaggtaggaaatgaattactgatgttatagatgtggaaaatgatggctgagagagggttgtggctggctccagatctaattgctaggcaatgaatggtctggcaccagagcccagagctactgtacaatgcttggtgggagtgggaagttgggtaaaaacaggcaccactgttaagtagggaagatttgagagaacacaagtgctggatccttacagacccaattctgcacctgggccctgacaaggacaggctacatgatcatgggtcaaccgttacaaccttctggtcaatttcctcatctgcgtatgtgaatagcaattcccaactcatgggttaatatgcagaccgagtgtttgggctccattacagcacaggtaggaaccaaagaagtggtagccattagtattttgtcattatttctagctttacagagggctattggtcctgtaaagaggctcatttcatttgttcattgtgactctgtctgggtgggaattctcctaaatacttcatgaggcccatctctctcttcccctgcagaagctttgccaaggacaaatagctcaagtatctggcttccatgttccgaaggaagaaccttgccttttaaggcataatgtgtgtgtgtgtgtttatgtgcgtgtatgtggcatgtgtgtgtatgtgtatacgtggggtgtatgtgtgtatgtgcatgtcacgagcctggtggcttatgtcttttactcctctttacttttgaaataatattcacctgttgttgtctttttcaaatatttctatgtctacagagatgaaaatctttgcccagattcaataaggcaagaaatcaattaaggttttcatttactgcttagcctcaaaagataagacactgagagaagacctaagaaagtatgtacagtttcctggaggtttcattctgggttctgtgttccagaaaaaataaaacaggaaggaaaacccttacatgtcctatttaaaacctaaatgttttgtttcttttttaaaaaaaaaaatttaaagccataccactttattttgattaatatggacaactccaacaaaagaaagatgcctcaattttttgaagacagtcctaaacctaacagcttggtttttaaatggttacatttaaatatttctttctctattcatttccaaacctgggccataaatcacccttaggaacacaatggcctgtgcctatagcaatttatcatttggataatgtcacttgttcaggtgtgcactaatttatgcctcaaattagaactcctgttggctgaaaccttgcctttcacgtgcacatcctgagcttcggccccttcggaccagctgggaatggtccaggcaaggaagaacctacgcaattcttcactcagggaagggggatggaggtgatgaaaagagagctggggcttaacagttctcttgagttcacttgtttagactcttaatgtttgtggcccaaggatgcaacctattaggaaatactcaacaagtccagactaaagaggaggtccctgcatgcaacgtgcatgtcagcttttgctgctccaagaaaaggcaaggaattgaacagcagtgggttcagagcccacaaggcagcattgcagagcgggagggatgccagagtggctgtcccaagttggaggcctagcgttgctgctaattccctgtcaaatcatctttctgggcctcagtttccctagcagtaaaagaattctaagatcttccttctctggcattctgtgactctctctcaggaggaagtagttgtttattactatagccagctgttattactacctacaacccccatgatatccctattttctccagttacccaaaaagagatggcacagaaacaactcttaagtttctgacccacaatatggagaatcggtacttacacattcggcagggaaatctctatttggaattctccccttctatctccactctatattttctctctttcactgtctctctcttccaaatatgtcaggaagagacaaagcactttctagcaccagcattaaaatgaactaccagggccaggtgcagtggctcatgcctgtaatcccaacactttgagaggccaaggtggcggatcacctgaggtcgggagttcgagaccagcctgaccaatatggagaaaccttgtctctactaaaaatacaaaattagccaggcgtggtggtgggtgcctctaatcccagctacttgggaggcggaggcaggagaattgcttgaacccgggaggcggaggttgcagttagccgagatcacaccacgggactccagcctgggcaacaagagcaaactccatctcaaaaaaaaaaaaaaaaaaaaaaagaactactagttaacacatgtttgctctgtgttagctgttatgtcatagttctttaataaaataaattcatttagtgctcccaacaacttctggaggcccacacgaatcctcttcatttgacaaattaggaaactgaggctcagggaggtaacctgtccaagattgcacagggaatggcagcatctgaatctgaagccagggccatctgaatcccaaatgagtactatttccacagtgctgaaatgagcaagttcgtgaatcagggccatttaaaatgtggctaagtgagtttgattgcttaagctccattggtaattaagatcaacggtagccaagaaggactacaaatatttttgaatttccacaaacgaggggtgtgactatagaattacatatgtatgagattaaacaaccgatttcaagagccacacacaaaaattagtctcattgcattttagccagggtttatatatttgaattgtaaattcagagatcctttctcagttaatatctctttacaactctgtgataatagctcttaaattataataggctctctctttcaatagaagaaaccagaaacctaaaattcacatttgttcattgttcttttgtaatgcagtcattgactttcttatatgtgtagctttaaacacaatttcctcatcgcccaagtaaatcaagggaaaatggcttcccagacacagtttttaaatgcaccagttttgtttaaggcgtgaaaattgtgagaatcccatggatccagggtgatgaatcactgcttccgccagtcacttccccaacctgcagctggagttgtcccaagctgctctctcccacaccccataggcagccatcccctctcaccatgacgccactctcctctgacacgcaagggaacacctgccagagggtgacttcaccatacccagtcactctgacaacagcccaaataaaaccatgtcagtcatttgaaccagaaacaacagtccaacagggctggggaattcaaagtcataggaaagacagagagaaagagggaagagaactgttgccacaaacaattaaaacccaggcacaaataccttaatgtaggaaatgcagggagaaggaggcagccagaagggaggagtcaggagtcagaagggactgggtttgagcccagcacttaccggatgtgcaaccttgggaaacttacctaccttctctgatcttgttgtcctatatgtaggatagaataacaggacccaacacatagagtagttgggattctgagtatttatgtaaaacacttaacacctagttagcactcaatccatgttagctgataatatattgtatcattgatataggattacatggtaggtctatgaacactctagagcccagtaggctcctctctctggcaaactgagcaaaaagagccttggattccagtcctggttttgccactggccagatgaggcaaatcacattacttggtgtcagtttccaattctgccaactaagagggtcatttcaatgccttccaaagacccttttatagctctataatatggtatcttttcctttacacaatgttcaataccaaattggcaacacaagtcacagaagtttaaatctcaggtgttcaggagcctcttcggaggaccaattcttctctctgtcccaggaatctgtagggggtagattgggcaggctttggggcctagcaatgctttgtaaagcctccctcttgattgcttggccaatctgactgcatccctcataagcattttaggcagtgacatgctgccttgaaattcttcctttcagtagaaaagtcagatctgtcaggaggagaataactccctgcttttgatttcttgttaagaacccaaggcgggaaaaaaatgcaaggagattaaaaaaacaaaaacaaaaactttggggcaaaggaaaatacatactctagcagctggctggccaaggtgcccgagtgaaaagcacccacaattctgcacactctgactataagtttttctctgtattaaggtgtctatagctccacccatgaacagcagccacatgcagactaaatcaggccagaccagaatggaatagttaaaacatctcttgccatgccttccggaatgccactcttttaatatcgcagaactcttatcagtattactaacggaaacttctagattgcctgtactgatttctctcccagggagttgcagtggtaatgagaaaaatggcaatgcctgggatctataagacttggtagtttcataaaggaccttatctatacactctcttttgattacctgcaacaatgctacaaagtaggcactgtgggtattattattcccattttacagatggagaaacaaccaacatgctgagtgagttaaggaccagtaggttaggagtagagttagaactggagtcatggctttcttgcttcccatcacatgccctctccctttttggaacaccttttatggacaaaaaggagaaaaaggcaggcttgaaggtgtcaaaggaagaaaattgggccagttttctttgtagtgaggctcctgtctatttagaaaaagtcattcaatgtaccttaaggtaagaaaaaccatctatgacaaacccacagccaacattatactgaatggggaaaagtttaaagcattccccctgagaactgaaacaagacaaggatgcccacttttaccacttctattcaacatagtactggaagtcctagtcagagcaatcagaaaagagaaagaaagaaagggcatccaaatcggtaaagaggaagtcaaactgttgctgtttgctgatgatatgatcctgtacctagaaaaacctaaaggttcatccaaaaagcttctaggtctgatacatgaattcaccaaagtttcaaggtacaaaattaatgtacacatatcagtagccctgctatacaccaacaatgaccaagctgagaatcaaatcaagaactcaactactttcacaatagctgcaaacaaaacaaaacaaaacaaaacaaaaacttaggaatatacctaaccaagaaggtgaaagacctctacaagaaaactacaaaacactgctgaaagaaatcatagatgacacaaacaaatgaaaacatatcccatgctcatggatgggtagaatcgacattgtgaaaatgaccatactgccaaaagcaagctacaaattcaatgcaattctcatcaaaatatcaccatcattcttcacagaactagaaaaaacaatcttaaaattcatatggagccaaaaaagagcccacatagccaaagcaagcctaagcaaaaagaacaaatctggaggcatcacattatctgacttcaaactatactatacggccatagtcaccaaaacagcatgatcttggtataaaaataggcacatagaccaatggaacagaatagagaacccagaaataaagccaaatacttacagccaactgatcttcaacaaagcaaacaaaagcagaaagtggagaaagtacaccctgttcaacaaatggtgctgggataattggcaagccacatgtaggagaatgaaactggatcctcatctttcaccttatacaaatatccactcaagatggatcaaagacttaaatctaagacctgaaacctaaagattctagaagataacatcagaaaaacccttctagacattggcttaggcaaagacttcatgaccaagaacccaaaagcaaatgcaacaaaaacaaagataaatagacgggacttaataaaattaaaaagcttctgcacagcaaaataaataatcagcagaatttacagacaatctacagagtgagagaaaatcttcacagtgtatacttctgacaaaggactaatatccagaatctcaaacaaatgagcaagaaaaaaacaatcccatcaaaaagtgggctaaggacatgaatagacaattctcaaaagaagatacacaaatggccaacaagcatatggaaaaatgctcatcatcactaattatcaggaaaatgcaaatcaaaaccacagtggaataccacttcactcctgcaagaatggacataataaaaaaaatttaaaaaatagatgttagtgctgatgtggtgaaaagggaacacttttacagtgctggtgggaatgtaaactagtacaaccactatggaaaactgggtggagttttcttaaagaactaaaggtagatctaccatttgatccagcaatcctaccactaggtatctacgcagaggaaaataagtcattatatgaaaaagatacttgcacacacacgtttatagcggcacattttacaattgcaaaaatatggaaccagcccaaatgcccatcaatatataaacatatatatgttatatatatgtttataatatataaaacataatttatatatatgtttataacatacattataaacatatatacaaatttatgtgtatatatacacacacacaccatggaatactactcagccacaaaaggaatgaaataatggtgtttgcagcaacgtggaaggaattggtatttgcagcaacctggaaggaattggagattatcattctaagtgaagtaactcaggaatggaaaaccaaacatcgtatgttctcattcatatgtggcagctaagctatgaggacacaaaggcataagaatgacacattggactttggagactcagaggaaatgttggggggtggcgacggataaaagactacacactgggtacagggtacactgctcgggtgatgggtgcaccaaaatctcagaaatcaccactaaagaacttactcatgtaaccaaacgccacttgttcccccaaaacccattgaaaaaataaattaaaaaatgtaaaaagtccttcagctctaaattctataaataaatattccacacatcctaaaaatggccaggtggatatcaaacttgaattggtaaattgtgtggtaccagtggcctgaactacaacaattgacagcaatgtgcacagttaatcccaattctgtgtttttcaaaattcatttatttaaagttgtacctgcacgttaaagagacaaataattctacaaagctttatagaaaaaccaacagtccctgcccatatttcttatcgccaagggcaaccactttcaacttctttagctgattcttttgatatttacctccatatctcgaaataacaggtttatgtaactactttttgatgtttctgttttaggctttatctactgaccttccacgacggaagatgaggtttttgctttctttcaagaactcccacccccaccacacacatgcacatttcctgttccccatcctgccaattgcaatttatcacagttttggttggatcaatattctgtgcttctggttttatgacaatgtaaatgctattcaccaatggggcatgttatatacaatgaatattctctcttttctgtataatattatgttttttttttctggcattaataattaacttttttgcttgcttaattttctctctacttatttcttattcaactccaaactctccaaatgtaagtttcaatgcattcagacaaatcaggtgttctatcagtttcaccttcttgaagctatttccccaggatcctgctgacctgctccagtctagattgttttgtttctgggctgctgtaaggctgttgtgttgtgatttctctttctcatgatcctggggactctcttcactctctattttgttggcttccttgttttttagagcctcctgtctttcttggtttatgccctcaagtttgatggtgcatctttcagtagtctcctgaaagagtgtgtgtaagctaacattttggagaccacacatatctaaaaatgtttttgttctaacctcacattaattaatagtttggttagatagagaattctacactggaaacaattttcctttgggactttgaaaaccttgcttcatcaccctctggtttccatgttgctgttgagacatctaacatgggtctaattcttgatcttttatacaaaagctgctatttttctttggaaaccaagggccttcttgtgtttggtgttctgaaatctcatgatcctgtcttagtgtagatctaacctcaccccttacactgggcatttgagagattcaaggagaaacttcagtgttgggaaattttcctgaatcaccttttgaattattttacccttcccatcccctgcttatttttctctcgttttttgcttctactcttcaatttttaatttattacagctcattattatttttgagtattcctttttttagaacattgttctttgctcatgaatgcaatatctctacttatctttctgtgttttttaaagtcaagggtattccaccctttccctccagttttttttttttcctcccttcgtagtttctgtttcctctaacttgctgctttctctgtatctcacattatatgctttccttaaatgactggtaattcttgtttatctgctctaatttaagagtggggcattaaaaagctgagtgtgatttctgggtacacgaaaggggttcatccactgttagaataatggattaggccatttccttggggagccacaatgccagcttctttggtcttttattcctcttagactagtcagataccacagagaaaattccagttgctgcttagagataaacatctggctgctattgtgtgggagacaagtccgaaagagaaagcagggagtcttcaattaaatacatgaacctatgtcttaaccccactgtttgcacactgtcctgagtccagagacactcagtttcacactacccaaaggataattgtctagctcaggagagggatggtaccatttcctagagtgaatctaggataaaattgctatttcaacagacttttcatccaacttatttttagcccatcgatttcattttcagagatacctggtgccatcagttcttaaacctgcatggcactgggttctgtgataatctgggttttcccccttgctggcttgggattcagctttcctgtatctgataagtcagttatctctattccatctgctttccagctcccaaaatattgttgccaatctattctccactattctttttggtctgtgggttattcttgaaaaagactctttacaaatcattttagtggattttgaggagagaatagaattacacatgtgtatttaatctgctatctctaaccattctgtctaagctccttcattctgtgtttaacatagtaaaacagtcaaatatactttggaccaatgatataatacagaaacattctttgaaaagaaatcttaatccactggaaaactgacagtttctttatggcatttattattacccacatctcaattctcatttctgactagtccatctctgcagaaccggtcctgcccaatggatttataatctgtacctttcaaatacctatttgatcattaatccacagtaagcaatgtgggtgcaaggccagccaaggaccaaggtgtgttaatttcatttactgtctcttgggtggctaacaactttccatctcaggttatttatgcaagttgaatcattttcatattcattattttaacggtgaaatggcaaagttttctaattattaaaaatcccaaagttgaatcaagcagtagcattctttagtttttaagaactgtgcacattgtggggaagcatcacgtgtttataagcatggcatctctgatcacactacctagatttgaatctctgcttccctttgtttgaccccagaaaatctgcttaaccactctgtgccttaatttctccatctataaaatggaaacaacaatagtacttaacctgtaagtttattgtgaaaattaaatgaaagcaaggtgcggtgcctcacacctgtaatcccattactttgggaggatgaggtgggaggaatgcttaagcccaggagtttgagaccagcctgagcaacatactgagaccccatctctacaaatatatatatttttaaaattagacaggcacagtggcgtgtatctgtagtcctagctactgaggaggctgaggtggaagaattgctatagcctaggagttcaaggctgcagtcagccatgatcatgccactgcactccagcctgggcaacagactgaggccctgtgtctaaaaataaataaatcaataaataaagaagagtgaatgaaataatatgtggagaaagcaaattccccagtgactggcacaaagaaagagctcagtagatgttgtcatctcatatttttaaggacttaggaataacatcaataaatatgtattaagtggcttaaggagaccagagacactccctccttgtccactgtgatagaagagaagtagcagtgtcgtctgagagttcaactgtaaattcagcacctagcaggtttgagcagaaatacagaaagtcaggttgaaggaggtattaggtcagagagctctaatgcagtgtaagtgatggaatctggacattggataggtgaacatcatccagaaggggcatgtcctatcattgtaataaaaaaggacactgccagtttctgaactatagtgacaccaccaaggcaacgggactgtgctggtcagaagaggctgtgccctatgataacaaatctctacctctcagtagcttacagaaaaagctttatttcttgattccatcaggtctgatgcagatcggtggtctttctctatcttgtttctctgccatctgcaacatcctgcctccaaaggcaccataggagagaaagagagacagaagaactaggacttgtatcctgtccatttacatcccatttgccaggactcagcctcacggccccaacccaggaatgaggggactgggaaataccatatcctctctgcccaggaagagcagacaggttggtgagggcagagaccattgcaggccactcgctttgtggagttctatctggacgcccagctgctttctccagggaacacctttctgtatcttcattgagtgctcacggttgtgcatgacgggctgtgtttgctcacgtcccacgaagtgtatgggtggcaaagtcttgaaatctgtgtgcttagctctcttaggcttcaaaatagtgagaatctaggcaggtaatgtgttaggagctccaccccagtgctgaatggggtctggaatctgttgactaaaatctagtcttcaaaatgagccccacttaattgtaacctttgcccatcttcccatcagcctgccattgaaatcttagcatacgttgtgtggctgaacttagagtctaactggccacagttgagggagtaaaaactactacagaatactatatctttattataattacctatcagatcaaatgtaataagagcaatattacagtatagtttacaaagtacttttacctgtgttgccttattttatctttgaaataatcctgagaaatagcataattatcataattttatataatagaaaatcaaggctcagagaactgaagcatcacatttaagatcaaaacttgtgttaatttcacctttttctttgtcttttaggtaaatgtcggatactcagtcctgcttagttccatgttatgggggagaacaaggtcttagaacttgaataacatataatctatttggataaaaaggcatactacatatcataaaacaatctatgaagattatgagagaatatattattagggactaatttagctcttctagtccaaaggaacaatgtcacataatgaagacttaactttttatatggcttccaagcctcctacagtgtcatgtctccatgcccttactcaggctgttccttttgcccagaaggactttctcttagttctcagaccaaccttggctcctccccaaaactttctccaactccccaggcagaattagccagcgttcttcaaggcgttctgcatgtgactctcctgtactgaagcatgaatcatatgctaaggatgctgattttgggtggaagtgggagaggcgaaggggatctatggtatctttttctctttccagatggagcttcctgagggtaggaattaagccttattctactgtatctccagtgtctagtgcagttcctaatatgagttaaatattcatggaataaaataataaatgaagagagagcacagcttcctaagatgcccaacatagtccccgggatattttttccaagcttgaatccaagccgaagaaaatggatggaagagaggaaaggggctgcaccagtggatgctgaggaattgctgggcttcaaactcctgccatcagaagaggaagctcctgaaaatagtggcctctctgtccttccatttccctccccaccttacctggctttgtttgccattttcaaccagtgctgtgattttcctccaaagcactgtccttggcatcattacctatcagcttctctctgtgcataaaggcccatgagagtatggagaaataaagggcacatgtattaggattgcttctgggtgcttctcatctccagcccgtcctcaaccctggggtgaggaaggtaggaccagggtctctagggtttctcaaccctgtaggtttattctttgcctaggcactaggtgaatctgaatccatgttcaaaagtaggacacatgaggcgaaagggttgatcaaacataaaaacccccaggttttttttcccacggtttgaccttaaggaagtcaactaatccaactgtgtttcagtttgactcctctataaaaacgagtctaatgatgcttcacccaacttgtggaggagtggccaggtttaattaaccaatgctcatttctctcagcactttggatgtcctccatgggcacaaaattatgttattacttggaataataataatagtttcccctaataattctgtgttattattgcatttaaggaactgtattagaggccttctggaactagtttaatacctataaatgtctctccctggcaaaacaagggagcattgcctggtgattatggtttgtcttacatttcaaaactagtccgtttaaaccctcagcagagtccttaaaacagcgcctggccaagggggacctctttcaatctcaatttgctggaccactgacagcactgaacttgaacaaagtggcttgttttcacagccgaggacttggcaactctaagggcccaacttacaaacgtggaaagataggcacagagaaaagataagcagacccagcttcccccactgcagccagagccaggtgctgaaatcacagatctgaccaccattgcccaccctccctgccccgccaccacttacttccaccggctccccttggctcttcattagagtccagtcaacaccccccgaggtgtgcagagccctccagctcatctttagatgccccctcccttgcactctgttcctccattctgatcttttaaaaaaaattttatatttcattgacaataatagtatatatttacactatttatatactataaactatataaactatatttatactatttatatactatagtgtatatatttataaactatagtgtatatatactataaatagtgtatatatactataaatagtatatgtatttatttactataaatagtatatatatactataaacagtataagtatttatatactatatatagtatatatactataaaaactatatgtatttatatactataaacagtatatgtatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatgtatttatatactgtaaacagtatatattttatatgttaaatgatgagttaaagggtgcagcacaccaacatggcacatgtatacatatgtaacaaacctgcacgttgtgcacatgtaccctaaaacttaaagtataataaaaaaaataaaataaaataaaataaagtgtagtgttgaagtctccagctatcttcttgcatttggaagctctgttattaggtgctatatgtttataattgttatgtttttctaatgggttaacatttttattgttttaaaatgtctccttttatatgtagtcacattttctgttttaaatgatacttttttctgttagtagtgtatgcattctagctttgttatgattgccatttgcaaaatatattattttctacccttaaaaaagttttatatttcattgacaaataataatagtatatatttatggtgtacaatgtggtggttatgatacacgtatgcattgtgaaatgaacatatcatcacctcacagacttatcatttctttgcagtgagaacatttaaaatctaattttttagcaattttgaagtacaggcaaatgtcggagagattgtgggttcggtctctagaccacggcaataaagcaaatatcgccatcaagtcacacaatttttttggtttctcagtgcatcgaaaagttatgtttagactatactgcattctattaagtgtgcaatagcattatgtctaaaatactttattgctaaaaagctgacacagaaacatgaagtgagcacatgcttttggaaaaatggtgctgacagacttcatcgaggcaggcttgcaacaaaccttcaatgtgtaaaaatatgcagtatctgtaaagcggtgcaataagatgatgtatgtctgtatataatacattactattaactatagtccccaggctgtgcacctgtgcaatacaacaccagaacttattcctcctgtctccatcctgggcttttgtttcttcagtaacaccaggtccaatctctccttggcgccctgacacaccttgctcctagcctggccagccctttctcccgtgtctttacctctagttcccaggtacacgttactgccttcccatgtgtgggctgaggcccctctagggtgcacccaaaacaccctgtgtttgtcccctgtgccaaatcacttggcagagagaatcatacctacctgcttacttccaggtttgctcatatactctgtgcaggcatgaagtatgtcagtcttgggccctgggtctgcacacagtaggtgcttcatcaatattcactgaatgaatacaaggatacagttttcttttctctcttatatactattttcttttactcaatgccctgattttaatgctaatccttccctaccctcttttatgccagtcacaggtgagtaatacggatgaagaaatgaaaaagaaaaggaagtagattctttgaaaggagagagagaaatactgtgagtgagagggattaggaacaaggcaaagtgagagagaaagagggatatttggatggggagagactaaaatgaaatcaaggaacaagtacaggattctatttaggttggtgcaaaagttattgcagtttttgctattacctttaatggcaaaaactgcaattacttttgtgccaacctaataataatatgttaaaatgcaaaaaataaaatcatccttaaattttatttttcaggaattttccacataagagaagtgaagagggaaggagaaacccgttagaattatttacatatatgatttccttttattcctcataccttattagacaggaattcaagctacatttaacagaggaagacaaagaagctcagagaggtggagtaccttgcacaaagtcacacagcaaagtggcaaagcccaatgcagaaccagcatgtgtttgaatcccaccttgcccatttataaccaggatgaagtgttcttcctttgggactctagagccttcaaaggtcccttctctttgggatgcagaagagaaaggcagtaattaataactaagaagaaaaagaaacttagcacacagctaaatgctgcactttgaagagtggattcttgcttttgcatgaaagattaaaaaacaaggatttctatctttcatcagtaggacaatgaattgaactgattttctttggctcttggtttgtctttcctatgattaggtacatgtttctgagccctgtgtacataagcccagcacgaaacttgctatttccttgtcacagcaatattttccacgatggtttggggcaggcagagagaatagtgctgctggacttttgcaaaaccagccaaaggaaggccaagaggcatgttgaagaacaaactctacaccactgtttgcctatcttaaagcctccctgacgataatgaatagattccagcagcccagaccattactgacagctaaataacttggtctcactctctggttttctacatctaaatatcccctccctctggggcatgagattaaaaacaaaaatctcgagcagagcaagcaacagtcttgtctttgatttatgctattactggaactgtagtccttgaaagaaattccttcaccaccataatgaggatgaagattccgttaactaataaatgcttcaggagtatgctctgatgctgttgaacttttcatgaaaccatgatgtacaagaaaagaagaaagatttttaaataacactatacagacacacatccgctatggaattagtcaaggcttcgaaacaccatgtgtaagagaaccaggttgacaatcagtgataatacatctctcctgaaaatactaggtaacttagccttttcttcattcctgggcctgcctttgtaaagggaagggagagaactaaaaacctatcagtgattcaatcagaaaatgcaaatgaggtcaagtttcttacaggcttctgtgagatttctctagagacatttccacagcatctctgctgctggcgcccttcggaggctggggctcgtctgttgggtgggaggaatgcagtacgagcttcctcctttttcctcggacctgagtggatggttgaattccagtaaggggctccctagtgctttgggaatatcactcctggactgaagtcaaacccagacacacacacacacacacacacacacacacacacacacacacacacacgggttgctttttcatgggtggaactcatggccggcccctctgccctgtctcagagtgaggaccctgcatcccaatcaggcaagagggaggctccttaagtgaatccctgtgttctgaaccgatcctgcctgcttccctgcctgcttccagggccagcatctccacccctgcagatgccccagggcagtctggaaggagctgtctctcacacaaccacgcctctccctaacatcccaaactaaaagtgttcatgcgtgtgcacgcggtcctcccctgggccacagaagtttgaaaagccttccctgctatctttgattgggaaactagtcgattgggacaggctgacgagtgaggctgcaagtcaggacgctgcactccacctcccatcacgtgagggtggttcagggaatttacagggtttctctttgttcagcacaggttctagcacgtgttttgaaagttgcctattttttttaacccaaaggtaggtaaacaccaccaatcaaagctctaagccagttcccttaagttttaagattggacagtatcaggtgttgtctttcaaggggttgaaaggaaggaagagacaggaaaatccccctcaccctagctttaagggtgttggaggtcttgaagaaacggacagacccttgattaaaccttctatatttttatgtaaaacataggaaaagggctggtgaaaatgaggcctgcattgcgtgaagaaggtttaagatttgagggaaaaaaggcgcattctcttttctgtaaaatttttaaacattttaaagctaaatgctaccctcttggcctatagctttcacactgggagtaaaggcagaggggtgggggtggaggtggcaggtgaatgggtccttcaggaaactttgaggaaaacaacacaggtttcccctaaaccgtaaaaacggcagatctggaggtcccaacttctaattttcaatccgtcggcttagtcttggtttttcattactgaggttcccttgactatatagtatctcacaatgtctctcaaagtgcagtcacagactacagatgagagaactatgagtgaagctgcttaaaatgcagattccaaagtccttccctgaaggattctggttgtggtacagggatctgtaaatggggtggttgatctctaacccccaccccccaccccagctctgcaattctatgcttctagactctctggaagggaacaccaccaggaactgtggctgtcccactgccagaggatacctcacctatgccaggtgtcaccaattacctatttccagctgtagggcctaggaccttggccaacattggctccttccaccaggtaacagggccagttaggctgtacaagggatccatcttccactggagatgcctccagtgcctccaggttcactgatcattggctgcagtgtgtgctctacttagccaactcccccttgccatagcctctttccgtctccctgctgtgtgctgttccctttcagtgctgactcttgtccccttggctgtttggatccggggcttctagcccctacgctctgcactgggtccgctccatctgctgcccgtgtcctggcgcctgtggtccccttaagtcctccagaaggtagggctcgcattaagagcctgctccttcttcctttcaccacccaaagtggctcaaaggcttccacgtgactagtaactcaccacttttatcccctatctctcctctgtattcctcaaaggctgggaacacacttttgtcatttcacatcatattctagtgatttgtatctctttctcctccctgcctaggttgtaagctctatgatgccaaggactgtgtcttactcatctttgcatccgtagcaactagtgtggggcctgatggtactgataaaaacatttactgagtgcttactatgtggcaggcattgcactaggtgcaagatactcctttgtgcaatacttgctatgctactctatcctcacaatcactctacaagagccccagttttattaatcccatgtgaataagtgagagcaatgaggccaaagggtttaggtaattcgatcaaagtcacacagctagcatgtggtcagctgaggattggaatccaggcagtctgactcctgagcctcatactaaaaactcaaagtttgctgaataaataaaggaaatctgaataaagcaatgagtagcagtattcacagaagcacggaattttagaactaaaaaaaatatatacactgtgtagtccaaaccctgattgtattgctagagaaactgagggtgagagcaatgaaacaaggtttggtggtaaatggtaaaactcttattttatcaaagggaaaattggggttcaatttcactcttacttccacaactgaaattgccagaatttgatcgtttaaaagaagcatagttatctcctagttcaagagcctcattttgcaaaggaagaagttgtagcccaaggagtgctatgacttgccaaggtctctacttcaccagagcagaactggaaatgaacctggctctcctaactccagctacactaacacagacccatgagccagcccattccccaccactctcccatcccagcttcccaggtcaggtacagacagtccaaccgtccatgatttaacctcagtggaaacgctccacactggagctcaaatgcaaggcaagcaggtccatccagatccagttctttcatatgacaggtgggtagagttacaggctcacattgcaactggggatttgtgagatccacctcagaagaaggcaatgctccccacaacgaggctgactgttgagtgtgtgaatcagcatctgggtggtgaagcaccccaggatgtatacactagccagtgctcagcaatcagcaccacgctttctggcaccacctagcatgcgcattagctgcctttaaaaatgctgatgcccagggtcaggcccggacaaatgctaacagaatctctgggagtggggccaggcatcagtatttcgtttaaaggcaccaccccctggctccaggtgattctaatatatgctaagctaattcataaggcaagtgaaatgtcttccatccaaattagcagtgtcacctggaaacgtgttagaatccaaattctacattaggtacccttcattattttctttctttctttcccatctttccttcctttcttcttttcttccatcctttcttccctcccctttccttccttccttccctctctttctctctccctcccctcccctccctcccttccttccttccttctttccttccttcattcttctctttctctctctctctctctctctttctttttttctcccttcctttctttcattttctcccttcctttcctcctcttccttccttcctcccttcctttctgagacagggtttcaaactgtcaccaaggctggagtgcaatggtgcagtcatagctcactgcaatctcaaactcctgggctcaggcaatcctcctacctcagccacctgaagtgctaggagtacaggtgtaagccaccacaggctttccctgttattttctctcatagcactctattgttagttttcataacacttagcaggatgtgaaattatacacttgtttattttatatcctttgcctcctcccaacctcagatggtaggcttcatggatagaggccacacatgttgtgttactcagcacacctcatgcctggcacacagtgggcactcaatacacataatcaacaaatggatggatagacattaggtgcatataggcaagacagatgtctgaatttttcattttttggaattcattgctgtagccttatagagacagaacacaagcatatgtaataggcactttatcttccccagaaataaggaagtttagcttactggagtaggtaactaggaattttttttagacaagttaccagaaaaaagaaaacaccaaaaataaataaataaaaacagcaggtgctgataagaaattaaaaaaaaaaatcaatgtaacaactttggccataagtgtggcttcgcctaaaatcctactgcttctttaggtcaagtccctaaatatttattaaatacatcttgggggtggccagcatattaatacattttttttggagaaataataaagtttaaaacatggtttatggccttcaagtttgttgggaaagtggagcttattgaagtagaattataagaaggataacataagttaataagtagtgaagtgttattcccaacacacaggccggtggaatgcatgcatatatgtgagctggcagatcccctttcctaatttaggttcaggggagttccaaggaagagatctgcatgaggagagcacactatgggctgccataatcaggaggatctttgtgaatgaggaagaggtttgggacttgcaaacattcttgattcaaccaggctcttggaagttaatgtagtcaacattttcccctagtccttgtgtggagaagaggtctaatctatgaagtcaaaacaaactttgttcttggatatgatttgggggttcaaatgaggagacacaattatctctttgagctttaaatatcgttttgctgacagaagacaactggctcttttcatagacatcttcccttattaaaaaaaaaaaaactcctaaagtgccaggaactggggtgttacattcagtaataaaatccatgtttcaaaacttggtgtgctcatggccatatgctgtagtgattaaatcagactagctggattcaaatctcatcttctgccatttaacagctgtgcgactatggacaaattatataaccttcctttgtctcagtttccccatctataaaatggggctaataataattcctcactcgtacgattgttgctgtgaagattaagtgaggtgatttttgtaaagtttcataagaaatgctatagaagagttagctctcattggaaaccaaacctaatctcaactcacacccatgcaatctcccattaagatctatttacttatccaaaagaccacctaaaatgaactgcaaatctgctagaggacagaataacagctggccaaggacaaaataacctaatggttgtggaaaaggtcacagcagtgacttcataatggaatataaaatatcataaagacagtccaaatgggctaacgtaggactgtatggctaggaacttctagagctgcctactgctgatacctgggacttacctcaagtgatgagagcattgttggtaggagaaaagtatagggttcatcctaatttgaatcagttgctatctttcctgtgccgtggcatcagaggtatctgttgtcaaccagggcaccttctaaattcttgtgccactgttaccgagcagaaccagaagaaagtgtagtggagatggctggccacaatccatcactgcttctagaaccacacctcagagcacatgctaagtacttctatgttcacaccacccaagcacagagaaggcattaatgcaattatcatacaggaaagtcaggtttgataggcagagcagtagaaatgatgtagtgattctgtggaagtcactgtgacattaataactatattcactattcatcagagaccagaatttgaactatggcaaagctatcttagagtctcattcaggaggttggtttgaatcactgaagttccatagagggtttgattcaagatggcctcatttataagtcccaaggtcaagaaccagaggcattatagtgaaatcctagcatatacacagtcagcaccaagtaggcctgcttccccatcttccgtctccatccttcacgtgctgtgatgccaccttccccttcacacaaagcatggccccgaagaacagcgaactggtaccccagcagcctgactctcccagaacctcctcttctgtgacatacaggaattgggttagctaatttctaacatctttccacttctaacatttgaatctaagattgtctttagtaggtatagtttagatgtaccttgtctgattattgggcagaacaagcagcggccatccagaataacatgaagagtatccttactgaaaaactctctccccttcttcctatcacagttcctgaaattctagcattataaatatattcctttgggcttcaaagcccttttaaattcttaaaaggctttaaattctatgaaaaggcaggtaactctgaaaacaatttaagccttcactagttctcaccttaggcagggccaattggtcagaccgctttccaaatatgaggaagccacaggccctatgggaaaggaacactggatggggatggagtggatcccagtctacccaacagtaggaactatgtctcattcatggccataaatcatgtcctagtactggcacatgcttggcactttttacattttcttttcttttagaaggaaggaaagaaaaaaggaaaaaagaagaaaggcaggattaatgaatgaacaaaccagaaattactactgagagtattttccacacctgacctggtcagcatatccccaagggcaccttttcaacttgggtcccgggtgctaaaaacaacccctgttctcaaggggcaatttccagcctggctgctgacttcccttagctcagagagggcccttgctatcactgaggactattcagggactgaggcagcccaggccattgcaatgctgagtcctgcaccagttctaggcgctacactttttttaagcacttgatttaaatgaagaaagaaattggcttatatttttagcagctcctgctactaaaactcatttgacaaaagtgccaaagggacagttaagtctgagtatgattttttttttttcccatggaggaggaggagggtataatttatctgaaaatgactggtactttcctggcctggggacattattctacctgctctctctctctctctctctctctccctctctctctctctctctctctcttttttttttaaagacacacctgttcttttccttcccatcaaattccaagcttaagatatttactgtcttcaggtttagttcctaaaccctaagacaatctcagaaagggaaaggtatataattggagtctggaaactccataactttcagtaacattttagaattagcagcatcttagtgggtataccaaagccctccgtgatgtgagtataatatcaagttcttgtaggagtataacattaagcccagttgaaaaacaatattaacgccatttctacatgtactgggtatcagattcaaagtgtatgacttcagagtgccccaagcccctcttcccaatgtttctattactgacttgcttagtatctacctgaggtcccctccattacagctatggggagaaattcttttttctttttcagggctgaggcactgttctgtcagaaggctctgctaaaatacacatatattacttttgaaagtcacatattaacccaatgctttccaaacgtaaatgacttcaaacaatgcgttagctcgtggaaattgagtcttgaaagaacaggagctttagggctgctaagaaaatgtctggcacgtaaaaaaatccaaaatgaactcatttgtttatttgttatttggaaacttttccccagaaacacaaagttatgaagagtggttatgttcccagaggacagtctgaaaaaatatgttttataaccataatgtaattgaagtgtactcctaaagggtatccctgaaccacactgcatggccaggcttccaagggaaactgtgttcagacaaccagcttggaaggccaggaccccagattcctgctgctgggacatggcgggtgttggagctgcctcctgggagagagggggctcctgaggaatctgggttgggtgagcagctgcctgtgcgggtccctgggaagaggccagctgcatgtatggatgtttgctccgcgtgagcctggggctgctgattattgctgcttccagttccaatcctataaaggattcttgaagactcctttatagcagtcaggaccattacagctgtcaaaaaacgatgacaactactgtttgagatgttttatagacagccaggtataaccgctcattcatgttagtaacccctggtatagtggttggcatgtatttggtgctcaattagtactggatgaagtaagacagattcgtgtacatatcagagaaaaactagtaccaactatgttggacatttcattgaagagggtcactagggtgaagaacaggcaatgccaggagtggtgggcactgcacctggaaaaggtataaggcaggaggcgggcagggagctgacacttgaggagacagctatgagggagtggcggtagctgtgaggagcaggagggagtgctgctggtgggaaagtcagggtcaggagaggcagcacccttccctatcctttcagccttgactcagtgtctcagcctggcgcaggcaagtaaagagacatggtaggtgaagaaggtggccctgccaatctagtaatcagttccaggtagagaaagtcttgggttgggcccaaagtacttcaaagggctccagaaggaaagagaatctatgaggaggacaagggaagggaaggggaagtgaagacactctagtgcacgtaaagtctggatttagctacagtgtgggggtctgttcatttccagcatctctgggtggctagtgactgaggccgctgagtgtggagaggacacaccctctgaaagcccccacacaggggagagtgcaccactctgcctggttcaggcgcatggggcctctgtgaccctcaaagagaaagctcctgggaggcactggggcagaaaccatacgggatatttctttataaccttcggaagaaagtaataaaagtcaagtcttcgttaatagcttctctaaggaccacctctttacattttccttctctctcttcttcctgattcccattgattttgattctctctcatgatcagacaacggctctccaccagtagttctctaggctctctcaaacctctgtaaaggtgcagaattcatttgcattcattatggtctcagggcaactcatttactttcatcttgcaatatccaaagagttgctcatttacttagatcatttaagggtttccagaaatcctgcaaagaagacatcaggtgtccctctccccctaaaactttcagaagaagttttgcacaccccatgggtcggggggagtgatgccttggagccagtgagagaaccagtcagacagagcattcagtaagaacctatcagggaggagatgcctttcttctggcccactctggttcaagcctcaccttcgcttacctggactgctgccagcctggagacaggagatgcctccaggagttttgcagcaggaaggcttcatccccactggcatttatttataccttagggctaatggaattcagcaggtcactgctgcccggagcaccggcctgttcaactctacatctcaccgggatggacgattccctcctcagtccctgtatcagtgagcagggggcagtgagggtgacagagggccttttcaggacctttgaggtcacgtcttagaggttttaacttccacctccacatgggcccgattctgccaaaaaatagttgtctggccacatctctagcttgagttctagtcccacaggatccccacattgactaggaagaaacttcacacatctggaggcctccaccagtgactccttccagagtcatctgttccttacatggtataagctcgccaggacagcacatggaaagagtttgtcagttcttccatgagccattgtcattttatgaagcaatccgctgaaagggtagggcccagacacttgagattcctaccaggagatggaagaaatctcacagagcaccagaaaactccggaataaaaggccagtgctggtgatgatctctggcttccgttcattggtaaattcacacatttattaatgtcttcagtgaacacatactttattcacaacaccagaagacaattaacatactgtcttagcagtagttaatgtctccctactgtactgtagtcttctcatggtgacctaggctttacttagtttagcactgtgcttggcatacagtgggagcacaacaaatagctctgagtaatgaatgaataaacaaataaatgaacaaacaactttaaagatatcccactgagcacatgactttgtgttagaactcactcaaaggtgaggagtcataccatttgtcttggatttttgtagaaaatatctacttccatccataccttcacccattttttaaatagtagttttgcgcttattctttttaaaaataaaaaactttatttataattgtaatatgtattggcattcaaatagaagaaagaattatttatttagaaaatgtgggaaaatacagatcagcttaaggaataaaccaaaacttgtccacaatctcacaaactctgttaacattttggataattttctgccactgtttttttctgtatataaaaatttacaaaattgggatcatgctgcagatgcagttttagatattgatttttccacttaacattatatcgtgagcattttaccacatcattaaatattctttgaaaatgttacacttaatcgctgcataatattatattatagctcttcgattcttaactaaggcagatttattgtccttaataaatccctaaatcactacacaactgaaattgttccctggcttctgtaactgtcttagtggctgatgcagattgaaaacttttacaatatgacaagtacttccaggcaagaaaagctgtttcaagtatggctggatctcatctccagctttttcctcctcaaagctactaattcatacaagcatactaatggctttggaatgtttattctcttaaaattggaggctctagggtacacaagaaaacaggcacagaatgtgatgagaaacacatggcaagtgtctagttgattcacaaaacactcaagattttcttgggcatgagggaccacacctcaatttaatggaacagaaatattttagttctctacagtaaagtgttgttgctaaaaatatatgtgtgtgcatgcacgtgtgtgtgtgtatgtgtgtggatccatcaaaaagagaaaccccaattcaacatagacacacagctatgcacttgtatagtcagcgaggagactgagaatacctggagaggcgatagtgaaagagaagcagatgaagggcctttacagtttggggaacattaaataagctgtgtcttccgctctcttctaatgaacaactagtttccaaatgttactgtattctctttcactccctgggtctcatccttttccaatccagtcttctttgccttgaagctggagcatttgacagggtctattgaaacttctaatgaggggaggttacatggagagctcactccagaacagccaggacaaagatgggatggtatgcctcgcaggggtcaccctcacgactcagtggtcacacctgtgtcctctggctcattctctcctgacatcccagcttgagagtggatactacctcctaatagcaaaggacacacaacagacatctctcctagaaagctatttctgggctgctcattggccacttcaatggaaaatcttccctggaggtcaggtctgaggcaggtccttacatttgctataggtgagtctcctagaagctcacagttatatagctctgataatattttaatacaaaacaccatatccatgcatttgtccccacctcatttgggtattttgagttgagggagagagacaccacactctccagatgaatctttctcaagtgctttttcatcacgtcatttcacgactcttgaactcaaaaccattccggtgacctactggaatgcaccttagtgtctgtgtctggccaaaatggtatgttgcaatcaattctgaggatgtcagaagaaatacttgtggctgattaatacttttaaaaacaagcgagtaaggttcaaggttgcccctataaaacatcactctcagatatgcctcctaaattgggaaaaaggtgaagtggcagctaatatggtaggaggtacacaaagcctacaacctgaccttctgggacagtgtctgctgagctgcatttacggatacagcaccatcagccacacgaatgcctgctaactcttctctcgaccaacaaaaaaatttgtatgttatcgcaaagacagctagctgtggctcaatatctattatccccttcttccatagccagaataaagaccatattttccatcctttcttgcagcttagtgcaacttggtgacaaaattctagaaaatgagatgtaactacaaatgaagcacacaactttcaggtggggccctagaatgaggctgacaatctgcactcccaagcctatcccacaccacccctccagtttgccaggaattttcctggttttagcattaagagtcctgtgtcctgggaaatccggtagtctgggcaaaactgggatattagtcacctacctccccatttccctctttcctcagcctatttcctggagtatggacttggtggtgagccaccttgaacatgcaaataaaggcagaccccaagaaagacaggagaagcctgggaccctgccagcttcatggagcacaactgttactccagctcagacttcgatgtaaaggacaaatcaatttccatgttgtttaaactactaatttttgaggtttgtagcatactcttagacatctatacccaaactaatgtatctaattgcatagtttaccttgctgatgaaaaaaaaaatggaggtggggtggagagtcgattcatcaaaatttaaatatgccagaggaaaagtgtcattcccaaaaacatcatctgtcacattttgttgaggaaaaaatgttgggcaattttataggactgaagtccgaggctttacctggcatttctctcctgctgttaccatgcctacactgtgtctcccgccatccagccttctcctcgtcccatctaaccttctgttccatcccaactgagtgttctttttttttttgagacggagtctcactgtgtcgcccaggctggagtgcagtggcgtgatctcggctcactgcaagctccgcctcccaggttcatgccattctcctgcctcagcctcctgagtagctgggactacaggcgcccaccaccatgcccggctaattttttgtatttttagtagagacagggtttcaccgtgttagccaggatggtctcgaactcctgacctcatgatccgcccgcctcggcctctcaaaatgctgggattacaggcatgaccaccatgcccagccgagtcttctttttttatttgtattttttattaagacggagtctcactctgctgcccaggctggagtgcagtggtgctatcttcacttactgcaacctccacctcccaggttcaagtgattctcctgcctcagcctcctcagtagctgggattacaggcatgcaccaccacgcctggctaatttttgtatttttagtagagatggggtttcaccacgttgaccaggctgatctcaaactcctgaccccaagtgatccacctgcctcggcctcccaaagtgctgggattacagattacatcccacccgattccaaatgagtcttcttcctgggtccttcctttctatgtccctttctcatttgctactctccagttaaaaaactcttctcttttcccttaagttcaccaaacccaccaagcccaatctcctttaccgttttttgttaccatgatttcatccttttctggaatctggcaacacctctatgaatttggcatataattactaatatctttgtactgtctttttcatgtatttaagtcttgtatctctggaaaggttctaagatccagggaggaagagtggttgagagaacatagcttaggagttagaagatctggactgaagtctgggttccaagacttgcctcttgggtggccttggatgtcagtttcctcatttataatgtgacggtgattataactcctctgcctttgcaccatgaggttgtgagaactggacactataggaatacatcatcaaccagtaagcaccttagccatgctaattgttcttcagaagctatcctttctctaatgtcccactggacagccctagcatgcttaccacagtgctggggatgtagtgaatgacagccccataaatctttgtacaatggatgaggaaaaaaggtaaaaataacagttcctcaaatattataaaactgcatagaaaagtctctgcctggacatctccttcaaatgcaaagaaggcacaaaatagcggtacatgtcaaactgaggtctcaaaccccagttcaggggcaaccttgaaccttactctcatgttttcatttctgagtggttttaaaagctaaatgactccttaattcatggtaataaagtctaagtcaataatgctacagatccaaggttagttcctgtgaacagcggcaccacccttctcagcctcaagtccgtgtgctccataccttgacatgaacacgagtaaaaatcaaaatggccccagatatgtcctaggatgccaagaaagaagtggcttctactcagcaagctgcaaagagagttgctattttcaggtgctctctagtttggcagattaccaaggtgatgatattaagcttaagactgcctgttaatggaatgataaatgtgagaaattcagtgaggccacttaagcaaacaccaactgaaggataaaaagcatcacaaagcccatgggggaagaattcagatgcagatttgcccagcagcccaatggacctacttccatcccccgatgaggggctgcgcatttgttgaggggaagtcattttgttcgcatctgagagtgacacagcgacccctcgacaatgctgagacctaggcccaatgcctcgagttttccttgcttgttccccttttcccctctcacactgcaatagtatattttccttcaggaccctcatcttcgcaggattttttttttccctccaaaaaaaaactatctttgttttcagaataggagtcgacaagctcggcatcactgaattataaatgattagtagttatgtttcctagatatatttagagctttaaagggattggaggttcttaaacacagaacgtggacttgtaattgtgaagctcaagtgtctacaagaccgggtagcagtggtattgtaagggaaagtggttttgaagggagagacaccccagtcacttcagaataacataatttggctgctgtcttggctgcatctgcacaaagtgggaccagaacactgcacacaaattgctctgatcaaatcaaggggccctaaaggagatcaggcttggcttaaaagctcttgggctatgagttaataagaattttaataaaaatggaaagtatagcctggggccatggtacaatatctctctgggttgctggtgttctatcagtcaatcatataatctttctgacgttactaaaacgaagagggtaagcaaaaactgtgtggaccaaagatttcaaaaacagaacctacagaaacaccatcagctctctgattggccttccagagccaggagatatacctaaaagtgaagtcttccccagaatgtgagacaccagtgaaaacgacctgtgcccaactcacttcacatcacaaagcagtttccatacacatataactctcatggcaatcgtgatttcaggttatgaccatctctattttacaggtgaagagtctgaggatggggtgtgggagccttgatccaggtctttgactcttacttccctgtccaaactcctcagtagcttatttgtacatttgaactcaagctattgaatcgttacgatcctctgctttggtttactattctgacatgcaaccaagtagatgactggcctctgtcatttgattcaactctaaagccagaaaatattattaattcaccttacctccaagaattggcattgatatgaaaacttattactgatttaaaaacaaatagcttccctggtatttgtttttgtctgcaaaactcaagttctgcgatactcaaggcatacatgaatacctagagtgttgcccgatcacttacttacttcattacactgacctcttttagggtgtccaccagtgacaggcatatttcttatggttaagcattggtcacaacagtttacatgcaaacttggtttgtttttgaaatagatggcatttagccgaaagtctagtctatgtggtgtaccgttagtcagcatgtgctggcgtaaatgtcattccgtgggaaaagagcacccccaggcaggactatgatgtggcttgaaacatccctcaaagatctgggctggccacattgctttatgtgcagatggagagaggagacaaaaaaaaggaacttccgtcttgctctggattttttaaaacttgtacaatgacagaaggagaagagatgtaaattcaaggacactggttgtccttgaatttctcggaccattctttatccttgccacagactcctccctctctgcctgtccagaagtgaaggtcccacaggcttccttgagcagtaggctggtcatcccatgctccacactttccctggacactaagaaaatccccagcatcaatctctaagcagagctctccctgggtctaagctccctctccgatggctccctgaacacttccacccacacgttcagcggggactccagacatagcattgtcagaatcaaactcagccttcttgcctaacctactgtttcccaggttttccgtcttagctggagacgcctccatttaacccctgcaggaaagctgagaatctctaccatcagccctcttcatcatagctcatgtccattagtcactgaatactccatgagctctctcctaaaatatcctccaatcagctcccccctctgccctcccacctttactctcctaggttaggctgtccatgtcttttgctttactcttaggcaccagcccacattcttgtgtacattgcagccagcaatgcttctacatagcaaatctgaccagggcctttccctgttgaaaaatccttcagtggctccctaaactcatgctcacatacaaaattcatattcataccttgaccttttttttttttttgtagatatggggtcttgctaagttgcccaggctgatctcaaactcctgggctcaagagatcctcccacctcagcctcccaaagtgctgggattataggcatgagccatcatgccgcaccccctcgttgacttttaaggccctcttgaactttgtctttggcccttccttcctgtcactgaaactctttctttcttattcattttctttcccatatttcctatgtttgtgtcaatatatcaaattagaaaaagcaactgactaggaaaaaaatgaagcctatttgattgaggtgattccagatgtgaaatgaagcttggcgaacaccagctcctctacaggtggggctttaataattacgaagcaagaaggatgcacatatatcaatcaatgcgcacgcagcacactgccaacctcacccctccttgcacacgtcaatacaggctcaggcttggtagcaggtactacaagttccacatgtgaaaaacacaaagcaagaaaatcgccacctcctgccctgccttccatggggagcctgtttggagtgtaggggcgcacccactctaagtcatgtctcaggctggcctgtagccttgcccttggtttccctgttgaacacagccttgtgcaccatttcccccgctaaagagctcaccggggacacagtccttactgtcttcatccgctgtgaaatcataaacggctccactaaacaagttagcatctgattgtttcttctcaggttgccagaaaaaaaaaacaaaaacctggatatttggacacctctgggagcaattgagttgtccgctttgcatgcaggcatttggcatgtgaaggtacagcctgaaggacaagagctgcctccttcatgtctgtgtccttgttgcctagcatgggagctggcagagaaaacgtctgaaaatacttgagaaggggcttttagaaatgaacaacccggctctatcccatgaagaggagcgtagtggaccatccagatccttcaaggcttggcttccaagtccttctctgaatacagactctgttcttactgcctctgagatccactcgagccatcccaagtggtgggatgagctgtgttccctacccccttagacctctatcctattgtttctgccacccctactctccagcatgctgttccacaccagaccttagagtctgctttatctaccaacaaccctagaaaacaggtgtaatttgttgacccagacatggcctgggctggggattttactctatgaccacatagcaccaaacatctggaacagaaagggaaaaagctctccagctgtttccagacatccagatgtctggcatgggaaagaggaacatcctgccacctgccccactgagggtatgctgtccaagcagacaggcagcaggtcaccgggccatggggccagcctctgtggtgcagggctgccactctgtctctgtgcaagatgagacttgacctgaaacctccagactgaaagacccctctttctgaagttttctttagaaaaaaaagtggcagaagccacagtaggttcatggggaaccccactcacaccagacgtaatggcgtcttttatttgtaggtatcaaaaagtgtggccagttcaagatttccctccctgctttcagtttccagggcacatggtttaaccaaaatcatgttaaaaacttcagtgtcttctgggtttaactcagttcccccagacaattttcttcttttcctttcaagggagcatttggctttccacctggtcatccttcaaaacattcattcaacacacacacacacacacacacacacacacacacacacacacacatatactttttttttttttcagagggtgtctcactctgtcactcaggctggagtgcagtggcgcgatctctcctcactgcaagctccgcctcctgggttcacgccattctcctgcctcagcctcctgaatagctgggactacaggcgcccgccaccacacccacctggctaaatttttttttgtatttttttagtagagacagggtttcaccgtgttagccaggatagtcttgatctcctggcctcgtgatccacctgcctcggcctcccaaagtgctgcgattacaggcgtgagccaccgcgcctggcctcaacatatattttttaagtgcttacgtgtcaggcattgtaagaatagtattaatatattgtacccttaatgaatataatgacaattttgactaaacaataatcacattaaagatgatgataataattgaaattacatattgaccatttatgtacctcactgaataatctcatttgtatttctttacttaatttatcaaaccacactaaaaataaatgcattacttttaatggcaaaaaacgaaattacttttacaccaacctaatatctcctaggaagctcagagtgattaaatacctcacagaaagccacacagcatattgatagtctagctcaaacttgaatgcaagtctgcctggagttcagcaatcacacccttactcactgcattatatcaatgcacatctgtacagtgcacgtggcagagaggaaccagggtaggtataatgagtttgtaactccagagagcaccattgtattccatgagactggcactggctagagcacagtgtacagcctacacggtgaatgactccccatggagttgtgagacacagtggccctgtcctgtgttcacttacaggcaccagaagcatgggaggaaataaaatcccatgcttatgtatatgtgcatatatcatatatgtctatgtgcaggtatggagtgtctagtatgaaggctggcatctagtaggtgctcttagatctttgctgtttgcctatttaaataaaaacattttaaaatgtaaatagagaaggcagatgccgagactggaggaggaagtaagagttacgccctgttgtgggtagcaggcaggggctggagggagagtctgggaacagccaagggataaaagctgtgatgatgggcggggtctgagtgtgtagaattgggcctaagatggctctcagagggaggaagagacctgggtctgcagcagcaattagaactgtttctggggttcacctcacttgctgccttagtatgagaactaggtttcctttgacagcctgtttcttgggtggtccacttttgactcggagggctcatcagagggaaaggaaggatgcctattcctctggtgcctggtcctctcagccagtgtcctctgcacctgccccagagggctctgacacaggcctggtggagattgagagctcaacatggggccaggtgaaggcaaaattccccaggttcttaggcaagatttgattcagatctgtggctgtgaagccaggccttttgcccttaaccagaagtctccagacaatggatttgcagccatgactcatagaaccctgtccccactctcaccagcagaggcttggctctgggaaagatggttcaggactctggacctcaggagtcccatttagaaaagaatcaagagagtgagatgtttgctcagctgccttttccctccagagagggacactgcatgtgtcccgccactgctaggctgaaggaggagaagagcgaatgagctctgtgttcacagcacatcttcttacccagcctctctggacatcccaggaatggggggcttagcttctggtttgtgacaaggggaggatgccttcattatcccctaatcctgtctccgtggcccggcagcctgactgacaaagcatcctgcctggcactgtggcaactgccatcgaagcctgaccagctggagcccaggcgatagtttttcgaaagctgttacccaaaaaaagcaacactgagttgggtgtagagataactatctctgctgtcacaccacacggggagggagggtagcgacaataccacctccttcctcgacaacgataccttacggaagccagagaaatttaggcattgaaagtaaaaacattcagcgtacttaccaaatgttgactgactccccgtgagcattttttcagcagagagctgagggaaacaactttttcttgttttctctccacgccatcccacagctgacacagcttggagaaagaacacacacccatagactgcaaacacttctcaggtggctgtgaaccctctcggggcctcaggcactacaaggtgccctccctgacctcctgggtatgaaacacagaggaatctagggctgagtgattgtgtgctaccaaagagaaagagagaggaagcaaagccacaatttggatcgtcctgtggctgccgcggccacagccatccaaccagcagctcgcctggcagtgcctactggcaatgggctctctctgtctctctctccctttctgtggctctttcttgttttctctctccctctctctctctcctttcttgggggctgtattggttctggagaaggaggcccctgccattgcttctgacattgcacaggaaaggaagagtaaaaatgctattgagaaagacctggtttttctgtttttcctggagggattcctccctcgcaaagggagtggattagaaatgatggaataattcgaaggccacaagtggacaggtggagccaacacccctccacacacctggtcagtccattttctgccctcgttctctcctccccgtcatgatgttgtgctccgccctttatctccttttttttggttgtcacagtttcagctcattgtcacttgtgaggaaagtagaaaccatccactgtatctggtgtaaaacagcctcaaacctttttgagaaaagcaggatacaaatgaatcaatgtgccaagcagtgcccttgggggcgtgggacctgggtccagtgatcccagatggtggccttcccccaggagagagaacagcactgtctctcctcccctcgcactacagtttgggtcactgccatcacggatgccttctcaaaacatatctttgaccccttcttccttctctgtggttgccaagctgacccatcccttgctcctcagccatcttcctttctaaagttcacgaatttgtgttttccacccccttcccttctctaccaccccagggccgtcgtccactttgcttggatactgacagagcctccttgccaacattcctcctttctccccaaactgatgacaggtgaagatttccccaaacagcaatttatttaatatcatccctgcaggaatatcttccttggctgcccatgggctgcaggataaagtccaaatacctagtctcagcaaacagaaacttctacatcttgaccctaacttactgttcaaagcattaatcataatagatattttcaaagctaccatttatgatttatgggccacttagtacacatcagatacagcgttaagcattgcttcctgagttagttctcacaagagtcctacatgaagtttcattacttgcactttccattttcaggcctgtagagatgaagcagcttcagaaggctgacagtgggtcagtggtcagtggtgagcattggactgcagatcttatgatgtcaaaacccatgctcttgaccccttcactgccccttctacctgaacggatgccctgtgctgctgtcacacccctcccccgaccctccacacaggtcctgggctgtcatggtcaccccctcccaaacccaaactggtgcctggggcagaggagctctaagaagtcctcaatccatatgagctgaaagttctcagccttcaaagtagaagatcgggtggataaagaagacacgcagcccaggaagcttcaagtagatgggcagtgagtgccagcccgccacatctgctgagtgagagtgggtggtggaagagctggggctggctgtattcatttgaaacgtgggctctttctctgcatcctgcagcagcctctttctctgtccacccttctcgttcacccaccacacccctcgtgaaactccattcctaaggtaattctccaaatgtccaaacccaagatctactcagccaagaagctgggttctgccgctctccctccccctgctgttctgctgcaaggaaatggaagaaggaacaacctcgctgggccacttggtgatttgttttttccttgctcaaagcacaaacatgcacaaatctcagagtccccatgttaagcagagacgctccctggtcagtctcctgcactctaacttcctaaaaattaaagagtcaaggcagaatcagacacggtagaagggagaaaaggcctcttagtagccataaagtccaggtacctcattttacaggtgaggacatcggagcctggagagaaataacttgtccaaggtcattcagtatcagagtggtagagcccacacagttcccaaggccttttctcccaggcggagagctctttccctctccctgtgatgtggctgctgcagccacacaaaccaactgttcttgttacacgtgtcatggtcaaatgtccactagctgcccaagggcaagatgagttacaagagcaattcttcccatgactttacagttgtcaggaggggtcaaggacgctttcaagattcacactctgaccgtggcaagccaggttctcggagggttaaatgactgatgaaaagaaagccaaaggctgagtcagaaccagggacagaacggctggcacagccctgtcttgctggggaaggcaaagttctccattttggcaaggtccgtgaatgtctctttttgcttttcctgggtctctggtgcacttgttggattgaatcttaaagcataccctgaatgctaaacatctcaggataatgcactaagtccttcctcagctgggctggcccatctttctacagcctcaccctaatatacctactctgctcagggcacaggaaacatagcccacactttcacatcttcatttactttttttttggttattctctccaccaggaatatcttcccctctttaactggcaaacctgcacttgactttgaggatggagtttaaatgcctgctccttttcatagcctcctctggctcttctctcctagtcccctcacttgtcttcccagagaactctgttcctggcacctctctgcccttcctgagttgaattctagctatttgttaacatgttttctcctatggctgtcctgaggctctctcaaggacagtgactcagtcatattcatctttgtaccctgggttgtcagctcagttactgggacacagagggaacaaaagaattactactttaaactacacagaaatgcatctacttaaggaaaactttgctccaagttcccaaatggaaaagccaatgaaggagttgttgttgttgttgttgtcgtttgcccctaagagtatagcaaaggcccccaaccagccagttttcattctgaatggtaaagtgtcattttacaagctgctgccacgagcaagcctccacgcatgtcgaatgcacacttgtatgcatgcacacacacataggagctagaaggagctggttgctctatggcaagaagcagcaaagaagataagatcaccatactgcaaaggaaggtaagccacgtgatgatgtgggtaaccccaggcacagatgataccctcagcgaggcccagcttaaatctaaccacatcaacttttcatgaaacagacatgaaaaagtaagactaagacaattacaaaaaaggtggtttaatgccttcttgcctcgatggtatcaaagctattggctccagggctacacttggggaaacaattctttgagataaggagatgaactatctgctcaaaagaatgtgcaggaagccaaggtaactgggcaacacataatgaaacggtttgtggccaatgagccgtctaaacaaaaatatccctggtaggcatcagttgtataagtgaaggaaaccaaacccacccttgtttcaaagtgaagactttgtgggtgccagtgtgtgagtgtgtgtgtgtgtgtcctcactaaatattatagttaaagtgaaattcacaagtcctccagctgtggctgacactggtataaaatgaaaaggttgagaaggtgagactagttgtcatacagcaaccttgaagtgcctttccgggtggcactgcctgctatgtgaaggctcatttgctgaatgaccatcactacgtcaacacaaattgagatctcagcattgatttatcggtgtgtgtcccagaaagacacactgcatttcagcatcacggtattctgatgtagttaggttctgaattctctgagccacagacgatggtatgtttctcctctctgaagctctgctaatgcctcgtccctatttccctgaaatatggtttcccccatcagttttcaaccttttcgtttccccaggcaatcttttgatgattctttaaggtccccagatccacagaatgtgacagctgggatgagcttccgggggtgccgattggaagctttacaggctctaaaacttgctactgaatctcagctctggcattagtcggtgttctttgatttcaggtaagtcacacaacctaaatctcagctttctcatttataaattgggactaacagaacccatcttctagttgagtttgctttagaaatatatgagttaattcgcattaaagtacttagcacaattatacacctcagtatgtgaagccatttttttgtttgcttgtttgagatggagtcttgctctgtcgcccaggctgcagtgcagtggtgcgatctccgctcactgcaacctccgcctcccgggttcacaccattctcctacctcagcttcccgagtagcagggactacaggtgcctgccaccacacccggctaatttttgtatttttagtagagacggggtttcaccttgttagccaggatggtctcaatctcctgacctcgtgatccgctcccctcgggctcccaaagtgctgggattacaggcgtgagccaccgcgcccagctgtgaagctatttttattaccaccaccagcatgatcccttcagaccctcttaatcttgaggtccagagagataaagtaacttgtcctagggaaatgaatcttggttgagacaataactattgtctctgctatacaatgattaaaccaaagatagcagcaatcgtaagtggctgtcagggctcaggtctactcgcttccaggtcagaaccacattggtgcccgtactgtgatttatcattgcatacttatttttttcagagtgtagcacttgataggtactgtataaatatttattaatcagctgattgcaaagatcactgctgattttcaaagcaacaggtttctctatcgtaactgcttctcctccacactatcacgtccttataatttcagaacacccatctaggaaggactcatactaatgtgttatcagagggaaacattccacccctttttggaatgcagatatagattgctccagatttcaggaacactaattagagccactggtaatttgactgaagcgctaaagcaccaaagcactcacagaaggcacctttgtactcacacattagagcttttgtcactacatatcaaaaatggtcaagctgccttttgatggtacccgcaggctggatgacagggtcaagatgccagcccaccaaatccatcatcggaaagaaactcggggccagcccatctcctaaaagctgagtatgttgcacagattgctggttctaaataggatattctaataaacattgctattgtttttattgtcttgtgcagtatcgaatatgcttctcacatactagactttatgcaaaaccaccatgacctaaatgtttaattcagatctttattttctgtttcataaccccttttaatatcactgtaaaaatctaaatggatatacatgatgctcttttggtaccaagctttttgggctatacttttatggttaatatcagggtcacagcaagagctcaagagagcatgggtatagcttaaaagtgcctggaatatacttcttgtcctagcaattgataccctctcattgcttcattgaatttttcctgttcttaacctctgcccttgttttcagtaatattagtataatgagttgaataaatggccctatctataaagaaatgggaaaaaaatcgggctttggctgaaactcccttgaggattaaaggtataagggtgaacgcagaggtgaacttagatatctatgaaataaacagagacagggtgtttctcggaggttgcagccaggcaagagtctaatcagagtctgtggctgaacctcatcagcttcaccagaggacacatcctttctagaatctcctgttccatcccctacttcctgtggcctactcagaacctctggaattggggatggctgatgggagtgacaggtggcccatatgttccgtgacaatgcactgttcattgcttttctgaacacctttgagtagactttgcactggattctgagaacagtgcctagacatgtactatccaaaagtagccaccaaccatatgtagctgtcgagcacttgaaatatggccagtccaaattgaggtatgcttcaagcataaaacccacactagatattgaagatgtggtacaaaaatgaatataaaatatcgtattaataagttttccatattgataccacgttgaaatgataatactttggatagattgggtaaagataaaatgttttattaaggttaatttcagctgtttccttttacttcttaacatgtggctactagaacatctaaactgacaaatctgattacattgtatttctaccagacagcactgctctaaacaactgccagagaaactgtcttcatccatgtacaagttagcccagtgagaacacaactctccagccctctgcccacgttccactgcactcagaatgaaatctgcgctccttctctggctcccgcaatgcagagggacctgggccctgcctccccctccagcccccgcttgctgctcacttcagtcatgctggcattttcctcagaatctgcaggcttctgccaggtccaggatctttgcagcctgtccccctcatctgtttttgtcgtgtgggtctcctctcaagtggcagctcctgggagaagccttccctcacctcctgtggtaggaagaataatggcccccaaagatgtcacctcctaatccctggaacctgtgaatatgctaccttacatggcaaaagagactcaaaggaggaagaattttgagatggggagatgatcctgggttatccatgtgggccccatatgatcacaagagtcctcataagggaaaaagagggaggaaggggagtcagagagggaggtgtgatgacagaagcagaaattggagagatgcagggccatgagccaaggaatgcaggtggcttccaggagctggaaaagcccaagatacgattcttccctgaagccttcagaaggaatgcaggactccaacctgtgttagtcctttctcacattgctacagagaactacctgacactgcgtaatttataaagagagggggtttaattggctcatggttccacaggctgtacatgaagcatggctggggaggcctcaggaaacttacgatcatggcaaaaggtgaaggggaagcaggtacgtcttacgtggtggagcaggagagagagagagtgaagggggagatgccacacacttttaaacaaccagatctcatgagaactcactcactatcgtgagaatagcaagagggaaatccactcataatctgttcacctcccactaggcccctactccaacaaagggggttatcattcagcatgagatttggaccgggacataaatccaaaccatatcacaaccaattttagacttgtgacctctaggacaatgacagaatacattcatattgttctaagccaaaacatttgtggttatttgttatagcagcaataggaaatcaatatacctcccaacctgagactgtgccccacccatgccccagctcctctattccatccttctgggttcttctttttgtatcctttgctgctatcagactgtttctaatttctttgtggatttgtttacttgtgtattttctgtctctcctgactagaatgtgagctcccctagggcagagacctcctatgttatgattacctctgagtactcttgcctttgaactaatgcctgacacatagcaaatgctcactggtataaataaatggttgaatgaagaaaggcatgacagacaagtagctctttgaaacattcacttatagccaattggatatcatctgaaaacttttagggaaaaagtacaccccaaatattaatagatgaaacggacaacattgacagatacagatattggacaatacttgctatttacgaggtaccatgatgatgctgtggagatacaaataacttgatgatcctcctacagtctccactgagagacaagcatgggcacatcataaaacatggccaaagtatggttttaattgttggggccaaacgagtggtggggctttaggtatgagcagtgatgtgctgataaaccagcctgcaaaacaacagcgaagataagggtctgatttgcaatgtttgccaatttctgtggtgtaaatattcctacagtgattgatttcaagctaccattgcgatgtctctgaatgtggagctgggaagaaacatgtacacaaggatggttttgttgaggaggtgggatttcagttgggcccatcagggttggtgggatgtggatggcctgagaatagaggaggaggcatcttgcacacaaagggaagaatctcttcagggctagtgaggtgcgtctcaaaggcccctgtggctccagtgggtttcctgtcattgagagaaacagaaatgagcaactaatgagacgtcatcatgaagaggactccctggaaagatgcaggagcagggaagacatagataattttccagccctgtggtcattttaacaagcatggcggtatagctaacgcacaggctgccaaatcccagggaggagaatcaacagtccgtgttcatggagctggtcccaagaaatccagacctgaatccaggctgatgccctcactcattctgcctctcacatgtttagggtcgaaataacatgcagctcctccagcccaaagatgagccagcaagggaacttagaacaaccctctttggaacagttctcaaagtatacctccctgaaattcccctcctcatccatgactcaacccctctaatttgcaggcatgggaggtttgattctgaggatattaaggtagtgtttaagatgctggtgtgatgtttaagcggggggtcagatggtacccgattcaaatcctgactccacatgactcctggggaggttacttgacctctctagactttgggttcctcatctctaaaatggggataataatgatatcctcctgagagggtttggagcagattatatgatgcctaagagacaccctctcctgtgcctggtgcatggtaagtgcccaattcatgtgcacattgatggtgatgatcatgttttccccctcttaaggccttgccagacagagcagagctggtttccagcaagcccctttcccatccatagtcacctgcccatcaacttgctctgagcagggagccctgtagacaactggtgcagcatcctcccagcccacgtcttccctgctgatcactttaagagcatgcattcttctgtgttcagggtgagatgttttccttgctttgggaatgtttcaatgaaagacaaggataaggccattacgtgaacacagggacaacaacgaaaacaagactgctttctgaaaagcaccaaaaagccttattttgcctgaatggccattattttcattctttttccctcacacaaagcaccggagcacatttcattcagtctgttgctgagtgagtgggtgtgaagatgcagtacaaacaaaagtggtaacatattgctgttgtcaggactcttgttaagcgctttgcgaggtggaccaagcttccctgctagcaccaccgcttgagtcatcaggagcaacgatgtacatatacacacataaatagaaaaaccctccataatccttgacatggctacacggcaatttatgagcaggagctggatttcaaaagtctgcagaacataaaagcacaattttcttctaagatgacagcaccttgtcagccgcttccacaatcttatgtgtggatcctgccaccttggagatgcagttccttctgtgcaagaaggcaaaactgctccattcctctgacacattagggcccctgggtgtgagcgtgaaaggcctcaacggggttgcatgtgttggcagccaggtgcctggagagtggggaggacatgtgaggtcccagggtgctggggtgttctaggtcccaggctatccaaatcataccactcaaagtaggagaaaacctgctacctcctactctgagtttgctgaaaataaaaagcaattttgaataggggaaggaggtaaaccttggcacttgcttccttttgccatgtaaatcttggcatttaccataaactgtcctttcttaaagacaattctgtggctttggtttatggcaatattatatgtgtgtgtgtgtgtgtgagagagagtgtgtgtgtgtatgagtgagtgggtgggtgagagagagagagagattttttttttttccccacaatagttttcttcctccagcttttgtcaaaaagcttactctaccaatgacgtaagttctgagaacttttcttccggatcactggatggttctgaggaagtaggaagtgtgtgctgataatgtctcagctccctgaagggcaggattccccggccatgttccccatcaagtctccaaggtatccatgtgtgcccacattgtaaagtatttactgagcgagctggggaacaagcaacactattgtgactttttccaatttcacaatccctgacaggccctgtcagagggatccctgccccgatggcacaccagcgcttgaacctcagtgcagggcctgtccctatgtgattcagccagaagagcatcatgtttaaggacaccatcatgggtgttcttattgaataccaacgatgtgtctggcgtggtcgggtgggtgacacaagggtaaggtagtccatgtttggaggcttataggagctaacatcatacatgctttgagcctcttcccacctttccccaacccatgtccaggggttggcatcctgccttggtatgggccagctgcacagctgtgcgtgatgcttggcaagtttgtaatgttcacagtgcctataagctccagtcccgtgtctataaagtgaggataacaactcctaagttgcaggtttgttgtaaggattaaatgaaactatatacataaaatacctaccataggtcctggcacaccgtaggtgcttatgaaattttcatagtcagcttcgctttgacaagtagtgaaaaaaagctatctgaggaaacaagatgaacatacagaaagcaacctgggaatattttatagttagcaaataataaagaactaagtagaataaataatgagacctttagaataggctcaagctgtctgcagcctggaagggaaatgaaggatgtggggtgagtctgcagcaaacagtatcatcaaggacaaggactggagatggagcttgaagagatggcctaaatggctgtggttcctctcggatgacaagatttctggtgcaataaataatgtcatttgaaaaaaaaaaattcaagtgcctgattcatctcatgggatcatgggagtaaaatgaatatgagaaggaaacatgggctggtccaggtgggacaaaggccctcttctgctgacagcatctccccctgaaagattgccggtaatatcctttgtgtctgtcgctgtggcaattagtaatgacccccagcttggcattgagagcattcctttataacgagagccagccagacacaatctctctgctcagagttcagggcggagggggagaaccaggcagatccacacggtacacgcttccaattaaaaatacaaacagaggcaaagcaaaatgaatgtcacagaaaagaaagtgctgccacccactcttggcctaaaggtcactgtgccacagccttggccattatctgcagccgcaaaggtcaggggggctgtctgcattgctggggagtatgtaggctttcataaggtctcaaaatgactgttgctctgacaccaaaattagtgataagctctcagcagaagacgataatagagaaatggagtgactgtaaccttttccgccatctctcttgtcggttccatgaagcagagtcacaaggcataaaacgagaagtttccacattctacaaaagactacaagattgctgacttaattgggtgcgtaacaaatggctataccactgccaacaagaagacatcaaaaaggaaggagaaaatagcgattaaaacatctcatgacaaccctttgaatttggaaactggctccagatatacctggacaggccttgatacaagtgcagggagctagccatgtggttccattaatattccaatcattgtggcccagcaagggcaaccatgccactaactaatttgttgaatttcaggagaatttaaatataggaagaactggaagaacactggacttggagtcagatagacctgcattcaaatctcaattgttgtccctatttgatggacaatattataaaatcttttaccatccttgtactgtaattccgcaatgttttcatctggaaatttaatgactttaatacctactgcacaaggtcccagtaaagattaaatgtgaggaaaaacaccggaaaagttcttagtaaatgatcaggtacagtggggcgtggtggcttactcctgtaatcccagaactttgggaggccaaggcaggtggatcacgaggtgaagagatcgagaccatcctgaccaacatggtgaaaccccatctccactaaaaatacaaaaattagctgggcatggtggtgcgcatctgtaggcccagctacttgggaggctgaggctggagaatcgcttgaacccaggaggcagagattgcagtgagccaagattgcaccactgcactccagcctggcgacagcgagactccatctcaaataaataaataaataaataaaaataaatgatcaggtacaatacaaatacaaacatagttcgaattcaaatacaaaaataacttgaatcattattattattagctagtaatatcatccattatccctgagaaaatctctactcctatccactctgaggtaacgttgtttttctgtatttaggccatccagggagaaaaatttttgctgttgatgataaacagaatctgcaaaatgctacatgcagaactatttcgttgggttgatatataaaacactaaaggaaataaaccaaggcacacagcacacacatgaacatatggctgaatatggcctttagtaggtatcagaaacaaaattagcaacttgtagcacttcagctaagcttcctagcaacagaaatacataaataacaaatacttatgatgattatccctaaaagtcactggaatattagcatgtgatattggtccctccaagtgttctctagctcaaggcaattggcatttttcaattacttaggtaataaagtatttgatgtttaaacctgccaaacatcgaggacgaggcatgaatgatactttggcagtttaaagtattggcctccttcctttccagaaggaaatcaatcattgaatcaccactactccaaactcagaatcgcccaacatagcaatgtgggttttccttctaaagttctgtgcctgtccctgttaaacaggtctggagaagatgctggtagtcattttgagcatcgcacagtaactgaaaggagctgacaggctcagaggctgggcagagcttacgattgtgcttgtctgtgtggctgaccacatgggggatgctctcggcactgtttgctttattagcccgcatataacttcttgggagacacagccaatttggtaagatgtgggagaaatctgtactttaaagtttcctggaacactgggtatcaaaggaatgagacgtctcctggcctttcatgttgcaaactagatggagagacacagcttagcagaacagctaaagcttaggatcaacttttacagtaacatggaaaccacatgacagattgtataggcgcctgcataacttctgactcactccccaggtgcttctgttctctatagctacacagagccatgttgaggagacaagaccagagcagtattattccacttggtgaaactggtcatatttagtcatacacttatgagggaggacaacagcagaattagaggcagtgtctgagtttactctgcctttgtgcaggtaaaatgtgactcagataccagagggtgaatgtgtggacccttacactttattatttattctcttgcagtgtttgcttttatttatttatttatttatttaatgaaactaagtctcgctctgtcgcccaggctggattttgcggtggtgcaatctcagctcactgcagcctccgcctcccggatttaagcgattctcctgcctcagcctcctgagtagctgcacaggcgcccgccaccactcccggctaatttttgtattttcagtagagacggggtttcaccacgttagccaggctggtctcgaactcctgacaacgtgatccatccacctcggcctcccaaagtgctgggattacaggtgtgagccatcgcacccagccctgtttgcttatttttttaaaaagcatttatgcattaaattgaactaatattaaatacagtgtagatttctgggctaacctcatatatactgaatcaggaattgtgatgaaaggcctgggaatctaaactttcagcaacctcaagggatccttaaacccactcatgttaaatatggtggccctgctgatccatcctcaacaaccacatccctgaacagatctgaagatcatccctaccaactggggaaactgatgaagtggaaaaggaaaagttaaaagacaatgaaaagagctcaggtaaaactatcttcttggcatatttgaggccactattaagtggcatagaacgttttgcttctgaaggtggaaaccattcagatgccttccacaactcaatattttcttttcctctcaaccctcccccaagtaataacactgaatagagttcacctttccaggtctcttcctgtccaaccactcacctgttaagatttaaagcatggtagcagatctcctgaatagaatctcttggggtgaagaggtgagatccatcacgattttaaagaatcactgacctttttttttttttcttagaactagaagagtccttagatattatcaaaatatttacaagacaaagataagtcatcgatgcaaatgaattaatacttttacaacttgaaaaaaaatgtataacattttacatcatgcttgaatcaagggggaagaaagagtatgctgtagagtgtgaattcaggtgactcctggcaactgcatgtttaattcaaatagagcaagagagaaagtgctgcctcttttctggacagggaacgctgcctgaatgagaagagttttagctgacatttcagaggtggaacctggactgtcagaagcatgtgttggtaaggacagagagggagaaggggtgctattctggggacaaattagtttaggagaaggctcagaagagagattcaccaattgggtaaaccttgagtctatcaaaagaggaaggatgaggaataatgggagaatgtcagaaagacaaaggaaactcttgttcctaatctgtgcgtagaacactggaaggatgagcacagaggaagccatcgttgcttcattcattcctccactcttcattcaataaacgtctagtgggagagcatccagggatgaatgatacttagttggcacctataaggaccttgcaggctcgtgggccagccagaaaaataatgagagacattttcattatggtgggacaagggctatgatgaatagttgaggggcacatgggtgaagtataaatgcagacagaacatgttagggaaagctttccagataacatggcacttcccagggcttgaagagaaacaatgaacagagatctgaaccccagggggagctacccggcaagtcaagttcccacgaagaagcccgagactgaaatgatctttgctcatgcaccccaaatggaagtaaatgtatcagatgttgagtctttgccctctccaccttgaacaccccatccacacaacacaacatgccaggctttggaatgaaaccagcagtgtacactcagccaaagtgactgatgttgctttccgggtatttgtagctgaaggtatgcctactcctttcccatacaaacagaggaactcagctggcatcaagactcagcctcaaagcatccagccaagcagaaggcctacctggctgccgcacacgccctgcaaaatggcacacaggtgctatcatccagctagcagcttcagccgtgtaaccaactccagagtgttgacagctgcagtaaaactcacttggagttcaacataattaagcaaaatgattagtaccgaagagaagctggcaacaaagaactttggtttctgaggcaaaattataggatcccaggatattagagctggaaggaggtcttacagatcacagccagccacctccatttcacagatgagaaagtcaggccaagagaggtgaactgaagggctgaggatgacagaagaagctacacagtatcagggtaagagtgaggactctgagatcggtcacactggggtttgcaacccaagtttggaactcactgacttcaggacagcaccttggtctctctaagcctcagtttcctttctgaagtttgtgttgctatgaggattaattgaaggttattgcagggcctgttgcccatggccagtatataacgttactatggagagtcagaacacggggtccatggccttgcttcaccatgtatgagctgtgtttccctgggtctcagttcttgtacttatgaaatggaaataaagatgctagtacctgccctaattatttgccaggataggtggaaggcttgtgggtgagagctgtgtacacttctaagcaagtttttgttattactattcccattatggcaaaaacacgttctgggtctttctactggtaagtggcagggccaagacaggacacatgcagtgaagaaaaaagaccagggacattttctcccaggcaactgatggactgcaatgtttggactcacccagtatggttcagaaggtctgatgggtcagtgatgagctcaggcgggagaagaaatctgcagtgtattcaatgccaaagggtctcatttctgggtgggagggacagcggggatggggtgaagcaggggtgggcagcaggaaggagaggaaagaacctggggaaatcaaaccacctgcctgggtttcactctgagttttcagattcattaaaaagaaagaaaatacacacacacacacacacacacacacacacacaaaagcacaaagcaaaacctcagtttggtcaatccacaaaaaatgaaagacagggctgcaaaaagtgctgagaatgggattgctcgacttttcacagcttcagctggcttacaataccctcagcttggtgcttctcccgaatccacatctcaaacgctctaattagattgtgcagccgaaagaaggcccggtgcccttggaaataagtgattgcttacttgccacaggaatgttctgtgctttcataggcttcatctttttttttttttttcctgggggcttgggaatgaattgggcaatttcttaggtgtctgctccacagaaagacgttgagcttacatttggtttctctttttacctaggttcttgcctctgcctgaaatactcttggtctggcttccttacttgctcacctgctcacctctaagacccagttcagggctcccacaggatccatccacctaaatccttaccaggggtgcctgtggaatggttactgtttacctgtcttcccaccaagagatgatcccctaaggacaatggctttgtcgtcttcatctgttcacctttgtgttccctatatttggcatggcgctttgcacctggggccttgcaactcaaagtgtggcttatggcttagcagcatcagcctcacctgggaccttgggaccttgggaccttgggaccttgtgagaagtacagagatctcgagctccaccccagacttactgaatctgaattttctttgccttttttttttttttttttgagacagggtcttgctctgtcatccaggctggagtgcagtggcacaatcatagctcattgcagtctcttcgtgggactgcccaagagattgtcccatctcagcctggtgagactatagcaacacgacacccgggttttttttctttctttctttctttctttcttttttttttttttttagagatgggggtctcactttcttgtctaggctgtaaattttcagtttaacaagtttcttatgtgatttgtggccacactgaagactcaccagaacagggtggggtggggaatacttaatcaatatttgtggaatttacccgatgaaatccagttattcctgctgaatttctctctcctccaggaggacatagcaaacgagctgaggaaggtgaatgctgcaaccctctctcctcagccctgcagccgatccctgacataaactccttgaagttcagtggcctctttccatgcacctaccacctacacctgctgctttcaaagaaaccacaacctggaccgggaacagaactggacgtgccaaaatgcctgaggacacttcatcgaatgtggctggcttgatgggaagctggcatgactagaaatgtcaggagtcttccctctcgaggtttcaagctttgtgtttctgactcaatggtccggattgagatcagatgagtcaagttcagatgaccatgcaaacctttagatggggcctaaaaccaaatctgtgttctcaaaccattccaaatgtgttcatcaccagttatagtttaccataccacccaatccaagagagtgcagtcatttctctaatagcagatgcataattttctcatcaatggaaaatctaagtgtacatcacaaggtcaaaagttgcgagaaacttgacaccttcgagattgtgccaaacctcaagcttgcagtaataagggctctcagtcaaaccttctgagaatgaagtgtatttgacccaacgtttagcataagcaagcacgtactatgctgtccctttacgatggctgaattcttggctagactatgaaggaacacaacagcctaagcaaagcctatataaaacatcaacccacggtcatggcccaatgagatatagagatattgttgaaatccaagaaagtgaaacaaaaatcctgagccttattcgctaaattcccttaattgtgacacactaaacaagtaacagtcattagttctagtatcatgtaagtacaacattctaaaatggctactacagatatcaaaagcattaattcaatgtacacttactgggcacccactgtgtgctaggggaagtgtgctagggtaatggagattcaccatggaacttccttttattttccctcactgcctttctcttttcaaatatttaatgaccatccactgcgtcccagaagttgccaggcctggggcaggagattctctctccttaaggcccctgtgtcccagctgggagtgacagatacatcaaccaataaataacatggtgggaaaagtccattaataatgatgtgcacacagtccttaggggtatccttgaccatcatgctccagcttagatctctgaaaacgaccttttggctgttactgaggatgtcagcaataaaactggatcctaaagaaaccattcatgatgatatatccttattggaattgacaatgcatgaggaaatcacacatgtaggtcccaactgataaagcattatccatccattaagttagacaggagaggtggcttaatgtcaataacatatctcagaaaaaaaatgtgcttatctcttgatttttgtagatcaaatcccactagaggaattgggtatgtttgtagacccaaccacttacattgataaggcagttttcaaagtgcttttataagtatttgctcattgggtcctcagagtaaccctggaggtagctggtggctcaccagtgtggcatggttgtgatgaggactactgtaccatgctcttcgtcaagcaaaaggcagacagtcactctccacctttttatagatagattgactgattgattgagatgagtctcactatgttgcccaggctggtcttcaactcctgggctcaagtgatctctctgccttagcctcacgagtacctgagactacaggtgcgagccaccatgcctggctcattcttcattttaaaagcataataaatactctttaaaaattccaaggaacgagatgtccctctaaactgccttcttcctcttcgtgtaatttgacattaagtgtcctggtgtgttaagcttgcctctatttaaatagccctgcagaaggccataccactcaggcttaaggggacagaaggtactctgtcctggaagcatcatgacactaaaagttcattaagatctctatcccagctattacactcctaaggtcactgggctctcctcaataggtatattaagcagcagcctcaaaaacagtcctcagttttaggatgcaaggaaaataattcacgaaggtgatcaactttaagttcaaattatattcactctagattttatcatggctcctgcccatgaatataccatcttccattcacatctaaggcaactagttcagggtgagaggaaatgggcactttatgaacatctgctatatacaaatctttacccacctttttcctcctttagaatttttctaactcagtggactctccatgattcaaaggaagtccttgattttcactccttctcacaaggttacctcttacaggtaacagtaccctcttgcctgcaaaggtcaggacaagaggatagaggaaaaagctaagggaatctcagaaccgtttatgtgctaaaattcttagcttagatgtatagatggacaaggaaaagtgggcaagagaaagtaaaactaaaatttaggcaaggaagccaattacccagtaaagagggaggctagcatcctagcatgagagtatcagaccagactatctcagacccttagtcttgtggatcaaggcactgatggagggcactgtagaaaagtgttgaaagcaatatggcagacactactggattggcaaattgcatccgctcctaccaaaggatcacactcccagaagctaaaggaaagaaatggagagtgggaggtgtattttgggtaaaaaagaaaaagaagcgcttgtatgaattttcatgttatttcagtgaagtcataatagaacagcttcccttcccagagcttgcccagaacagctatttaaagggggagtgagaactgtacaagctttgactagattctgaggtcggagccttaattagagtcacaattgtattgtacatctatttgtgtaactgttcaattaggagtgtaatagctgggacagagatcttaatgagcttttagtgtcatgatgcttcaagactgcccttttttggttgttgttattattaagctttcatataggggcttttcctctctgctgtccaactgtgtggttctcccttcaggcaggttgaaatgcaagactgagtcttgctatatctaaacttgggcattaaaaatgggctgtcttccccttatcatcttcatgattagcttgtaaacagtttcttgggtctatcctgttatcaacaaaaactctaggaatactggaatattagggccaatcttttacagttgagataattgagattcagaaagatgaagtgaactactggacacagcacagatagtgacagagcctgggcttgcacattagtgttctgacctttcaggaacaaaacaatcacaatgcctgtacatgtcataataaggtcattctaacactacaatgtacaccagtacccaaactggatcattcatttaaaaaaaattcattcccgaagacatagtttttgtggtcttaataggtattttacttaattttcctctgcctttcactacttagacttgggtacaattaaagatgatatttatattttgtgttatatagaatgaacagcactcaaacacattcttatttaagcaaatctggcctacgaaaagctgtattcatgaaccctcaccaaataaatggtgaggatggttttttgttttggctttagaaaatgattctctgccttaattccctcacatgtaaaataggcataatactgccatctaccttacaggattgttgggaagattaaatgaagtaatgcagttaaactgtttagtagactgtttcgcagagcttcaaactcagtcaatactagctgcttttgttcttattcttttcattatcacaaaagggtggccagaagattatgcatgccaactgtcagaatctttttttttttttttttgagacagagtctcgctctgtcgcccaggctggagtgcagtggcaccatctcagctcactgcaacctccgcctcccaggttcaagcaattcttcttcctcagcctcccaagaagctgagactacaggtgcgtgccactgtgcccagctagtttttgtatttttagtagagagggaatttcaccatattggccaggctggtcttgaactcctgacctcgtgatccgcctgccacagtctcccaaagtgctgggattataggcgtaagccactgtgcccagccctcagaatcattttttatattttgtaggaggaggcggacaactggggtggcatggtgggggtggtttaagtgttaatattttgagatgattaaaaaggaagagaaaatgaatgtcagagcttgtgaaaatgactgttgagacaaaacaattactctgttataaattaataatgcaattaacttatgatatgttattgagtgcttgaagaatggatagccctcaaatattctttttaaaacccatttattgcccaagataaacttaagggtagtgtcacattttgaaaaatgttattttattggccataatttttcacagtttcgatggggacttagtgacagcccaacacagcaaacgtcctttcatgttaccatccttgttttttttttttctttcttctaaagctaaattgtcctgggacactccaaatgtgatttatttgtcccaaggccagtagaagtttccatgtaggtgaaaatggatgtttggctagttgaagagaaacggaaatgagttctgcaagctgacttacccagtggaaatgggtaagtaactcaggaacattatatcactgtacattctgactataaggaattctggataattcatgtcccttatagatacatatgaacttacacatgatctatcaggaaggaagaagacaggagccccatgaagagggtgggcatctcagtgccaggcctttgtgctatgtgctttatttactcacttagtaattgcaacggtctagtgaagctttaggttccaaagtcacagagcaccaagtaacactaccactgggatttgttccacatttggtattgctagtattgtggagactttgttttaccttgcctcttcctttggggaacagtagtaggcatccacttttacaagaaagttgatgctgtgaagaggaaataagaggccagataaattcaaggtaaaattaatgaagatatgtttagatcctggttctcccattgcctggtccaacgttctttccaccacattccagtccttagggatgaggtagaaagagaaagatgtttgatagacctgataaaccctgaacagggctccctgtcagagaacttgggttccagtctagtctgtgaatttcactgcctgaaacctggctctttacttcctcacacctgtttcctcatctatcaaatggagaagttggtctagaagatctccaaggtccatttcagatctaacactctattattctattatctttgtgctctggtaagtagaagcatatagccctgggcttattaatattaactggggcaaacaagtgaaattagtttatgaaaatagagctgtggtttttgcttggagccaaatctgccttatgagactcactttaagcattggtaatgggattgctgatggctccttggccagaacctcaatgccctgctgttacactttccaggtggtgccaagggtgagcgtcctctgtagacacatgaaactgaggcattacacagtttaagtgaaaggaataaatcaaatcagttacattcagcctgactcatcttttgtctatcttttctcaatgcttgttcagtccagctcagtacgaaggccaacccttcctggaaacagccccttccagtcccagcctgcattgaatgggttgcttcacccaaccacagagagttcctactctctacactcataccatttatattttgggactcaggcctgtctatatgtctcaatagctgagagctataatgaagatcgttgtgtcaggggtaatgctttacgcctttgttcaggggagagatgggatattaaaattttttggcctagacaacttatcttcttttatttatatatttttacatgtgatattttgatacaaacatacaatatatagtgatcaaaatgcatcaccccaagcatttaccatttttctgtgttaggaacattccatttctcctcttttagttattttgaaatagacaataaattattattaactatagtcacccctattgtgccaatgaacattagatcctattccttctatctaactgtatttttgtacccactaaccatctcctctttatatccacctccccactattcttcccagcctctggtagccattattctactctccatctgcatgagttcaagatttgttttagctcccacatattaaatatttgtctttctgcacctggcttagttcactcaacataatgtcctccagttccaagtgattttgtgatttataacaagacatatatatttggtcttcatccatttctgttactgagttcctaaaacccttggaatttcagaagggataagagaatgaaggcaaaatcatcatcttttattgttcataacatacccttttcaattacacctgcgtttatattaatgactgccctttaggaagctcctaagcatggggggctggttgccagaggaacaaactgtgtgattgggactctcagccccactctccagacctctagggaggagagaggggctggagtttaaattagtcaccagtggccaatcatgcctacatgacaaagctgccataaaacccaaaaggacagggttcagggagattccaggttgctgaagacatagaggtgctgggagggtggcatgcccatcccctatatcttgtcttatgcatcttttccatctgggtgttcctgagttgtatcttatctttatctatctatctatctatctatctatctatctacctacctacctatctacctatctagtttcgagtcagaatcttgctctgtcatccaggctggagggcagtggtgcgatcttggctcactgtaaccactgcctgcagggctcaagcgattctcatgcctcagcctcccgggtagctgggactacagctgtgagccaccatgcccggctaatttttgtatttttagtagagacggggtttcgccatgtttcccaggctggtcttgaactcctgggctcaagtgatctgcctgcctagacctcccaaagtgctaccacactcagcctttttgtataaacctttttgtatctatcttttaatataaaccagtaatttagtaagaaaactgttgtcctgagttctttgatctgttctagtaagtgactgagcctgaggaggggtactggcaacttcgaaattatagctgatgggtcagaaatcacaggtgacaacatgtagattgacatcttaagtgggggcagtattgtgcaactgagcccttaactgtgggatctgatgctatttccaggtagatagtgtcagaattgagtttaattgtagaacacccagttcgtgtgtgccacagaactgaattgttataggaaaagaaacgcacacatcaggtgtcatatgtgaagtactgagagcagtagcagagaatctttcctcttagggtatacagatgggagttcataggctatatatttgacctacatcgccctttttgccaagtttattttaatgttctgctcttgggttctaacaaaagatgcattagagcctaagtgtatcaatgtgctaaataattaatatgtactctatagaaattttgttgaggctacagctaccaggatctcttgatattctctatatgagatcctatgagagagttttctcacaatttcatttcaagaaaatggctaccccgttttaatgatcatttgattaataagaactgtgaattgacaatgtctcccattttattttggttgccaggaagtccaggtgaaatacgaaataaattgatgcactctttcttgttctatataatatgtatagtatatttttaatctggtcatgatagttttcaattttacttacacgttccctgatcctgcttctctaatcttatttatattttgccattgttatatatcagaagtttccttctattttccccaaatagctcttaaaataaggtgaaatatatataaatatacaaataacacccataatttgtttaaatctaaaatgcctagcatggtgccagaattttagcagttaataactactgcttgatttatagggagacacattacaccttatagagaagcagtttctgagagtcagagctggctggagaagaactgcatggtccctgtcactggaggtatctgtgaataaactagataagcactttggctcacttagttaagccttggtttctttaactggaaaatggcagtaatagcatctcccttggaggtcactgtgaatagtataagttggtacatgtcaagctctcaagctcttagcacagggacgcacatttgaaaaaagtagcctttattattaatgaggacttgtgcattgaaagctgttttattagcttaagtacacttccaaacctgatggttctgttgggctagcaagccctcagtcatcagaagaatcatagacttagagtcttggaccaaccctgcctgtgtggctactgtgagagggatttaaacagcaaatgaaggactggatggagtggcctttaggcttccttccaccccaaagtgcgtggtacttcggtttcaaatccattcaatcagagatggcataagggtgtctgggagaaaaaaaggattctaatgtcattttattagaagttctcccttctttcatgtgtaaatttcacttgggaccttatcaattggatattaaagcattttccaggggggaaaaacactcagtaagaggaaaattgagaaaatgtctgagagcacttcatgccttcctgtctatctgtacataaagagctgctttcttcacagctttccaaacacaggttggcaacctgattatttccactaggcacagacagtacacttcaaacaaggaagctgaccagaacccatgccaaacatgatggatgttccagttttattaccatcaacctcggaccaaatcactccatcaggcacccccccattattttacagtattttgatggtggtatccttcagaaaatgggccacatctagaaaaaaagaacacatcagttccttatattttggctgaaatgaccataaaattgcaggtcctcagtgcagccaaggtaaccattttttcccactgacctttgtgtaaggagttgtcaggcatcggaatgtggctgaattaataggtaggacctttcccagagatatagagggcacaggctgatttcgcgattttataaacagatttttcttttccatgaaaatcccaggagaggcatctattacagaggttgggactataggtgtcacccaggataggccacaatatagattatccaggtgcacctaacaggagaaggaaaggtggtctcaataatgcagggcatgtttcagcttaatactcctgagttcagccaacactttggttagaaacatgattggaaatctcctgttgatagagtctctccaaatagactcttatcaacaggagattgccagtgggcaggtctgatggcacacaatgtccggcatgtggctggtcacataacaggtattataaacatttgttaaaagtttaaatttgccccagctgctctcaagtaatggcttttacaagtcccagacttctaggatcgaaaaatgcataagcaagtgaccactcctccctctccccttggaaaaccataaaatggacaagaaagtgcataagcgatgctagccctaaggggaaccctggccctgacacgttttgccatcctcctcttgttccctctggcttggtagtgcatcactgttcttgcttcctccacacttatgtcccagaggaggcaacttgactaggatacattgcaccactcagaattcataataagatcaagaagaagtgacttgaggactctttgtgttccttggttgcctgcttatcttttctcactgtggttgactgggccaaggaaaatatctccatgaagtagtctttgcaacaatggtataagaattcaatcagacatgtgactaggccttcctattattcatgatttcagtcataagttaatgagcaaagcaaaggttattccgttactagccacagctggctacagaaaccaggtgctatttattcagagagttattgaactgctggtatgtaccaagtagcatgctaagcactgtggggctaaataaaggtaaattaaacaaacatcctatgcacaaattaattatcctatgagggggaattagacacctacttacatgaccagagagtgaaaagtgcacctaagagctatggacagcgatttttgtggattttagaggagaaataatgtcttctgtttacaggtatctaccaggttgtacggaagaagcagttcatatgttggtccttaatggataaaaggcatctggacccaaggaggtagtggaagtgtagtgagagtggcgacaaccatagagcagaggggcgtctttagctagcaaatctctgtgggaggatacattagactaagaaggcacttggccattagattacgtagtcagtttataactgtatatgcgtggtgacgctcaaacacttttgcacagaaacctacttggcgtcacaaaagcataagacctcctggacaatggcctgcatcttcccctccccactaggcattctggttgtcagtggtcacaggcattttatgctaggccaatccttacactcactagtcacatatgggtcacttatagagttgtttaactgtccctgtgacataagcataggcttgcctttggcaactgtacaagacaagtcctaatcctattgttcttttccaagacaatcaatgtgatctcttgccaagaagtattttttaaacaacttcttaactctctcagttactctactagtcctgttaggaagacacatctggtttgctagacaatcaatgcaagttggagaggtttgatactcatgcaaacacagccagatcctcttttctctaaagtgagaacttttagaaatgtcttcttgagcacatcggaacaagcataggaaacagtaattagaatggacttcaatgcataatagatcaagtctacaaaaggagatgggttggagatatccaggcaacagaagttttgcacgtttccccaaattacattcctgttgcagatcaaagatttgtttttttttcaaaccacaccaaagcacacatttggaagccaaactcctcaagggcacttaagaattatttggtaaccttcctgttaaatttggagttcagcctacaagcttaaggtacaccaaataatggccttcactgaatcgctgccctagcaaacaaagcattgtttatgggattggagaatgacatctacatgaggtttgaagtattttatgtgcataatgtgtttcaagggccatggccagccagactacctgtaatgccattcatcaaataaatattaatatcaccaactcagattttgactctgttcttccttgtgggagccattcaacctaggagggttgatgagggaaatattgcccctatattccaaagctgaatggtttttccacttaagaaaggaagacttttcccttttacagaactggctctctcttgtccagtctagccagttcaaagcctcttatgtgaagcagtcagcttccatataccacaaccatgcataattaaaaactttaaggatgttaaatgcaatgcagtatcctggattggatcctggaaacagaaaaaggacattagtggaaaaaactggtaaaatccaaataaagtctggacttcagttaatagtaatgtgccaatgttaacttctgagttttggcaaatgaatcatagttatgtaagatgttaacgttgggagacactgggtaaaaggtatgcagaaactctctgcattatctttacaactctatgcaaatctagaagtattccaaagtaaacagtttattgaaagctttgtggatgaacttatgctttggagaataactcactggcagcactatgaggtaatctctatcataaagcaagtgtgccatagcaaaataagcactagtctaagaggtaggagctccatgtctgaggcccaggtctgtacatactttaagctgtgatcttgcattggccatttaacctcctatagaatgaatacctacatctgtgagatgctctgcatctctcacaggggtattaggaagatcatatacaaagatgctctggagaatgcaatgaaaacctaaaaggataacaaattcaaaatgcggtctgagcaagacgttgggtatcttgagaaggtactgagccatgatccgcaggcaaacacaaaggcagctattgtttggtcttcactctggaagtgggacagcaagagaaacttttcgaatggtacctgagagaccacaccagggtctctcagggtgcacagaatttagcaaccaagtataaagtagggcagtgagaacagcaaaggttttgcttgacatctcctggaatctctgaaactgcagagtggaatcacttctctatttagtgactgaagaggtggttcatacacaagtagaggaatcttgtggtcccaaatgctagcaccaccacttgttgatttgtcattccaattaactagttctttcctatggcagtacatctggtctttcttgcacaattccccagcaacaacaatatcaaagtcaactccttagcatggtgcacaagctccttcacatctgcccccctggctcatctcctgccctctcctccttacctccagccatgcacccctatgtgctgttccccaagtgcacatattgtttagtgctatgtgctcttcacctgctcttcctcctctctggggtgcccttccatatcttcctcaccagcgcaatccctactcaacttttcttttcctaattcctttatttatgggctccctctttcctcttctccttcttcttagttttcgtttttcacatcaagtgccgagtctataaagattcttccttgatcttttgtctctcccagtctcagctggtgcccagagcctcttgtgcccagaatttcccctcactcatgattaaagtgttcatctcagattctgactctctccctaacacatcctccacaccagattgtggtcttctatgggtaaaggtcgtgtgtgtgtgtgtgtgtgtgtgtctgtgtgtgtgtgtctgtgtgtgtgtgtctgtgtgtgtgtgtctgtgtgtatgtgtgcaagttatcttaatcatttagccaaatattcagtacaaagtaggtttttggaataaatgaatgaatgaagaaatggtcatgccccttagatctagtccagaagtatgcaggtacttctaaaaggccaggaaaacttgggattacatgttaaaagttacttctattagaataatttccaaatacattcatataacttgtggtgagctcacacagttcggtattattaacaatatgtacagaggattttgcagaatgacataatgagaatgacaacattttatgactaagtaccagataatgaaagaaaattaattaatttgctgctaagataaatgactatacaaacttaggggggaaagctgccacagctattatgtttctaagtttgttctggaacataaagtagcttccaccgaacaactcccacctccaattagctgtattagctctattaagttgaaatgcagctagagatatccggttgctgttttaaacattcccaaataatacattctggagcaaaaagcaaattttgtaggtaataggtataaaatatcagggaatttatctttcacatagtaattcacaaaagaaagggcaaatacagaatgcaaagcagtctgtctatccttctataaatattcgccaattagcttatagggaagtcacttaaaacaaataacctatttttttcaatgttaatattaattttaccaagccaaggcatgaagtcctgaaaagggaagaagaaaaacctacaacagctgtttatcttaaatctggcatcccttttttggctcaagaaaattgataaaaatctcattttataataagttcactgctacataaaatttatacatttgaacattaaattttatgggttttgtttttttaggggagtagattatactaaaattctgcttatttgcagacaaagctgtgtccttgagggtatagttgaagttagaaacaaaatgttttatcttatttttttcaaaaatatgcattaagcatcaactgtgtaccaggcactgttctaggtgctgggaatacagcagtaaacagaataaactttccaactttgtagggttacattccagcttaggggtcagtaaacttccataaagcatcagcagagtaaatacttttagttttgtgccaagactgtcttttgtaagactcaactccaccattgtggtacaaaagcagccacagacaatacatgaaggaatgagtgtagctgttttccaattcaactttattaatatagaaaggcatggggcctgatttagcatgtaggccattgtttgctaactcctattccagcgtataaaatttcttcttaatcaccaaaactaagtaggggtattacagaatttatggaatgatttacagaattatggaaatttagaattgaaaaaggacatccacttattttaaccttattttgccctgaggaagtaggatcatggttaaaagtgtggcctctggggtcagcctgctagtgtacaaattctgctttttcactaactataggtgatttggggcaagttatttaatctttcactttttctcattgataaagggaagtgaataatactatctacacctcaggagactcttaggataatccaggtaaacatttatcagggcatatggctcacaggaaactcacaacaaaattctagctattcatcagaacaacaacatcatcaataacaacaataatggtaacaacaaaaacactgagactcagagaggtgacaggacttgcagagggtcccatagctagacccctagcttactgacccctaagtttactgacccctaagctggaatgtaatcctacaaagttggaaagtttattctgtttactgctgtattcccagcacctagaacagtgcctggtacatagttgatgcttaatgcatatttttgggaagaaaaaaaaagataaaacattttgtttgtaacttcaactatgccctcaaggacacagctttgtctgcaaataagcagaattttagtataatctacccccctaaaaaacacaacctatacaatttaatgttcaaatgtataaattttatgtagcagtgaacttacaaaatgtccagtgtccaagtcaggataggaactcaggctctgtgcctccaaactcaggatctcgtctgatcacttgctgtccttcctggatctcggtaaatcatgtgatccatgagtaataaatgttgggtatgtctacaaatggtagcaggactcactcagttcaataacccagggaattctagagctgggctgtgctgtatggagaggcacttcagggaaacagacctttgagagttaaccaaatctttctgttagaaatgcgtctgctgttgtctcaccagtatgtccaacggtgaggataccagtggaaatcacccaggagaagaatatggtcattctgggaataaattctgcagccacggtggatgagagaagccaatccctctagatatgaatgaagccaggccttcagtagtagattcactgtgaaccagaacgcctgcaggaggttaaacattttggcttttttcacctgatggcaggctccagtggaccacccaaggagccctttgaaatactacttttcatggtaattagtttcaaacttttgcttgtttcacttaaggatcaggttctctaaaaacttctttgaagaccacagttgttcagcgtatttaatgtcagttatcctcaaggaaagagaaaaaccagttgtgaaagccaagggttttataccaccacaccctcctgaagtcccacagatttctactatttcaagcaaatcaagccacaatagcataaatgttctttcaaggaactttaagctaattaattgtgaatgtgacagctagagtacagagaattaatttcctgaggttggtctcccccaaccaaaaaatgtgttttttctgaagttggctttctgggatctgtcatttgtgggctcttacaggaagtgggggggggggggggcggctaggagaccaccacacttgttggaggcactcggaattcttttgacaaatggttttgctgacttgagacatctgggccatattgggcttaaatttgattttaaaatctttcttcttaggccaaagataatgttctctttggaaatcctggacattactgcactgatgcccatacacatcaaccttcacacatttttttaaaaccttcgttatcacatcaaggctatgtgataagagtcacacaacttcagtctgcctgtgacaccatggagcacacttgttaggatttttgctgattttttttttctgaaataatttttacatagtaccatttccaggtaattttcaaagagaaacttcatctagtgtttatgcttcaatcattcatatgcttaatacaggtgtatgggacatcttctatgcctgagagttaccaggtatctgatatcatgaaaacatggctctttcctcaaggattagcgagacagacacctagtcacaattcaagatgctaagtgctattaaattttgtggatattggacatattttcacttgcgagtgggagctaaatgatgagaacacatggacacgtagacgggaacaacacacactggggcctttcagacggtggagggtgggaagagggagaggatcaggaaaaataactaatgggtactgggcttaatacttgggtgatgaaataatctgtacatcaaaccctatgacttatgtaacaaacctgtacttgtacacctgaacttaaaataaaagttaaaaaaatactttgcagatattggggaagactttttagaagaaaggacatctcaacacaaggctgagaagtagttcaccaaggcaagtaaatgaaaagcacacatcaggctgagcatgtatgaaatccagatgcagacacaaggacctcttaagacctaaggtagtattactgaacaatgagagcctgggtttctttcacctgcttggtgtggtacactcttaaccttctcatctacctctctctccccaggacttagcatagtgcccgctattttataagaatacagtaataatgtcaaatgaatgaatgagtgttcttatgactttttttggacacaaatgttcttcccctgagatagtaagttctcttaagatagggtgtgaggctgttttgatgtaatccaaagataacttaactgatttagtctgtgagtaaaaatggctgttattatttttaaaatccaggtagatgttatcactctcattgttattataacactgttatcatatccaagcatttttaatgaaaacaccaaagtttatcttataaataacaaatccattacaaatctaagactctgttaacaatcaagatccatattaatggagttcctgacacttcactacttcagaaacactagtaaaataaattaataaaataaagcagtcaaagcaataaaagaaagatttcactttcatgctatggaattatgtctgaatatacccataatttcttccctttgcagaaaatggtaaaattgcctaaatcatagatcagtggtgctctaatgagacccgatttggattcacttctattcaaggcaaactaactgtatataaatgccttgctttaaacattcacaatattatacaaactatcccactgaagtgagtttgggctgggaagaataaggtgtggagcctaaattaagaattttccagcgttggccaggtgcggtggctcacacctgtaatcactttgggaagccgaggtgggcggatcacgaggtcaggagatcgatgccatcctggctaacaaggtgaaaccctgcttctactaaaaatacaaaaaaaaaaaaaaaaaaaaaaaattagccaggcgtagtggcgggtgcctgtagtcccagctactcaggaggctgaggcaagagaatggtgtgaacctgggaggcggagcttgcagtgggccgagatcgcggcattgcactccagcctgggcgaaagagcaagactctgtctcaaaaaaaaaaaaaaaaaaaaaaaaagaattttccagtgttgaagaggacagagtgactttctcctcaccagcctcaccctctggggacacagagagagctacaaatttggcattacccagttggtggctggtgtgactcagaaggagggaaaatcatggctcagaaactgaagatgtgttgaaaccaccttgatcttttgaggctccgcctgctcgccctgcagtggctgagtcctgaccatcctcggaggtcactcctgctccccgaaagctctgctcctctgctagtactttttagccttcttagctaaatcttaacttactattattgctcagacctctgtctgaaaacctgggccctgcagaaacagcagctattggaagcaatactcctgtaatgacctactgtgcttatttttctagatgaagtaaattatgtctgaggtaatgtcttgcagggcgttagttaaggaaaaattcccattaggtaggcctccctacaggtatccagaattggtgtcttatcctacaatgtttattttaattttcttaatttaagctccttggattccagacctccagaccaatggtggatctgctcatcaagtcccaactcagccactcatctgtcagcttgtgcaggttttgggacaggatctgaagacctccatgacctttctacttcttggagtcatgatttctaaaatctggctggccttggtcttcttggctcccaaggtcctctactgcccaagttcctgtgtcacaaaatcaactgtttccatgtgttagaagcatacacttcatctccactagcagcagcaaagaatgatcacctatctttgtaggggagcaggggtttactgcaatagagaaccagggtagtggggcccacagtgctgagtttcaatctgttgctagttgctaaccaggtggccttggagaagttttttttttctttttttaacctttccaaacctcagtttgttcatcagtaacatgagaataattatggtacccatacatcataggactgttgggtagagtatatgagataatatatttaaggcctttaacagagccaggcacacaatcaatgctagaaatattagctgctcgtgttagtgttacttagagaagggaaagcaaataactgtcaaaagtcaataaaatgatactctaaacatctaattaaatgcaacctgataatcatagaactgtacatttatatgatttgaagcattttttcctaaaaagaacagttagtttctatgattaattatttagattacagaaacaaatttgaggactcactttaagaggacacgaagtggcaccaatggagatcagacatcagaggatatcaatgaaatttatgtctaacaggctaatagcactgagggttagggtcagggttctggaaattccactatattaaaaggaaatgcttttaaatgttacttagcagaaacaaatcatctcctttttcaccacttgtaaaataagtcacaaacataaaccttccacatctacgtgccattttagaatgctgtttcctttaaaagcacacatacaagccatccccatgaatgtgggattgtcactgggtcactagataaaggagatttataaaatctgtgactgcatctcctgtaagcatgctttgaagaagtaatctactccttcacccatgggtcctagaatatggcctgcacacagacaaatgtgtaagttgtaaggagcagttctgcctccctcagaggctgaaattctttcttctgaccaatcacatctcaccttactctttggtttccaggaacatttaaggattaactactggaaatcctgtaggtctataagcccatgtatttctattccctcacccactcctcaccctggcattggtttggcatccacctcttcactctatcttacttttggtcctaatttctcaacaatgatttctattaggtcaaccctactgtcacttatgtaggtcaaaaacctttgaatttcaccaggcacggtggctcatgcctataatcccagcactttgggaggccgaggcgggcagatcacgaggtcaggagatcgagaccgtccgggccaacacggtgaaaccccatctctactaaaaatacaaaaattagctgggcgtggtggtgggcacctgtaatcctagctactcagcaggctgaggcaggagaatggcttgaacccaggaggcggaggttgcagtgagccaagatcatgccactgcactccagcctggtgacagagaaagactgtcaaaaaaaaaccaatgaatttcaacaacttcatttgattcaacctatttttcccattgttagtttatggatttgttgtaggccagctcaaagcctccggaaaaggagaaaatatatgcatatagcaataatcagcaacagactggtttttatagatattcaacataacacaaagaaattaaatttaatacgtgtctgacctgagaaagccagaaataaaaaaatccgccgatgcatttaactttttttcttagggtatgccttgctttaaaggtgaggcaggtactaatctacaaaacaaatcttgccacctgacacctcagcctctatctctcacccctattttaacctcaaggcctcttctgtagaccccattatggactcctcaatggttagacaaatgctgatctaaacaaggattaattagaagtgagatgaaaacaatgctctgtactctgccttttccacactgagtcttatgactccaaacttcatcatgatctttggacccttgctgcacctttcttattgtcagcctctgctcttggactgcacttgtctttcttcccactgccacaccacacccctatggcctcctaagctgcatggctcctgccattcccacatctggacacactcagcatgactgtctctgctgtttccagccccactagagagagaccctcatcaggccaggaggccccagacaggcacctctgaccagccctgctgggacccagtgctggcccaccatttctcccaaagggagattcaatatattcaactgtcctgaagtctctactctacattggatgaaacaccattttaccatgacttagaaaatcaggatacggcttaaactgcgaggctggccattagagctgaggctcaaagcacatttcaaaacccaaaatggccactctgtcactgtcatttcatttttagtaaacctctagcctttcttttaccaccaaaaaacaagaagagagagagagagagagacagagagaaaagagagtgggagtaaaagggaaagagttagaaaacagggtgactttttctgaacaatggttgcattaaaaagtgtccttgaagcagagagaccactcaagaaggaaataacacctcaaaccagggggccattcaccaaaaaagagttcacatttgaagctctttgcaaaatgttttcgtgtgtctgctttcccttgttcattacaaaactgatgaaaaataaagatgataagtatgtttatacaaaaagaacccattcaataattcatcaccttgttggcttacaatataactactccaaaagaaacgtgttttcctacccactgaccatgaatggatacctgagacttaaatatggctcagagcattgtcttcccgcgcacgtgttgcggaactgtccccagtatgctgcccgtgctagttaacccaggtggggcttcagccttgatttgccccactgttctgtatcttccatctcttatgtctcccactacaaagcatgctggcgaacacccaaagttttgtttcgttgcaaccactaaaattcactagacacggaattatagtatttttcagcctagaatggcattctcgattaggggcaattttgtcccctagggtatatttggcaatgtttgaagacatttgtgattacgacaactaggaggggagtatgcactgacctctaatgggcagaggtcagggatgttgctaaaaacatcctacaacgcaccagacaacccttcatgataaagaatgttctggaccaaaatgtcagtagtgctgagattgagaaactctggcctaagtggaacacagtagtaagcatctgctaggccaaagcctagggagggaagggatgacaggatttgcctagaactacccagtttggaggtggtagagctacatgcggcactcaggttaggtagtgctatatatttcctctacagcatgtttattctaaaaggacttaccctttagatggagcttaactacacacacacacacacacacacacacacacacacaaacacacacacacggtctagaaggatacacacctagacgtaactggtgattactgctggacataggattgtactgattttccctccttgttctgatacgttcagccaagatttgtttggtttgttacttttgttttgctttacaataagtacttactgattttataagcagaaagaataagaaactatttttattttgaaaaactatatagggaggccgaagtgggagaatcacctgagggtatgggttaggagttcgagaccagcctggccaacatggtgaaagcccatctctactaaaaatacaaaaattagctggtcttggtggcaggcgcctgtaatcccagttgctcgggaggctgaggcaggggaatcacttgaacctgggaggtggaagctgcagtgagccgagatcaagccattgcattcccgcctgggcgacagagagagacatcgtctcaaaaaaaaaaaaaaaaaaaaagaaagagagagagagagagagagagagagagaaagaaagaaaacctatataaaatgcagttgaatttagcttgattagtatttattgccggtgtgagcacagcaagaacagcattacgaatcataggaaaaggatggatacgtggtacaaatagggactcttttggaaaactgacaacatggattcagagtattaaatatctaaaatatggcttaataaattatagtttgaacaaaatacataaattatattaaaaagtgtttgtttaaccccaaatatatgcaaatgatggaatggtatgcagctgttaaagatcatgttttccattatttcagtgttgatctccccattaaactgaagtccatgaggccagggatcttgccttttcaattccttctgcatccctggtatccaaagaagttcacacagtaggtatgtaataattattgttgaatgattaaaatgaataaatgaatatagttatcagtgacagtattacagataattagaatctttttatttttctgttaatatgtttctaagattctccaataagcatgtgctacttttataaatagaagatagattgtgttgtttgtgcaaaaagtaaaggaacagagaacttaagtaaaaaagaaaaatggagtacaaaagagtatacgaaagggtgttgagtacttggaaagcccattccacgatgcaactgagggataccacgatgtggctaccatggattccaagtgtgggtgttatatttagccaattgacggccagcactcctttgtcaaactggttttctcttccagcattcttctctgatttgagcttttctcccactggtaacaccaagagctaaaacaatggagaagctacaaatgagattcgttggttatagcctccagtggcccccacagtattggaggcattgtggcagccgtagaggctggaggtgcttttcaactggattgcgtccgtggctgacaaatggaataaaagagctatgctgtggtgctcaaaatagaacagaaaaaaaaggatcccaaagagagaaagagagagagagagagaaggacaagaagaagaagaaaatggcacagacatgagaggctagcttctggaacaacctaaaaagaccaatgttaacccagacccatgaatatgattctcacatcctttgtagaattttttttttttttcaaaagtgcctctttgggactgcaaccctgaaaaatgtcatctgcccctttgctggaatgactggatacttatgtcacccagtagaaaaaaatgcctggtgattttatgtatatttgactacttgtggttatctgggtgaggtgactgaagaaacaaacaaatctaaaaatataaatccacatttgtgtatggagagagagcaaaagaatctgagggaaaaaaatgaaagagggatacagggagagagacagggagatgtggacagcctgtataacagggtgggccccacagtaactgtcatggggtagagttagcagttactgaagtggtctggagtttattgactctattaaggtcctatgtcaaaacccattctctcttgccttcttcatcctcccaaaattttgagacagtatgtctttaccaagagaaaaatcctttcctccttcatttagagctatagctcaagatgaaaacagcccccaaaagagcacgggagtcatgagtgtctcattgtttttgagcacaggttttagggacatagagcaaggatgattgggaatccaggggtgagaggaaggtgggagtcactgaagaaataacaggcccccaaaacaaatgttgttttccttatagtttggaccatagcaagccctgtctttaaaagcagccttttcatttcattctatgaaaacagcgtatatgactgtagtagattaaagatggctatatatttttaacgctcccttcagtgagaagtgggtttgatttccactggccttgaatctggactggtctataatactttgacaaatggagtacagtggaagtgatgccatgcccatctggggctcagcctataagagaactcatagcttccatcatgttctcttgtagccctgatcttccacatgagaagtccaagtactctgtagtagaaccatgtagagataacctcagaaaacatggagtgtgcagttgaaccccagacttccagctatccccgccaggttaccagatatacaagtattgccatcttggacccttcaatgcagcctggctgcagttgaataccaacaagtgactaactgatgctaggcagaacagaagaattgcccggcctagccctgtctgaattcctgacccaagaaacattgtgagatataacaaaatggttgcggctttggctacagaattctggagtagtgtgttttacagtgatagacagtctggtccaggcaagaggatgacaatgtctgtctactttcaatgttggctttgaatcaaaaatatatatatttcagatagattgatcgacagaacacaacttgtagtctttacggaatgcagtacaatgcaaatgctatctgtttgtctcagctcaaatcttagccttgccatttgctctgcagtatataactttggcaaactactaacttctttgagcctcaacttcctcatgtgtaaaacaaggataacaacatcgccttgatggaatggttggaattgttatatgagaaagcaaatgtgaagcacggagctcaggaagaggtatgcacagcctgtgctccctgagccatcttgtctgtgttaacgtccaattttcaaatctcaggcagcttctctgctgcctcatttcctggtcactctgacttttcctagggaatcacttccccactgtttgtcttgttgacatttccacctgactgactgttagaccttcagcaaatagagggaatctttaaaagaaccatatctggtatccaaaaagtccttcagtagccgagaaattgttatatgtggagattacatttcccccaaaaaatcaaagaacatggttttttgtaaggcagatgatctaaacacccataatatgaacattaaaaaaagatcaaaaaggagttctaagaattgagatggtaaaaataagaagaaggttctaactcgggatttcattgaagtgactggacaaaggtgagcaggtgggggcccctggatatgtttcccatctcccggtcctacagctcacgagggctgaggcagtaactaggtctcaaaggctatacactgcaacgtcttttgcctacaaccaagtgcagaaatatcccacatgaaaggcccgaattccatgcctgggtggttcctgtggaacctttccttgcacttgcttatgttaaactccttatagagtcagcctgccaagggccacccagtgacaaccatggatttcaattcctcctgcaaaatatgtcaacccatttgtttactcaatatagacagctttgatctccatctgaggtgggtctaacagtaatgaaaaaagcaacttttcttgcatgaacaattgtaaggatgatgaaagaatcaaaactctgaaagaacaacttaagacattactaaaaggactgtgtcctcatccaggttttgcaatggggatattttatagttacaacttcttcctagacaactgagtctctttctgaaatggtttggcacacctgctaagagtttgtggcatagacttggaagacgactgagaactttgaaatccctaccctttgcaaggaccagaggacactcacagttgccacatttaaacccaacagcccactagaacaacatcatctgtgactatctctcttgtgctcctcggctacaagatcgtcttccttgatagtttttattgcttctggaagtaatttgctcttcatcaggttatcacaaatgaaaaccaagacaggtcagaagaaagctggtttctttgtcagcaagatacttccctttgccagagctgagagagagagagagagagagagagagaaagagagttggaattagaaaaaaaaggtttcaagtccctttctgacatctgtgatcttttaacagagatgtaaagcatatgagatttgcaacctttcgtggcctgaagggatccagttatttggccagttgtgaagacatactcttgttcctactcgcactgtcatgctgtcatggggggtgcatgcctgtttcatgataaaaggaagctaaacggggtttttacaggaatttcagaagtctcagaattattgaagactcataccaggatgaaacccaagttcttcaaaccaaagtgaagcaaatgtgacatattatagacaagagcagaggagcaggaaaaaagagaaagaaatgacaaagaagcaggcggacaaaatgaatagaaaaaatggcatcttttcatgcatgttggatgtaactcctgggacatcaatttctttctatgtggttatacgtttgtggttatctggcatttggacgggcagaatggagggaaggggtttttaaaaataacacactctctttggcacaggacagtactagcatgaaaggttggttgtttcaaaggactaatccaggctgtggggctgtcctgcaaacactgaatcatgaccttgccggcaccttgctgcgggcatcagcaggagaagatgtggaggttccagcaatggtattttgttccacgtaagaccaaccacattccctcacatcttacttcacatagtctagcactccgtgtagtccaatatgggcatctaagaagcagcaggctaataagagcccaaaatgaagaaaatctaaaaattagcccgacttagccaataaaaagtagctccagctaacccagccagacctttaggaaagagcccaggaatgtctctctccatccttgccctgctcctcaacctcccctttgttcaccaggctcccaacttctcttcttgcctcatacatacccggccacggatgctgtctcatcggctggatgcacaacacttcaatggagcaagggctttctgttgttgttgtacctgccctcttgctccatcaactccaggtgagtatttcagggtcccagctgggcggtcccaaacctgtcaggtctgaccaccccacctcaggggacactggcctgacctgaagcaagggcagcaggccggtgggcctggtcaccagtccctggagaaggtgtttctaccacgttctttcagtgtggtgaaaaggacatgtgtgactgctaaggaagagttacacggggcgaaaagggagaggaagattacgtgtgcacatgcacacacacacacacgcacatatacacatgcaaacacacacatgcacacacactcacactggcagtcttctcagggaaagcagctgatgattatgtttccgcaactgaataaaatcaaacccaaaccacaaggtaacagcagccgtctggcccgccctacacatggcatttctgggcacagtgtggccgattatatccttcaccccacggctctttcagccctgctgtttctggctctcctcaagattctctttccctttaagacatcaggcgggtgcttgtcaattagagtgagccacagagaaaagctgtctgtgctccgggagaggtgaacctgcttcttgatgagcccttcctgagccagcagcaggcctcctgcccagagaggatggggcagagagatctgaccaggggatgggcagagggagcctcacacattcctgctccgaggagtgggagggtgggtgggggcagagtaggagccttcaccacagaaaaacaatgcgtcttcaattgtacagaaagccactgggatcagaagctgctcacgctgtttaagagatgcttaaggaaaatggggccacctcagaggcacctctcctgacccttctctgccacccctagccccgtgctcagggtcagagttgcctcccatgtcgcacacttatgctgtgtttaccccaccattatcctggctgcagctgactacttcccacttgaactcctcgaggcaggaactagattctccggtgctgtgcttccagcaccacgcccagcacagagagggggttcactcagtgcttgtgcagggactgacatctaggcaagcttccttttgcagaagaggaaactggtgcttagagagaaagacagggaagggagtggggcggggggggggggaaggaaatccccccttctggaataccagggagcatgttaggcatctggcactcatttgttcattttcctctcagaaccctggtgaattaggcttcactgccttgcagacttcctagtgagtgctgggacatccatttatttgggagagaacaaaatgcacagttgtacgaaggcaaaggctgaacagttggggagagcgacagttggagagaagagcatcagaggcctcgtggtaaacccaaatgagagctgcgctgtgcgggaggatgcctgggaggcaccaacgcccctggaacttagatctggacggccttgcaggcaaagatacacaatcccccaagttaaaatgttgaagggcaacagaccaaaaccagaacaacacagtttccacctcctccccttcacctttgcccattagcagagttaaatttataccagagttaaatttctatgtatgaactcacacacagaaaccaatatacactactactggaaacgtaaatcacgacaactcttttggatggcaacggacgtaaaaataacttaaaaatataaaattacttgtgacacacaaagaataagagattattaaacagcatcaagtaatttaccaactttgaaaatagaggaaaatgtatcatacatgtattcatgtactctggaaggttccctactgaaggcaggccctattgggattctcggagtctatctttccatagtaagtccctgagaggtcagtcttattttccaactgtctgtgctatgcacatacgcatccctgcattatatcagtacttgtttaaagtcacctgatgttagagctgaaggcactttcacgttcatttattctaacccccttattttacatgtgggaaaattgagagctcaatgagttttctcaaagttaatagtggaggtgggcctggaatactgcatatttctaaaatgtcccatttaatgccactctttaactacagaccacaccaactcccctcagaagaatgcagagtacacaaattttaaataaggaagaaattgcatgcttgccatcaagaggtgtaccgcttgtccacaccatctccgcttttctcttgccctggaggccccagcagcagaattgtgagcacataagccatggaggatgacgctgcagaggagaacatgtgttcctgtggtcagggcatcagccaccatcgccctgctcggggccccttcacagggaccagagagagcagtggtgataaggtgtggccgagggctgttctttttgagccattttagtgatgctgggatgttatgcaaggaaatctttggcattgcagtaatcctggattataaataatttagcatatttctttgtaaactacaggccagaatccttgcaaataagaaaggattaacttttttagaagtacttgctcttgagactttaagttcaaggcagaacaatgcttgccgtggtaattccatctattttaagatcacaaaaccataccaagttgaaaccagagcagaagatattaatgcagtgctctctctgaagtgcccaatagtgggacgagaaagctttcaaagggaattaagtagacagagaaagctccctgttcatgtccaaatcacaaggaggcggttgaataggattcacagttctccgtgggaaggacccacaccacagctaatgttcaaaacaggggggagatgtctcgggaagatcaaggacccagaattctgctgttagaatcagctgcctgcccattagagcctcaaaaggaccctctaccatgtgtgagccaatatgatcctgcaaatgagcccatttttctttttgtaactggcccaaactttatctgaaggaagctatcattatgtaatatttccaaagcacccttgatgtaaacttcagatctgatatgtgggtgtatgtatgtgcacgtgtgtgtgcacattgtgtgtgtgcatgtgtgcagtgggagagggtgaaaggacagtgaagagtcagatgtacatacaaagtagaaaaactgatgggcagctgctctgaatatgcaggaacagagaagcatccagggagaccctcaggtcaaggctcagcacctggtacatcacacagacaacagacatgagaggaacaatattagctccagagaaagtcagagccaggaacagtagaaaagtcaaacgggcagcaagaggcggagactcagaaaccatcagccagtaagtaggtggcaaggcaggagcatgaaggactaggacagtcagtgaactgcacctccaaagcctgtcctccagtgcccactctgctctggcctctgcctgtctttccagcctcatttcctgctattctgcacgtgactcctttactccaccaaattataaatgcagcctactctgcatgctgttttctagcttcttgcctttggtttttctgttctttgtgctaagaaaatcctttctcccttctcctaaaaatgtatctcattttccaagatttagctttatggtcaccacctcctggatgccttcgtggcttcccaaaccttcagggtgggtttagtaccactcctacaagctctgatgatatcctgccaatttccaagcttcctccagaggaagatgacaaagaagtttcatctttgaaaaaagctctaaaagaattatggctgtttggggcaggcgctgtgttgagaatgattccgaggcctcatccagaatccattggaaagactgctgcagtcagttacggatgcctgccatttaagggtgtgggttgaagtttagccattcctgatgaggccaacatcttcattaggcagatgaggaacctgaggctgaaagatgggaaatgtcttgcccagtgttacaaggctgggtaacagcacactcagatgggaattccaggtcttgggattcctaagcaagtactccatttaaataagattcccaaagattctaaatcaggaatattgaaactcttaacatatttttaacttttttccaggggaggagggtaattatatagtgaaggagccagtgaagaaaaacttgaagcttttgcaattttgcttggacacccactcacctgaacccgtgccttataatgttttctcctgcccaatcctccaaaagtccccgcctttatgctttttttaagtgagcactgttggtaccaccagtgtctattacccaggttaaaatgaagacttcgagctgactctcctggtatcacgaatatacaatcaaaatggatgcctacacctctgtgtcagggaggaaaagtagaggaagttgaagccacattttccaacttcatccttcactcctttcactctagaggctgaaactttcctgacaaagaaatatacttagaatggtttcattagataaactctttccctatcttactgtgaaagaaattttccagtgagttccagtttcaggaggttacaaggtaaaagggaaggaaagttggcatgctcccagcctgacaagaagttgtcgcattaccatcaacgtcacataaatttagctggaacattgtatcggattctataatgcacttacgtgagcgattaaatggtgagaaacacataacatttgcctgcccaccccctctcccattgccctctgcttctgtgagagtttgggattccagatgaattctcccagcatagcctcagcttgcaaagggtcatctaacctttaaacttcagtccagcaaagcaggctgaagagaatcaccagggtgtctcctgttatgtgcttcaacatcaaatgacctgcttcaccaggttacccaaggacacagctttaaccaaagacgtgagaattcccagaactggaagcaaatgcgagctgatgataggacattccccaaaccccctatcccaggatgctcgacagcaattagcagccatgtcctttgtctcacctctgctgtgtttttagcagctcagtttcttcagaggacaaggcaagagggaatgggattaggctgggagccctggttttctgagggaagagggtattaaacattttcacttggagtttctctgaagggtttctggacaaccaaacccccactccgcgcccctgcgaaactcctcctggcaccgcccctgactttctattttctttaggtgcccaccttacccctccacaagaaatcaaagcagccgatatgcagttgaatttccaagtggattcccttgtatccgtttgtctgggtgtgtgtgtgcgtttttaaaaaattttaaattttggataagccctctaagaaagaggctcctaagggaagcgggggctgaaggaaggaagaagtgggtgacaaagcctctaggggatcaataaattcagctgctcctgtgtacaagggaaagggcagtgcaggaagtcagatgggagaagaaatcccagaatcataaattttaaagctgaaaggatctttagaggtcacctggcataacctcctctattttataaatgaggaaactaaaagtcagacatgctaatggacctgcccaaggttatgtaacttggcgatgagaaaaggaggacccaaacccagacctctcaagtcccccgtctgggccccttcatcttcttcacagcccacagcagctgccacctcggccgagcagccattttgatcgctaaagtgcctgcgggaagaccccatggccacccccagacacttcccatgatgctcctctcctcagaagccatgtcatggctgcccactctctccaaagactccctccaccagccacgcggcccgcagccagagttcttcctgtgaagagccctcaccgcttcacttttcatgtgaagctggcaaagccgcttcagcgatcattttttaacacggcagctccctgacaagaggattaaagcaggcggctttcaaaaaagtatcaagaataatttaaaatgcaatatgttaatgcttgtccagagttttgtacactttcgtgaaaagtcatcaatctctcccgccacaccctaacgacaatcctgtaactggcacggttttctgacattaagaaaaaaaattagtgaacacagtcataaattaggaccagaaatctaactgcagatgaggcttccgaagtcacaaagcaaaattgggcgtggagtcacaaactgaggatttttgagggagtaggtggtggttattttggaggatggttcctttgcagtcttcctggaggatgagcaaggggatcagaaaactgccgctcaaacgctagtgtgcatcagaatcacctggagagtttgtgaaaacagattgctgggctccctccctagactttcggattctgcaggtctggggcaaggcctgagaatatgcatttctagcccgttcccaggagctgatgctgctggcctggggaaccatgctttgggaacctctgggctgaaaagacactttcaggcctcccctggtgttaggacttcattaaaatatagaagcaagaatgtgaggtgcaacttaaacatccctgcacaggcacagcaggcaaggcgggaaatgaaatcgcacagacaccagggctcgttgtcacagcatcaagcagtgccttaaacagggaggtaagcagtgtcctccagctgctacagtcacctctaaaaagataatgcctgtctgagcaaaagcaaacaccagaaggcttaaaaacctggggtccccatgctcattcctcaagcagttgaaaatgtctttatgtagagaaagtacagtgtaaatagaaagtagggctcgatttccacaagctcaagtcaaagaatctgctgagaaggccacatgacacacgaaatgaaatccaggtccttgatacccggaggcaagaaagcgaacggaagatccaagacaatccaaaggttcctgaatttttacagtaaacagttctgatcggattcacttgctattttggaacatacatgaagttcattaactggcatatattaaaaaagaaaaaaaattagaaaaagaaggagctggaggacaaatcagtaattgctcctttagagcaaaccaaagttactgagaaaatctcctataaaggctctgtcaaaacaagtcacttaaggattagtgagagctaaatcctccgtcagagagatttttctcaacagtcgtaaatgggttttagtatcggaaaatcttagaaaatatacttctcctgcctccacccccctctcagaatggctctttcaatagctcggcatcttgtgggagcaaagtatttccttaggctgaggctttttatttaaaaaataaaataaaataaactctgtcattcatggcaaagtcagtggctggaaataactctttacaggcatggagtgcatgtttcagaggcttgcccatacaacgcacatggtcaagtacagcctcagcaatttccctcctaacaattagtataagctagggctcttactttgactttttaccttgttccacttttggtctcattttcttaaggcttcactgctcaatttgttcattttgtgaggcaagagcttaaagttcatccttaaaaatgcgtaggtgattcagttttttaattagaaaaaagcaaacactgctaatcccaaaccttttcaatggcagccttctaggggcacacattttaattccatcagtaaagggtcatcttattcattctcttataatcatcgtgggggcccatgctgtatttctgggcagtctctggagtctatgacactggattacagaggtctgtctctgttcattaagtgagtgttcagagaagacccactcatcctgtaagcacttagagacactctggagtttgatcctcatgagagggtgacctggcaaggccattttcctgtctgcttcccagatggtcacactcttctttgtctgcccaagccttttttatcttatcagtactcaaagctaacgcatcttagacatcgttggtaccaatcaatggaaagctaacacacttgcacaacagtccatatgcgaataagcattgattttaccccccttggttatagactgcatttctaaactttccatttcctccattagaccctttaaaaacatccatttgtcagacataaatatttctcctgatacccacacaggaagtcttagttacaggcctggttttaggcattactatactaggccattccttagcatgtgtgacatgagtgagtaatcagaaatcccaaccccaaaatatttcccttcccaatctaccttatacccaaaatttcaccactgcaaaatccttaagacactttcaagtccagaaatacccttttaatattaaattattctgagaggcaacccattaagcctgtttaattagcaagactctggagaatttagctttttttttttttttttttggctgcatagccaagggaatttagggttggaatgacacaggcctgagtggaaattcaagagctgtcatttcctagcaccatgaagttgggcaagtcacttaacctctaagaggctcagctctatcactttatctaagtggggcctgacacttgggtagtactcaataagaaaatttcctttctcatgaggtggctgctcagggagagatggtcaggacagaatatctacccaaggttgagaagacagaggagaaaccagggcacatcctggagaaggcagcttcaggagtgggtcctggggtctggggtggggtgggagacgttttcgatgttgtttaatgggcggtagtgggaccaaggagagttccagtcacttggaaaacaggactgcagagtggaggcaagagccatagaaaagagagaaagccctagaaggggctaggagggccatcttctgccacttcactcatctgtggatcaccaggtctacccacagttttacaaatttcactccagttctgccctaacttattacatatcagggcctttcactcattatctcaaaaatgacatatagagatctttgcctgtggggttaatgagtaatcaggaggtatcacattaatctccatttcactccagaataagttaaacagttgcctcaaatccttctcctgtagaggaagaggggtgtaaatacgaggtaaatatgtaaagaaaagcatgaaccaatgacctcagtaatggttccagagaccaggactccctattctgggggtgaggataaaagtttccatgtctgatttacccttgctcagggatgaacccatgtttctgtattccacatccactggatagatgccctgcagctaaagacatctttttgagcccccaaattgaagcctttggatttccctatgacatgtgaattgtatttatgtaggtattctgatgaaattgcacttccctcaaaaagatgaaacttaaatgaaagaggatgaacctggaacatgtgcagtgtgaaaatttacacagcgaaggagctaagtctcagccatgatcagtctattttgagcttcctgttaagcaccaaagtgatggaataggacaaagaaaaattgtacccataataaatagaggatgacccctgtgaaaagtaaagatagagcccatattggattagaaaaagacttgatatttccctccacctttacctccttctaagtctatccaggagtaacaaaaatgatgaacatgggatcttaagtagtcaaaaaactgtaagattaggaaaggaagctgtaattgtttagaatctactatgtgctagggattttaggtgtactgcctcatgcaatagatgagatgagagcacaatgaagaatacttttctccactttacaggccaaagaagcagaggctcagcttggctcaactgcatatcagtaaatgacaggaataagattcaaactgagttctgatgactccaaagaatgtgtggggcagggtcaggatggtctttaggctttggaggccttctctttactggaggcacaggctttgttctaggttgtaggaagagaagtaaataaactggtaaatctttctgtataattttctcagggttgaaatggtggcaggggagctggccccggtggctcacaaatgcaatcccagaaactcagaaggctaaggcaggaagatcgctttgagaatagcctaggcaacacagtgagacattgtctctaaaaataaataaataaataaataaataaataaataaataaataaatttaaattagtcaggactggtggtacacacctatagtcccagctaccctggaggctgaggcgggaagatcacttgagcccaggagtttgaggctgcagtgagctatgatcatgccactgcatcagcctgggtgacagagtgatactctaactcttaaaaaaaaagagagaaatggaggcaggaaaggcagaactcttcagaaaacaaggcaatgcattctggcttttttggtttttgagaaacatcacataggctggatggtgaagtgctctaagaatatctattcaaaatgactatgaaaaggttctatctagcatacagttttcaggaagcggatatgagggcacaggggatgggtttggggtcaatgaatgcatgttctcaggcttactaatagatgagaccatggtagatattcccttgagcttccagaaagcacccagcaagttaatgcattcatgccactgtaaactagcatttgagtaaggggtggtccaaacaccctacttatggaggcaaagagcagcagctcatctgcagaccactaggggttgttcgcaatgcaacagaaaccacgtcttatccttgacagggcagccaataggtaatcatgttttacacatgtcattttccaacttcatcttctttcatccttctgtagtatctcccagggaagatctcatagaagtaactgcatataccagtttcaaacaccctcaatatgaagagcatggaactctgcattcagctacctgggcatgtcaaaagcacatcatgcaataagccaatgtttagtatatggtccaacatggacgtggtaccttcacagctcttatctgattgaaatgcatagatgtggataggaaatgacatgcttactaattttctgagaggaaaaaggggaaatccagtatagtgactgagtgaaaagttagtaataaaaggtaagtgacccagacagggagtttcctgagcaagcataacccagcagtttttagccacacttctttcatggctttctcttcaagttaggttgacagatatctgatccaatgcttggccatctactgaaaccacctcttaccattccaccaggtaaggacgtcagcaaaaagccttttcaccacaagtagcaacctactttccaaaacaactccccgcacttcaaactaaaccaacgactaagtaaacccagattaaatagagctttatcaggatggagtttgagtaatctctaaatcaacaaattccagggaatgtgtgtacagaatatccattatacaaatgtcagaccacaaagtcaaactctttgttgagatgctgttaaggccttccctaatacagccaatatagcagagtgggagaagcagggtcatgctagcttctattccagagcctgtttttccttatgcaaaggccagtaaagcaaattttctgcagaattattttagttgttcctaaaaagaacaagatagcctttcctcattagtctgaatagacagctccttttctgagttgctttaattgctgtgggttaagcttcactatcacacatcctcacaaccataatacaactggcatcatttggcgctttttgacttggttaagtacaaactacaaagtccaagatgggaaaggtcatttattgtctgccagatgggatgtttcaaaaggaaatgatttagtcacatcattaggagaaaagggaagaattaaaatgtatgctcacatacagatttcggtacgcacacaaaatgatcagcacaggaaaacataaacagtagcccaacagcacacaagttacagcacacaagttacacagacttccttaaatggtatcttctacattgatgttgaaaaatgtggattgctattttaatactgctgtcataacagtctagtacaactggtagcatgaggctgaatatgcctcagagtcagatagagctgggtccaatacgggactcttcacttactactcatgtgtgtttggggcatatatcttatttccaaaactgccttataatctataaaatgaggaccatatgggctgggtgcagtggctcacccctgtaatcccagcactctgggaggccgaggcgggtgcatcatgaggtcaagaaatcgagaccatcctggccaacacggtgaaaccccgtctctactaaaaatacaaaaattagctgggagtggtggtgtgcgcctgtagtcccagctactcgggaggctgaggcaggagaattgcttgaactagggaggcagaggttgcagtgagctgagatcgtgccactgcactccagcttgggtgacagaggaagactccatctcaaaaaaaataaaaaataaaaaaaaataggaccatatggccttcctcctaggtttttgcatagatataataaggttacatgtaaagtatctgcccctgacacatactacttcctgaatattattcctttccacctctccttaggtgtgtgtgcatgtgtgtgcatatgtgtttagtattgaaattatgcctatatgtagaaggcacacaataaatacttcttgtcatttactcagtaatggacattgatcatttaccttttacactaagtgagaaagtcttaaatgatcttgattcatgattttttttttctttttttgaaatggaatctcactcttgtcgcccaggatgcagtgcagtggtgcgatctcagctcactgcaaccactccctcctgggttcaagcaattctcctgcctcaacctcctgagtagctgggattaaaaacaccagccaccacacccagctaatttttgtacttttagtagagatggggtttcgccatgctggccaggccagtctcgaactcctgacctcaggtgatctgcccacctcggcctcccaaagtgttgggattacaggtgtgagccaccacgcccggcgattcatgatgttcctaatggttctgtccatttttacagcccatctcagctgaaagaaatatctaacagttctgtttatttgtaaattacacccaaataacttaacaagtatttatgtcctaacaacttgatttctgaaaaaaagaatacacataaactaaaagaaaaatgagtcccattcactgttaaataatcgtaagtgcttaatagtgagatgcatgagcctgttgggcactacgcaacttctcaaactctggcatcaggttggatgccctcacccttgtttcctgctccacactgattttcacatggtcctgttttataatacagcaactgacaagaacttagcttctcaaaggtatgacatcactgaaagaaagttatgcattccagtagtgaaactgtgaactaccttgagctagtagttcacacggtgcctgacagatgtcaagaattgctgtattttcctcaactatttaaaatatttcctggcacccctttgaggccactgcaatgtccagggtgcctcagctcacaccttgggaacccggaggctaattaaccatagtgaatcagattcattttctatgctactactgaaatatgaattagacaatattatagataaagctgaataatatgacttgttttaatacagttctaactcgattttctacttcaattccattcttcagccattgatatttggctttttaaaagctgtccttgtagtgtcatatggtcaccagataaactctgcagtgaaggctctttagattcaaatctatgttgaactatttcaattttatgattttttttttttaaaaaacagagagtaacccaaagcttaccaggtgatccttcttagtaaaagggatttgtgggctgtggatcagcttcccactgattcatctgagatgaagacaggaccctccatcctgcaaaaatgggtttgaaaaaagaaaggaactctccatttacacgtgagaatggctcagccctaagaatgctgcttgcaggttcactgttctgcatttagaatccaggcctagagaagcagcacggcttgcctctgctgtgaatcagactctatcttgtgttgttttagagtcatgtctacatagctgaaagatgatttggatctttttcaagaagagagtggtaaggtgaggtacagtgaggcagaagacaatgctggtcaatgctttaaaatcactctctgagaggaaaacccttggtttctactctctgctgatttctgtgttaaaaatactcccaccgtggttgaacgaggtcactgaattcagagttagggaaagaggcacacaatcagctctcacgagctgactctagcccttcactgggcagaacgcttttctcctcttctacagctgcccacggaatgctctgaatctaggggcgtactccgctgaaaggaagatttataaatgctcacgtttattagctcctaattgaggatatctgccagacacaataaataaagttgaaaaacagagtgctttggagagaaagtaggctaatccgaagctttttattcaggggatgaattctggtcttcctctctgtatatgggacactatcttgacctttctggctgagtctattagctcagaggtggcactccagtggtcaagtcaactggcattcatcaagcaccaaccacaggcttgaaatttatattagttgttttggaaggttccaggagaagacaatgtagactcctgaggaggggatgatgtaggtgaggagagaggctaatggcacatgaagcctgcaaaactgggctctagactcttctcattgcagcttcagagtaaatcaagtaacactgtctgtcttcccagaggtacccttggcagagaccagcaggatctgttgtttctactgttggacgcgtttatgggccctattggccgatttggcaagcagctttatataaaatgtcttccggaaccatcctttcccctgtgagtcagtcatcctcagagtcctaattctgtccagtttgcatcaggcctcctcagtctctgtagcccaaagcacacgatagggtaccaatgttcaaggctctgctttattttgaaattcagctggtgaagctattatattctacctttctccaagtagtatgcaatgcaaagtggcaattttacaccgtgctagcccaacataaattcacagatgagtgcacaccttatttggaataaagagaaacacaacagttattaaaggggtgattaccttcccagggaccatgaatttaaaattatgcaaaatcggaggtcggtctctacaagttcacatagtgatttaaatgggggtaacaatgaatataatatcttctaacatgttaaaacttccacagcaaacctcttatataatgctttgttgcttcattgatttgataagtttgtgggggtacattttgcattcatatacgacgtataaagtatcttgtttgctttacaaaaatgaaacatcaataataacaatcctcaggttgctatgatttctctgtcattcatactgagtgctcagtgtcaggaacagcatttgttttgcccttgaggaatttgcagagcagttagtaggtatcggtgtcctttgtagtggttcaaataacatataactatcgtaatatatttgaaataagccaattattatgccatttgaacatctatcctccttaagatatatcctgggttttactgaaggacttctctcttaataacgtttttctttatgatatgagcgtcctggctggaagagagctgagcttcagatacatggtgttggagtaaggagagagtcttttccctcaatggttatttgcatgggggctaaggagcctcctagttggggaggtgaacttgaactgtagcaacaatcaagattcaaacatgcatagacaagtatgatggcttgaagaggagactgcaggcagaagtcaggagacagggatggaaaagaagggtcactgtgagagaatctggcagggccaacagactcagccacaagtcagcaagtaaatggggagatgctgaaatgggtgaaatgttctccttcagtatggtggctggtgtttgaactcattttaccctctcttccaggggctgtgcacaccttaggtagaaagagctatacatgtgaactgaaacaactctctcaccaaattctaagacactttggggctcaaactactctattcaaactacccatctaaatgagcacagagacagaaaacgttttcctcacttcaacacgggctgctatcctgtcacggtaatgaacgacggaagaaggctggtggctggggccttctcataaccatgagaagaaacaataaagaaaaataggggtggtgtggtttggggtggtcaaggccaatgttgaagacattgatacagctcagaatagcaggcagcatccaatggtgagtggaagcccagattaattccaaaacacatataaaacatgtctacctctttgggaactcaaaaaatgtgaggttgggatgagctgcatgaaggactgcattacctgaacaaacgggtgagggcttgaggctctgggggcgctcgtctttaatgttaatgagactcattcataccatgggctggggaggcttggaaatattttagttacataaactgacatcaacccctcttcttcttttaattgatatgcagtcttagccctgttatcatctctgatcttgaccatttcccttagccactgggcaaccaatgtctccttctgaacagttgggagaaatgtaaattcactgttttttctccagagcagccagaggttccttaatttgcatcgttatatgagtgcaaagcatgatgataaaatatgcaattcttaagaaatgtcaaagacagctcattagatcaacttttttttctgtgtatttttttttctttttaaacagggaccactgtgcttcctttcaagtgacaagagttgtgacagctgctctataaggtattcaatggttaattaagacacgagtgtcattgctgagctcttttgtgtttcatagaaagcagttgctaaacagatgaaagtaggtctgaggcaaggggtagcataactattatttcaattaataaatagctctaaaagtgaaggaagtgataaagccctcaagagcgtctgtatctgccccggttctgtcaggaaaattaaacagagcacttgtgattgccattgcttctgtttaagagatccaagcaagtagggtcacctgtgctgagcaggttagagccggcctggttcttggggcaccccctagtgacatgttcctataccctaggatatccctttccttgctactgaaagaaatggtgctgaattcaccttgttcttccaccctcatcatcctttattctccccctctcttctaccaaagaagccctaaaatgtattttcagataaatatcaggaaagcatttataaatatttcagaggtgtttcataaataaatcagcaaatctacaaaaagacttctctcttttaatgagatcttgtctgtggtatatcccttttacttgagcatcattaaaaccagttgggaagatttttatactggactctcttttcgggggcttcataatatatgaacaagcctgctatgcgtctgtgaaacatgtagcctcttcttctgacagattaggcagccctggcgcgagggaatagcttttactctttttaaagtaaatactaatcaatagcaactgtaccgacaaaaaccttcttgctgcctaattgcaccacagctactcatagaccccaacagaattttcccctagatgtaacaaaattaactaccaggggctgagctagtgaattatcaccatctctctattcaaatgtaattaacacaaccccccaactaccacatgtaccattaaagtaccatttgtatgtgtaattttcaaacagggtctaaaggtcgtgcccacatcaatcttttcaacacacacagctgcacaggaaatcaaactggcagggaggtggtcgcagccattctaggaaatctctccctctctcagatattgtttgtagtttctcttctgcagcttaatgccctctgtggtctctttggccgtgtcagaaatagccagactgtatcagaggcaaacaagtgatttaaggaattttaggaagccaatctagtacccagccctggccaatccaggggctagctatgcagaaatcttactgatagcttgggatggatactacggccacggtggttaataataactaagatttttattgtacattcagattataaaaaaacttgtacctgcatttttcaaactcattattattattggcaattgtagtaataccaggggctatatattgagcatttgagctaagagctgtacatctatagtttgtcaattaatcctcataacaactttatgagttaggaattatttcctctattttaaaaccaaggaaactgaggctcagagtgagtgtgtgactcaaaatgctccaagcagctagaaggagggagcaccagggtttgaacccgattttctgactctgaggctcgttctgacacataatcactttgggagggaggtatcatcatcatcctcagccccccaccaacattatcatcatcaccaccatcatcatcaacatcatctgcctttcatacatgaggtaaacaaggtacagagaggtgaagcagcttgttcagggctacacggcacagaagagtatggaagaagaggcttggaggcaagataaaggcaaggggcagtcattggggattcatggaatagatgtctctctaaatgtctctcatgtcctggtggccattccatctgtcactttcaaaagtcagtggaaagagcaatgtaagaggagtcaggagtcaggggccatccactcagaccagacaccagctgggtgaccttgaccttgacattccctctctgggctccgtgctcttgattacataacaagctagattagaagatatctcaagtcacttccagatgtaacattttaggctcttcatttgtgaattattcgtgctagaagaggccatatgtggaaatttaacacagcaatactttctcaaaacttcacctgtaatgtgcctgttaggactcaggcacccatgttgtcacaaagccatctcttgataaaaggaggagccctgggctgaggatgcccacatttagcgttttttttctcagaaatactctgccactcccagagccaacacgtacaaatagcatttgctgcacaccctccacttcccatgtgtcatttggcaaggctgccccgcttgtcaagagggctatgcaaagtcaccaaggtctgtaactccagttagaactcaaacactaatttttcagcagcagagtctgttgtgagaaaccttgctcccaggtgcacagtgaacacagagggtccttctctaatgggactcccttgacttcttccactcaaagacgcctggttccagcctgtgaggctgtgcatggggtcagctccaatgctcggaacgtcccgcctccacccagatacacactgaccacatgtgtctggggctcctgagtttttctctgcccatagctcacccagggcatgagtgccttctgcagtttagtttatagttgatccatgctggtgaggcctgcctctgagtcagggccaccattagcctggccttgaggggacatgcaccttcatgcctgagctgaccgtagggtgtgtgtggagggggcgcttttggtgtccagaggcacttggcatcacattatatccatttaaatatgttttcccttgattctgaatgaactgagagaaacaaaaaatactaatcaaaatggaatgcaaatatccaaggctcctttctctcagaaaatgccctattttcccccctccatggtactaatgttttagaaatagaaggcacctctggagagacaggataataccaaattttcaaatctgtagaaaatgagtacaggggtaggcggcactattagtgctactaaaaataagctttgggaagctacagtaaatggaaaaaccagaagagtcattccttttttaaactgtactgaaaatcctgtatgttcaggagccattttctccagagattccaacaataatacttggaattcaatatccatttctacagtggtctctctcccattttgtccccctcccttcaccactgccccagtaatgcaggctaaatattaagcttattacccccacagaaagcgtggttctgccaactgaacattgtgccagataccaagaattgaggcgattatgccctgcatgctgcttggtatactgaagatgggcgttcttttactttatttttatttcatttcattttttttttttattaaagagagttctactgtagacaaacaacccagggattgtttgaagaaaagggatatcccctcagacctggggatgcatttctccctcagtggctaaacctctttgtcattattacctccagagagagacacccagggatctgctcacaccacccatctccaggcaagttgaagcatgtcctggaaagccacctgaaccctggacagctccgcctgactagagaaatggtggcaaaggaattcttgctgtggtcccagcggtgagcataacagagttacctctctccaccccaaatattcagactgcaaggacactggctcccaagcttcgacctgcttggagttccattccaggtactctgctgatgtctcggccagcctcagccacagactcccagctgagctgagctgttctgaggagtcaggaaatttgggggattttaacagagaaacaaagcctggcaccccatgtgtcaaagctctggatactagctctttagaacctaggtgggctaacgggaaaagtcaatgttagcagtaaacccaagatcaaaacttattccatgcctttccatcttctctcaaacatagcctttatcgaacgattgaaccctcacacacataaataaatggagaaagatgtactctgaaaaaaaaccatagaaaatagagtcacaagttatttataaaggggagatttgttaaagtagccaatctacttccctcattttataggcagagagacagaggaagagcaggttgaaggttctgaacaggatccccactaagcgtgggtcacattaggggacagaacactagcatgggcttttgcctcctaattcagcgttctcaccacccttgttgttccatagagcctctggaaagagagtggcctcaagtgggactggagtgaaaggccaagattgagaacgcctacctattttttacaaggtggtctggaatgtattattattttttttccttctttatttcagtctgggcatttttgcctcttaaaagcagctaaccctttaccacggaggtgatgcagaaatctactcatcaagtaagcctgaaagccctttgattcctgcagaaaaatctatatgtgcccttcagcctcataattgagttgcaaaggggaaaaataaaattgtttcctggctgtgtggagccattctacccaacatgccaataaaaagcaagtggtgtttttgtccataggatgtccaggttcagagtcagatccatgaggctaaacaagggctaggttattaccaacaaatgattacactccaggttgtattgaacagagtgagatatgtgaactcttgagactaattggaaggggaaatgtcaatgttgacatcccctgactggattccctaaaccacagtggaaactaacccagaatcttaaaaatgctggcttccagaaagccctattcttatcaggaaatgtgaatattaatcccaggcaagtcacttagccactactgtttttctttgccatcagatagtaatagccatctgcggtatcttttttcagaaaattatttggaagatcaagtaaatagagtagagcattttaactagtgaaatactcctcttattcaatcacagttattctctgcagtatgtggaagcaggttaacaccatctacctcaaaacaactttgtgaagttgggggtcccgttttagacatgggaggactgagactcagagagtttaggtggctcatctaaattcacaaagaacttagagagaaacagacaaggtacaaacccagattggctagttccatctcattttctccatggaatcacatggcttctctcttgatacatgcaaaatgcttttaaaggttaaaagagtgatactgtaacaactaattgaattcatccccacactgtcagtcatgtcaatatttaggagttcacacttctctccatggacataaatcatctttatgaggctctggctgttttttttttgttgttgttgttttttgggttttttttttttttttgagatggagttttgctattgttgcccaagctagagtgcaatggcgcgatcctggctcactgcaacctccgccttccaggttcaatgattctcctgctttagcttcctgagtagctgggattacaggcgcccaccaccatgcccagctaatttttttttttttttttttttttttttttttttttttgtatttttagtagaaacaggatttcaccatgttggccaggctggtctcgaattcctgacctcaggtgattcacctgcctcagcctcccaaagtgctgggattacaggcatgagccactgtgcccggctgactctggctgtttttgtaactacagtaagctcctctgtgacggaagctcctagttgtatctgattcactggtggactgatggaatgcctggactagtcttcaacacaccttctgctctcaaggccatttccacggccatgtttgagaacatcagatcaacccaattttctgtcatactcagtcagttgactttactggcggacaaaatagatagttgccttcctgttgtgatttctaggatcttaggggaaagcccttcttcttcactacccttctatcccttcccttaaggttttaaatccttgaatgaggattttaaaaatcattctagaatgaaagacaggtttaaagtgcaaatatattaaaaagccaaggacgcattctttaatgagtaagtaaaatactaagcaattcgttttgggagaaagaagggctaaaagagaaaagtgtcaggtaacggatttttgattttttttttttttttgaaacagtctcgcactgtcccccaggctggagtgcaatggtgcaatttcggttcactgcaattgccaacttctgtgtccaagtgattctcgtgcctcagcctcccaaatagctgggattacagacgtgcacctggctaagtttttttttttttgtatttttacaaaatacaaaaaagacagggttttgccatgttggccaggctgatctcgaactcctgacctcaagtgatctgcccccattggcctcccaaagtgctgggattacagacattagccaccacaacctgcccagtaactgatttgagggaaggtcacagaggtggagaaagggcacaacaggcatattagaaactcctcagtttgtccaatattttgcttaaggcaatgcctgttaaactctctgaaccagaccaggtgcagtggctcacgcctataatcccagtactttgggcgacccatgtgggaggattgcttgaggccaggagtttcagaccagtctgggcaacatggcaaaaccctgcctctacaaaaaaagaaagaaagagaaaaaaatagccagatgtgggggggctgcatctgtcgttctagctacttgggaggctgagatgacaggatcgcttgagcccacgagttcaaggctacagtgagctatgattgcaccactctattccatccagcctgggcaatagagggagaccatgcctcaaaaaaacaaaacaaaacaaaacaaaaaaacaaaaaaatcaccacctcgccgggcatggtggctcacacctgcaatcccagcactttgggaggccgaggcatgtggatcacgagatcaggagatcgacaccatcttggctaacatggcgaaaccccatctctactaaaaatacaaaaaattagccaggcatggtggcaggcgcctgtagtcccagctcctcaggaggctgaggcaggagaatggcaggaacccgggcggcggagcttgcagtgagccaagatcgtgccactgcactccagcctgggtgacagagcaagactccatctcaaaacaaacaaacaaacaaacaaaacaaaacaaaacacaacaaaaaaaatcaccacctctaggtgctagagaaacagtgtttggggaatccattaacaggtgtgatttaaaaattttttacaactgctttactgaggcatagtttatataccacaaaatccacacattataagcatccaatttaatgatatttaatgatttttagtaaatgtatagagtagtacaaccattaccataatttagttttagaaacaagttcaatttgaaaaaaatagtgctttgaaaaggtatcactgcttgcccattatagcactatagggtttattcttactgataatctgcctaaagtaggctccacaaaacactgggtaagggcagccacgctttggaggacttcctctttccctggcttctgagtgattatgtgctgggattcaggagtgagctcagagctcaccacctcgtgctcaggctcagggaggggcccttggtgtggacatggaaatccctgccatgtccatagcctctatgctcaccacctggaaagttacagagagctcccagttacacctctggtttctagagccagtagagcaagcctgtgatcagcccctccaccccagcctcctacagccacctctcccaggaaagcctagaggaaattggccaacgtcttggtattccattctggttgccaagtgcccttattgtttttgcatttctaagagactgtcagtacaacttcccccgtgactgccacgtgacaggctgtgctgtcctttatctcagggcaccaaatgacttacttcattccaggtctttctgtttcactgtgagtcaggtggaaaacagaaaggtggccctattttaagggaaatgttaaaacaaagacaatgctgtgctttgctggcatttgttagcagcagacacggttaaagaatggctatgggcaaatatttggatgactatagaatctgcttaaatactatggatttactgtatagggtgtcaaagtaacaactgtagagttagagtctattaaagggggtctcaacaaaaaatatttatgcccttatatgcatgctgctttgtcttttgaaaattatctttcctgttttttccatctcatagttccctccaaacaattgaccactccttttgccatgtcactgcttcctatggaactcagtccggtggattaagtgtttctgttaatgtctgtctccctttcacactgacttttgtatgaaagggaccgtgcctcttcacctctgtaactctagtgtataccatggtgtctggcaatagatgatctgcactccattgactgggaagaggctgtgaaaacaaagacgggtgcacgttcagagcaaatatttcctgctttggctgtgctaatttgctgtactttacacagtcagggaatgatgtgtgatcatttgttgaattaagaaattgttttggactcaagaagcaccaaatgtaaactgcaatgtcagactgcgagagaaagggtgggaggctttggggaaagggctttcccaaagtgcttgcccatggggaggtgagggggaatgcaggctcctagccacagagaatgaattcattaagtccaccaccatgctttgtgagaaccaggcagccactcctccttacatacaaccccagtcagatctatagccatgacaagaaatacaaaggtgtgctttctatttgtggtttatggaattgccttcgggatttgacttttatctaccatgtccactgttctgcctccaagacctatcacagtacttggcacacagaacgcagtaaatatttgtgatgcaaatgaatatttcatagtccagctggcttctttcccatgttttttttctttaactgtgcactaaaaccacagtgtcccggaataaattttctattgaacatctcacttgactgggaagtaatctgtgaatgtgataaagaaatggagagcaaatccttggaaaccaaggcttgggagttccatcatttaggaaacaaaagcagtcaagactaaaaatctcagacatcgtaaagtgattactcaccttctgaaagaccccagaaatatcagaggacaccgggggtcagtgggccatccaggaagaagctttggtgaaggggagggcactaatgtttctttggcacttattgggtattgggccaaatgcttccacctttcatttcggtactcacaagaaatcctaccagatggtcatggtgatcatgcctttccgaatgaggaggggagatcagagagactatctatcatacccaagattgcccagctagaaagtagccacaccagaacttgaacactagcctatctaattctaaaaactcagctttttccagcccaatatgttcctctggattttaagtcccaggagggcagaaacaaggctatgggcagttatctctgtagcctgctctccccagcatgggccagaagaagcatcaagacatgctttctgagctgcatttcagatcatgagcattgggacttctttccccaataagtggtctgactgaatcctggccactgcctccacaggcactcacctacagagtgctggccctggaggaagttctcaggcagcactgattccactgggggggcacaggccccagtgcagaggaggggctcattcttaggcacatcacttctcctctctggacctcagttactcatctaaattgacatgatttgccagattgtttctcggcattgtcaaagtttccatggtggcgcgaatactctatttctgcacagtacagtacgttcaccactagccacatatgcctactgagtacttgaaatgcggtatgacttaagaactgaattcttaattttatatcattttaattaatttagatttacatttaaatagccacatgtggctattggctccattattgggcagtgaaatgaggaagcttcggcttgaagaagtggaagaggaagcagcataagatcagaattctagctcgctcgaatgtgggttcaaatcccaacaggctgtggggccaagaacaacatatttacactcttcaagtctcagtttcttcttctataaaatggagataataatggcttccgcatgaatttgctgggaagattaaatgagataaagcacttagcacattgcgcttcacataataagggctcctacaggaaggctattagaaaaagttcataaaacagcagagacatgggggtgtttctttccctgattaacccattatttcactcaccaacatgtcacatctcaaattgactggaaggaaagaaaggtttaaaatccactgggtggggcactggagggggaggtgaggagtgatggagacaaggcagttctgccgactttacacttttcccagggctgttcctgtatgtgtcgtttgactgattgggtcaaattacacaagatctagctagatattcagattccctccaatgcgtctgtgttgtgtaatcctccctgccttgtaaaggaacagatctgattggccagggattgcacaggtggcaacttcactgagattcacaatgcattggaaacaagggaagagaccctggtattctatgacaaacgtgcagacagtctaaaacatcaggacaacattttctatgtgatttagctggtatttctgagctggaataattaaacagagatctatccacttgactaaaagaggaagcagtcgatgaggaagtcagtccctagctccctttgccccgaaatatgccaattctgaatatttcgcatcagcttcctcttaataaatagcttaccactcatccatccctcgaaaatatcattagaattgcctggatatatatatatttttaaataccaatgcccaggccacatcacattcaattaaatcagaaaaggtgataggtgagtatgacactcaggcatcaggcatcagtattttttaaagcccctcttgacccccaggtgattctgacatgcagctaagtttaaggtcaagtgttagagatcagggtagaaactcaggagttaactgcacggtgagccctgatctgtatcacacactcagggcctaatcagaacatgctgatgtttcgcttagcatacattgcttattgcaactagaatatttctcaaccaacatccttcttaataaagtctaatttgggccagttctacactgttagtgttgacagggaaattccccatcgcactggtgatgggagggggtggtgctttcaaatcaagccttgaagaagtatccggcttccagagcccaaaaccctcaacagaggagctgcttcaacaacttctgcatactgccacctggtggggcctggacccaacttcatcacagctcttcagccttgggcacctacccgcctccccaaacagatgtaatttaggaaaatgtcatgcattttcaatccaatttactggtgccttccacattgatcagacttccttctcctttttcctcccatctggttaatataattattgcttttacgtggcaaagccattttatgtaatagctttgtttgttactatggttacaagtttagtagccctttggaatataaatctatcatccctgaaagtagctttctgtgtgtcaaggtgcagcccttatgtaaggagagtaacagcgttagttttctgtcgtaaggaaagtggcctttcttggtcttatttttgaaagttctacgagcctagcctagacactcccgggaaactgctgggtgctgtcccactttttccctctggaattttcctaactgacgaggcatccacgagcagctctatctgggagaaagtagggaaacgtcggccgaggggcagctgtgtttgctgggccagagccctcgcattgcataactggtgtttttcctggtcagtgtactcttggctgatttatttaccagttaaaggcaagggctgagaatataatctctcaggagttaagtttctttgcgtgtaatccctttccctcacgcatctgaagcatcggcccttatttcctgatggaagtggagttataatctccctttggaaagtggtaagagttcagtgctgggttcaatctgccaccctcaagtgacaaagcgtgacagcgtctctgctatagtgcttcacacccaactgaatcagacgcagccctctgagcacaaaagtgggatggcctgtgaagctgggctttcttcccattctcagccagtaacagcaaaccttggagagtttataccatgtgtccctgtacgtaacctcatctaatcctttcgacaaccccaggaggtatgcattgccatcaagttggcatcactcccattttacagagaaggaatttgaggctcagaaggattaagcaccatccccaagtcatataactagtgtgtgggacttaatgtctttggaaagtcctggttgctaacttaacagagcctcactttccagattcaaggaaccatgagaaaacaaagagcaggcagtatcaatgccttcactaaagccttgattaagccaaactgaacaaacatcaacaatcttcttccctcttcaggagaaagttactggtttggtaggccattagtgaatttccagtggctactaattaactaaccatgtcattcatgtttattatcacagagcaggtacgtatttatttacaccactcacacggcaggataatttgcagttatataatttcatggtaattacgattggaattgccatgtagaaactgggcactttggagatgcatgattaccaacaactagctaccttggaattacccattaatgacatgattagttgtggctttgtaagaaaatgttgttatgaaagggactttatcttttcattcccaattgacagaaaagcaggaaccttggagatatcagaaatattttttttcttcttctggcaggtgaagaatgtagttgtgcaggtttgtcctgtttctgggcatgtctggggtgccttggtgacagggagggagcagaaagagatgtgtgagcttgagcaaagggtgcaggccctgagctgtaccaggctagtcttcaggtctgttgagccagggtacagccaggaattaccaacttgttaggcagagagtaaggaagctcagaaagcccgtgcttgagctaaggggtacgaaacccaggagactgaatgactgcctgtcctctgctctgtggggaccaagagaatataaggaaggcagaagcagaggaggtggtaggttccatctacttatgatgctacgaaaagacatgcggcttatataatatgcactaggcatgaaccaccctgcccccaaatacaaaactggtctccagactgtatttcttggcaacagtggcctccttggcttttcctccacatccccttgagttgactatcctctgaggttgctcttgctattgattctcactggatatcactgggcatggggaggagaaacccacacaacggggtgcctggcatatgaagaataagagaaactttagctcttagaactgcaggagacccctcgtttaatagaggagaagcccagggcccagcaggggtgaaggaaggtatggtccaatgtcacaaagcagataaatggcagagccaggcctggagcccacacaggccacctccgagtgattttccataatgcaattccttcatgagggaggagttgttgatgcctcaaaattgagactaggctactatagataatacctatatagggagtgcctctgcatccattatagaggctactctgggatatttaaatacatattttttacctgattacggcacctatacaaagactcctgtatcacattcctttcactggtcaagagcaggcagacatttgcacctcctgacctgcaatgcccccctactaatagataatgagaaatctgaagtccacactgattcccttttcctctagctgctaggaagctgaaaaatccatcttttccttaggtaggagttttcattacggttttcttttcctctcttttgcctgatatctgcttttgttttatatattgttttgatctttttgtacctatgtttttagtataaaatttctggatgcaggtagggctgtcaactaatcaataacaaataaacaaataataatcttcatgcttggtgttcaaccatgcaggaaataaaatcttatagaacgtacagaagagccaggaaggatcacacactccactgtgctaactgcatacgaaggagaaggggaagaaggctcagttttagtggaaaggaataggaaagagaagaggcctcttcctttatcagctccctcacagcttcagcagcactatctcaccccactaaccaaacatccaaaggacttggaggcagaaaagaaagcttccggagaccttggaattatgtatgcatctatctatgtatctatctatatatctaagtatctatgtttctatctacgaatcagccattttatcttccacctctatcatctaagttaacctttctctaatatttctctaaggctaatctcatcatctttgtcttaaagaagcagactcagaattaagtaatgttttcaacgtcaaagaataagtagatctgggatttgaacctatgcccatttgtatgtgaagcccacattttttcctatcatatcacccacatcctcagaccatggctgtcacctggaactgtcagtaggccacccattttaggtctctcttaggcctaaagtcaccaagctttaccagtacccaaactgggtgctaggaacaacaggctgggcactaagatatgacagatgtggattaccacataccccagggagaagcctacataccatgggttcatagttaacagcgagctattacaatagatattgttcatcctcaaagatgaaactgtgatgagaccattgctataatattgacaaatcttcaggtacaccaaatgtgaagatgaattttattgaaatcttcataacatttttccatttgctgatagtttaaacaattatgttcatgtttctctctgtgagatgacttttggtgtcctgaaatgacatgctattgtgtaaaactacagatgcaggacacctcagtggagttcttttcttgcattaaactcacttcaaggaagatttatgaagccttgaaggtctggattgggccttggggctcatgatcaacccaggaccagaatatcaaggcctaaattgcagtcttggttctacctcatagcctcctaagaccctgtgttattctccagtcttatagaactaatcacataaagtggttaatttcttaacctatttgtagagacaaatgggtgatagaaagaaaactggagctcctggttcacatatgcctaccccatgcccctgcaattccactgccaggatatatccaacagaaatccatacttatatccacctgaggacatgtataagaatattcacagagccactattcataaaaaccccaaaatggaaataccactaattccatccctaacagaatggatcaatcatggcacatttctaccgtggaacactacatagcaatgaaaaggaaagacccattgcaggcatcaacatggacaaattctatgcacagaatgttaggcagaagaagccgtccataaaagagtacatagcacatgattcaatttaaatgaggttcaaaatatatgcaaaagtcatctaaggtgctagaagtcaagacagtggttacctctgaggaagggtagtgactggcaaggtcatgaggtggttttggagatgctgatcctattccatttctttatgtgggtataggcgatgtgttcacctacaaattcattgagctgcacaaatatgatctgtgcacatttctttgtatgtgttatgctccaatacaattaaagaaaaaacagggttcaattcccatctctgccactcaccatgtggcttttggaattcactttacctttacgctacatcttcctcatctgcgaaaccagcataatacagttcactaacagggctgctgtgaggatctaataagaagctgtgtataaaacacctagcactgaacctcacacatggtaggtgctcaatatatggtcattcatttttaaaattttaaaaatgtgatggacaatattgaatatacacaaaactaaagagaatactataacagacccccatggaccccgtcactgagcttcaataattatcagcctatggccaattttgttttatctgcatctgtctccccaaccgttaaaaaatatatgcacagtctacagatatatgcttgtttttgcatatatacatcagtttgcatctctgagaaataactcttttagaaaacataatttaaaaagatcagtggttgttggggcttgggggagggaagggtgaataggtggagcacagaggattttgagggcagtgaaactgttctgtataatactatcatggtagatacatgtgtttataaatttgtccaaacctgtagaaggcacaacaccaagagtgaaccctaacataaactatgcaatttgggtgataatgatgttggttcattgattataacaaatgtgccactctggtgggggatattcatagtgggagagtggggggaaggggtatgtggaagctctttgtaatttctgttcaatctttctgtgaacctcaaactgctctaaaaataaagtctctttaagaagatactcacatccatgatcattaaagactactgctactatcctatttcttgtccagttttcctaactcataaatatattttcacaactgttttgctcaaatcaagatccaaacaaggtatacttagtatgcatttcttcattcttaattaattcaatgtcttaacaaatcacagagtcaatagataggaaagctgtttatgactttggccaccaatcacataatactttgtgaggagagaaaaaagggtattgtcatgaagcttcctaaaaacacccagagtttctgtctgtaacactcttctgaattctttagaaccatggatggttgctgtcactgtcaaaactacatctaatactataaaggaaagaccctttaacacaagactgtgaatacaaatggcagagcagatactattgtcacacatatatgcagaagagattctgtaaggggtatttccgggaagacagacaaggtgtgatatctggtgtcactgtgtgtatgaaagaagcattttaagatcctcaaataaacataccgcccaaattaaggtgaaagtaaagcagacaggacccactttttgcactttgtatcttttctctctgctctttcagcactgcccaaagaagctgtcgttttcatcttgcacacaggatgccgtcctctgaagtctgaacaaaggccggatcacatgcctaagcagtattttaccttgtgctgattccttaaaaaaacagattgtctcctggattgcatgcatctagaagttcttaccacgttttattaaacaaccagctaatgcttctgcttcctctaaggagatcatgagtccccccactcccgaacaaagggccttcattttattcatctgtgtattccacatcccagcacagcacctggcacatagtgggccctcaaacaaatgtatgtgggataaatgaacagatgagagtgaaaagaggctgtgacgaaagcactggacgggaagctggagacctgaggtcatctaggcccctgacactcagagtcacttgagtcaaggcaccaacttccgtgggcttccgatgatttctagggtctctcccaagtctttttaaaaaaggcacataatcctaaaatgtgcttacttactgctttgctgtgttgatccacctagtgacttatatctaaagactaattgctaaacaaattactgaggcctttccgaacgctccacagcaacaaaactttgtttttcccgttgccccataccttctgtgtcatttatgttcccactacagatcacagtggcaacaaccccacccagaagagccaggaaaaaaccctcccctctaactcaccatagggcttgccatgtgctagctgtggttctgctaagttgtgctggaagctggagtgggcaagggctcagaagccttctctttcccccttagtccatgcctggccctgctgtgggcagagctacgatgactgaccatgatcatgtgtgagcacggggcagtgtgttttaaggggtgagcactggcagaggtgggtccagaaagggccagcccactgaaaacttcccaagtgggtgaaactcaccttggcacttgctctcctctctcctgccctctatcccataccccatgtgtagcattccattcaagaaaagaactctgactttcagcttgttgacaacttatctcctgaaggtgttagctgacaacttttctgaggcagaagatgtgaccaatataggtgctgggagaacggaaggaaggggttgagttacatttattcagtactttttcactcatttaaaactaagcacacaactgagaggagtactcttctacttttaagaaatgttcttattgtatcactgccgctaatatacgcttatagtctaaaaatatagaaacagatttgaacaaagaagaaaactaaagttacacatactatagtcctttaaaattttagagccttctagatcttttcatatatttataagtgaatatatttcttacgtgcctgtaatcatacttctgctcatccgatttaatgtaattctattgtatctgtaatggaatagaaattcttgtccttggataagtcactggccctttctatcctcagattcctcattaatcagtaaagcacgaatacacaggaaaattaagtcgtgaagcactaaaccacagggcggtgcgtggaggcagccaggccatgtggtggaaatactgtgaactataacaaccatagagatatgaggagtgattattgataggacacattaccatttccaaggatttaaaggtaatcaggccaggcacagtggctcatgcctgtaatcccagcactttgggaggccgaggtgggaagatcacttgaggtcaggagttcgagaccagcctggccaacgtggtgaaaccccatctctactaaaaatacaaaaattagctgtgcgtggtggcacatgcctgtagttccagctacttgggaggctgaagcaagagaatcccttgaacccaggaggcagaggttgcagtgagctgagattgggtcactgcattccagcctgggtgacagagcaagcttctgtctcaaaaataaataaattaataaaataaaataaaataaaataaaataaaataaaataaaataaaataaaggtactctaacaattgaggaagtgcctccttatcacatcctgacaggcggacccttgctgcagccacaggtgtagactgctctctcaatggcattttttgaaagttgtcagtttcttggtgctggaacctctcccagctcagaagttgtcaccttcagactatctatcttctctaaatgggattggcttcgaagagaatatttgaaatgtccccatattcaaactgaaaggagacaggctggaccagtaagaccagccaagagatgttgagttacacatattgtttggggccacagagccctactctgtttctcctccacctgtctgatcccacagtactaacaatacattgtctgtaggcccagttgtaaagactctcgcccctgtggactggctgtcctcagaggggagtcagggaatccccagcggggctgtcatggagctttggcccagcagccccacagctcactcagaaatgcactgcatgcctgatacagtgaatgatcatcagaccggccattggcggctgagcactttgcctttctgggcttccgtttcttcactggaagcatgagggtgtggaatccaaggactatcagaattccttcctgcccagatgccacgaacctgtacgtttctgtccatttttgtgttctgctggtactcaggacagtgcctgtaataatgcaggtactttgaagtatctgttgaaggaatgggtgatgaataaatgggtggaaattctgtgcttacgatgagtggaaacacaacggttggtgggaattaaactcttaacacatcacatggtgaccaaaaatgctgaggccatatctggcctgcatggtctgacatgattggaggcacccctgaaggtgggaggatagagtagattgaatgagaactgctcttgaacaactaggatacaaggctgctatatgaggggccagaaaagattgcatcagggcctggagatggtaacattcatgacaggtatacatctatggttttggaggcatctccatatctgcatttcttataagcttgtgcatatagtgacacacagctattcgaaagccaaaagtccctcaatccaatgacatttggaacagaacctggagcataacctggaaggcacctgcagcagaacctggaaggcaccctatctgacctggcatcagctgacacctggctgtctacagctttccataagcccttgccaaagtctcacactccccaacaggcccatggactcagcagtacttggagaccgagtcactgggtagattatagagttatcccagcccccatcttgctcaaccccaaccttgggtgcattgacttcccagtgaaacagaacatcgaatgacattttaagcacagtggtacatcttctcagagagggtatttggctataatatgctgcaaactttaaaatgtgcatatactttgcctctgcagcttcatttctaggagatcatttgagaaatgcacaaatatatatgcacatggatgctccttagtctcgtttataagagaaaagctgggaacaaactaaatgtctattactacatatcagctgaatacattatgatttactgatgaatgaaatatcccgcatcataaacatgacgcataaaaatatcacaaaagatgtccacaagctactatatcattgactaaataaaactgtctatatgatgtaattaatccatgtatgtaagtacatccagatagactgtacagagagagatgactggaaggatcctcatggaagttttaatttactacctggctcttgagatttggggtaaattttcctctgtgcttcctatttttctttacagttggaacacttcatgataagtgtgttgttgatatcaggaaaaaattattatcattttgaaataaaaaataattttattggaagccttggaagggaaaaagagtggagatctctccaaacagttgaaatgaatttctaagcaggtgcacgctagtcacacacatccttcccacctctctgaccagataggaagtgctcaacacatgtggaccagttccctactagctgccaggtaaccaatacgtgaagcaaaatggggattctacaaagtgagagtcctaaggaagctctatcctatgcgatatggaatggaggcaaaggatgtgtcctactgtcatctgtaatgttcacttcccaggacccagccatatacttggcagtaagtagctgatgaacattccaaccattattaaataacacttctttcaatttcgaatatagtctttgcagcttcctcttccttcctacttctaactacaggggaacataaaaacctgaaaaccgtctgactgtggtggctcatgcctgtagtcccagcactttgggaggtagaggtgggtggatcacttgaggtcaggagttcaagtccagcctagccaacatggtgaaaccccatctctactaaaaatacaaaaaattagctgggtgtggtggtgcacatctgtaatcccagctactgggaaggctgaggcatgagaatcacttgaacctgagaggtggaggttgcaatgagccaagatcacaccactgcactccagcctgggtgacagaggaagactctgtctcaaaacaaacaaacaaacaaacaaaaaacactgaaaaacctaatccctgcagaatgcaagcgtcagattttgagaccattcagtccgatgttctcattttatagagcaggatactcattctggagaaaataattcaagttggctattgacagtgtctggattagaaccacagtcttccagccctgttttctcctcaccttcctcacagccatgcccttgtttggggcccgtgctttctcttgtttggactactgcaacagtcatcaagcaagattttcctcccatcctcccatcttctccaggtcacattccctggcactagagaatctctctggaacactgaactgccctgcccatatcttttccctgaataaatccctttaaatgttcctcatagactccaggacaaaattcagactcccctgcatctcacatgagccttttgcaacatattcatggaccacagtggcaccctgaagaaataatctttcacacacaacagctggaaatacttcatgttcctttattgtcaagtaaatgagggtttcttccaagggactatcctgtaactacttaatttaaggattaactaaaacaggaagtgctaatcagctcctgaaaacacaaccaacattctaggcgggaagctcgtggaagccaacaacaaaagcattcgcgctcagtatgcctgccttccccttggaacctaatacatggtaggacctcagtaaacactacttgccaaatgaatagactaagtaataatcagaagtggagaggttaaactaatacaatgggcagtgaaaagaaaagctgtttttcgttttcttataccccttagaactgaaaaagactctgagtttgtccaattcgactccctcatttcacaaggaaggcatctgaagctcagagagacaaagtgaccgccctaaagtcccacagcatgttcatgggagagttaggactgtgctgggagcttctgatggtttccactgtgccatgctgactctccaggcaagtctaaagtaatgctggcaataatgcacagagctctaggcacaggctcctctggaaggtgccagacagcatacaggctggggcaccaggtgtacagctaatcatccccagagaggtttacctgagcttccaaagggtttttttcttttctttctttcttcttcttctttttttaatcttgaattgtttggtgaagagtgtctcaagccaaggagcagacacacttgtgtgccccgctcccactcttccctcctttgttcttttctttgagctgggtccattggaggagcattgtatggtgcccctgctgggtctacaaggcccctttttggttcaattaatgagccataaataacccaatgaaggtgtcaacaaagagggtaatttatcataccttgtcaagacggcaagctttgtgaggcaagcgctcattcacagtctggtgcaacatgttaagatttattcctggccaggtccctcctcctccagccctccctccccctatcaaaatttatctttcacaggaatcctcacaggtgtgctgctttgacaaataagctatgaagtctggtattcatcactggctggtctttgttgagaggaaggcagcgggaaataaatttatgttagagggaaggtacttgtgattcaaacacactcaaggggagcaacgaggttatttccatcctcctggttctgcaaaaggcgagaaggagataatgctaggacagccactttcttcagtttttactacttgatggaagaacagccaggactttactgagatgcgcacttagctgtcagtctggaggctccagtcgcattctcttgaaaatgtttggttgggaaatcttacagtggagtagaaagtgctacaagacatctgatatgcccagaatcgccatatcaggaggttttcccgcttcgctcttcaacttctggcttcccttggagtgctcatcctgaagtgtgagtttgcataatagccatctgggagtgcttgctaaaatactgattcccaggcctcccctccagcccccagagatacggacctgggaagtctagggaggagcccaggaatgtgtattttgacaagctcgcctctgttcttgccttcagacgcatatggtttatggagcacattttggatcaacacgtgctgcttagagtctctggtgcatgcctctgaactttctgcaatgatggaaatgctctctatttgtgttacttaatactgcagccactagtctcttgtggctgttgggcccttgaaatttggctagtgtgagagaggaatggaatttcttaatagtatttaattttaatttattgaaatttatatagccatgtggctagcggctaccattttagatggtagagctctagcccatcattctgcatagtagatacagacgaaaaagctcaacataagacctgatatgccagtctcctcctactctaccctattttccagctaagaaatactccaagtccctggagtgtgccctatttagtcatttctaaacaggaagagggaggagcatatcctcccacctccattctcaaggtctatataagccgagagacagaaagatccaatttcttaagtgccttccatgtgggacggtgggaggcatctttgagaattacatatggtctcccaatacagggagggaagacaaatatacaagtgacccaacaccaggtggcccactatgaagctgtagaaaacacctatagatgcaaagtgccaggagtcctcagcctcccctagcagatgtgaacacttccggacaccagccattcccttcccactttggaattaatgcaacagccttgtagctcattatgcccaattcactgaaggaagttagacttctgaattccttccttgaagtgtccaaggtaggtttcccactgtctgccctgttgagatgggacccacctctgtggttacactttgtatgtggtgactgtcatcacctgctcatctgctcacctgtagactttgaggtccgtgagcagagattcccaatcatttatctctgagccaagagaccgaccctggtggggcaaaaccagtatgttctaaaatgaaatggcctcacatctgcctatatgaggcctcttacgtcttgcttaaggataaaagtggcccttgaaaaacagaaagtggtctgttctctgagggtaaaagggtgtaggtgttccctttctacagtgttatgagagggacttaccccttaaatgtgtattttaaatggcagggggaagagggggaagaccacatggaagagtgactggtccagggtctggggaagaactccctgtctgtgagaaaattccacctgggaaagagaaggtgagtctgcctagagcagcagataggctccaggtccataagtggggccaggcaggcttacaggagtaggaggcacggaggcacattgggaggtaggctgttcactgcccagaggcacaaagcccctgtcccagaagtgaagggcagcctacaggcctccactggatgccctgccacccacgaacagcccctccctgcccaagcactcttccttactcactcctctggctccatggggaagcagaatcccaactcatagctgcaggaggaatagctgaagagagaagaggcctggcttcagcttccagagctaagccctgccaatctcccagactcctgcagtctttcaagtctccgacatttgattactcctttcttctcatgaagtgtccttattttgcctctagaaaacaggcactggtatcaagagttgcatggctgatgccaagacttaatgctccagagtgtcttgcacagggccaaagctgcctcttctggcacacacagagttctacagaagggcccccttataggccaccagccactgtgaggacctcataagcaaatgtaagggcaggaagagatgggacatggtctggcaaaaacctcagccttctccctaagctcttctgccttatgaggctgatagctcagactcaaaacagttggctgagttctccagctaaatattcatttctccagctaaatattgattccttcaatattaacaccatgtcagggagccatgttaagccattgcctcaacttggcactgcagctaaacataatgaaatgccagaaattagggtctagaattgattatggtaccaattctaatcctgaattctcaaagcaatatctagaaaaatattgaatcaagagtttttttttttaaatgaagatcctatactggagggagatgggcaacttctatttggaataacaagcagtatcaatgtctttgaattcaccttgaaaaccaatcctttggagtagaaagaattcatggtatttgaaatgtccaagattactaatgaggggaaaatctgagggacctgagaaggtggggttgcttgagaagcagtaaagcttctcaaagaagaaatggagatgccatgagcagctgccttggaccagattccaaggcagtgtcttgtaaactcagccacgattagggctgggtcattctggaccgtcctaaagagaaaccattaaaaaccattaattccttcagatatcacagctgcttactcatagtagctcattcataggtaaggaaactgagatctccctaagatcaaataagtaacaggtatgttaaaaagtttcatttgtttacgtgttactaccaagggccaagtttctccatgtagtgcaaggaaataatttctgtgcaacagctcgagatatgcagcttgagtttgcctgaagccctggcactgtgaattgcggctccttcagatcttgcaagctaccagcgatttggcggggtgggtaactggttgggaaacctcccaggaaaccacagctcctgcaaatgactcagtaggtggttccgacttctctgagtcagaaccaagcccatggcccagccccatgccaagactccctggcattgttgagatgctctgagcttggctggcatgtgacactgaggacctctggtgtttgtctgcaaagggatgaatgctctttctgataaggaaccaaggagtgtggaacagaaaagcagctgaattctctcagtggcctggctctctcttgccccctcaatccctgaagagtgttgatggcttcctacgtcagacaacctttcacttaaaaacttactcctcttccttacccaggagtttccaggttgccccccacagtcatgaacttgcagacacagaatgcttagttctagtattgattctgctgcttcccagggctgtgaccctgagcaagtctcctactgtgggcctcaagtattacccatcccaatttcatcatcagcccaattgtcctctagtgccatgatgatcatactaatcttccaacccaaattctccactggctcccactgcctatggaatcatgtccagacttcttagcctggtattcaaatcccaatctatcttttaagcctcagcttcctctattattctccctgtagcctacgttctcagcaaattggaccactcactctccctaaatgtactgtgcatttcccattccctgtgcccttgcagtgcccttttcttgagatgccctctccttgcctctggaaattttgcctacgcttccaggctcagatcaaatgcgacctcctcctccaagcagcttccgcagctcttctcttgtgaagcccccttgatctctcacatcacagtttgttggtaccttcctattgacatagaacgcattattctgaatcgcaggcatttgtgtggatgacttctctctcctcctggatggcatactcctaaaggaagaggggtgggggaggatgtcttattcccctttcaatttcccatcatgccagggtatacacatctgtactaatgaacaaatgaatgaatttagaaaatctagatggatgttctaaaattatctacagctgtggtatttcataccagaggtggctgcacatcagtaataaaaaccagcccagacacaagcttttcatatgggaaaaagcagaggcactggtgcgatccattctgttggccatgaaatgtctttgggtgtgtgcacacagactcccacaaaccagatgcaacatctgcttttgaagggcccagagaggctgggctccctcatttctcaaagtgatgagaagcgcattggagtcttgcagctgacagtcgttcggtaaagaaacacctacttagcatagccccagctccagctccacaccatatgcatcaataggggtgggtcacagtgccctcttggcagtaagccaggaggagatttgaggtttggttttgctgtgctcaacaggcagtcctgatctacattaacaagtctcctgcttccgtgtgactagctaacaaggagactgctgcctgcctcatgcagggagacctttcccaaagcttggcacctgccctatgctggcccagtggaggccaaatgggggagcagaaaggaagacattgctaaagttctcttttccactttccttcaagagactagaccagtattctcaaactttagcaagggtcagagtcctctggagggcttgtaaaaagaaaaaaaaacaaaaacacagattgctgggccataactccagagtatttgacttagtagctctgggataaggcccaagagtttgttgttgttgttgttgttgttgttgttgtttgtttgtttgtttttttctgatatgaggtctcactatgtgacccaggctggtctggtcttgaactactggcctcaagcagtcctcttgcttcagcctcctgagttgctgggattacaggtatgagtcaatgagtcatcacactggctcaagaatttgcatttctaacaaatttccaggtgatgctgatgttgcctgtctgggagccacactttgagaaccactgtattggctactccaaagaaaggcaaatgaaagccctcaagccatcactggctggacaagaggtatgactgtctccctgcctccaggctctgctccattacaatctgtcctctactttcccacagaaagcacctttctaaagcacacatccacctatgccattggctgcactgcctgttccttgcctataaaatacaaactccacagccaagcttatgttgtctaagccgttaactgtgtgccaagcactgttctaaaacctctacacattataagctcatttaatccacataattctatgcagtaggtactattattatccccattttagaaataatgaatcccacagggggccctcaggaaatattttctgaatgaatgaataaaaagatgctcacaagcatttacactgtgtactacagaggactatttccatgccaaaggaaaccatcaaaaagtgaagaattggcttgccaaccagtcatttgttcctgcactacaccaaataacccatttgcctgtaattggctggatattctggctttgtgtagacatctcctcgctgggagaaaagccagagttaatccttcacaaagggttgtttaataataaccagaaactggaggagagcagaaaagaacacagtgatcccacacaagctgaggaaaatggactgttcaaacccacagtgtccatgctgccagtaagggcccttggtgtggcctgaggtttcttaatttttattataaaaatagaacatgaatatgtctctcctgattatcaccaccaaatacaccagtgaaaacatctatggctacatattactctaatgcaacactaatgcttacactggaacagaaaatcaggtcattgtcgagagtctataaatggacagccctctccatccattacttatttatgtttcccgccttttgcttaaccggccttgaggcccaaacagagaaacacaccatacataaagttaccagtccagataaataaaacatcagactcaaattggcagcttcatccttcattgctttggaggaggtggacttcaacagccagatgctgcacaaatgatcagcaaaatgtgaccctttgagaccgcagcagacaagtcattcctaagacgtgtatcttcccaaaagttagctttgccctttttagagaacattcttgtttactgcagacagaagacaatgatcccaaaataagtttgagcccaaatctctttgagttgggcaaactgagactgacattgttgaattcatcaccagttgaagtcaagggtttccccatgtggccggccctacagttactcagcctgaaggctcatcatggtaatattacccatgggaaggtctgcatagtaacgaaaccatcagagtccctgtgcaaagttccagcagaaaaacaatgatgctaggacccaatcctatctgatggcccagaggtatctatggccctgggggaagcccttcttagtaaaaggaagacccatctccaggaacaaaatgacttgccttgctccttacagtcttctgtctatctactcacagcagccatctcttagattgaacaaagtaggatgcttttacctagttttcagcttagccttgtgctaggcaacctgtgaagtggctctgatggagagagctggtgtaattagcagcacagggcacgtttccagaaacagcctggatggagaaacagagggcacccttgcacacctgtcacaccttcagcctctgctcaaaagtgtccaccttctttgtccacagtagctacagaagtgaaaatgtttgcctcggcatcctctccatcaccgtcaccatcacctagcccccaaacggggatcacagtgctctatccacccctgagagcaactgtgtgcagtcaccagcaaggatggttctgccagagtgacgggcactgcctgtgaccatacagtggcagcagtcaagaaacaagcccttctgctcaatacttcatcttttcctgtgtgctgagaattaagtacctcttagctagttagaaaaactagcagttattattgatgaaatgtgtaagacagacattttgttaggggcagaggagaaaatagtagaaatgtccagtcgttgaggactgtctgtaaaaccattcaaatcaaaccacttcaagaaggataaagcactgtgctgatgtaagggatggtcattagataagaggagtattacatcttatgctctgtgaaggaaagggtataggtcttatatttttttttaatccaatgataacaactgcaaacatttacttaatgtgtgctaggcaccatatggagtgctctatgttggattatctcatttcatcctcacaattttatgaggaatatatcattattatcaacccattcaatggatgaggaaaccgaggcatacagctggcaagtggcaaagccaaagttagaacccaaaagtctgacaccaaaactcaacctgccccctctgacacagaaactttcatggagctcagtgagaactttaggaccagtgtaggcactctctgaattcttctagatagcactgagcttgagtatggttgttgtttaagagtatttactgtctgggtgattattctggctcatttcataaggcttttgtcttggtgagaaagcactcaccatcttctagttggaaagccaaggtcttccaaccttgggaaaatcctgcctcattatgccaagagttaccaaacagcacaggaaaatattatcacagatttcctgaaactgggtgagatcattcagttcaaagcctgcacaattctgtttcatatgcactgggggcagaaaaatgtatgattggtccttagagctcattctcatgggtgattccaccagtttcccagactccaacttgggtcttcccagtagtgtctgctaccaccaaagacagtaaggtgcagtggagggagttctgaaccagaacacctggttcacgtttcagctccaactactgttacagtttgtgtgaccttgagcaaatcacccagccactctggccatctgaaatattatcagtcaaatggggatgctgatatttgtgataatgttacataaacttgcctacctcagaggctcgcagttaggaccaatgaagattctatatgtgaaaacacaggttaatacagagcacaatatcagtgataatagctaatatttcttttctttttttgcttatgatgtgccaggaacctcatgaggtggatcatattatctgcaattgctggtgaggaagaggaaggagagactcagagaacgaaaattagcagaagtagaatttgaacctaggtttttaggttcaagataggtttttccagcttgtgtacacaagctaatgttgccctaaagggagtgaaaattgatttttgagggccaaaaagttgctgtttttatatataaagtacagatatacacatcgtacataaacagacacatagtgtatttgtatctgtggtattacaatctcatggggagagtgattagaaaaaacaatgtctaaaacaggtctgtaggaggcaataatgaagaaaaatttgagaaatactggtctatcttcaccctatcattccatttcccataattaataaagatgatcattgttaccatgacaattaagtttctgcagtggaaggttgcatgctgtattcaaatatagtacctgtgaaggtggtggccagtttagttgccactgtagatgatctagcttagaggtcgtgtgcaaagaattcaaataccttcacatttaaattctaaagtgtaaaacttctgccaatcaaaattagaaggtaatgtggcattaatgctactcactctacaccctggatacaggtacatggttagatcagttcatacaaactagaggagggaaacactcacttaaacattttaaataagagggaggcaagaaggtttgcttgaggccaggagtctgacaccagcctagtcagcacagtgagacctcatctaaaaaaaattttttttaatactgggaaaaataaaaatgataattggtgcatttagaacattaatacaaatctgcctagatctgccactggggatacagattgcttcttttctttcggctactgaaaaaactggagatttgtgtgtaaactccgagtaatatctgtgaattaaataaaaaggcactggcccatgcccggcttcttaaacaaatcaggcttattcatgcaacatgcttccagaaatgtgttcaagtcctgtcaccagtgatggctcgatcaaagttatttgctcaggccattgctcgttggtccatttcaacttgctacgtcctgtagccatcttcctctctcagacctcttccctcggcatcgcagctcctgacctccactttggccttagtgctccctcggagacttcttgtcattccaatcatggattcactcactcattcactcactcattcattcattccattcattgtattatatacaacaaactgcgaccttgttcccaccatgaaccaggcattctttcagcatggtagccctgcctctcaggtctgagaggtccaactgtctgggccagccttgtccagattctctactggacaaagggggctggagaggaggggcatgcagtcatcagaggcttcattttgtacaaattgcctttgaggtgttcttctgactggagcacagcagggacgcacgtgctcacttgcaactctgggccaggctggtcctgaggtacctgtgataatcaatccagttgccatagcggccttaagtgttcatttaccactatgcgacctggagcaataatatattatgcctttcgccagagggagccgtgccagcctcagcacagggcggccgtgtcggccatcagtcaccactccccttcacaaccttttgttccccgctcattatggtgaattataacagggggacagcacatttttcaggagagtttctcctgttaagtctgagagctaactcttcccgggttgttccaagtcggctgtgctagccctgtacccctgcaatgtttatgcacgggacagtgccgttcactggacttccctcttttccctcctcttgcacttagaatggctgaaaagcagtgtgtgtgcacatttctacaaggcaagataaaaaaccactccagtgtatttactataaatattggatactgcattttgttgcactctgtcatgtgcccgaaggcctatcctggtggtaaattacattacagaacactaaataggccatcatgtcagctttgagccttggcattgctacttcaagatgagtagaagatcacttccaaagtcacacatgggaggatcaggggccaacacctccaaccctatcagcattttttgaaaatgtttcactctaatagtgatggtgaacattctaagatcctaaaaattagaggctgggtcacaagattagatcactgaaagaaattaaagataaaattgttggctaagatgatttctaatagccccaaaccagaaacaaccccaaaggccatcaattggtaaggaataaacaaactgtacgtccatacgatggaatactattccagtaataaaaagaaattataatacaacaacatggatgaatctcaaaaacatccgctaggtgaaagatgttgaacaaaaaagaatatgtattatattattgtatttagataaaactctagaaaaggcaaaatacagagacagaaagctgatctgtggaagccagaggccaggttgcagggggacgggattgagagccaagaggcccgagggaacattttaggtgagggaactgttctatgtattgtttcagatggtggttatggttgtaaacaataaccaaaattcatctaactgtatgcttataactggattacattgtatgtaaataatattgtagtcagcctgtaatcccagcagtttgggagtccgaggcaggtggatcacgaggtcagaagattgagaccatcctggccaacatggtgaaaccctgtctctactaaaatacaaaaaaattagccgggcatggtggcgcgtgcctgtagtcccagctactcgggaggctgaggcaggggaattgtttgaactcgggaggcaaagcttgcagtgagccaagatcgcaccaccgcactccagcctggcagcagagtgagactctgtctctaaataaataaataaataatcataatattttagtcagtggaagaaaaggaaaacaaatgttgaccaaggcaaatggccatgatttttctcctatgtgatagcagacctgcaagaaagaagtggtattgtatagaaaaacaagttatactcattagacaaaatcaaatgagccaactttgtgaacctaagcttggagacaccaaacacttcataatttttatggcatggtgataagctattacatataccaaccctgggatggaaaagccttgtcagttgcagttcaacctctggttaattcaagctgggtctaaaaggcactaaattgagtgtggtttcacttccttggacttcaggttccttgtccttgaagtggaagggttggatgaaatggttgttaaagcttcaaaatgatacaactgtgccagtctttgctcaactccaagctctttaatgtgttggcgtctcgcgattccatttagctattaggaccccagggccaaatctggcttgtcccaatgtcattgttctacagaaccgggtgaaggggcctaagatacttggaggaaagtctaccagtgccatggtcaacagtgggccctcccaatgagacagcctcgggctgagttccctgtctggacacagcagccagtttctatgatgctttcacccagaggtgttcttggaagatctccagtgtactttatttttagttccttggtgagtgctcactttgtattctaagaaaacttttagatctcaagacaaggaatttttgatctcacttttttacgcaattatgagtcattccacatgttagcattagcaacccaagacctccctctcctcactgatctatctttttcatctcttcaaagatcctggaggtaaggaagggttttaaatgtttgcccttgaaaagaaaagacgtgcaaaccggaaactggtgactagcactgctgttgttaccaagaaatagtttttaaaagcagacattttaggaagataattgttgatctttgcattacccaccagtccagtgagcaggcaaatctcctatgcataaaatctgctaagtcttcaagcaaactcacctttcctaaaggattgaattaaaacttaatccataatatcttcggaagattccccctaattttttaaaaacatggaattttttttttcatgtgatagatctggttgaaaaccaaaatatcagcaaaagccacagctcatcataaacgtaactatctatggagcccttacataatggtcagctactgtgcacacagtagatctttcagaccttacaactagatgtggaaactgagtcttagtgagtttatgtctcaaggccaaggctgcctcgcctgtaaacagcagagctgggatatacacccttatcagaccaaatcccaaatcagtgctcttccccctagtgcttattgtcaaattctggtttgtcaaattgtcaaaccagaaccaggtttccgttttacgtttctattcataaggcgaattatgtgtgttaagcaagatgttcggcaattatttgcccatggatgaaaaggtgtatgcttaggtttcttgtatcttatactttgcttcacattagggatgtagcctcaggcacacattcatgtgagcagtgacctgtaatcagtttataagattatcacttaaaagaattttcctgttactgatgatacttagagattggctgttagaatgctgtgtgaatgttatatgcatatacatacaaacatgttttctctttatccttgatcttcctatcctccttcaaaacaaacaccgtctttaatctttaggtttatgtgcaaaagtgataatgcagacataccctgggatggaggtggggaggacacaggcaactgggcataaggagagataataagacacaattccaaggctggcctttgctggccttacacattctggaacaaataaagctaacaatattatcaagcccacgaagccctgttagagttgaaattgcagctcactgaaggtcaaatttattagattttcttttctgccttcatagaatggttgaataacaacttcctatttttagcatgaactctcctttgtaattgcttcacccaaatcaagaaagctggagtcagggtacctgtatccatctttgctggcatcatgttctaaatcaagtccaagtagctatgcatagtagcatcttcttattttgagacttggcccttcaactagtggtttagaaagaaaggtgactttgctaggatgctggggcaaaaaccagggtgctgaggaagactgccaggttctgcaggacattttaaaagtacactgtcaggtttggggtttaacctctcacatgtctttcttaattttttttttttttcacttttaaagttagcttaggaacgtcaattctgattctattcaatcttgttctggctcttgtagtcactcttctgaggcactcttgttctttgctgtatcaaggtcatacttaaaaagagatgttatttcttgatcagggttttgagaggattacattttcaatgtgaaggttcagccactgttttagaggactgtactaatgagcataagacagaaggtcttggcccaatgtggacccgcattcagttctattctccaaggatgacatctttaacctcagccagctatttcgcaaaagtgagtaatgggtcggctgggcatggtggctcatgcctgtaatcccagcactttgggaggctgaggtggggggattgcctgagctcaggagttcaagaccagcctgggcaacacggtgaaaccccatcactactaaaatacaaaaaattagccaggcgtggtagcgtgtgcctgtaatcccagctactcgggaggctgaggcaggagaattgcttgaacctgggaggcagaggttgcagtgacccgagatcatgccactgcactccaacatgggtgacagagccagactccatctccaaaaaaaaaaaaaaaaaaaaaaaagtgagtaatgggtcaaaggggaccagatgagagcataaatgagcataaatatatcacttctattaactaaacaaaccataaaatggaggccttttgccatagtcagtcagtcgtccattatcatgacaggaaaaatcacacatatgctctcatatgagttgtccatctgtcaaagaatttgtataaaccgaagaacagtaacatgcactgaagatgaaaagcacctggggagctttaaaaattcctgaggcccaggccaccctggtcccacctgggaagtctgatgtaactggtctgagatggagcatgggcatcagtataatttaaaagccccaggaagatcctcccatgcaactagagctagaaccactggtctagacccagttggccacagtgaacaccgtactaagggccagggactctgcacaaactgccttaatgggtggagttacaggtggtaaaaaacagaaaaccgtatacaataagcagcacggagcgagatgcggtggctcaagcctgtaatcccagcactttgggaggctaaggcaagtggatcacctgagctcaggagttcaagaccagcttgggcaacatagtgaaaccccatctctaccacaaatacaaaaaagaaaaaaatggccaggtgtggtggcaagcatctgtgatctcagctacttaggaggctgaggtgagaggactgcttgagcaaaaggggcagaggttgcagtgagctgagatcataccactgtactccaaaaaaaaaaaaaaaaaaaagcagcatggcccagaattcctgtctgatgcttcccatattcccagagggcaatacaccatttccaataatcgtccctgcagaaggatagaaaaatgtcagcaacaagagtgacacttaaaactgcaccccagactcctgtggttgagatgctgcatgcccaacgtggtctgacttcccactgactgacctaggcatagcaccaggtggagcatgcagacatatcaaggtttccatagggtccacagctcagagatataacagatgcccgataggagcaaaatgaaagattgaaacaaaaacaaacagcccactttggttttagagcagagaaagctaggagctgattggcttaagagcagagaggaggaaggctatagtttaatatacccagcaaatccagcaatatggggctggaccaccccatatagataacctataaaatataatttccctccccaccctctctctgaaaatccaaactcatgatcacataaactgcacaaatcatgggaaagaacaggaactctcatctctctttttaaaggaaaatatgtattccacggttcctgttggcacgagctggacattacagggctgatatctctggggacaaggcacagtgctggcttcttgcatggaggcaagtggtgccaactggccagcataccaggttggctctcttccaggacacagtggcttgcatgagctcccgtcaggggaaacgttgttatatcatggctgctgcagacaagaagatgatggaaaggataaggctctccaggctacaactaccgagaacagtgcttgttagaaaaaatacttttcaccattaggggaggaaaacggctctttctccaaattcctcccatttgctccccatccctgccatgcataacaatatgttccattcagaagtagtgttagaaataaaggattgcagacaaaactgtactttggaaaagggaaaataattggttcactcaaggggcacttttttggcaaacccaaggcaactcacaatggtacatatgcttgtctatcccagtgcacatgatgagacctgaaatcgagaggtcacttctgtttgtgggaaagccaggatcacttaattggccagaagagccagaagcaagctaacctatcaacctagcttttaatctatgaggcagaatctattccctgactttttcacacaggtgatgatgctcataagttctcccagcagctgggcagactgacgagtcaggaatgtaccaggttccccaccctgagttcaggctgggctcactctagcactcaggtgggttatatgcaggagaaaccaaggaacctccaggaagaagatgcattccaaggggagagtgaagccaagtgcacctttctgaatcaaagataatgagccaggatcagcgggtgtgctgagggtgattccgcacagcgtcccccaccctgagtgtcctatgtcccatgggagagcagctgcaattgcatggatgaataaaaccaaaatgactccgactccctctccctctccctctctctccctccttctccccacggtctccctctccctctctttccagggtctccctctgatgacgagccgaagcgggactgtactgccgccatctctgctcactgcaacctccctgcctgattcttctgcctcagcctgccgagtgcctgcgattgcaggcgcgcgccgccacgcctgactggttttcgtatttttttggtggagacggggtttcgctttgttggccgggctggtctccagctcctaaccgggagtgatctgccagcttcggcctcccgagttgccgggattgcagacggagtctcattcactcagtgctcaatgttgcccaggctggagtgcagtggcgtgatctcgggtagctacaacctccacctcccagccgcctgccttggcttcccaaagtgcccagattgcagcctctgcccagccgccaccccgtctgggaagtgaggagcgtctctgcctggctgcccatcgtctgggatgtgaggagcccctctgcccggctgcccagtctgggaagtgaggagcacctcttcccggccaccatcccgtctaggaagtgaggagcgtctctgcctggccgcccatcgtctgagatgtggggagcgcctctgccccgccgccccgtctgggatgtgaggagcgcctctgcccggccccgaccccgtctgggaggtgaggagcgtctctgccccgccgccctctctgagaagtgaggagcccctccgtccggcagccgccccttccgggagggaggtggggggccagcccccgcccggccagccgccccgtccgggagggaggtggggggccagcccccgaccggccagccgccctgtccgggagggaggtgggggggtcagcccccacccggccagccccttctgggaagtgaggagcccctctgcccagccgccaccccgtctgggaggtgtacccaacagctcattgagaacgggccatgatgacgatggcggttttgtcgaatagaaaagggggaaatgtggggaaaagatagagaaatcagattgttgctgtgtctgtgtggaaagaggtagacataggagactccattttgttctgtactgggaaaaattcttctgccttgggatgctgttgatctttgaccttacccccaacccggtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccccagggtcctctgcctaggaaaaccagagatctttgttcacttgtttatctgctgaccttccctccactattgtcctatgaccctgccaaatccccctcttcgagaaacacccaagaatgatcaataaaaaaaaaaaaaaaaaaaaaaatgaaacaaaaaagggccgttttccagaagtcatgggtagcacctggctagtgcaaagtgcagtcttgggtgctgtgctgcctgcagcctccgcagtgggagatggtacctaaacaaggtattgggaagagttgcagcagtaatggcatcattaacaggcagggcatggggccttggggcctcaggggcagctatttgtgggcatcagaagtggcattagtgctatccacagacaacaacaccacccctatggccacctgtgggcatctataggggtggatgatgccttgatgatttccttggatgtcatggctaagccattgttttttggcagctgcagcttctgaagatgttactgagagccacagagaaagtgaagacggctaagacaaccaggtcatgcgagacatgcccaagacgcccagattgcttaaaagacatttgggaaagggagcatttaaagttctttccagaggatggatggggacaaaactacctggagagcctattttttattcccaggcaaatatgactgaaaaaaaaaaaatcacaggtgttaaagaagaaaaataaaattggatgaaaaaatgtctctgctttttctggtgatgcaaatacaaggcatcatccatttagaagaaataaatacattttttctttccactccaaaatgccaacatttacaaatgagttatagaagtcacttctggaaggcaaaatactctccatggttcatttcctcagtcactcaacaaatagtaactaaaaatagatgaagttcccagctagtgcaaatgtctgtcagggataagtaacaacagaaacaacaatatataatttatgccagacttttttacatgagcaacctcatctaacacttatgaccctactgtgacaagtaccattttctcctattttaaagatgaaaaaactgaggcttagacaagttatgtgacttggtgaagataatagaaatattaagggaaagaacaaggtcacacatttggatcttccaattctagccctagattcttcccatcccccacaacaaatataagatacggtcctattctctgctttcaagaaacagacacaaacccattaaagaactagaaactagaacctgtttctattctctcctggttctaaaggatggatgcagaagagactgatagttcaggcaggagaggaatcaatggaagctggaattgtcaaggagttgttccagagcaggagagatataaggatctgaacaggcaaacaggaaacaggcagagttgagtagaagtatattctgagcggtggacaagatgaagaaatatgagctttcttcctaaggtgtgctggagtgatgagatacagcacagtagtggtgtccagtcctgcattctttccttccccaacatctctgaagcacctagcatgcaccaggcaccttgttacacccagtagcacacaccccctatgacatggccccttccccgtgaagctcacagcctaacgtgttgaggcagctgaaccccacgtgattcccagcccagccaaactgtctcctactatccatgatgaaaacatcagaagttgccaggccaaatcttgcttggcttctcaaatcaggctgtttatcagcactgcttcacacagataaaacctctcaatatggagctaaagtggaaaaaaactcagcacgtaaaaataaactgcccaaatcgtgttccctccccactccattcagcgcccagtatcactacacacgtgaaaatgccacacagccctggacccgagcagcagagcagctgctgtgtgtggacacaaagtacaactcagagccctctccacttctgctccaattgtcgtagcctcgtctgaactctgagctggacactccactgcaggatacagagcatgaattgagagaaagcttcctaaccttcatattgtcaactggtgtcttgctgcatttgccacagatcccatagtgtggtgttagaaatggtgttgacacactcccacatatctttagcattacatttcccatgttgctcctccttatatctttatctgcacttggtttataagtgaaatcaactgataaggcttccatttcataccatctgttatgtgtcaccaacgctggttttgtaaaagagatgagaaggatctaagactattgaaactttcacagtcatttccagctcggtaggctagaaactgaatcttaaagagtcactggacatactcaaagaagaacttcccactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtaggggccaatattcaacattcttaaagacaagaatttacaacccagaatttcatatccagccaaactaagcttcataagtgaaggagaaataaaacactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaataaccagctaacatcataatgacaggatcaaattcacacataacaatattaactttaaatgtaaatggactaaatgttccaattaaaagacacagactggcaaattggataaagagtcaagacccatcagtgtgccgtattcaggaaacccacctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacgtaatagacatctacagaactctccaccccaaatcaacagaatatacatttttttcagcaccacaccacacctattccaaaattgaccacacacttggaagtaaagctctcctcagcaaatgtaaaagaacagagattataacaaactatctctcagaccacagtgcaatcaaactagaactcgggattaagaatctcactcaaaactgctcaactacatggaaactgaacaacctgctcctgaatgactagtggatacataacgaaacgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaacagagacacaaaaaacccttcaaaaaattaaggaatccaggagctggttttttgaaaggatcaacaaaattgatagaccgctagcaagactaataaagaaaaaaagagagaagaatcaaatagacacaataaaaaatgataaaggggatatcaccaccgatcccacacaaatacaaactaccatcagagaatactacaaacacctctacgcaaataaactagaaaatctagaagaaatggataaattcctcgacacataaactccccaaagactaaaccaggaagaagttgaatctctgaatagaccaataacaggagctgaaattgtggcaatagtcaataatttaccaaccaaaaagagtccaggaccagatggattcacagccgaattctatcagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggttggttcaatatacgcaaatcaataaatgtaatccagcatataaacagagccaaagacaaaaaccacatgattatctcaatagatgcagaaaaagcctttgacaaaattcaacaacgcttcaggctaaaaactctcaataaattaggtattgatgggacgtatttcaaaataataagagctatctatgacaaacccacagccaatatcatactgaatgggcaaaaactgaaagcattccctttgaaaactggcacaagacagggatgccctctctcaccactcctattcaacatagtgttggaagctctggccagggcaattaggcaggagaaggaaataaagggtattcaattaggaaaagaggaagtcaaattgtccctgtttgcagatgacatgattgtatatctagaaaaccccattgtctcagcccaaaatctgcttaagctgataagcaacttcagcaaagtctcaggatacaaaatcactgtacaaaaatcagaagcattcctatacaccaataacagacaaacagagagccaaatcatgagtgaactcccattcataattgctacaaagaggataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaatactttaaagttcatatggaaccaaaaaagagcccacatcgccaagtcagtcctaagccaaaagaacaaagctggaggcatcacactacctgacttcaaactatactccaaggctacagtaaccaaaacagcatggtactggtaccaaaacagagatatagatcaatggaacagaacggagccctcagaaataacgccgcatatctacaactatctgatctttgacaaacctgagaaaaacaagcaatggggaaaggattccctatttaataaatggtgctgggaaaactggctagccatatgtagaaagctgaaactgtatcccttccttacaccttatacaaaaatcaattcaagatggattaaagacttaaacgttagacctaaaaccataaaaaccctagaagaaaacctaggcattaccattcaggacataggcatgagcaaggacttcatgtccaaaacaccaaaagcaatggcaacaaaagacaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaaagcaaatcaaaaccactatgagataccatctcacaccagttagaatggcgatcattaaaaagtcaggaaacaacaggtgctggagaggatgtggagaaatgggaacacttttacactgttggtgggactgtaaactagttcaaccattgtggaagtcagtgtggcgattcctcagggatctagaactagaaataccatttgacccagccatcccattactgggtatatacccagaggactataaatcatgctgctataaagacacatgcacacgtctgtttattgcggcattattcacaatagcaaagacttggaaccaacccaaatgtacaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggacggtggtggggtggggggtggggggagggatagcattgggagatatacctaatgctagatgacgagttagtgggtgcagcgcaccagcatggcacatatatacatatgtaactaacctgcacaatgtgcacatgtaccctaaaacttaaagtataaaaaaaaaaaaaaagaacttcccataaatgtgagatgggagtaaaatctttacaagtggatggtgaaagcaattgtcttatggaggtctgtcttatggaggagtgccctgtttgggccccagtggatttggtattcatcacctattgacctatgtggggtttctactggatttaacaaaagtgaaagaagcctgttgccaaaaacttcaagggcaaattctattaaaccttgaagtttcaagtgaaatgccaaatcttcttgaactattaggttgttgcaaaagtaattacagtttttgccattaaaattaatgattccctagactccaagaccagttatttttgctgagctctccaagcacttgaagggcctcattcagctctcattacattctgggcagatggtgagcttcttgagggcatggacttgctttattcctctttgcagtcatccagtaatgacagactggatgactcaatacatacttactgaggaaaactgggcatttttctccagttatgtgttgctttgacttaccacattaacatgggttttgtatctttttaaaaatccatcttaaggctgggcgtggtgactcatgcctgtaatcccagcactttgggaggccgaggtgggtggatcatgaggttaggagttcgagaccagcctggccaacatggtgaaacctcgcctctactaaaaatacgaaaattagctgggtgtggtgatgcatgcctgtaatcccagctactggggaggctgaggcaggagaatggcttgaacccaggaggtggagtttgcagtgagccgagattgtgccactgcactccagcctgggtgacagagcaagactccatctcaaaaacaaacaaacaaaaaaataattgtaacgtgtatgtgttattcaagattgctggcattgtctcgttttaaagtactcatgaacattaggaaatatgataatacatacaaaacatatagtatatttcattatatagtaagtactcaataaatatcaggcagacctccataagacctccaattgttgtcattcataaggttaccctggcattgacttcatgtctttaaaaattcctggttctaaatgcaatacaaatatttttcaaaagatgctaaatattcttgggaattcaacacaataagaactcacatttatacagtgcaaaagattttgtgagtcgatttttacaaagttacaactgctgtcttttgctggagaagaaatggagacttggcccccatatatgctctattcaaggtcacagagccagggtggagcaagaggagtcaggcccaaacaagaatgctgacttccaatcctgacagtcccaacgcctctctagttcttccttgctgctttccaacatttttttagtttatccattttgtgtattccactgagaaaaggacactttatagacgtatattctgcaaagaggtcagatgacatctgaaattgcaaagcggtagacaaagcttttgagcaggatggtatattattgaaaacagttagaaaataatgaacaacattgtaatcgctggcacaattttaaaaaagattgctttacctggttttgtttcctttctggttagataatttcaccagcctgtttgtaacaaaaagaagcagggcaagcagattctcttgctggaaatttaatagcatgaagttcagtgatgaatagaattatttctcttattttgatcatgctttgcccacagtatgaactcaataaacacttgttcaaacaaattattattacaatgacttgttttttttttccactgggcagtaataactttaatttgtataatgctttatagtttacaaaacatattcttcatgtattaccatttaattctcacagcaattccaaaaggtagatactaatttcttcattttacaaatcaggaagcagacgcccaggtaagacaggtaatttgtccaaggtcaaaactgctcacagagcaagacctgctagaaaacaatgacaatttaaaagaaaactggtcttttaggggaggaagtatagcagaatgggaaagtataggagctttgaaccaaaccacccaggttcaaaccatgtctgtacgatgcactagctctgtgatgatgcacaggtttcataaatattctgtgtcttggtttcttcatgtataaaatgcaagtaacgataatagctgcttagcagtatattagtttgttaggatgacttatatgaagtgtttggcatttattgagtactcatcttaaggactcaataaatagctattactgttacaatgattactctttctgtcctcagaaaagtatcttagtaggccccctcatcctttcaattatcagtacataccagtctattataaattgtagaggaagctgtgagttagggacatagctcaagcactggaggtcctccgtgtgagtcttggtcccacctttatcagctgtgagatcaggagcaagttttcgaatctttctgatggccagattctgcatctatgaaatggtatcactcttgtcctatcagcctcacagtgctgctgtataagtcaggtgagagctgaagggaaggcactaggtagtccattcattcactcattcattcatagcctgttggcagtgtgcctcctaagtgccaggcactgtgctaaacagtggtgattcaaaaatgagtcaagacgatggaggagacagacgggtagaatgataagtaactgtattagaatatgcgttcaagtaaggtattattacaatgcacttatactgaaatagacactttgcgggctataagagtgctttaaaaatgtgaattcagcccacattctcactgcagagaaaagactaaaatcctctcagcaaccacattcaggaactttgccaagaaaggcaggtgaggactccattgtgcctgtcatccttcagcatggaagaactagtaactgcaagggctatgattgtagctgttgttccaacagttctgtgacaacacgtacctcctcaaacacaatgcaacagtgaggcctaatgtcccaggatttattttcattaagtcgatgcttatggaacacctaatatgtgacaatcactgtgcctggtaaataatgttggaaagaacactttgctcagtccctgagggggctatagttcagtgaggcagagatgcacatatactaattattttgaaatagcctgactggaggtcaggaaggcttcctggaggaggtcacacctaatcttaaagggtaagagctagttagctagagaaaggggggacagtatgacagaaaagagaagaacataaagaagatagagactgttctaaaagagttaattatcctagtgaactgctacattttcttctcaaatataaatacttggtccccaaatataatcatattatgtcccgtactttccatgatttatcctataaggagctttgtaaacataactaatactcaaaatgacctatgaggcatgcttgatttcagagtctttttttttttccctaatccaggataccttgaaatgagaataattagccaactgctttgattcaatgtctcctttgaaattgttcgtctactttatttcttcaattggataaataaattattcagaaacctgactatgggagcacacaaatctaaaatctgagctagaattttggtgggcaaaagttcatatctcattacagaagatgtttgatataaatattaattttcctaaagtggtgatggcagagattttatacaaaggatgttcatattggattaaacaccagattcaaattacctgagcctttgcgtgcatggagcatcaaattccatttcatcttgataagaagctgccctggagagtcattagggatttagcaggctaatgtggtccactgcccccttaccaaaacatatgactgtctaaaatattatttatgccttaactgccttgcctagaggtggagaggaaagtgggattttataatatcccatataatataaattttgcccctgaaactgaataactgtatattaattgcctagcgtagatgctcattcgattatacccaatcttcccaaccactctgggaggctggaattttatccctgttttaaaaatgaggaaactggagcacagagaaattaagtatcttattcaaggtcaaataattgagacttagcaaccattgttgtgaataataaaggaaataaaacgcatggaaaatgcctaatctggtgactgacagctaagaaataatggcagccgtggctgtcattaagaaaatctaccatccacaaaaatgtatggaaagtacatttggaatgtgtcctgtgggaagatgattcttgattgtgggtcaggatatggcacaatctgagacgtccactcagtaggtttgcacagcaacttggctcaggcacattcttaggtggctggcaaggaagacctcacagaggcaatggcccatactctctgcaccagaagagcaagagtcccagcaaccaactctctgccaacaagccagacatcgaaactcttcaaacaccatccaagtctgaaaactgcacacctattaaagttgtacctgcaaagagatccttatggacatattccaaggctgtagaattttggaaacttcaaaagctagaactaccagcttgcttggtacagccattgccattaggtacttttgtgtaagaggaatagaaattgtttcttttccttgcttttatgtctactggacagaggactatggctgcttgactcagtgtaacagagtgacaagtaggaaactgacccaaagagatctaacaaaatatacattaaaaaatcattttcctgaaacattcaaataatttcaagtatgtggcatcttagcctgactagtctaaattctagcactctgaaggaagggcttactggagtcctagttcaaccacgtacctgatagtgactttgttccaatgtctttatctttaaactaacgtattaggcaacatcagtgtgtcctgaaacacacaaatgttgaaagatgtttccaggagccttaaaataaaagggttctttacaaaaataaacaacaacaacaacaaatcctatagatatggctcatgtttgtatcctttcttggagagtcaccgtgctaatgggagcatattaaagagcctgaaactccagatgcagacatattagtgtccttcaagtcatcatttccacatttagtgggccatgaagtgtgacacctttaaacaccctgggaaactggtaggacgcatttgaaaaaacaccggattaaatggtcctgaaggttcttctactgctgcatcccatgatcctccagagaaggcttttttttgttttgttttgttttgccataaaggtttatggtagagacatatctgtgaaaaatctctcaattcctctcccatctagcacttgtggcctccttctcatctctctttcctggccttggggtaagggtgcgggcttgccatgcaagaggaggtatcctctatacttccctatagccagtatagattgtaaaactttcctttgaaaccccctaaataaatgaaaacaggattttttttgtgtgtgtgtggaatgaggaaaaaaattgcctgaaactaggatatgaggttctggacacttcctggtttacacagccacctggctttacctccctctcattgctacaaagactagattgattttgtggtcccttcccactccaaaattacatgatgccatagagacatgttaaagaagaatctttatcataaaatcattagcttacggctggcacatttaacaagcatggtgctctcatgcaattcctgtagcaaagacaacctctacaagcaaatgagccagccatttctacttgttctcctgaaaccatcctcaaaggtgggggactctcttaggaagtagcagctgagatagcacttgagatagacacagatttaggcaatacaattgtccatctgattaaaaagaaaatacctgctcaaaaaatagtctttggcctactggaatggctaattaggagtctgtgcagctgatctactgaatggggcagcgactagagagttacacgatcaggagagatgaattgcagacacaccagtttctccttaaaatccattttcatcatgttacactttggcacacaaatcttttttttttttttttctaaaaacagttttccctctttcctactgcacgaagtccaaattcctccaaatgacttctacgggcctccaaaggctggcttcacttgatcgcctctggattttaacacattcgcttcactctagactgtttcactctttggtctccctgcatcaccaccatcattcctcctttttagctgtgtgctttacaggtattatttcaaataacctcaaagcaacccaagagaccgacaccattgttatcattcccatgtcataactgggaaactgaggttaagtaacttacccaaggtcacacagatagcaagcagcagaactgcgatttaagccaaagccatctgtctccagtcttcactcttaactctcagtttatataggctttattcatcttctttcccaagtctgaccactccatcaaggtcaagggcaaatctcacctccttcaggacattcttagatctctctggcctctcacctggccgttccatttgctacacttccccacataacatttcttttctcatgttgtgtcatgctgatctctgtgtgcatggattctgattggactgttagtcacctgaagctggggaccaaataaagcataactcctatatctgctacaatgccctgcatgatgtaaaaggtacatcatgcacaacagaaatctgttcacagaagagttctctgatggtcctataaaggcattgctccagcctcaatcttcccacctgagatacaggtacacctggtccttgaagccaagattcacaaagataaaaaaaggtaacaagaagaaaatgtttatcacccattgatatacgtgacagagacttaaaagtcaagtgccgataatatgaagtaaccacacttgtgttgccataaagcgtctcagctgctactttaaatttggcctaagatatgaatgggcaggagcctctttcctttgaaagactttcccggctctgaatgggccaaaggaaaggaggagggaggaagaggggaaagaagccattatggctttaatagtttaatccaccgatatatgttgtcgacctggccggcctccaggagcactgagaaccgccagctcaagccaacacaagcacatgctaacttgatgggcagtgtaatgagacacagattgtatagctgaatgtaggcacaaagccctcatcaggtttatggttcctggggtcccagcctgaaaacagtaactgacacaggcaccacatgcgctgggtttagacatataaacacggaaggcctgcgaatatatatgtgaaaggtgctggggtttgtatttgtttggcccagtgcatgagctgcagatgggcagattctgttggaacattgaaaggtgccccggtcctgaccgagtgctgttttcttcttactgtgaccacgaggcgagagagtgagagtgagctgctttgaattccgagtatctttgcttttctggaagttttaaagttgagctttcttcttcaatgccttcaattatcacagtgcaaatgattatattcccagcacctccacccaatagctacagaaatttggcatttcctgtcctgactagaaaatgacctggcacagaccgagcgtaagcctggctcttcagcttttttcctgatgcagcctttaactcatttcccctccccactttctaactgctagagaaacaagagattagtgcagatggatggaaatattttttccgcttcagcacttgctgtcagaaccaagtactaagaaggttctcagacagtgtctcaggcaacctggaaattcccaaactcatcttaaacaatatttacctggtcccaaaaggaatgcacagaccaaagaagctgttttcttctgagagcagcccctcgacatgccacttagagttctagtcgaggctggactgctccccgctctcctccactttaccctagctgtttcagagctgtccttgaaacattagcacaccattttagagaccataaaatgaacacttggcagcctgaacacgtccacctgcccaaacatgaatgttgctcttcactgaaaatcatggtccccaggagccaagggttgtaacactctgttgagagtggtggcatggtctttgtctgaaagggctgacaatcaaactgggaaaacacaagccttgctcagaagaattggtagcaagagataaaggccaaggaagtcatagaaaataggtgcaccttatgttcaaagtaagtggttgcaggagattgggaagacaacatggaggtggtaccatttgtggtcatgaaaaataggtagggttttaaaaggtaggaagagagtattactttcaagggaaatagcttaagtaaatgtatctaatcacctctatgttcctactaccatgatgcctataagcagcaatcatactgtgtaccagacactcagatgctctacatgcatatgcatggtacatagcgtaattctcaagcttatgaggcagatatgactatccccatttacgcttcgaagaaattgaacttttcagagggtaaatgacttgcccccaagctgaatagccaatgggtaagatcagctctgattctaaagtgtgtgctcttaactgctcaaaggcatagaagttagaatgtgcagatggtgcaggggagcccctgttgcagagcacaggcctgaggcatgggtcataaggcactgttgactaagcagaggtcttaggcctgaatagcagagatgaggaatgatggaggtggatgatggaagcaatggttgaaaagggccaagtctgcagggaacctacagaggtttatgttaatttctcttgggcctagagcaattatctgggtggtggtggaaaggatgctggcattatctaggttgtggccccttggcctcctggacggggtaagccaataaagaaattgcacttatttgtgaggtttcccttgcattcctctgctcctgtgcacctgactgctgaaggcatccccctcagcttcatctgaagccctttctgagcactatgtgttgatgaaagtgttctactaaatgctatagaactcagcgggaatggcccagttagctctgctagcacattccaggagactctggcagacaggtgtggatttcagccctggctaacatgaacaagctcaggttcctctgcagtatcctagccacagtaggaactcttcacaagctttctggctgggatattcaaggggaggttcatcagtgggtggcttaaagccaaagatttatatcaaattattccttatgtctaacttaagggaatggagagacatgaaaagcaaggtggatttagcacctcttatttgcaggcagcagtgtaccttcatttcacactttctctcacataaaacccctgttgtcctgtaagataggaatcatctcatttaatagactgggaaaccatagcccagaaagtcttaataatttgaccatggtcacatagctggtaagtggtatagtctggtttcaagtagaagttcatctgattcctacccctgaatggttttcccattctgttgaagccatgttggggctctatggaatatttttggtgcctgaggcattaatatgcctatctgtataagatgaggtgtggtgtccagatgaagaggatacccctgggtagcccatttctttatgaagcagagatcccagtttgagccttactgctactcaccctaggattcgggtatggctggtggaaggttggggaggctctagggtgcttcctgggaaagccctcctctgaaaagaatgagtcttgagaggaatagtgtgagggtggggatggagcagaggggagagggtcatgctaagatttcattctgctcctttccttgtagccatatacctgagtcctggggagagacagaataagatggctagtaaatactccagggccctggggagtgtagggagggcagtgctgccttgtggcaaatgcaggtgagtacagccagcaagacttggggtgagatgtcctgctggcacagcacactgtggcctgagcagttgccaagggagcttatgaatgcactgggaggaactagttgagaacactgctgtctgtcttcaatcactgcagccctttggcaaagagcgccacagttgctgatgtgggaggaaagggaagtggtggctggagtggccactgagaggatggcttcagaagcatatgcaagtgacccttctgggagaagcagtggtgcaggggcagtgggtaaggagagctcttgtttgagactcttgggaaccataagttgcactgaattacgccatactaattatgctatggggatgttccctggaccaaagagaagcttctcttgctctctccctccctgtagcaaacatttattgagtgccaacgatgaaccaggcatagattaggttctagagattctgagataactataggatgaagttatccctcaatgaagataccttcttagtccaacaggactagggtattatgggccttgggtactgcagtgatctttaagcccatcagcaccagtggaagccccatgtcccgccaccagtttttgacatcttggagctcatggtccacccttccttcccagcatcatttttcaataccctgtcatagagcatcccagcaatagaacacaaatggcaaaatatcaccctcttctcagtcctgttgcttctctcaccacctagttagtgtcctggtgttgtcccaaggcccagtagtcagggcccaaatccaaatgtagaattagcaatggtctctgtacactgggcttaaaactaaattccagcattaaggaaatgcctaactgtataattacatgagacacagagagtctcacattggaagaacttaatatatctgagcagaagaagaaactagcccaacacaaagccattttacatctttgtaaaacaagacaattcaataaacatgacatcaaggggaatgagtcctctggagagggcagaagcctctttcacattgatgaagctattaagatgcaaagaaggttgcaacttgatttctctgtttgcaagcgctatttttctccccaagcactggtttctttaattttcttttttccctgaaacactaattatgccaacctctttctctactcaaaacctgaccaaaccttcaccctgtctcacacttatgaccctactacgaaccctccccaatcaggccagtccattccctgtccatgtgctagaattttaatatatatgtattagtttgctaaggctaccgtaatagagtatggcagccataaccaagtaaccataacaaagtaaccacccagtctgagtggttaacatgacagagatttactgcctcacaaggctacaagtctgatatcaagaagtccacagacctggttccttctgaggatggtgagggaagggtctgttctaagcctttctccttggccactcaatggtcatcttctccctctttcttcatatcaccttctctctgtatccacatttcctcttcttataaggatatcagtcctgctggattagcacctaccctagtcacttcttttcacttaattacctctttaaagaccctatctataatatggtcacatgctgagtatggggattaggacttcaacatatgaattttgtggtgaggggacacaattcaactcataataatactctctagacatggctttctgattggtttctggaagatgagttttatttcccagctggctcgcacattccaccaatgtgattcatttctgttttcacaaaacttaatggctagttgacttaatatttaaaatttgtaagctccaagaaagaagggactgtacctttcttgggagccagtgctaatcctagaacaatatctggcacatggtaggaatgtattagatgaatgaataagtaaccagaatgttacacagtgggattacatccctctgaccttccagagactggccttctttctagagaacaacctgaccttggctttcactgtaagagagaatgcttctacatttctgataaacctggtatgttgtaaatatgttgcatcagccacagaagtaaacacatgctagcaacaacaggcagtcaaaatactctttaagtgtgattgaatagaattctgattatacagtttagccaaggaagtcggtccagctcagcaccaattttcactgtcaaagccaatttgagcaacttgggactgaggtttaaactctcaactgccatgatgtttctgcagggccatgaatcggtgtcatagctttaggatattccactcttctgccacctcagcagaatgatcctggaaataccctaaagcagtgcattacccaaaatgattatccatgagtccaactgggaccaactccctatcttctacagggcatggagatagattctaattagtagcagaacctgaagttaagagttcctcaagacacatcatgactttaagtccttgctatttgtgtatgtatatagatacttaaatattttttgtagattttttaaagcatatgacatataatttttgttatacatcggcatatatatttatgcattgacagatgtaccatatttatatgcatgtttacaaatatatgttttcacgtatcatgtgttctttttagcctctacttcattacccctacccccaaatattaccaattaacagagaatttgaattgggaatcagcatcaacaaaatgtgacaacatcgaatggagctaggagggacagaagcagttaaagcaaagaagtgcccatgtccctggttatgtctatcattatgacgtgctcctctccatccaaaatgactgacgggcctgtaatttgttgttgctgttgttttggcacatatttgcagaaacaaacttgttcatggtccccctgctgatagctcaaccatgcaagtgccataggaaacagactttggcatttgagctgctcacagtctgggtcattcataaaagtttaattttctaaaaatattcagtgaggtgcttttcctgaatgagatgacttctggttcatcaacgtatttatgtgagtaaatagaaggcagatcagtaagtcaggaatctaatcagctatcatccagtccatctggtttaattagaaagcccagccgctcacaggcaccttttagtaaaaggcttcagtactggttccagaaaggcgggggtgcttctgaatgtggttacaaatgcttgccatctcccctgcctccacagagccccttatcaaactcccatcacagaacacacttgaaacatatcagtgcatgcctcttaagggcatgcaaatgaagctaaaatgtggcacaggggaaacaccactgaacatcacggccagtccctcaattcattcgataagcatcaacttaagcaccaataataaatatgtattggtgcttacgctattccagagactgtgtgaatgagctttggactaaccctggttggggagatcaggacgtaaacagataattcccaaactctgagatgcactctaaggtattgagggagccccaggactggaaacctgctgagctgactctggaagggcacttgggagcaaatatggacagaaggggagcaaggaaggttatagccaatagtccttaaacatacgcatgcaccaaaaccttggtgcattacaaattgtgggtcccaccctcagagtttctgattcaggaaatctggggtggggccagaacattttcgtttctaacaaggttcctgctgattctaattctgctggtttggggaccatactttgaaaatgggctaatagggccaacccaggctcacactggaatcaactgggagctccaacagctactcaagcctgggtctcctctctggagtttgtgatttaattggttttgtatacaaactggatatcagggattttgtctgtgtgtttgtattttaaaaatgtcaaacttacagaaaggttgcaagcacaacataaatcttttttttttttttattaactgagccatttgagagtaatttgttgtcttgatgtcccatctttctttgtagtgtattttcttacaaataagaacattctcctacataactaaaatataaacatcaaaatcagtaaattcgcatcagtacattacaaccactcaagttttggcaaatgtacccatcatgtttttgatagcaaaatgatctagttcaggatcacaagctgcctttagttgtcatgtctcttcttcctcaatctgaaacagtttatcaggcctcccttgacattcataaccttaacacttttgaagattacaagactgttattttaaaatacgtccctcaatttggatttgtctaatgtttcctcgtgattagatgcagctgtacatctttggcaggactatctcagtagcaacttcttactgtaccctatgaagtggcccatggtttctgtgtgtcccattactaatgatgtttacttgggtcacttgatcaaggtggagactgtcaagcttctccactgtaaatgtactcattttccttttgtaattaataagtcctttttgcagagttctttgaaattatgtaaatactttgtcatcaaactatcaattcattaggtaataatctgtatcacaggaaatcatggtttcctattttgtatattaggttataatctgttactatcattatttctttgagaccagtgtgggcccttcaatctggctctgacttctgggtttttaaaagctttttgggtgattctaatgtgcagccatgcttaagaaccacttctctaggtagaccaaagcacctatattcaaaggatattcacaggattgcaggcaacatgcagcagcctcagggaactgcaaggttttcagtgtggctggtggacaggatggagaaggagatgaagacagggagagattcagtctttagattcatctgagcccagacagcctgatcatcattatctccgatgacagcatcctatccctctctacacaccaagctatcactccatacacgatggtggtactgcctcacagttaggtacatggttttcagcataagggagggggtttgagttcctgctccaacacttcttagctctgcaaccttgcactagtttcctgttatgggctgaatgtttgtgttcccttccaaatttatatttggaagccccattgtggctgtatttactcatggggccttgaaggaagtaattaaggttaaatgtggtcctgtgggtgatgcctgaatctgataggattagtgttttcgtaagagataccagagagctcatgtatgtgcactcttgcacgcgcactctctttctttctctctctctccaaaaagaagcggggaaagaagaggtcctgtgagcacacagccagacggcagccgcctaccagccaaaagaggcctcagaatgaaacctaccttgctagcaccttgatcttgcacttctcagcctccagaactgtaagaaataaatggctgttgtttaagccactcagtctatggtatttcccatctgtaaaatggatactaatggtcctatctcatggaggtcttgtgaggtttaaatgagaaggaaacaaagtactcagcatgctctctggttctcagtaaaggcttaacgagtgtcagctattgcttcacttgtcctcaaacacaccctgtacattcccacttctctgcctttgttcatcatcagttcaattccgcaaacattatttcagcaagtccccactgcgtgccaggcattgtatgaggtcctggggatatagaatgcaacaagacctcgtttcaagtccaaagcctagagtgaagatgctccccactgctggccttggtgaagctgtttcagattccatttggaataaagggactgattcacaagaggaaataggaacttggtttgaaacctgtttcacagcattgggctgctgagaaaatgagtaaatcataggattagatccaacaatttctcatagtatcccttggttttatgatattcatatggtaataaagccctctccccagcttaccagtaattatctgaggccctccaaactaatacggttgtgtattttttccttgacgatcacagagattttttttccctttgtgttggtctcaggtataagaaaatcacactctaaaatgaaaagaactgtgaagcaattaagcaaaaatggaagggccttcctatgctccagtgaaattcagacaggagagagacagaaacattcctgagccacgtgcaatcatcacttatagcaggggttcaactgactcatgttggaagaaagcatagtcataattttatacttcctttgggggcataaacagagaagtactttctttgtttttggatgagaactaagttaggatgagggagtcaaaatgagtttgagaagataaaatatgaagagtccaaaatgtcacccaaagtccatattgaagcatggaaagggacatcatgccatgtgttagaggaaactcagctttggcttggacacttttacagaagccgccctcctctggactcccctaacactgcatttgtatctccactactgcctttcccgatttcctctttgctttagagtgtttgagtatgttccctcctagacagtgagttccttaagggagaaattcctctctcatgggtccttgctggtgtctcccatggcctagcacaaagcaggtgcacactccccactcccaggcccgcatgtccctaactgcagtgggtggctgggcacacggaggatgcggatgtccaacatttggccttggatccagacatatcgtgcttttccctgctgctggaaattcccactctgtatggtttttcttaatatctctgtgattcttctcctcactccattgcaatccttaaatatttttcctcttcccctgtatcattctcgacctcagaactaacctttctgtttatagccaccaagctcccttttcttcctttcttaaagcatttctgcaaacctcttaaaagctcttttacagacatgaatggtggatgaaagaccctgcggaggtgttcactaaagagtcacattctccttccttttggccagtaagaatgtttaggagagatgtggatgttccttcagttcacaggcagaacttgctcacattgggccagagagagggtgtggagctcctgacactggccctcccaccattgggctgtctgggccagggcagtggttcccaagctgcattccctgaaacctgaagcttccttggccctccaggcctaaggagagaacaagaatgggagaggagagtggatggggtcatgcctcccgaattcatgcttcaaacacagccactctgccttcatctgttgtacagattaggcttctctaagagatccgggaagaaaataaaaatggtgccactgctcaaatattttgtaagccattggagtagtgggaaaaaacagccagtcagatcaattgaatgttggcaaatccttcctttaagggtagattggatttgcatattggaaaccatcaagagccacttggagtcaagcctggtgaaaaaataatgtgagcacaaggaataataataccactggaaggcaaaacaacaaggacaacaacagcataaagagcaggctgcagctatgatataaaaatacgcatgtgtatgtgtgtagctcacgaagcactcccgggagaaactccccaaccaagcatctgtgatactgttggaacaagcacataaactgaccttacaaggtgatgacactgaagcttggaactcactggtatgcataaattctcctgttcgttatgagtatggctgagtgttcgttatgagtatggctgagtgtgtgtatgcatgtctcactgcacgtttcactattttaaaataaagtccaaaatttctctagtctttggagaaaaaaaatgcctcgtggtgtttagtctggatttaaatgctgctccaatgcttactggctgtgtgatcccaggaaaatcatttcaacttttctaagctcagtttcatcatctatcaaatggaaataataatattacttactacatagggattttgagaagtttaaatgtggtaaagcatgttgattcgtcagcataaggactgacaaaagaataagttctcttaatagttgtggctcttagtattataattgctattatcattatcctctgacctgagtatacctgactccagcatacctggccagaatgcattcaagatccccttctctcttcagttaatagatgaggtctttaattgactgagaagcatttgggagaaaaaaaaaaaacaatcaatgaggggcaactttgctaagtcatccgatgactcatgggaaatccggaattagaacaaaaagtagaggcagtttggtcagcagggcatggggaggacacgcatttaagccccatgtattttggtgtgtggagacgttgaaaaaagaggtagggagggtcctggaaaggaacatgaaagatgctgaaacctgagggcatcttaaaatcacaggttcactcagtgtcagagtgagatctgtgagaaccctcattctagtctacacaccgtgaggcccagagaggtgaagtttcctgcccaaggtggcccagctcctgggtggatgagcagtatttaagcacttgcttatctcctgattcaggagccactgactttttcctgccacctacccaatttctctgccacccagagggctctgtctgagctaaaagggtttatgagggtcgggcagggtggctgagcagccttcgcccagtgctctgaaaatgctctggtttttcaagtctgcagcctcaaagcgtagcctgcagtagttctcctgtctcaccttctactaaaaatgttcactctgaaacttgtaacagtggtgacctctgacaaacggcacatcccagctgttaacattattcggcttacaacagaagttgccctcacgacccttgtagccaggcccagggaggaggtgacactgtcagggccaggcctcaagaagaacaaagagaaaactcaccttggcactcaaggtctgggaacggctggtggctcgatcaggctccctgcaatcactcccttctgtaaccgtgggtcggagacatgaatgctgcctctggactcgccaattaggcccagccatggggctgcggagccccacacaaggaaaccctattagcaattagctgatggaggatcactttataccagggcttatttttagcacactgtcaccttttcactggggccaaaccttttgtatccaatccatacctgagttgcaagacattgcatttcaaacctctgttaattgacttcattagttaatgtgctgctccttgaatcccgggggtaaatgagcagatgaagaagactaatttaaagaaagtctgcagacaacagaggaggagggatgcccctgcccccaccctggcccccgtggaacccacgtcaaggagcatcagattctccccaggcttaactccattagtcatccctgagtcctctaatgagcttaggttatttcctgtttttccaggttttgatgaagggagctgtcataggaaatatgaagactgtgtctgtatctgaaccccaaagcagctctcttcaccagcacccccttgccagctcatttcagttcagttgtttcacctctcaggctccttgtctatacattgggaaaaattgctgcctcacccatttctccccttcacacagccagccaggtagttctgaggagcaaagccctgctaaggagagtgtgattagctccctggggtgataatggaagtcattcactctgctttttctttgtggctcctaagttatcaggacccttaagagccaaaatatatgaaaaatttgttctggagttttagccctctaaaggcctcattcattccacgtgcactgagtctgtgccaggttccttgtaagcggacaggtatagagaaatcccaaacaaggccccccaaagccacagatgagtggcagcatcatacaacttaaatgccagggcctggcctcatcctagaacagcctccaccccagcgtggggcaaggggaccaccgtatcaggtaacttttcctgaaggaggggccctcacagcttacagaacctttgcaaacaaagattcagccagtgaagaaagggaggtggctttcctaggcgttgaaaagaggatggggaaaggctggcacatctggggaagggcaagcaacactgttcggctggacatggtgaacaagtgtggacctgaagaggtgggatctgggcaggtgggccaaggccagactgcagagagcccggaatctttcctgaatgggaggggagctgagaggctactgggatttcaacaagggaagaagcatgatgaggcacacgtcttaaaaagataactgtggagagagtcaagggcggaaggggcctgggcagggtgagcacagatgcccttggaagctgctgcacctagcagggcttggggagcaagtcgcctgggcagggagtaatgggggcctaaacaatttcaatccgtcataacatacattgtgaagatatgcaaagctttagaagtgagatccgaaaagagaaagcaggcaaaccgagtactgggtgcctgattctaggaaggtgtcccggtctgccaagttccttcccaggctgagtcctgtcactgtcaaggcatcttcctggatttgtcaagtaaggcttgagctctgacagaccttctggaagaagtccattttcagtttgccagacttaaaaaaacagtaagaaaattggatcctagaactcactctggagaacactgaaatgaacatgtggggtcctattcagaacatgtttgccttgagtgtatggaatctgggtcaccttcactgaaagcccctctccctcggaggctaagctggatttctggggccctccacttctctccaggaagtgaaggtaatcatgcgtatgtgtgaggagtcagaggatgaagagtgaatgaatggaaaataactgatacagtgttaggctgggcacaggaaacgggagacccctaacagagttccctgattcttacatgcttgacatgtgtcccctcttacttcacagccaccaacactaaacacatgcacacgtgcatacatacatgtgcatacacccacatctcagttccaactctcagctaagagttggcatttgcattttgtgaggttttcttgggaggggacctttccagagagccacagatccccctacactcatctcttctcctcacctaccagcagggactggcttgggccatataagctggaggactcatgtaacttctcttgctttaaggtactttgctggaggtggagcaattaatccacaactcagcccagggaagcagacagcagatcgtcatttcactaatgagattgctgagccgtggctcggagtgcgtgggcctggccaggtggagacttgatgctggcaggaggggcgttagaatcctcacctacctaagcctgtggtggagcaaacagccctgcgggactcaatgcgtgtaacccttggattttcacccaacagttctgcaagtctctttcctcaaataaaccatcccccatctgcataatatggaagctaagtagatcgcccacaaagaaaagagaacaatcctgtataaaatgaggaagccagactaaataattccaaagtgtctttaggcaaatgcagaccagaatacagcatactgaagatggatccttctagacccactccttctgcttgtctggaaagcccaggcctgccagcatcagcggcgacatttcaattctgccagtttgatcagaccacgtggattttctctctccaatacaccagctgataatgaagagacaaatgttagctaaggcagccctggtcaatcccaaagtccttagatgcaaaagacagggaaggtgctaatcatctcaggaggagaccccagacgggctcattaaaaccattataagaaatccctatctcccccaccacacctccaaggaaaccctgaccctggtgagtgagcagggattgcaggggcttcccttgcaccagttcttttggcttaggagggaggacatggcccagctcacccaccacctgcagcagcaacagcagcagccattacctttgaaataatcctcgctcgcacaccaagtatttgttatgagtctgtgcctggaagtaaatatcacttctgtttaggtgaccatgtgtcctgggtttcccaggacagtctggtttatgcctgttgtgctgacacacatatgattagtacctactgccatgctgaaaagcgtcttgtttgggcaataatgtatgtggttacctaagctctaccaagttgtttcaaaactgattggagggaaaaaaaaaaaaaaaacctatagcgccaccaacaattaaattataagattatttttccaagatcacagtgactcaaagttttccctcatagatgttatatatttagtttgaggtactggtggggagggggtcgtaaatgcaattcagtgttataagattagacaagcaagaatggtattctgtagccttacgaaatcacaaacacatgtcagtcgtcagtttaacaaaggatcctctgtttaaaaataaaatgttatgctaaaaacaaattacatttaagtaagtatataattatacttatttttaaatgctttcctatgaaaagaaaggttttcctgtttttttaatgagataccattcgataatataaaattaaccattttaaggtatacaattcaatagtttttggtgtattcacagttgtgtatgaccatcaagactatctaattccagaacatgaccccaaaaagaaaccccatagctgttagcagacaatccaattccctctccttcatcccctggcaaccactaatatattttctatcttgatgactttgcctattttgaacatttcctatgaatggaagcacactgtatgtgtcatttcatgtctagcttctttctcttagcataatgctttgaaggttaatccatgaggtagcatgtatcagtattcccctcctttttatagctgaataatattcctctgcatggagataccagattttgcatgcccattgatcagctaatggacatgtggtttgtttccacttttttgctattacaaataatactgctataaatattcaatgtacaagttttcatgtggacatatgttttcaattcttggatatatacctaggaatggaactgctgggtcaaatggtaactctatgtttaattttttgaggtactgccaaactgttttccacagaggctggatcattatacattcccacaaacaatgattacgagttctaattacttcacatcttcttcaatctttcttattttcttcatcatcatcatcatcatcatcaagatcatcaacatcatcatcatcacaatcatcaacatggccagcctagtaggtataaagtagtaccttactgtggttttgatttgcattttcctaatgaataattttcatgtgttctttcatgaacatctttttgcagtggctttttgtgtatctcctttgaagaaatgtctattcacaccctttgcctattttattttaatttaatgattcagttgtctttttgtagttgagcttcaagagttcttacatattttggatactaatctcttacaaaatatcctatatacaaatattttatcctattctatgggttgcttttcactttcttggtagtgtccattgattcacaaaagtttttagttttgttgaaatccaatttaccaatttttttcttttattgcttatgtttttggtgtgacacttaagaaactattgcctaatccaaagtcctgcagatttatacctatgtttctttctaagagatttataactttagattttacatttaaatctttcatctattttgaattccttttttgtacatagtatgaggtaagggtccaacattattcttttgcaggtggctatccaattgtcctggcaacatttattgagaaatttctctcccatttgacacccttgttgaaaatcaattgaccatacatgtatgtatttctgtgtggactctcaattctattccatcggtccatatgtctatccttatatcagcactacactgtattggtaactgtggctttgtaataagttttgaaatcaggaagtgtgagtcctccaactttgctcttttttttttttttttttgagacggagtcttgctcagtagcccaggctggagtgcagtggtgcgatctcagcttactgcaagctctgcctcccaggttcacaccattctcctgcctcagcctcctgagtagctgggactacaggcacccaccaccatgcctggctaatttttttttgtatttttagtagagacggggtttcaccatgctagccaggatggtcttcatctcctgacctcgtgatgcacccgcctcagcctcccaaagtgctgggattaaaggcgtgagccaccgcacctagcccttgctttttttttttttttttttttttccaagaatattttggctatccaatgtccctttcattttcatttgaattttagggtcagcttgaattttaggatcagcttgaattttagggtcaactgcaaaaaagcagctggaatttgacaggattgcattgaatctgtatatcaatcaggggagtattctattttaataatattaagtcttccaatccataaacatagaagatgatttctttcaaaactcttttgtagttttcaatgtataggactttcacttccttggttaaatttattcataactattttataatttttgatgccatttcaagtggcatcactttcttaatttcatgtttggatttttcattgtaagtgtatagaaagacaactgatttttggatattgatcttatatcctacaactttgttgaactcattaactctaataatgtgtgtgtatgtatgtgtgtgtgtgtgtgtgcacgtgtgtgtttctttaggattttttagaaaatcatgtcatccactaatagaggtagttttaacttccttcttctaatctggattctctctttctctcttccacttctctcatttctaactctctttctcatctaattgccctggctaaaatttctagtaaaatgttgaatagaagtggtgagagaaaacatccatatcatgtttctgatattacagggaaagcttccagtctttcacagttaagtatgatgttagctgtgggtttttcatagatgccttttattaggtttaggaagttcccttctatttctagtttgttgaaagtttttatcacgaaaggatgtgagatttggttaaatcctttttctatatctattgagatgatcacatgggttttcccctcttcattgtattaatatggtatattgcattgattgactttcatatgttgaacaaactttgcattcctgggataaattcccattagctataatgtccagcccttctaatatgctgttggattctgtttgctagtattttgttgataatttttgcatttatattcataagagatattagcctgtagctttcctttcttgggatacctttttctggtttaagtatcagggtaatactgacctcacagaatgagttagaaagtgttccctctgctatttttttggaaagattttgagaaggattggtgctaacttttctttaaatgtttggtagaatccattgatggagtcatctggtcctgagcttttctttgttagaagttttttcttgctaactcaatatttacttttataagtctattcatgtattctattttatcttgagtgtcagttttggtagtttttatatttctaggactttgtccattttatgtaggttatccagtttgctggtatatagttgctcattatattctcttaaaatccttttgtatttctgtaaaattggtggtaatgcccttctctcattttttaataactttactactttcttttatttctcttcatcagactagctaaaggtttgtcaattttgttaatcttttcaaataaccaacttttggttttgatgattttttttctattatctattccattgatcacaactctaatctttattattcttttcttctgtttgctttaggcttagtttgcttctctttttctagtaacttaaggtggagtttaggttattgagttcagattttttttatgtaggtcaggtgtcatagtgacaaactatctcaatttttatttatttggaggtttcttaacttctcattcacttttgaaggataattttgcaagatacaaaattcttggtttacagtattttttttttttcagcactttgaatgtcatcacactgcctttggcctccatggtttgtgatgagaaatcagttgataattttactgaggatttcttctatataataagttgcttctctcttactgcttttgagattctctattcgtctttgattttcaacagtttgattatgatgtatctcagtgcagatctattctagtttatcttacttggagttcattgagctttttgtatgtatagattgatattttttatcaaatttgcaaagtttcaccattatttcttcaaatcatggttctacccctttctctctcttctctgagacgctctttatgggtgtattgatgggcttaatgtcctccggtctcctaggctctgttaatttttcttcatctttttctttcttgttcctctgactggatactctcaatttacctgtttcaagtcttctcattctttctttggtctgttcaaatcttctgttaagcccctctagtaattttttcttttagttattctacttttcaattccaaaatttctatttggtcccattttataatttatatctctttattggtattcactatttggtgaggtattgctctcataacttaactctttagacttagtttcagctttttgaatatatttacaatagctgatttaaagtctttgtctagtaatgaactcgttttcactttctcactttctcaaagacagttactgttgattgctttttttttttctcctggtatgtgccactgatgtttctttgcatgctttgtaattttctaattgaaaattgaagattttgaatatcataacctgggaatcagattctccctcctctccatggtttgctattattgctgttattttatttgttgtttattcacttttccgaattacttccataaaatctgtattctacgtcatgtgtagccactgaatgcttagttagcttagtggccaattaatatttgaatagaaatatccttcaacacttggaactaataaatcatccactcctagccaaggggctctgtgtccattgtgtgtgggggtgggaggataccttcaacactcaaccaggcagtttactactcagcctttgccttcacttcctgattatgcgtagcctaatggccagccagagttaagagactggggcctgcctgcatttttcctgagtgtgtgcacagccctggacatgtgaatgttcttctaaaatcttaagaacatgtaggaccttttcaaagaccttattccctacagcatgtcattccctagactttgcttccaagttttttggctagtctattgtttcccccaattgttatccattgccttagacagtagagaagaatgtttagaccgtgctcccttgggagcagcttagtataaagcaagttctcagtcaggagagataaaaacatgtgtctagtagcatgtcttcaaggcagccaccagatagatcaaattagaattttctgtaaataaggtccattctgctccctcatatgcctgcactgggaatgtgggttgttatttcaaggctgctgctgagctggggattggagtatgggattcagataagttaagacaccacagttttgcttttttcattaagaattgactaaggttttttgtttttgtttttaaataaatgcttcccagagtacttcaagtatttggttacattccagagttctgaaaaagcacattctgatggttattgccactttttttctagcttttatagaagggtgaacttttgggattccttattccaccattttctctgacattacttgttgttttgttttgtattttcataaaggcgaggcacctcctgcttctcctggatgtcatgggaagccagctacctttatagaccttgaagaagactggcgggtggggagtgggggttgggggtttctaggtataaaccaaaaattaaattcttagtgccaccccctactacaaccaactgaatggcccctcctctcagccaaagggatttcaaagaaacctgcaaaactagttcaggccatgataggaaggaaccaggaaagagtggttggacatgtttcattatactctgttccctttggcatccaggcacaactgaccagcattaacaataaaacagagatcttaagactaacaaaatagactctttgtagcaataagataccaaattccagcctgatgctagtatagcgtcacatgacatagcaggtgctgaaagtatcaaagtgttttaccccaaaatatatttctttgtcacattttgaaatagccctgcaaagctgtctctggtggggaaaatttacattctatagagaatcctcttccctttctagttttttcctgatctgggagagattttaactaagagtctggcaccttttaaggtctgatgagagacatacaccctctattctgtctgaagcctgctacccagaggcttcatctacataataagaaccttggtctccataaacctttatcttaacccagacactcctttctattgattccaggtctttagataagaactctttcaaccaattgccagtcagaaaatctttgaatccacccatgacccataagctcccactttgagttgtcccgcctttccagactaaataaacgaatgaatacatacctcaaatgcactgattgatgtcttatgtctccctaaaatgtctaaaaccgagctgcaacccaaccaccttgagcatatgttctcaggacctcttgagactgtaccttgggccatggtcattcatatttgattcagaataaatctcttcaaatattttacagaatttggcactttttgtaaacatagagaagaggcagaattcataatttttgatttgtatatttcatagcaaaattgtaactctgctgtgtttttaactcctaaatactcctggattggtaatatactggggataataccaaaaactgtttctgagaatatgttagtaggataagaaccaagatgtgaagaacaattacagagtttctcatatacaattattttctgattcactttataagaacatatagcaccccgattgagtaatgataattaacaagatgcttttgttcctttaggttttaaaaattacactttccctatgaaactagatttaagcaatggaatatcttcaggataatactcacaaagagaggttggagaagggtgcattctacatatatttttgttgtttttaaaaaagaatcgtgacaatagtaatagcaattaattgcttttaccaataatgctactaattattttaattatttaatattagtataataataatagttattattataattactactgacagttacctacttacaagtcttattggagagagtgggggaatgtggacacataaatacacactatctaatgtctacaaacaatttacacaatataggaggtaacatacacaaataataaggcactgtctgtaataaccagtgctactcaaagttcatttggagcagagctgatttgcaagcttgttgttattggtttgagacaagataaatacagaaattgagagtagtgtttagaaacttacagcactttgacaatggggcacataccctccaaagtgaaatgtgttgtctgtgacgtttaataataataagcctgggcttggactacatatgtctttttttttttttttcctgtttcattcttctggtaactcattttgattatttccttctttaacaaaagtattggtctgcaatgaattgggagggagaggggaggaactagttcttcactatagacaaatgtcagtttagaagatctatgctgtttggtttgggaaatgaaaggtttgggctacatttattgtttgaatttggagggacagagagattactagggactagagtggtttgagcaggatttatggaacaagtgtgacttcacattgttacaaattataggtgaagaatgaaggaacattccaggatcaagtttcctaaaatttggaaataaactgtggaaattctcctaaggtttgtatctttcttgtctgaatctaagaatctttttctattatgatgagtgagatcaggaaatgaattaaaatattttaatttcctccttggttttgaagttctttaaagaagggatttagaatttaaatagtatggttattagtatctttgagtgaaggagaaagcgtaaattaaatgtcgtctcattttttaaattaggtagaaaagcttactcccacttaagaaaaagaagaactaaattaaaattcgtttcgccctgagagcaatcagtatatctaatccaaattgagaaaaatgaaatcctttttaaattttagtacctgtatgttcaaaagccataattctgtttggaaatctatgaaggtatatttttctcacatacgaaaaattaatcttgtgctaggtaagaaactcatcctctttttttttttttttttttttgagatggggtctcactctgtcacgaggctggagtgcagtggcacgatcttggctcactgcaagctctggcttccgggttcaagcaattctcctgcctcagcctcctgagtagctgagactacaggtgcgcgccaccatgcccagctaatttttgtaattttagtagaaacggggtttcaccatgttggccaggctgatctcaatctcttgacctcatccgcccgctttggcctcccaaaatgctgggattacaggtgtgagccaacgcgcccagccgacatgttttatttaaatcaaggagttctcaaaaattaagagtttatctgaagatttaaattaaaacttccacagtatttgaaggctgtgggaaccacaacggatccgaatcaagttacttaaacttagcagtgaaaagtccctgggccctaagaagctaagacttcctggtggtcccacagcaagacataagtaggtgggactagaatataggaccctggattgagagtaaaggtagtacagtcaactgatttcttcttttttttttcctggagacggagtcttgctctgtcacccaggctggagtgcagtggtgagatctcggctcactgcaacctccaccttctaggttcaagccattctcctgcctcagcctcctgagtagctgggactacaggtgcacaccaccacacccagctaatttttgtatgtttagtagagatggagttttaccatgttggccaagctggtcttgatctcctgatgatcagctaacttctaatccaacatccttacttttatagtttcctatcactacaattagccccttcagacatgtgcttttcgagttcctgaacaatttgaggccacctcttcattaattggccaaagttgtcagtgatcataccaagttagacagaggtgaccggctaggtgagaagctggtaactgtctttggccatgggagctttagacatgggctcatctgaggacaacacaaggttatcagggacagggtgaaggctttctttcaagttcacagtgcccagacacacagaccctgagtttttgaaaggctctgaaagtgcttagatcataaagcacacatcacatgctgtagttgttgtcattgacctgtgtttgtctctaactgcatgaaaactctcaaagctgtcacatgggggtcaggctgggccagtaggattgtagaagtacggaccaacttccacgttttcctgaagtatctgctctgtctcagtttagggggagacagaaccacctagaatcactgacaccttgattcaacacaatccgcagaccgggtgattaaataaagcactttggttttttcatatgtttgtttgttcattttctttgcctgtcctccactcaaagcactttggattcagctacttcggatgtccagtaatgccaaacattcctggaataagactaaacttgcctctccatggaaagactggtaatcacataacaagggatatgatgatattggtagcatgctgaggtcagctgggtagactgatgctcagaacagatttcaggactaaagacatggggttataatgtctcattatttcttcccatgccacatggatggtgtctccttattgttgggcacgtcattctcacctccgtgccttggtcccagctgttccttctttcctggaggacggtctgtctaatcataattatccaagacagactccagattatccaagtctgcttattcttcaaagctcaactcaaatcctaccaaaacagtactgcatgatgggaaaaccatggacttcgaggttgaccagatctgagatgggcaaacaacctctctgaatcacagattctttatcataaaattctgggtcatagtgaggattaggggtgctcaaaaatggtaagtattacaactttcattattccagccaattactgatgcccttctctcattaataccaaaaacctgagacttataaccacatccttcaggatgtgtatgatttgtacaacattttggggatttcatcgtctccccagacattcttgagggcagtgaaggcacctcacttctttgaaacagagattcagttacactgagtatccacttagggagcccttgctttgtgataagtactgggctgccttcatttaactctccaaagagtcctgaggaagcaatttttatctcagttacagacaggaaaactgaggctcagatttattggttgcatgtccaaagctgcacagctagcaactggcactctgatcttgaaggcaagccctctttacctacaagtgctctccacacagaaggggctcaagtgcaaatactgattgatgggctggatcccactcatatcgctggtctaattgcatccttttcttcgtggcagcttggcctgctgtcccctggctgccaagatgttcttactcacactgctctgccttcactcttgccattgtgttgagaatccatcaatacaaagctgtacaattctaagtacccaggaagtgagcagaccatattgcacagggcaactaagtggtaagagtgaaaacagcgtagcagacggaagccctaagcaggtcctccaggccagaaggagggttgggagagggaagacactgggggcaagtgacagattacctaatcctagaaacaggtagaaatattaattccctttggggtagaaagtcagaagcaaatgtagctacaatcagtcatagcatgctaatagccaggaagtcacatttgatgctcctggaaatagactgctcacctcgtaggtcagaaggcaattacctccattcagctcaggaaatgcctatttttcaaccagtgagcataatgtttggggatttttgctcatctgttgttccgcctccattggaaagaatatataaaagtcatagccaaaggcaaaacacttgccccgctgacaaacagcccattgaccatggcaaatcctctactgctaaactattagaattacgactcgctgcttccttggcaaatacctgccctagatgaagtgctccaaacgctgtagctgtctctgtctattcccacccctccaaagactctatgatgtttaaaggccacctgaaacattctcaataaggtacacaatgcagtttaacagacactaacatcttaaagggctgacctagatttatctactccaggtgcacagagattggtatgtgcaccccactccccatttccacttacttttcagttgaaactactatgatctcactgtcttttcttttacaccgaaggaaagaaggaatcatccagaaagggtgcgggttgtggggcgggcacagtgataaaggcagaataaagaaagaaaagggtattttttgaatgtccaccatgtatacatcatcctgatttaaacctaatcaccttcagggaaaagtattcttattttatttctattcaggtgaaaggtccatcagatgcaattagccattttaaagtgcacaattcagtggtatttggtgcactcacaataatctgcaaccactacctctttctagtttcaaaacagtctcatcgcccctgaaaaacaacccatacttattaagtaattgctccccatccccttctcctctcatgtcctcttaatgactaatctgctttttgtctctatggatttgcctattatggatataccatataaaagaaatcatgtaatatctgaacttttgtgtatggtctttcttttagcttaatattctcaaacttcatctaagttgtagcatatatcagtacttcattcctttttatggctgaataatattccattgtatgtaaaaaccactatttatgtatccattaatcagttgatggatatttggatggtttctgctttttgtctattatgaataatgctgctctaaatattcaaatttctgtgtgaatatatgtttttcttgggtatatactcaagagtggaattgctgctttacgtctgctttaagatggggaaactgaggcaggaaccctgcctgaggtgatttagcttgttcgtggtagagtcaggattggaatctagtccagaccactccaaaaccactttttttacttttgtttttataagaaaagtagtccattcacaggtccatccactatacttagaacttctctggctaaaaattcagtgaataactatttttgtcagaaattactaacttttactctccactcaaacaccctgaggtcgagtcaggattggaatctagtccagaccactccaaaaccacttcttttacttttgtttttataagaaaagtagtccattcacaggtccacccactatacttagaacttctttggctaaaaattctgtgattaattatttttgtcagagattactaactttccactcaaacaccctgaggtcatatgattaataccactaatttgaactcatggatccaatagtttcatttggttcatgctgagatctgagctttttgtttcccaggaaaatcaatagcagcagactttatcttgttagatcaaatataacttttatttttaaaagctccaattatgccctaatgcactgtttatgtactcagagggcttaatgagataataaatgaaattttaatttgacaattaatagtataaaagtgttaggatattttgaaattaggaaggcttttgtgtgattttcttttcttattagcccttgttttaggatataattatacttgtgtcacattatgactgggcagcaactcaattattaagaagtagaaaaatgagtaaatttcctactcctgtgccttttgtagcaagttatgaaaacaaaataaaaagtaaaatgtaatcagaaatgctaagaaatggtgtaattctttcatttccaatcattcccgggtaagaaatggctgatcaaacagccaatacctttatcatgaatattcttcaggaatgtaaactgataagacagcagatcctggaagaacttgggttctcggaatgaggcaacggaaaatttaaaatgtgtgaaatatgttacatatacaattacaaagtcatttcctcacacactgtgtatgcacacacacacacatccaagcccaaacacccacacctacagcatgagttttccagggttccaaaaaagcaaaaatacttggaccattatttaatacacatttactcaatatttgagggtgccaagcatgaaacattataaaggagttaaagtagatggaatctcaaaatacaaggcaagcaaaaatcaaattataaaccttaggtttagctaaagtgagttactgacaactaagtaaaatgttcttcatgtcaccaaatcccaagtaatctttatctatatgtcatgtctattaaaaaagcaaacaactgtttttcaaactagcaagagccaaatctctttcatttttcatttattcaataatcactggatgctcactataaaagtaaaatttttaaaaatgaatggaaaacccagtccctgttgagaagacacggactatacccaggaaataataaaacttcactcttcttctcagaaccaggtggcaagagaacagaacttcctgtatcaagctgacttctagccaaagaccaaagaacaaatatcagtaaagcaagtagaaactgtttgttgagtgagtgaatgaatgaatgaatgaatgaaataccgcagacagaataaagaccgtcggatttacttggaaactacagactgggtaaggggagactcaaatgtgggttttcaaggaggtaataggcttcagttagagaggtcaatagaggatgtttctggatcactttagacatgcaaaaattaacttgacaggcaatacatatcaaaagtcctaaaagctttaagagtgtttgtgtcttaataacaataattctaagagtttttgttaaaaaaatggctcaaaagatgaaaaaagtttaaaagtagtaaagttttaaaaaatataaaatggtatttaaaagttaagacggggtgttggcagctcacacctgtaatcccagcactttcggaggctgaggcgagaggattgcttgatcccagcagttcaaggctagcttgggcaacatagcaaaaccccatctcagccaaaaaacaaaaaacaaacaaacattatccggccttgatgctgcaagcacctgtgctactcaggaggttgatgaggagggaagattgcttgatcccaggaggtcaaggctatagcaagccatgacagcatccctgtactccagcctgcgtgacagagcgagaccgtgcctcaaaaataaaataaaataaaataaaataaagtaaaataaaatggtaaaaagttagaaacaacctcaatgtctaacaataagaaataagaacattatggtaaatgaataaataaaatcaagtctttggatttaaggagaagcagatgtgaaatagtgttaagtaaaaaagatccatatgaaaatgttgttagtactataatgtatgcttttacacattattgtattaataaacaccagagtttcaaacaaggaagaaaaatggattcctgctggaggaaatggcacaaagaaggcccacgggtttggaatgacggagagaagaggaaaaaatggaagacttgattaaaacaatttcaactagttgccaggatttaggccccattcatttctggttaagcacggagctatgatgaagttaacctaagattttaagaaacactggcacttacggagggaaatctaggtacttgtatttcctatgcttgccataggataaagggcctacacgacccatacattacaaatttgcccttacaacccatgtagggtaggtcctacagacacaacatatataagaatgggaacaaagaatagtcaagactagatcttcctatcccccacaagtgggtatccaggcctagatatagatggcaagctaccgtgggatcacttccttctcctcattgccactacagttctgagagggaagctttacctccacgatcatctactcatctgtcgtcatcccttgtcccacagtcagagcctctgacaccgtggatgttttcagagagccattcacacaggttacaaagatacaagagaaggatgtatatctggaaatcagaatgcacctgtagacattaagtaagtcaaaagtcaatctgtgctttaaatataaagtctacttcggtctggtttgagtacttaactgatacttaaaacactgatacttaaaagagaaagccatatagaaaaatggctttcctggatccgcataccaaaaaacttcaagtgcttcagcatgaaactactgatccataaattgcagaggtcccaccacccaccccctctcccaaagtgctggactattttgaaatggaaagcatgagcttctgatcaagctcttctgccatacttacttgtccttggcattggttacttaacagtgtaggtaatagctgtctatttacaatattcttattatgttaagctcagctctttcttggatagtggtaacatttccaagttgaaaaagtaccctgcaggtctctgagaaatggctaaatctgtgcattcttctagcatgtgtcatgtcccaagtattcttcctcaggcacttcacatatgggatctcactgaccttcataacattattgtggggaaggtattactgtcccccttttatagactggctaagaaacttacaaagcaagttaacgacctgggatcggctgggcacagcggctcactcctgtaatcccagcactttgagaggccaaggtcggtggattacctgaggtcaggagttcaagaccagcctggccaacatggtgaaaccccatctctactaagaatacaaaaattagccaggcatgcatggtggcagatgcctgtaatcctggctactctggaggctgaggcaggagaattgcttgaacccagggggcggaggttgcagtgagctaagatcacgccactgcactccaacctgggtgacagagcaagactctccatctcaaaaaaaaaaaaaaaaaaaaaagacctgggatctaccttaaatgttgtagatacattgttatgatcagtaccgcatttaattctcattcaaccagtccaactcctttttctaaggaacctaactgcaatcttttaaaccatcagcaaaatcatttggtattcttagacacccacaaacagtgctactagtagcttggataaagacaatttagggggtggatccctgtacaccaaaggtaaattgataaaacattttccctataatatttacctagatacataattttcaaaggaaaataaaatataatctctatctaaaaattctaagacctataaaaggggcaaaaaacatgtgttaccctcatctggtataaatgcactaagtaacttggtaaaactttgggttcatcatgaaatgagtctgggcatattaaaaattcaatgttttgtccaagtttgaactggacaaacaggtttatctctgaaagctacctcagataaacagaggtcactaagagtggttatctaagctgtgtggcatttatttatttttgcattacagatttcaaaacaaagagaacagaagtgaatggcactaatcctgatgggaaaagccctcataatttcttctttatattccaaaaacttcagtgattacacttagaggcttccaaggcgaatctcctcaaatgtagtagctgtaactgtaaatattctgctaccgattttctttaaaagaaactgaatgtaacgtaaccaattgtttgtgtaaataaccagacctacatctccattctcaagcctattcaaaacccctcccttctcctttgactaccatttcatgagccccaggaaaaaggggtctaggcccattagcctggcttcctgttgccatctctgcctttccctgcttctttgggtaccagatctttctgtccttgtaggaggatttgagaaggagaaatcctgtcctcctgccctgaagcctacatgattatagcccaggaatagcggaatgcaaaaactgtgaccagaaatcaagtggtccaagagcggggaacaggatggtgagagggcactgtaggtgagattgaaaccagaatgaagacaactcaacatacgtcttctttcaggtccttccatgccctagcccattgtaaccacaggcctgaatgaactcacaggcctccttgagaaagccaactttaccaaccttttgaagacccttcgttttaacaagtgtggatattctattggggcattggggtgtcaagggccagaaactttaaaagggaaagaaagagaagaaaatcaggaagtggtataacaaaggcctaattacaagggaggagtgtctctctacagacaggtcactggaaggatgccaatggctctcgccgcataaaggaaaagattgttataaaaagatttttaaaaaaagaagaagaagaagaaagaggcatggcagtggagactgggagggtggggcagagaatagggaaatgaataagaataatgacttaaaagctttctttttttttctggttctcttctttcctttccgcagatgctcagctgagccagtgcagctggctccctgacaaatgtggaaaaatcagccaatttgagctggttgttagcactccgggtacagaggctcagataaatgagggcctgcctcaggtgtggcagctgagcttcccgagtgttctcaaatgattctcggccagcgcgaggcctcctggccttcagggcctcatgggtgctcccttctatttcctggctccacattctgataggcgtgaccttggaagaagcatcttcctccatttgttcctcctcccctccccttcctccccctgaccaggtctccttccttcaaactggtggggcttcctcccgctcacttagtaaaaagcctatagcacaaggtctcttgtccccagacgtttgagcacagatctgatagcccaactcaagaccccctcaaaaatgcctgatgtgtattccttttcaaatcactgcattggtccacagagtctcgtgatatgctggcagaataccctggggtttccctacaagacagtgaaggcttctttgtaagtgttcactaacaccaaatagtacgccccacatatttatgtcctcattgttatgtccaccacagagtatgaatatgaaaaaagaacgcacatctgaccattctgttcaagaaaagcagtcaatattttgagtcaagttcaaggggaaaatcgttttcttgcaggtagctgtgaaagttccttgcttatcaaattgtcccctttccagtgattcttgtttatgcattgataaataaaaagaacaaaaatgaggaactaagatatttaggagcttatgtgaggaaagtttctagagggatggaaatgatctagatcttgttttttgtttttttttttttttttgagatggagtctcactctgttgcccaggctgcagtacagtggtgagatctcagctcactgcaacctctgcctcccaggttcaagtgattctccagcctcagactcccaagcagctgggattacaggcatgtggcaccatgcccagctaatttttgtatttttagtagggacggggtttgcaccatgttggccaggctggaatcgaactcctgacctcaagtgttctgcctgcctcggcctcccaaagtgctaggattacaggcatgagccaccacgcccagccctacatcttgttttaattggtggttacatgggtatatacgattgtcaaaactcactgaactgaacacaagatctgtatactttgttgtatctccattatatctgattcaaaattaaagaattttaggtcttttgtttcagtaacacattgaggtctacaccagtacaatgaagtggcagctacagtaaaaatgcacagggaatacatacattgtgtcatatcatcagttaccctttaaatacaatataatatcttcaggccgggcacgatggctcacacctgtaatcccagcactttaggaggctgaggtgggtggatcacgaggtcaggagatcgagaccatcctggctaacatggtgaaaccccgtctctactaaaaatacaaaaaattagccgggagtggtggcaggcgcctgtagtcgcagctactcgggaggctgaagcaggagaatggtgtgaacccaggaggcggagcttgcagtgagtggagatcacgccactgcactccagcctgggagacagggagactacgtcttaaaaaaaaaaaaagagtatcttcaaaagaacctaacgtaatttttacaccatcctcaaatacattttaggagcctataaagtccacagtgggtcaaaaatttttttatggaagaagagatgatattggggtttgtgtgtgtgtgtgtgtgtgtgtgtgtttgattactgctattcttataaactgaaaacaaaatatgttaggtgcttgaattggttgttctcagacgttttgatgtgggaagtactagctgggagcttggaggggagggtcaacataattggtttgtttgaattatactgatttgcagattaagtaagaatgtttgtgtgatttaggaagagaatgatagcacttcagaggtgaaaaggtatcggatttatagggtctattctctcattaaatcaatataaaaatagaggctcagagaaggaaaacaatttgtctacgaacatacagctgtctcgtgccaaacatgaatcttccgagagtcaagtctgttctccttccagttttgcattagttttattttacatgacattctctacaatattttaaagaaaagatatatttatatgtcattaactttctagaaagtaatatttttattaatattaaaaacatcttcaaaaattgtttttcccctgagaatggctgcttctcaaatagtgtgttttaaaaaattaagatagtctactgatatactcaaatactcacatttatcttcttagaaagcacccatgtatatcttccacatgatagttatggcttaaaaaaaattcaaatttatgttgctgctgtcccatctacccatctctacaatagaagattctaaaaagtgattttgtcaccagaaacccacattttctcccatctggaccttgaagtttcctttaactttgctttagtgattgggcaagtcatctttctttctgtggctttaagaattgcccatgataaagtaaaagagccataacctcaaggaaaccatttattaggcttaatcaaaacataatactcttgtttatgtcttcaacacattgtttatggagagagtgagccacaatgcacagacactatcacgatgctccggtgaagatgggtgatttaatgcccaagagcacaactgaatccactctagagaccaataggtgtggctcaaccatagcttcaaaatttcagaggaagttcagaaaccccatatgggtttgctttgctttttctattccttttaaccaaagctgccttcatcatgtataatctttctttttttctgagacaggttcttgctatgccacccaggctggagtacagtggcccgatcacagctcactgtagcctcaaactcctggactcaggtgatcctcccaccttagccccctgagtagctgcgactacaggcatgtaataccacacctggctgacttttttaaaaaaagcattatagagatggtgtctcaccatgttgcccaggcttcaccatgtatatttctttctttttttttttttgagacagagtctggctcctttgcccaggctggagtgcagtggtgtgatctcagctcactgcaacttctgcatcccaggttcaagcaattctcctgcctcagcctcccaagtagctgggattacagtcacatgccaccacgcccagataatttttttgtattttagcagagacagggtttcaccatgttagctaggccggtctcgaactcctgacctcaggtgatctgccggcctcagtctcccaaagtgctgggattacaggcgtgagccaccgcacccaccccaccatgtatatttctgacagcctcttcacaaggctgataactatgtgatattcttgacaggtccccagtgtctctctcagcttggccagggcccacccacctacccctctgtagaatctcgaaacaacacctcagcatcctgggagactggcatgataatattcgtttttcagagcaagaaccaaactgacaaggaacagccataggaggctcagatcagggctatctccgctcagtgacagggaggtctgtctctttgggagaggttgaagacagctaaactggagtggttgccagggggagagggggatccagaacacaataaacaaccacactggattctgctacagtcacagcatcccagagctagaagagagcctgaaaatcatcaagcatggtggttatcaagcagttgttgctgatgtgttcaagcagtggaattctttttgaaattaaatcttctgtggacccctggcatagaaaacaattaaaattgaggaagaggttgctgagcagtgaaaacatcctcatcgtttgatagaaagattcctctcacggcatacggagccctgaaacactgctgtgggaagtttcccaggctccatttgaacatggggttctcaaaagaacagtgacagggagctcactcccactaaggctcactccaccataggtagcccagactagcagagggtatcttcctggcacagacctggaatctgactcctgctagcttatattcatggatgttagcttacctttgaggccaaataaattagcttgtatccccatttcacatgggaaaatcttcatatattcaaaactagcaggttgtcttttagacatgcccttcattacatggcaggctgtgtccatgccccatctctcccacacatgtgcccaagctcaccccacctctgcccctgccgcggccttatcaagacttcctgtacatctgtctgtgtgtgctgggggctcagccttcacgaggacccagaggctccttagggaaatccacaggcccttgtgcatgtgaacaataaggaaaggaaaagattttgcttttgggttcttcatcccccctcccaccagcttcaaagttgaccccacccgttctgaattgagggcgatgaaaactggcttgtggccatttagaagaggatcagattctggaggcaaattctaaacagactttgcatgtgaaaagaaaataaaaacagctgaattacagacaagaaattaatctgcccctttccccctcaaaaaaaggcatcctaacagaactacttcaagattgcaagggggacttcctgcacagtaacatgaaacgtttccatcagatcaacagctggaaaagcaaagtttttttttttaagtgttaacatttcacagttacaatcgtttaacagatgtaaaattataggatatacttagcgtttaggttttaaaaaattattagctaaatatcttttggaaaatacagttgatggtgagttcttcttgatgatgatggcaagaatattttaaatgttcattacactaaagaaaaatgttcattatactaaaccatactttaatcagcttaacgtgtggcttacacaggtttacctaagattaactggacattttaaggcctgggaacagattgttctactgaccagccaactaatgtaaaagatgagaagaaccaagactgggaatgatatcagatgcaaagtgaacatcccataatcgaaacggataatgacacactggtgagtgaagggacatcaggatcacaggttcaaaggcaaggagatccttgtccagggagcatgcctgggagagcagggagaggtggtgtccagccactgcccttcaagtaggggaaaagtgagtgcagaggattgaaccagagaacagaagctgctaacctgacggaaaatagacctggtgagtgaaggttagtggaattggggtggttttgacctcagaagaaagaaaaagggcaatttgattactattgtccagcacatgactgacccttataagaggctttagggaaattaaatgaaagcaggagaaattcaggtggccatttccagagggagatcaggcaagcaaagcgggaagtgatcagccagggaattagaggacctgggtggacccagcttgtcactatcatgtggggacacctgagataagcatcttaccctcttgggcctcagtttcttcatctttaagataagaagactgtagcaaatgactatgaagattcctccagctcatgatgatcttttaattaaaaataaatggaaaaaaaagacctctcttaactgaggttagtaaaagtatcaagcaggtttctgaggacactccattttaaattaccttattattgggcaaatgtctaacccactggtttcttgtaagtccttccaacattctggccctggcctgctttgtcccatcccaagttgcagtctcatcactctgtccctcaccactgtgataaacacaatagttaccaatccatggtctgctggaggaaacaacgcttttgaaaaatgaattaaaaatccctgtgagggcgcaagagtgtgctataaaaaggtcattaataactcaacttagggctcagattcccattggaactatcaaccacaaaataatctgcttcctggctgagtaaggtaagggctccaagaggagcacaaagcctttgaagctgaaatgttaagagtcagaggaagaaaactaacgtgatgtgctgggctagtttccttgaaatagatttaagctttacagtgccgctgggagatgggcatttattatatctaccactataagcaagcaatcaaaattcagagaagtcaagacggctgcccaaggccacatgggtagattgtggagtcactctttcaacaagtatctcctgagtgccggctctgtcctagacactagggatacagtaggggaagccaacatggtaactgtgctggcagagttcactttctagtgggaggagtgaacagctgtaaaagcaccagttaataggaaagaaatatttgatagtgtgaaatatgacaaaaattaaatcaaggaataggacagagagtgactgaggggttacttctatgtggccaaggaaaaaagaactctctgaggaaggggcatttaaaccaagaacagaacgacaagaaaggcacagtcatacaaagatccaggcaagagtcggctgaggtgggcaggaggaaagaagacagtcctagagtggagacagccaacttcaaacagagcgtggcccacgggggcagccatgaacaggcagggcagctggggagctggtggccaccaaatgagctcctttctctgccaggctgttgaggcgggctgactggtttcatgtctgtctttcaatagaatgaatgggagggaaatagaaaccatgtccacatgacattagtacctgcatctaggaaggaggacttagtcccaggaaggctggccctcccatctggccaccctgagaggtttcagttcccttctggttcatgtgccaagcttacctgtcagctttcacctcccaagggatgcagcgtcagtgtgttgaagctgcagcatatgaaccaataaagctacctctgagtaacatggaagcaaggtaggaaggcaaaaaccacatcccactgtgatatcatcagccatatttcttccacatggcaagttttattttgtttaatttaacaataaagtcattatattaactcgattcaatagaagcagcagggggatttctcctaatttaatcgtgggctttggggcgtcttgctcagtgttaaaacaataccatataaaaatattaaagggattgtattatattgaaaaaaatatgttagcgtctccaaatgcagcctacctttaatttagaaactagtcagcctactttttactttatccgaagtgtcatctagtcaagagggccaatctctgcaagcaaatcatgccgctttagggtttaaactccgcaaagtgagcatttcatccatggaggtgatgctccaatttgaagagttattagatacacccagccagggaatataaataacttgagcttaccagtgtcacagaactggttttctgtaagtcacttgaaaatacaaggacatagggccgggcatggtggctcacgcctgtaatcccagcactttgggaagaagaggcgggcagattacgaggtcaggagttcgagaccatcttgcctaacacagtgaaaccccgtctctactaaaaatacaaaaaaaaaaaaaaaaaaattagccaggtgtggtggcgggcgcctgtagtcccagctactcgggaggctgaggcaggagaatggtgtgaacctgggaggcggaagttgcagtgagccgagatggtgccactgcactccagacagaatgagactcagtctcaaaaaaaaaaaaaggaaaaaaaagaaaagaaaatacaaagacataaccaacattctgtatcaatctatgtatccattatataggctatatagtatgcagtttaaaacgaaaagtagttcctaacaattaaccgttataagaaataatctccaagccttttagaagtcttgaaggactgaagagactatgtaatctgctgatttagtgatttgaaatctggggattccaaattcacacacacatatacacacacacaatggctagagaccaaacaatgttttttgttctcagctggcaaaatgaattaacaaattcattaattaggatgctgtttatgcttgtactgaatatatatgaatgcaggcccactcaaggattccagctgggagatgccaacttttgaaattcaaagacaaactagatttatctttggtgccttcataagcttattgtagtcacactgaccatgtgggtttgtgtgtctaagtgaggcctgtgaatatttatttaaccaagcaagttttaaagtctatttcatgtcctttcaactacaaaatgcaaaacaaaaagctagccatgggtggtgggaagacagaagaaattatctttatacaggactgcttttagaagaagaaagaagtggctgaaatctggggaaaggtacagataatagctgtgattcactccagccgtagctaacaaggccttgtgcttttcctggtgggaagcagatgggaaggatctggaacagggagaacgagtagggaaaggaataagccttggatacaccgctgtttccctgtctctctctcacatggtctttctctctctccctctctatgagaaatcttttttcatggcccaaaaaaaaaaatgtttgaggaacaaaacaagatcccattgtggagggactaaagacacgccacagggagcttctgtcacacggttcagatcccagagtgaaggggagtcagacaagaggaggtttcaactcttgaaatctttgtcatgcatttgctttctttattgacagtacttacttcttgtcatggaaaagtgtaatttgccaaaaagggggcagtggggagaggggaggagtagaaagaaatggggagagagaggagagagaagagagagggagagagaaagagagagagacagactaatacgtacaatacaaataatacagcaagaggaagcatcctattatagaattctttatgcttaaaatggagtctgaatgttttttttttttttcatctaaaaataagcctgcgaccttttgcatttttcaggccataagtatttctgcaaggtccagagtcccaaggcacatgggggcagagtgagggctgtctggtccaggtccccggagctaagaagtatacctgtcagagaagcagcagccaggttgaaagagaagaaatccacagaggcctgggagggtactctgaacccccacttcctctgtcagttattgattaaacctcttacacatacacacccgttctagggaagctgaactttaattttatgcctcctgcagaaaacagagatggatacagacatgggtccgggagtaaataacactcagcaacataagaagaacacacacctgcaaacgttgccacggttagattttttaaagtgtaaagaaatgaaaaaaaatgtcgaacctcacttataatcaaagctatgcaaactaaaatgtgttacactttttaaaacttatccaattagcaaagatgaaaaagaaagataataccaatgttgatgaaggtttatgcagacaggcactcttatgtctattcaaagttggaatagaaatgagtagtctttctggagttaaattaggcaacatgttgcagatgccttaaatgtgcagattctagtgcagcaattccacttttagcagcgtattgtatcagacatatgcagtaggatgttcatcacagcattgtttagcaaattgatggaaacaatctgagggttcaacaataggatgattggttaagtcaattgtgttacattcatacaacagatgtgattaaaagttatgcttggccaggcatggtggctcatgtctgtaatctcagcactttgggaggccgaggcaggctgatcatttgaggtcaggagttcgagatcagcctggccaacatggtgaaacaccacctttactaaaaatacaaaaaatagccagtcgtggtggcaggcgcctgtaataccagctactcaggaggctgaggcaggagaattgcttgaacctggaaagtggaggctgcggtgagctgagaccgtgccactgtactccagcctgggcaacagagcgagactctgtctcaaaaaataaaaacaaaagttatgcttacaacaaatacataactaatgaaatgctgaggaaatgttgctaacctaaaaatgaaatctgaaagctttctctctctctctttctctataatatgtatatatacatacacacacatatatgtattatccatatccatacaatgcttatgttctaagcgtatagctaaatgtacttgcattacttaacactcacaacaacacaataaagtatacactattattgtggccttttcacaaatgaagaaactggaaaatgagagaatgaaaacctaaactcaggtgtagtccagtctaaactatataaacttcctctcttggccatgagtaggagtgtgcgtatgtctgtgtatgtgtgtacatgtgccttcctcatgaatacagatactctgaaatgttcatagtcacctcttagtggtaggcttagagccatatatatatattttttgtttgtttgttttgttttgttttgttttgttttttttgagaaggagtctcgctctgtcaccaggctggagtgcagtggcgcgatcttggctcactgcaacctccacctcctgggttcaagcggttctcctgcctcagcttcccgagtagctgggattacaggcaggcgccaccatgcccagctaatttttgtatttttagtagagacgggatttcacagtgttggccaggatggtctcaatctcttgacttcgtgatctgcccacctcagcctcccaaagtgctgggattacaggcatgagccaccgtgcccggccgtaatattttttttttattgttttgtgctgtgtgtttcatgatttctacagtgaccatgtatttcttttgcaactaagaaaaaactgcaattagcttctcttttgagatgttattctgattatgattatcttctgactcgttggaactcagaaggtgtcaagaagagggagaaagtaactaacagataattttcccctgggtgtactctgaagcccaggaacagccactgggaaaagtctgcccatgtgccctgggaaaggtcacttgactccatgaagtgacaaataaaagtgataatgcatgtgttaataaaaacacctgctgcacacaatccatgctgttgctccttcctctgccagcctctgaaagacaccaattccagcagtggtattctccagactccccatcagacacagttggaattttctcaggaaagaccatgaacttacaatcaaagggaaatacattctgcctgaagaatgcattatcagtgctcactagatgcaactgactgtccctactctcgtaagttctaactccctttgaattattgtccttggtttttggagcttatttctatctctattacaggggttttcaaactagaaaatgtatcctcttgaagtgtcacaaaaatccttcctagaattatatggacatagataattctaaggaaattaaattccagaatctcaatttcccggagtctttcctaaatgtgtctgataatgcatttgtggttaagaggtcatgccagtttactcatctctccatttacaagcttgcttctcttaccttcaagcagaaagacataattttcacctatggcaaatctattataactgcctgtccagggctatgaacaccattggagttcttgccccagaaaggaccaatttgatataggggttaaaagtaagccttctataaccaagacattataaatccaaggtaggtggttggttgttttgggtgtataattcagaggttcaaaatggaaatgaccttgctctaatgaaactctgttcccatcacataattgataggcaatgtttctcaccatttatatgatacggactaaaacaaggaatggaattgatattgaacccttggcaaaaataacattcatccataggtaaaaaaactaattggaaataaagaaccatccatctcattaagaaatatatttctaatagacattaacttctatatttaataattgtttattgaaatgttcaatacgtttgtgttgttttgatcaaatttgttctaaaaatcactgtaatgataaatcaatctagaagatttaaaaaattacctatacctttacggtcataggatttaaaaaatttatttacacatatttttattacaaaggattatgacagcatgatcaatgaaagatttttaagcataaaaatatataacattaggctaatgttatataggctaatattatatattttatataacattagcctaatgttatatattatatataacattaggctgttatatatttaacattaggctgttacatatataaaaaatattacatatttatatatataacattagcctaatgttatataaaatatataacattaggataaaattaggataatagaaattatcctaatagaaaattaggataaaagaaaaaagatgtagaagttttgggtatcaaaaaagagcttgttcgtgtatttctttaaaaaatgaatgacagcaaacatttacaccaaaatagtatttagatttcactagatacatttcaaaagtgacaagttttatttttaaatgtaaatatttataaaatgccagaaattaaatcctctgctattgaactatttaaacttatgataaaaaaaatttaaatgtcaaattttggataaacatgtggaggtataaagaatttcaaaattctctctctctctgtgtgtgtgtgtgtgtgtgtgtgtgtgtgtgtgtgtgtgtagtaaatgaacgacaaaaaatgaaacccactgtctaatgcatctcatgactattctttttcctccatgggacccaagaatttactttattgggtttaagggggctaatgaaaatatttgatttagctctctaaagagatctggccatattccagctgcacccacaagccaggtatatcagctgggtctctcgagcaggtgatcaagaacgcatgaacaggaatgagcacaggtcagccctgaggaagagggtcatgtctgatactgggctgttccctgaggggtggaatcaatttgactcacagaaggaaaggaaaactaaactttccacctgtgacttataactacaatcaggtcatttatgctatcatttccaagaatggaagaaatcctatggaaaaaaatgcgcatgtagatggaattcttttcctttgtacacatttgacttacccctttttaatgccttttacttgattccattagaaaaaaaaatccacaactgagtacactatgctttagaaaagctgcatacatatacccactctcaaacaatgaaaatgacttggaaattaatgatgttgatgtagaaaaattgcaggaacaggcatactgcttttcttcctctctgctgactctgaccaagggcaactccaaggatagaaagttatccatttgatgaaattagaaagacacggggcatagaaagggtcaggtccagccacttaccacctctgataggataaacatcctatcagagtctcggtttccttatctttaaggtggactttaaaacagacaccttgcctactgcttcacaagactgctgtgagtagcaaatacaaatgcgaatctgaaagaatgtcatatgccattagtgattcatcactttgagtattaacagctcttcaatgccatcgctgttagaagaagaaacttggtgttctccatccccttcttggtcctgatgctgcctttctttccctataaaagtagcccattccgggggagggatgggtaggaaagttgccatggattttattaagatagagtaaaaatttattataggaaggatgcacatttcaacaaaagcttagggcttgcagccctcgtttcactctaatgaaagaaactgccacaactctgggcatagtcctatgcttaaacaactgtgtttagcttggtggaaatacaccaagatgaaagatgtccaccttgattcatccgtacgatacaggaaagaaaatctggcaaattagaaagacatggggcatagactgtctatttatacctataaggtcaagactaatctttaattttaattcagatagatcgtcttaatgaagctgttaacaacagtgagaaatggaaacatctgatttgtcttgactacgcttagacctcacaaatcttgaactacaatccacagaatcaagatcacttaacacttacttaaactgatttctgtaagtaatgtcaaagctctatcctgaggtaaaatattattagtcctgacatgattaacctgggcaattgacacataaaaaggatcttaatccattaatttgctaattggtgttcattactttggacatgggcttcgacatgtcagcctagtgttcatctgtaggaaataaagacccaaacagggtatgcaactgtgcagatctgactgcagcttggaaaaaaaattggagtcttcaaattctctgaacatgaaaatgaaaaacacaactaataaacagttgtgttgccttttcttctttgcccccaactgtactgcttcatttttaacatatgtttaactgctattttttattaaactcatatttaggcagggaggaacaagcttaccacatatgctttgggttatatgctaactattccttgtcagatggtgagttaaaaagaaagacactggaagagtagaattaaatgtaaatctgccttatgaaaatccctagcttttgagaggaaacacttctatttgagagaatttgggacaggtaatttttcagggccccctgggacttgaatctaatactatcatacagaggttctgtttcaggtagagtcatcttgagtcccatctgagatgtccctgaagtgctaaaaatcatccctttaagaatccatatctaagacggtccatatcctagaccctattcttggcttataaagttgtagtgaaaattagtgaccttggtcatattaggacttagttgcaagtactctctatcgaagaaacaaaaggctgagagatcgatcacctggtctggccaattgtatgaatgcacaggcatacaatccaaacatcccaggggtgtggagcttccattcaccagaactgaccaggaaggggagtgttcactagcagattatagaaaacatgattttaatgtgccctctcttcaatatttactgtgatcccttgtgcctcagttttcctacctctgaaatggaaataaaaacatcaatgaagtcatattaggacttagttgcaagggggtgctgtgttatgcccagtggacaataagaacattgcatgactttagaacctggagatgaggactgttggctgggagtactcaaataaatttactccctcaggttcttccctcctatttctacttacatcaatgagcctggttccttggttctgttctgctgttattccaaaactctcagattccatgcatatatattgattaagccaagcacatttcaactacatcatgtcacctaaacatcgtgtaaggcttatatgattattacttcatgatataaaaagattctgatgaagtcaagtgcgaaggcaaaggtcatttaagcaaaggcagaggtaggaactgaacccatatcttctgattccaaatccagctttcctcccacccccctcattcaactgcacacacttctggcttcttgtcatttccttcctctctccattttgtatttctttccttttcctccaccatctgcatcttctgcattctcttccttgatccattctctcatgagatccattatctcatcactcaatctgtttctcttctatagaactgctattaaagttcctgaattctaagacaattttcttagaaggatagaaatgtgggaaggaactctaataatgatatcctaaaactaatgatgttaggactaataaaatgacaaaagttttgcttttgttgtttgattttaaatgtataaatctcactttaggtatctgtgagcatagttggcttgaaaaaacaaaacaaaacaacaacctgtaatccaaagaggaaacacagtgccgtttcctttgattttctcaagggagatattggcaaaatactctcatggaaagcgtatctgcaaaagctttcctacgcattaaaaaaaaaaggaacataaaaagtattagctatttgacactcataaagcagactgaattactctaggcattgctgggtacctggcatttactacagtcacttgagctattttgatttatgagggtttagccctcaagcaggttaggtttaactaaacttgctaccaagtgcccacttaaggattctttcagcaaacaagaagaaatattcttcacttagagttcatgccaccaagcctcaagcttcactagtaatgaggcactcatttccagagagcttgcgctctgttttctccacagcttccctcaatttacatctctatcaaagaaacaaagagctgagagatcacctggtctggccaattgcatgaaatgcatgggcatgcaatacaaacatcccagggctgtggagcttccgttcaccaaaactgaccaggaaggggggtgttcactagcagattatagaaaacatgattttgatgtgccctctctccaatatttactgtgaggctctgtgcctcagttttcctacctctgaaatggaaataaaaacatcacctatctcataagattgtttggaggattaaatgaattaattcaagcatagcatgtaaaacatgtgctagaagatgatattaagtatgcagtaaatttagctaatactatcaacgctttcccaatttgttcctatagggcacccaaattggtacagtaatctttgctgacaaccttcctccccatcacaagtctcacaaacactaacttgttcctcttgccttattctctctcaatcctaccctttgctagtcaaaattaagttctaacaagacaactggacagatgaatttgtaagccacctaaggtattttctctcccagggaaaggaaaactataattcaaacaaaattcatgtctcagaaagattcttaagcaatcactttaataatagacttgtaggttagcagataaatgtttttttgatcaaatatcctttctcaagtgcctggcaaacattgtttcactaaaccaagttatcacttttttttttgagacaaggtctcattctgtcaccgaggctagagtacagtggtgtgatctcagcttactgcagcccagacctccagggctcaagcaatccttccacctcagcctcctgagtatctgggattacaggcacacaccaccacacctgtctaatttttgtaatttttgtagagatggagtttcaccatgttgcccaggctggtcttgaactcctcagctcaagtgatccgcctgccttggcctcccaaaatgctgggattataggtgtgagccaccgcgctcccagcctcatctaacttcttgattcatctgctcccaattttaattacaatcacaggcaaatggtatcttgggatgacaaacttccctgaaatctttctgggtacatgtcttcaatttacttcatggagcaccaaactataaccacagaaagtgaattctcgttccagacacattgtttattcattcagttgcataggataagtcactttacttttctgagcctcaattttctcatctgaataatggaaacgataatatgtattcacataaccacagcttgagaaccaaatccagctcgtcacatcttcttgtaaatagagttttattggatcacagtcatgcccatttgtttatgaactgcctctggctgcttttgttgcggagttgtgacagagaccgcatggcccataaagccaaacatatttaactatctagccctttacagaaaagtttgctgacttctgctccggatgactgctgtgagaaaccagtaagacaactgacagggaagtgctttgttacctgcaaatactgatgtaaaatgtgaatctttattattgccttttagatgtctacaggattagtgtgtcgctcaccctgtagctgcattcttcctagctaagcaatcccaaacaccttgagcctgttacctattaggccaatttaaaaaatttctcttgttgcctttgttgttgggtggggtatttttggacttgctccagtttctcctattcatttttcttttaaattttaattaatgtatagtatactggaaaggttattatctggttctcaagtaaagtctcagttactatagccaagaactgggttggctttttttttttttttttttttttggagggtgtctcgctcggttgcccaggctggagtgcagtggcgcaatttcggctcactgcaagctctgcctcccgggttcacgccattatcctgcctcagcctcccgagtagctgcgtctacaggcgcccgccaccacgccaggctaattttttgtatttttagtagagacagggcttcatcatattagccaggatggtctcgatctcctgacattgtgatctgcccgcctcggcctcccaaagtgctgggatcacaggcgtgagccaccgcacccggccgggttggctttttaaataacagctctgtaatgaagtactcttggtcaagtagatacagcaggatccaaaaccagttaaatcactaactgtgaacatttgagcaaattatttaccctctctcggcctcagcttccacatctataaaatgagagcacaaattatacacagctttgagagttactgttgagattattacagtgtatttgtaagcaagctgacttatgcaaaatgcctggcacatagtaggtccttagacaaggctgcggatgtggcttcctcatgtccttgacagagagacacttttccatcacaatcatgcccagatgattttaaaattgtgagtccgtctattaggcataagtatcctaccttacatttgtccctattgaacttcaacttgcttttgatttattgaggtcactttgacttctattcctgtcttctaaggagttagaatttatgctcttctgaatttgtattctgtgaacctcatttccaaaggatgaaagaataagagaaaatacaggttaactagggtcataaggctagctgtctaaggcaaaattaagtgtagatttgacacaattattcaaaacccaatatgacaaaatgttttggctgtaactatctaagccttaagaaaaaaaatacattttcctatcaatttttcacttcacactgctaacacagacgaagccaaaggggtagaaagacaaatgggtggtcaaaattaacagcatgcttagggaacaaggaatagggaacctgcgactttcctccctggcaagctctccctgatttttaaatgcttctgccttaccaaggtttgttttgagagtgtttttaatctgagatattttatctgctaaaaccttattttttctgctccattttctgcattttcctccagcatctttgattctcagcatttacagcaagcaccggatctctcctatagcccgaagctcgttaaactaccgcaaaataagatataagcacctcattaattaccatcagcaagagaattagtgtgcctatcaataaatattaaagttgcacattctatctctaaagaatgaacttgccatgcacaggtaccggatgccttcccacctgagacagatctcaatcacagaagacaaggaaagccctggcggcagattctattttaatccaaggatttggggagggactttcctgccaactaaggattagttcttttccttagagccttgtgactttgaaaaccagctaaaaatgcatatcaaaatgtaaaatgcctaaatcagcattgtgggaatcatttaaaatatactgacaaagctgctcttataagttgagatattaattcaaaatttttaagtaaaaaaaattaattacattgaaatacacaaaaaaaaatgtttggaagaaaggccttttgctcacctgcaatttctaattttccaataacacaataattatactagttcatatttattgaagttattatgtagaagacgctgtattgagaagcgtaggtgctcatctgttcaccaccacaatgccatgaagtctgtgctattattattttactcaccaaaaatgtggggcttaaagagattgagcaacttgctatagatcacagatctgtttttaaaaatcagctgcatacatgggggaaagaacaccaaacaattctaagaatatgctccaaatgatacaaaattatatacctgtaaaagagcttattgcagtcttaggttgcattaattgaagaagatggtccaggaaaaaggaggtaatgaccttgcccaaatccttggacctcagaattcctccaggggtctgttttcagtatgatgaacacagtttacgtggaatatggataaaccagggggaacgtggccaagacgaccggagggcttgagtcatgatatcggagagatgactgcaggaactagcagtggcagcctggaaacagaagagtatcaggctttgtgagagactgtagacggtgtaaaaacaagaacattagctgggctccagtttcccctttttctctcattagtaccacaatgtagagtgagttatttaacctctctacatctcagtcttctcatctctaagacggtgctaataatggcactctgcttcatacagttcttgagggaatttagatgagataatacaaataaagcactgaccattgcacctggcattcgagaagctcctagcaaatgctagccactaatattatggttgccgtcatcattgcttctgtggttcttaaaatagaatggtgatttccaaaatcactgcagaaaatggtctcccaggataaacaggtggcatgccaacaaagacttcatggttccaaaggtttgggaaataccaacttagagaaagttaagcaagatttgtactctgtgcatgtggctctccaagaagaggtaaagtatataacaattcccagctgtgtttggttaggatcatttttaaagaacactccttggaaggagtgtgttctacgagctttgggtcccatgaccacagacgagtctacatcgtcataagctacgcccatcatctgatgtggatgaagcacaccccagagaatctgcccggaggtttcgcgacccataaggagtaaagaatagctgaatgtggtgaaatggggagacaagtcactgggcaattagaagtgtgaaaatgtgcctcgttggacacagggtatgaggcaagcagagaaaactggtggagtagtccccctggtaaaagcttacttttaaagtaaaatggcccagataaacctgatttcattaagtgagacctggaaataaggttgccccatatatactcagccgaagacgtatgaatgaataaagaaatgaatgaatatttttattccaaagttacccactttcctataaaacatatcataaaagtcacaccattattattattattatcattgattaccattacagttaaaattataaacaacatccaaacgaatatcacctgagcctttcttttccaagttgaatatatcacataaagcaggctcttttgattcctacgtttttatttattggcttaacctccagggctccattggaataagtaacactacatgaaaacaagttccaaatgtgagagattcaacagaacccaggacaggctttgtgtagacatggattttcacatgcttattcaaaatatttgctgtcaacggtacttggtgaaagtgattgttacatacagcatggctaacttttttatgtaaatgaaatgcaaatgtatgcaatgttatctttaatgcagatgtagcagaaagtattaagatatgctgagagcctaattaggtcctacatcaaaaactatacataaacttgactccaatatctcaagaacacaaattgagtctagaaatcccagtttgcaagcttaaaaaaaagatgtacatatatattttaaatcacagttctttttcttttcccttctctaagtctgaacacttgaaaggatgatcttggacagatatttcagcgtgggggagggggtgtggagtgggtgggaaatgaacaagtttctttctaacaaaaaccaggaagcaagaagagaaaatcagccacgagccccccaaaaaggcaaaacaaagctgtcttgtgctttccattttcatatgaaaaatgatgacgtgccacaaagcatatttttgcatttatttccatttctaaccttcctggagacaaacacatgtgcattccttcctaatcgctgttacagtaaaaccttatgaactccaggtccactaattctccatgttgatccttctgacggggtgagcggaagtttacctttatttaaggagtgaaagggttgacaaaacaaataaatatcataaaaagcattgcagcatgcctgctcaacctacatgacataagctcttcttaagcacttagaagcactgttcatatagaaaactattcaactgtcttttctatttactacaatagatcctccaaaagaatgctcctatgtgatactttgttagccccttataatttactatgcatagtagaaaagtgataaaatggaacatcttcgtaattgtccataatccaggctccttactaattctgaggagtcttgccttctgattcctcagcaaagtgtagtaggcttagagtggcaagtaccgggggcctctcctgggctctagctgtgacttgctctgtgtccttggacagctcagtggcttctttcctgctagttttatggggcttttctttccccattcacattctaaaattgctttgggaatcaaaatagaaaaaaaaggatgcagaaacaatcagaaaagtatggaaagtactttataaatgtaaggtgtcactggtctctaaattgtgagggcgtgtgggagcgtatgtgtatgtgtagtgtgtagcgtagtgaaaaactccacatgcacaggcatatatatatttggattcataaatatttacaggtgtatatacatctgcatgcatgtatatacggagcatgcatgtatatactgcatgcatgtatatattgtactgtgctcatatataacatgtgcataggtactcatggataagtacagatgtatatatgactatactgacctcagagcaatcatacatataacacatatgagtacgtatgtatatgatgatatactcaaatatacacacatatattgacacataacagacacacatcctcataaatggtaaggatgtatatgtctatctctgccaaggcacacattaaatgtgcatatatctgagctaattaacctgtgcaccttgccacagagagtacctgaaatggcccaagacaaaatctagacctacgtatccaggctgaagggcttaaagcaaacagagcttatccagctctattcccctctgagttttcttccatcttatctaatacaccctctgaaaagaaggatcttttttagttctgctaagatccccaaatgctcttaacatctccaaagctctctaatacaaaaggacccagttgctgcaaggcacaagaattgcactggcttcacagcaccacagaacatgcccagcggaatacattacacagcgctccacgcagctcctctgaaattgatattgctggcatcactcgccccaaatttctaacattgtcatgataaccccatttgttctcaggaactgcttcccacattttaaaggaacagaattttccccatgtctgtccttcatcatgccctttctttaaagaaaaaagaaagtcttcccctgggttcttcctccattttgtgtagtaattcctagtgttgtcagtcgatgattatcaagtatataccaaacattatttcctgctaatatacaatctgtgcaattttaaccaggcttgcacctcaaactgaggacagtggaaggttttgtcttcgtgctaaatagtttggttcagaggataatcgttagagatgctcaaaagaggtggggttgttctgggctggaaaagttagtgaagggggggaaacctgtcctgccccactctcaccttttccagcactcccctcaaaagaggaaaccattcagctacttcaagtctctcacatctgtacttatccatgggtaccgtaccttcatgcaccttgcttctcctctgtgccactctcctaatgaccatcttccctcctgatggggttcctgatgtcggcctgaccacctctccaatggctggtcactgacggggcctgcctgcccccagaattcacctccaaagtacagcatgctcctggttcctttgccacttctcaaaaagcttcttctgatttctgctccgacaccaacttcccgtcctctgacctccgctcttctctctctgtatccttcaccaccacccttcagcattaaccactgaaggaatcactaacctctctcagaggctccagattcacatttgcaagtgtctgctggacatcatcacagaacgtccctttgtagagtatcaatgaaaccagctctgaatgctgcatcttccttccaaatcctaatgtggctgccactgtccgaattttgcaagtttgaaacgcttcatatatgtctttctgttcccttctctttaggactccacattaagtcagcatctcagtatcacctccacttagcttcccacctctgtcacttaacattccatcctctctcctactactcaagttcagaccatcccacctgcagcccaggatgaaagcactctctttgccccagaagtagctagcatcttaccatggaaagcatgcacacaatggggaaagaagagccaggattctagttcggaattgctgcttcttcgcaaacagactttgggcagtgactcaatacttttcaggcccaatattcacatctctaaaatgtgaatgaggctcttttcttattgtttattgaagataatgatgtctggctattgttacaacaaccaaggcttcccttctccaatccagatgcttccaaaaccttcaccctcagagagactgatcaaagaatatcaacaaaaggcccttcacatctttattttgaaaagtatcccaggcaatcttggtgcactattagattttgtagtctctgctctaatccatcattgaacttgaagctggaattcccttcctaaagcataactcaaatcacattattcccaaactgacaaaacttcaagggccccgtataatttcctgaggacattttaggcccctcatctatcttttctccttcccaaatggtaacagacctttgtgctgaattaggctatttattgctgcctctcagttatgatgaattcaattgtatcagaaactcaactgacagtggcctaaacaactaagcatttacttttttccacataacgtgaattctgggggcagatggctttgtgctttgcttcactggttgtacaaggtcagggatccgggccacagttggtaactctcttggtcctcccctcaaggtggggagatgacagtagcagctgcggcaagcaccaagttcacacctgtgttccaacgctggggacgggagaggcctgcaaagagaggtcctcctcaacgccccctctctagtctattggccataaatgggtcacatggctacaggggaggctggaaaagtgactgcgatgtttcagcctctatagtgggagactagaaaggcagaggctccgtgaatgactatgagtaaccaattattagaaaaccctaaatacaccgtcagtatcactgcctaaacttagaattgtccttttccaaacctgtgtctgtttaagtgattatagctaacattcagtaagtgcttgctataggccaggcagtgcttcaaatgctttatgagtattagttcttaatatttacaataactctgaggcaagaggattattctagcaatcgtacaagtgaggacattgaggctgatcaaggttcaaacacagggaacctgaccctggatcccacactcctagccacagaacaacactgcctctcaaggaacagcttaagcataaatcttctccatgaagaggatcttgcctgcaatccccggaccagatgcacaattctcttccttaaaatcctctgatgtacttctcctatggtgagggcaatgatataatccaaagtagggcatgtctgagatgcacggaagcactatcaataattacaacaggaaaacacactgtcctatgcaaacagggatgtatgaacatcctacctgcggttctagcctccaggagagtgcttgtgtacacatccaatttcttcttactggtgcactgggattttgagggcgggcactatacatgaatggtatatcacctggatgggcttcatatggtgctctgctcagaataagtgcccttggtcaaatagctatgtgctgacccaagggagccttgaaaggctgacaggatgtacttacacaagggactacagggtggcatctgtaaagagtgggaaaggtgaaggctctaaatcagattttgcctgaattcaaatgctaggtcaaccatttgcaggctctatgatttgggacattttacttcacgactatgttgactgagttctcctgtctataaaatcatgataacaaaataaatttccctacagggtgtttgggaccactgagtgagctaattgcatgtaaaatgcttgacaaagaaagacttcaaatttaggcagctattaattaatacaaacatgttcattaatttgtgggaaaaaatgtatatgagtagaacggggcacggcaattgtgtcacatgctaaggtaccgcaggaagataagtttggattgtgtgtgtggctgctgggcttgaccttataggcaccatctttttcccaatgcttttaagaacagagctcaaagttcagagtgccatctttgttttcatgccagtattttcaatggtgcacacacagacacacattctgttgatgcaaaatctgctatggactgggatggggtcatattcagagccccgccgtgataaataagactcctttctgtacttttgtgctttcttatttcaaaagtgggtaaaaatgtgaccccctagacacattgtggcaaagagtgtacagatttaagtaaaatggttaactgagagttaactggttaattctattctaaaacacgtttgtggttttgctgtctggaggtagaagaaaatggtaggttgaacataaatgcaggtttgcatcttgtctttggctcctcaggtaagagatgcagggaggcagcagtatccctagtggtaatcaatgtttaagaactgacaggccgggcacggtggcccacacctgcaatcccagcaatttgagaggccaaggtgggcagatcacttgcggtcaagagttcatgaccagcctggccaacaaggtgaaaccccgtctctactaaaaatacaaaaaaaattagctgggcgtggtggcgggcacctgtaatcccagctactcgggaggctgaggcaggagaatcgcttgaacccaggaggcagaggttgcagtgagctaagatcctgccactgcactccagcctgggcaacagagtgagactctgcctcaaaaaaaaaaaaaaaaaaaaaaaactgacaaaacttgtattagtccattttcacactcctgataaagacatacctgagactggggaaaaaaagaggtttaattggacttacagttccacatggctgggaggcctcagaatcatggcaggaggcaaaagacacttcttacacagtgagagtaagagaaaaatgaggaagatgccaaagcagaaagtcctgataaacccatcagatctcatgagacttattcactaccatggcaatggtatgggggaaaccacccccatgattcaaattatttcctactgggtccctcccacaacacgtgagaattatgggagtacagttccagatgagatttgggtagggacacagagccaaactataccactcagcttttgcagggttatggaaaggtgggacaatctcaagatcagttagaaacctttaagacagcaaacctgttgctggtgttgctgcagtgttccaggtaacagctttggatatttttgtctaagcatatttgggtttcctctcatgtgagtggacactgaaacaaatgaactagctatgaaagatgcacctttattcattgtaatctcaatcccaacttcttccttttcatcatttcacatgggatgagagaccttatcacactgtcttcatcagtagataactcccactaactcaagaataagcagaagtatccaatttgtatacactgatatataaaaccatggtattctcctacttactttgatcaaccccaatttggcatgtccagttactgccctggggacccattaagagtctatggaaacaaaaaatgcatgaacgagtgttgggagttgattacaagtccaaccctctataaaggccacggcatacttctgtttatttaatatgcacaacaccaagagagagaggtagtaattcagtctgctgggtttctccacaaaatctaccctaaggacaccagcataacaggggaacaagtcaaactggggtggaaatcagttggtatttaaaaaaattatacaagtagcattcatcctaggaaaaagcagaactttcttggatctcttttttttttttttttttttttttgagacagaatcttgctctggtgccaagtgcccacgctggagtgcagtggttcagtcatagttcggtgaggctttcacctcctacactcaggtgatcctctcacctcagtctcccaagtagctgggactgcaggtgcaagctaccatgcccggtaatgtttttttttttttttgagatggagtctccctctgtcacccaggctggagggggcagtggcatgatcttggttcattgtaacctccacctcctgagttcaagtgattctcctgcctcagcctcccgagtagctgggaccacaggcatgcaccaccacgcccagctaatttttgtattttttgtggagacagggtttcaccgtgttggtcaggctggtcttgaactcctgacatcacatgacctgcccacctcagcctccaaagtgctgggattacaggcatgagccactgcacctggtcctggctacattttgtattttttatagagatgggagtctcccaatgttgcccaggctggtcctgagctcttgagctcaagcaatctgcctgcctcagcctcccaaagtgctgggattaaaggtgtgagccaccgcacccagctggaaatttgttagacccctttccgcacttgatgttagacaacagacctataagcaattttatatcttctggcttactttttgtttgttttgctttggtttttgtatttcatggttgggagcaaggcaaaagtgccccaaggttttcggtgtttaagatctccgaagttttaggcccagatcacatatctaatgaatcaaacagacaggacgcaaacccatgcctccgtgacccaaagccccttcatgtataaaatgatgagccagggtcaagctccaggatgcccctgaaagttctagccattcttatggcatagcactgtacactgggacatgacttaatttctccacaggcttctcaaatcctaaaacacgtctctgtccacgcctgaggctcggtatcacaaagccttgtgaaaacgcctctcctgagagaactttcagcccccagacagccgctcattcccttcaagggctgtggtcccaggtcccgggccctagctgtgcttcagtgacatgattcaggagaacctcctccaaagcagcagggcaaaccctgttattttctgggagctgttgtccttgagtcattacctcacactcttagaacttcttccagtttctagagatgaaaatgcgactcagacagtctttgtgactaaggatagaagagaatataagggtgaacacaggacaccttgtggactgaggacataagttcgtaaaagctccctgggctgatgattttaatacaaaagagccaccagacacggttctgagtttaaaagtagaagaaatctggtccagtgtaaatcaagcttattaacgtaaagaattagtgcagaaaaattaaatgagtggatgaagaaaaaagtttggaaggaaaaaataatcctcctcactaccttttaccaaatgagcgttggcaacatgggttggagttgcctttatgcacataatttgccatgcctacattctttcagggcctacaataatgttcctagccatgtatttgaattaaccaggcccagaggataaaactttcaaattaaacacattcctaaaggatttcaggctcattgtgtatgcaccaaggaaacataacatcctaaaaataatacgtacacagagagaagcacattttccatgaacattaaagtggaatatgaattatgacccagctcatgggaatagacatctgattacatgcaaaatggagcttttgtaaataacatcagtcttcgtgagctaccacaattattatcaaccatttaattttattccctagcaactcatccatcgttgttaaaactgtccacttttgttttttaccttctgatgcatgaggctccgaattttataaagttcaccgttaaagctatgtagattaccagcccaacagcgaacgagttcacgaaattattagattcaccaaagcatatgctgcattgtatatctgctattttgggatgtattttgctggtgaattgctagaagcagcaaaattacaacggtagccattctgttcactttttatacaaaggaatcatgaaaatgtgtttaaactttcggtatttgggtatttaagtgcaaagtgactctcaagaaaatcaagtatacttctttctgtctccctggcctgcaatctttgacactattttatgaaataccatccataattccagttggtctatgtcatatataatacgcctgcctcataagtagtaaaataagccactttgtgccttcaccaattctatttcacaacaaagtcaagagacatgtttattaatagaactaaacttttattgatagaagtttaaacaggaatagatgaaggatgctgccaaatgcatcctttgcctgttcctattttaaactcaaaaaccagacacaagaagtacctatggctaatcttttgttctgggagaagttgctaggtggcacctctgaacaatgcctttaacaccttatgggagacctgacctcataaaatacgttgtattttctttcccttgaaattccatttcagtcagaggtgaggattttcattggcttccagaaacctttgagttttaactgcatcaggagtaagcttagaaagcctcctggcctgcaaaaaaaaaaaaagctgttgaatttcaccatgcagcttcaacagcatttatcattgtaactgagctgtatttggttgaattataaaagcctgtttgtttatgtctcttctaatggaatatgagcccagtgtgggcgagggtccattactatcatattcatttgcatgcgccaatagtattagttgaattgatattcactgaaatgaagagaggactatttaaggtgcgaatgcaagtttatatttctagtaaacattttaacattttagtcccaatttcattttagtcttggcctgaaaacgtattaactgggagggctagccatacctttctattggagccattcatttgcccattaacacagaagaagtagaagaaatgaaagggcagaggtggcttattctgtttttagcatctactttgtgtcagactttggctcggcgttttgtttattttgtgtcatttgatccataactatactactgagattgactgaattatccccatctttaaaattaggaaactgggactcagggaaagtaaataacatgctcaactaataaatggtgggatccagatctatccagctcccaagcttgggccacgtcctctgctctgttacaacaagtatgcttttactcaggcatcatctctaactttcttctttaattctctactttaaatcttgcaattaataggagatcctagatctgccaaaatggatagatagtacctaaaactatggtggttaacatgtgatttgaagttagaaaaactatgggataaaggccaaattacattttctctcaaagtctcagtttaccaatctgcaaaatggtaacaggcaatgtctatctcccaaggtggctaggagaaataaatgaccttacaaacctaaagcccatagcactgtgagtacctaacccacagtaagtgttccacgaagggtagctactgccattatagctaaccacttgttcaagcaaaaatatttctaccataaattatttcctaagagaaagtttgctcaaaaatattttttttccccaaatactgacaaaagcttgccctgggaatcccattcctcttcacatctgacagtaacctggattttgacagctctgcttctggctcacaatgtattcacatcaggacctgctctgcttttgcccatcatggttacttctacatttttgcaacttaattccaataaatatataaaataaatgctgaattctattaataaatacacaaacgggtaaaggcatgctgggggcatgaggaggagttgagtggtttatggagggcccttcctatctccagcacaatagagactatgccaaggaaattcatacaaacggtctagataagtagactgccagaaacaatctggttttaatgaactaaattaggattcattcattcaacaagtatctaatgagctcctactatgtgcggggccctttgttaggtgttagaatatcatggtgagtcaaagcagatacagtacctgccccctctagtttacagtctgttagaaaagaccagcattaaattaggccaagaatcaagcaaacaaaagtagaattgcaaccatgacaaatgctagcaaggtgacagacacagtgcagtaaccctatctagcaggatctggcctagtcatgcaggtcaggaaagttcactgaggaagtgatgctgaattcaatatttaaaggctggcccaaatgtctatcaactgatgcgtgggcaaataaaatatagtctgtccatacaatgaaatatattccatcataaaaagaaatgaagtactgattcacgctaaaatgcagaggaaactcaaaaacattatgttaagggaaagatgccacagtattgtatgattctacttacataaattgtccagaacaggagggatggtggtggtgagggtggtggtggctgaagagtgactgctagtgggtatgatggggagtgagtgctagaggatacaggtttctttttggggtgatgaatatattctgaaataagatagtactgatggtctgaagtaagatagtggtgatggttgcacacctctgtgaatatattaaaaacactgaattatacactctagatgggtgaattgtgaggtctgtgaattaaaaaaaaaaacatctaaacaccaacccgaaccagatggtctgtgaattatatcccaataaatctatgtgaaaatactgcaagcctagggaaatgacaagctgaggagcaaagctcctgtgtgtggttggaggacacatgacgagcaccattggaaagacagaaaaaaaaggccagggaggatcaggcctgagatgagactgaggagggaagcaggagcaaatccacacagggccctgccagccatgttgatgttctgtttatcctaaatgcaatgggtggcactggagggctttaagcaggaaagaggtggagggaagaggaaaggacacaatggaatttacattgtgaaaagatcattctggctaaagtaaggagtacagacgggagggagttggaaagcttatgtgtaggccagttgagaggctgcaaaagtccaaggcaaaggtggaggtagcatggatgggccgaagtgaagagattagaaagatgtgtaagatgttaaatcaacaggacagggtgacagactggatctgagggtaaagaaggggaaagaattcttgttttcatgttttataacaagatggatagtggtggcacccatgggagacaggacactgtaagaggcccaagatgtcagagggagacaatgagtctggttttagacatggagatcaaagcctttggtatccaaaaagggccacgaggaagacagtgggtgcaatgattccagagctcactggagaggcctgggcttgagatggggatctgtggctcacctaaagagagacaagtggaggcataagtacgcatgatcctgccccagtgagatgacaggaaggcttgagactgagctctgaggagccctgacacttcatagcctgaaactgcataattggaatctcatcataagacaaacccaaagtgatggtcattccatgaagtaactgacctagagtcatcatctgtgtcaaggttatggaagtcaaggaaacgctaaggaagtgttcacattaaaggaaactaaagagacctgacaactagatgtaataggtgattctgaactagtacctttggctataaaggacctgattgagacaatgggtgaaacttgaacggggtcaaaggatttgaaggttataatgtatcagtgctaatttgctgatattgatggttgtattatgtatatgcaggagaatatccttgtatacagggattacacactaaagtattccaggtattggggcatgaggttggcaacttattctcagatgattgagaagaaaattaagtttatctgtactagtcttgttacttttctgtaagccagtgggcatgacccatgtgagaggtagagtgggttttagaagagaaggaataatccatggtgcacaggtcctgagaaggaagagttgaagcacaggaagtttgagaagaaatttaaaacagttgtcatgttgtgtgagaaaatgagtcaatcagagaattagaagattgccaagcatatttggggcccataacaggatggtgattatgaacaaaacaatgccgtgacttttaagcacattcgagaactgaaaaaaatgtagcatctaaaacagatttttaaggttgcgtgtatatccaacttactaagcaagtttatttctaataaaagataagctatactttatagtatctcttccccattaattttgagaaaaacgcaaatgattgtgaaggatattagaaaaatatagtttaaaactcacaaaactatgaaagtcagtttatgtatatgtatatgtgtgtataaaaaatatgcatatgcacacatacacatgtatatttcattttaattaaaaaacccaggttatttaaaatatcattattcaagtacttcaagaccaaaacagttgacatcagtaactgtttaactgaactaaactgaatttatttacaaattgtcactctcttgacaagatttgagcagtagaaaggggtaagagaaacaacggcataaaaatatcaaatccaaaagtattattagctagctgaaactcaattatgatataaagaaaaattccttttgaataccaaattttgtgaaacaatgggatacttatgaaagtgtaatttatatttattttcttttcagatctctaggtgaaggatgcctttatttcacacgtcttcatctgggatctataatgctcaaaagagattatgcctccagtttatttatttgcattatttcttttctattatataccaagtggtaacactcttggtctggttttcctgagatgcatatttgaaccaggacttgacttagctcagcaagcaactaacttcctgggatattgttgctgaagttttgtactatgtggttgtgtgtatgttctagacatacatgtatgaagtagttaaagttcttcttggcaaattggtggttgggggaggataagggttacaactatatctactgacttttagaggtatgccagatgtactgttcagtggaaaaaaatatgcatggtatgatgctatttccacaccaaaaagagaggaactccctataaatgtgtatccatgcatatgtacatctgtattagcaaagagaaagacgtggaaggataaatctgctattacttgttccacgacgatgggcaaatggagaggatgacagaagaaccacaggaatggttagagactcttcttatgcaaaagactatatatagaagttcatgtgtactatgtaaaactgttcataattttgttttcattatcacttacttctcttctgaagagttggaagatatatgttcctcctacctaatctgccaaggatggtcattttatcgctgattacctgatagggtttgtctcaaaatagtgtctttttgtgtcacaagggaagtacactgtgaaagggacttattgcacgtaagcatgtatgtcaaattcagcacatgctctacccatgaagaacacttcagttaattgactggctagcaaaattacatgcagagtacttgaaattacgtaggattccaaagaaaacccttccaagtagcttacatcacattttaccagttgtggttaccatttgtacagatcccttagaaagctataaaatgtgacccaaatgtaatttaaagccagaagtgttgaactgaagaagaatggtatatctcccccaatacacaaatcaagtagaatcctgcaaatagtgcccttctgggcatgagactgagtcatatgaaatttggctaaactcacaaccttgaaagtgaattagagaagagaaaaaattaaaagttggttttcaaactataagccactaagaggtaaaaatcaagaacttctatatttgatcaacggagtagaccaaaattgcccacttcaccttttcacatgacaatcatatggagtgtaatcacacacccaggttggaccaagggtggatattagaaacattttacattcacaactaaagtcattttgaaaacaatgaaaagaggccaaagttaagtctaacaaatgcttaagagttttctaacacagcccagacatctacctattcctgccctggcttcagcaagaattatcttcatacaagatcataaactaggaaactagttttcatttatgggtcaaagagcagtacaggggatccttctgcataaggccacagcagcaatttggaacaataataaaataaggaatcctttcttattacctatgtctatataaatattacatgcgtatacatttatattatgataatagctataatttattgactgcctactatgtgtcaggcactttgccaggtgctttaaatactttatgatacttactcctcaaacaactctgcgaggtaggcattgcctttcctgttttacagagcggggaacagattcagatctgcaatttgctccaagtcacccagctgttcaaaccaaaggctatcagattataaaagtccacgctctcttggctataccccaaggagtttgtgcatgttgatcactgagcttggaacaaatttaggctccagtctatggctacaaaacaaacaggagaggcaaagcgggtcttccatgaggcaagagctgcctcaggcaatcaggggagagtgctgctgagttttcctttagtccaaatgttccctctgttctcagattgttcagagaggactaattctccccaacaatgcttccagttcagtcctcacttgcaagcaaaactcaagagccccaaatttatagctttattctgaaaaaaaaaacaaaaaccagttttgctctcagtgggacccttcaaatttgttaagacctcctgccattttctttctccaaatccatcaccaaccaagtgagagacagagggtgattcattctttatctccaaattgacctagatagtagctccatataaataagacactcaagcctacagattttattaacttaatagtggttcttattcaagtattatttacttgctatggtgtccaatttggtcgccaccaacccacatggcttttgcacatatgaaatgtggccagtctgaattgagatgtgctgtaaagtgcatacatacaccagattttccagatttagtatgaaaacagggatgtaaaatatcttatcaacaagccaggcatggtggtgcatgcctatagtcccgactacttgggagattgaggtgggaagattccttgagcccagaactttgagaccagctgggcaacatagtgagaccatgtctcaaaaaaaaaaatcttattaactattattttatattggttacatgttgaaaccaaaatattttggatatgttacgttaaataagctgcattatcaaacttaatttcacctatttatttttattcattttaaggtagttactaggaaatttaaaattacatatgccacttccattatagttcaattggacagtcctggtctagaatgaaggcttgccaaagctatttaaagactgttaaagttctgtatcatacacaggctctttttgtttcagtttaatcctagaaggaagaaatgtgttgaaattgcagctatataaaatccttgatggactgaaactaagggggaaaaagaggaagcaggtgggtttgaaagaaggaaaaaaggagtatctagcattttcttttaaaaatgtcattcttgatttatttggtggcacaaagtgattttcttacgtttctcagactgcttgagtcagtctatatagaggctattcctggatcttagttgaaagctgttgcctttctaattgtttaactgatcacttctgaacgacaattacagttcattgttattccctgttaaaaaaccattgacatccatccaaaagttatagcttacaggtcagggaatatttatgtgatatttatagtctgtgaagaaaaccctggggaactgccagtagggaggattatttaccaatttctttttcttcaagtttgaatttatttgagatttatatccaaaagacattttgtaatcctgtgtaactctgatgtgtgactataattgtgcatgttggtcaagttcaaggaaaaaaaaaatcttttttctttttaatagtgggggctgggaaccctggttgattccactaaaaacatcacagaccaaaaaaaaaaaaaaaaaaaaaaatccactcaaggaagtagtgttacatacttgaagaattttctgaagttagccaagaaaaataagctacgatcaaggaggaaaagctggagtttcagttttctggagattgtacttcctggtaacataaaaacaaaagttaaattcagaaaaattcaactatgaagttagcatcacataaaaaacaatggaaaatatttaactatgcgcatatgtttgtacacaaacagaaatagatataaacagaccttaattagcattgtagactttaattatctttgtacagtaattgggaatggttttgttctgatttattccataatgcttactgtgttctgttaacaactcatttttttccccttccagcccataatagaaggcttttactgcatactttattacatctgcttctcatttaatgaccattgttctggtctgtcagagcgagtggctatacaacttcccaaatctgcaagattaagcaaatattttgacaatgtctagtttcttttttcctttttttcaaaacataccagataaaaataaaaagatttttacttacccacacaacgttaggagagtttttaatctaacgacaataaagaactaagcggcagcaaaatgtacttcatgtggcaaaatacatcaagcaattttctgtcccatttcacttaaaaagtcctaagaatctggtctgaatcacacagctggggttaatgggagcactcctggactgcagggaggttgtgggcccctgggcaaaccacgtggagaccttcaagcttctagaatgagacagaggccttctgctcattttggagggccccggcaggtaagctgaatgataggtgtctgaatcactcactatgaaatgtcatttttaaaaatggtcatgctacatacaaaattgcaataccactgatggcataaggaccagggtcataactctccccaaagaaggtggatacaaatacacaaacagaagcatttctaagcaactgggcagagagatacagagaaaagaggatacagcgaaaaatctattaacccataggcattcattaattctacaaatgatctaatggtgggaagcagaaaatacacaaataaaccaacaaaagcatgacatggacataaatgctaagagggaatggtatgtggaagatgctgcagtcagtggaatgagggaaaggggttaagaacagatgagctttcaagagacagtctatgcctttcagagtagtttaggaaaaaagttaccgaaagataactaggaacagaaaacaaggtgacagaaaggaccgcattaaccccagaagcataagcctcttaaaactttctggtggggagcctctccttggaggcagcaaccagggaaaattcccgcaaggaggtcctacgggagcagccagaattctactagaaagacaggaaagacatgacagggatgggtctgtaggagagcatcggcaaagatagcaagaggatgcaatcctctttagaggaagtagaggtttgccttgttgctattagattgcttcacatctccattggtttgcgtttactatagggcggaaagcacaaagcaggatatgtatgtgcttcaggaagcttaagtgcaaggcaatggggttcatttgtgagctactggcaaaccatttgtatttggggtgggcgtcccgtgcagcacgcctctggaacagtcccttcactgttaacaccactgactgggcccttaattggagcaggtctgcgcgttttaataaacatctttgatgagttctctggactgttccattaaacactcattctaccaaaaatgcctggtaattctctctaaaaatgttttcatgttaccgcttccaggtctttctaaagttaggcagtacaaagaaacaaaaatccaaaagacttgactttaatttagaagtctcaaagagagtgttcaccctagagcagagatttctaaagttgtagtattggactcgcttgcctccacccccacccctgcccttctcccaaaacaagaaaacaaagcagcatcaaagcttgaggtacagaacagaataaaacatgttggtgcagatttgctggcctcggtgaaaacaacctgaatcagtaggtcttggggtatcttcacttttaacaaacactacaggggattttgatgcagtcagttcaggaattaaattttgaaacacacttttgtcaggcggcaacagggtagatagcttaagaatggggtaggaagctagactataggaattcaaatcctagctcctctacttcctagctgtgtgaccttaggaaataaacactctgtgcttcagtctccttatcttcaaaatgggataatgggagcaatgtgtaagaattgaaaaatatgtaaagtacttagtactgtgccagacatgtcgtaagtgcatgaaaaatgttagccactattaacagtggattcatcccaaagtgatttcagctaatgagccaaatttgggtagaggaagtacgctgaagcagattccaaccaaaccaatgaatgaatacagctaagcataaaatagaatccttattaggtatcctcccaccatcatttcagtacggtcagcaccagtctataagctgtacagacatcctatacaatatcaatctcctgtagcacaatatatcctaacaatcctcttgggcacagacgcagccacagggcaggagacaaagcaacagaaccagcaagcacgcactctgctgcctcacttcatgggaatcccattcaacaccagtctaggaagagatgaccttggaatgcagatccagttaattcaattcaatgagcatttattgaacccttgtgatgtatcagagattcacctagatgctgaggataatacaaagagcaacaagaaaatcaccctgtcctcaaggaggtcataatctagtgggaaaaagagatacaagtaattgtaaggcaaggtggcctgagatgaatgctataatagaagatggaagaaggccatgcgaacacagagtaagtagtaattaactctgatgggggcagtcaggaaaggctttcctgaagagcagacatagcatgccattgtgagagatcaataaggcaagcctatgaaattgtttaatgactttatcattcatggaaacaacccagaaaaagcctgagggaccatctctgtctctgcattaacatgggtgtgtttaagatttgattaaatgtttgttgtttctgtaacatcgcatttaaaaaaaaaccaagtatgaacattcgtctattattctgatcttcttcaaagagagaaagagtcctagaaatacttttcttttttccaaagcaaaccctctgcattaatagcaaaagaagaatggcaagttatcgaacgtattatgaactagttagccaaagcgcaagtctgggaaggcccacatttgttttatgtagcaatgagacaaaatatgagagtttttttcttcttatatatggttgcctctttctacttgactataatcattaataatttctttggaccagcagaggaaacaggtattgatcacaataaaacattgcatccacaaacacttgctatagcaggttatggtctccatggaaaccctccaatagaaccaatctgaattcaatttcagaagtaatgagaacagataattttacactcaatcaatcactgtcagctgccgttatcagccaatcagtcattatgtcagtcagtcacactctcaacaaacttcttctgtggcatggtcagatgagaatgttttgacatccagaagcaacacgagaaaattggctcatctttcctggcaagatgccaaagacacagcactgcattgtgtttgctaaggcaataaacagtccaatcaaaatacactgtggtagcggaagattctaggcagcaatttcaataattgttatgatactgatggcagagacgtactttcgacccaaaagtcatacagtttaatcctctcatttaaacatgaagaaacagagcaccagagaagttcaagtatctgcccaaagctgcacagctaactggtggaaagcccacgactaaaacatgagcattctccccttccagtgctcatccaggatgccttgctgctgctcttcactgccttcctttttgaggcaagagggtaaagggatatttgaagattaggttctaattctaaacagagagccccaagcctgtgggagactcacgggatatttgtgaggcttgtgctttggagccaactcaaacctcttgctgtttggggttagctcgtccttggccaagtacaacttctggtttctaaggaggaacaaaagattttgaaacactacagggcaaccaaatcactgttacaaaatgacattttcgataagtttagtgcaggactatcaagaacacatggactgaattccctaaaaatgcttgggagagggaggtaaaatttgaggggaaaaatctggcaaaatacagttgggctcttgtcaacctcaaatgttagaaatgttggcatttgggaattgtgaagaatctgaaaggtgtctggtttctttcttttttctttttactgcattattgctttgtccatttctcagagacagttctctgaggctgaggttcacattcttccttggtaaaacagatggttgggaggccgaggcaggcagatcacgaggtcatgagttcgaggcaggcagatcacgaggtcaggagttcgagaccagcctgaccaacatggtgaaacctgtctctactaagaaaatacaaaaattagctgggtgtggtggtgcacacctgtaatcccagctactcaggaagctgaggcaggcgaatcacttgaacctgggaggtggacgttacagtgagccaagattgcaccactgtactccagcctgggcgacagagtgagactctgtctcaaaaaaaaaaaaaaaaaaatagatggaccagcttgatagtttgcaaacttcaatgtgcatgggaacttaccaaatctgttaaaaatgcaaatccccagatcccacctccagacattttcattcagcaggtgaggctgggcccaggaatctgcctttttaacaaaggacccaggtaattctgatgcactttctttgccaatcagtgttagaaaacattggttaactaatgctatttggtaaagaatttgggccattttgttgatggtagttttccaattacattcctccccaaacattccaacttcgtaaattgtgtgtatcacccatattacaagaacataattctaatggctatgatcacaagctttgatatatatatatatatatatatatatatatatatatatatatatatatataaaatatatgaaatatacattatagtgccactttctattagctgtaagtaggctttatcttaaataggtaggtggtatatgggacactaatacatcccatcagaatttgtctaaggcaaatgaggtgaaaaagcaaagcaagaatatgggttcaggcttgagctaaaactagtaattgcaaaaagaacagtttggaagctttcacatgaaatgcttgcttcatttctctagtctgcttgcctgacctcagctcacgatacctattttatcttctcgcaaaacattgatataaagctttttgcctgtttctacatgtaatactgatcttttccctccatttccttccgggctttatttttttttctttttctgatgcatttcaggacatttgatgagtcttggagtgtgtttaaatgatgacaagcatgtgatgtgtacactaggtagaccgtacaccctatgaggacaaatacagttctttttttgccatttcatcccctgaacgtgtcacagtacctggcacaaagcacttaaaaatattcatcgaataaataaaatgaatgaaaggatggatggatggattacagacaagtaaaaactcatccatctggaggctgaatgaatgcagatacttcaaaagatctatactttatagtcataatcaataatcactcattttttcaaaggttgtttttattgataaaactcttggttaggtgttgttgaccccacagaaaccaaaagcaactatagtattttgtaattatgccttcctttgtaaaaccagctatcatatagatttttctttgccaggcttatttcattgttgttttgactgaaatggaaatattactggaagctaaaataactcatagacattgggtgaaccataggggagacagtcaggaatggggagatggaaaaaaaacccaaaactcaccagtgcaatcagcaacagatcctccagaagcctgtaaaaattaagacaacttttaaaactctctttgcctgtcatcactacacacatcccaggctcacagtctttctgcatcatgcagatgacagaggtaacccttaggaagcttaacttatctcactggtaggtttcacagcctcatgccagtgacgtcacagaaaacaactttaaatcttccatgaaacaagcaaactggaggagagatgaattcaatgagctatcagaggtgctttccatcctattagaaaaaaggaggaaagcaggaaggaaggcagtaagaaaaggaggagaaattaacatttgtcgagcatccattgacaaccaggcgccacactaaactcttcatattttatctcatttgaagcttattatatttccagggggtggaaattcattggttcattttattttattcatttatttactttatttattttagagacagctctcactttgtcatccaggctggagtgcactggcacaatcatagctcactgcagcctcgaactcctgggcttaagggatcttcctgcctcacattcccaaagtgctggaattacaggcgcgagccaccatgcccagctagtatgttcattttatagatgagggaaatagggctcagagaggttcatccccatgccccaacagctaatgaacaataaagctgggactaaagtaatagcaaatatttactaaggacttaacgtcagtcagtttcatgtgtgttaactattaattcattgaatcctccttttaatcttatgaggtaggtacctctatgcccttttcagaggtcacagaacaaacacagagaggttaaataacttgcccaaggagtcacagctgatacatagcagagctggggctggaacctgcgtgatcagcatcagaccctcgtctcttaactaccacactcagccattctctacaatagcgtctaggttggcctttttccaaaggctaaatcctttccggaatacaactttgattttatgtttctagagaaaacaaaaaaggcatacctcaacaatagcctattagacttttccaagcatgacaaatcatgtgtatttgttatatatacagataggctatgtggtcttaattaaggtgaccatataatttattgtccaaaccatgaaagaaggtgctatcaataattatccagggacaacagtggtaacctggaactgttccaagatggcaagggtgcctggtcaccctagtcctaatgaataaatacacacacacacacatacacacaaacacacaaacacacaattagatatcgttactttcagacacattctgatactacccgctggagtacggatgtgtagttaaatgctttctaacactgtgtgagcccaccctcctcccacctcaagagctgctagccctttctttacctaatgcatttcttttaacttgttttctcacaaaagactgtacgtaattggtcagccatgagagattaatttgtgcttagctggctgagcggacacaagataactcaatagcggatgatgccagtgcatgaaccagcagcttctctcgataagccttcctacctactcgggacctcgtccctccatagcctgcttctttgggaattgccagccaagtcctttactttatttacctcatttttgcctgcctggagaaattcaaacttgcagtttttaagtttcttcatgggccatttttcttacggaaatagaaacagtagcaaagacacccagactctccccttctaaagcaatgcatcaaagagtgcactggggtatgtggatagcagagaaactgagcaagggcaagtttatgcatatccttcatcctgctcacattgtttataactgcagtcagacacagacagcaggctgagagtgatggacatggcgatgacaatggcgatgatggtgatgggaagacttctaagaacttaaaaagcgttttacacagatgatctcatctaatgctatctcagccctaggtggtgggtgcaattatcattcccattttagagatggaaaaacagatatttacagagggcaaacattctgccccacgtccaatctaggtaacttaacctcagagctaacactctaacccacagggcctggacattcaaatgcacaagtcaaccacagatgacagagtacaggacaaattggactggagagatccatgcctcccaactcctcatctcacagatgagaactccagttcagtccttttgcctcctccagaaaatacttacctgtcaagaactttgtaaaaatgaaatgagagaaggttaaaaacataaccaagaagtgctacataaatgttttctactgtcactagaccagcccttaaacgctatttcagaatgtattactctaatagagtaatttttaaatacctggacatcagagctaattggacatcagacattggagctaattccacctaaccatagaaatgcactgtggcctgggtttatgcctgtcatacagttccctcccacggcaggtacatttgccacatcccaatacactgccagtaaagataaagtaccttctaatatacttataaaagcacagagtgcaggggctagggactatagaagaaggcaggaggcaaggaagcaaagggttttatttttttttaatgtccccaactcctctaacctggtccctttgctttgtttggctggtacgacaggtggtgactcttaagcactgtgtagcctgctcttgtgtccagattatcccaagcagtctgaaacttcaagagaatttgcagtaatgcacaagtcaggatttggttcccagagcaaagctgtgctcaaaggattggacatcagaaacaaacctaaaaagagccacaaacacggaccccaggctcctcccaccccctccctaactcacctgtagggtttaaagagattccattttaatgaagcaggatgggcataacacttgggaaggaaaggaaatctggcctaccccaaagcaattagcttcctctgctaggaagagactgtgcttgtgtcctgaggtttttatttcatttttcctcaaggggatgggaagttcgctggtctaagattcatgcctttcagactgctcctcaagtgaggaggccacgtggccctgtaacccaaatgccaggcccttggtatcaccttctgctcctctcagagacaccttgatgtcaccttccgctcctctcagagtcactctgccgagtcgccctgtgatgaggacattatctggacctgtgctaatacagtggctaccagccacctgtggccaccgagcacttgaacctggccagtcccaactgaaatgtgctgtcagtgcaaaatccacacctgagttggaagtgaataaaaatatctcaatttttttacatgaattacacattaaaattgtactattttggatatattgagttaaaaaatgtatctccaaaattaattccacctttttcttttcaattcttaaaaaacatggtcacacaaatatttaacactgtgtctgtgcttatcatatatacgctatatttccactggacagcactgttctagacactcatcaggtatgattgctccatttcccagcagcatgtgtatcaaccaggagcctgctagaaatacagaatctcaggccccatcccagacctactgaatcataatctgcattttcagagatccccaggtaatctgcatgcacattaaagtctgtgaagcactgccctggggtctaaaacattacttggcacacaagaggcacttgagaaatatttgttgaatgaataaatgagttatgtctaggaagctgctgtacttgggggcactcgggaaaatgtgaagggctgtccctggctttctccttagctcagttaatattgatatactcatcagattaatcacctttcattttagtagctgatacggtttggctgtgtctccacccacatctcatcttgaattgtagctcccataattcccacatgtccagggagggaccaggtgggaggtaattgaatcatgggggtgggtctttcccatgctgttctcatgatagtgaataagtctcaccagatctgatggttttctaaaggggagttcccctgcatatgcttgcctgccgccatgtaagatgtgactttgctcctcattcaccttccgccatggttgtgagtcctccccagccatgtggaactgtgagtcaattaaacctctttcctttatacagcactcagtctcgggaatacctgggttataaacagacctccggctgaatgttaagcactttaatgactgagaagctggggagtatggggcagcatctttcaattgctgcgctgaagtaaaaaggctgagacaaggacagaaggtggggaaggtgagtactctgaggcacccaagctgcatagcactgcttgtgctgggatcacaaggtgcccagatcatccaaggggtgtaccaggtatagaggggagaagaagaccctagaacaggtcagacagtgcagagaatgagggcaggccctggccaggagtcagggagaggctgggcctcaaggcatactgcagtgtccagcaaatcaaaaatctgacaagggactggcctacatccctactccccattccattcctttctagacctaaaatctcaacacaaacggaatgtctgatcactttagctataaaaacacataaagccatatttttcccccttaaatcagaagcaaatgctaagggaaaaggacttcgtggcatgcagagaacaacaggcacaactattgtctctgtctcctggcagtctcccccagacatctgcaacccccactgcaacaacctcagaccagaacaagagagggctggaaggtcggtggggagcagagagaaaagaaagcaaggactgagaaatccggggacaggatagatcaacggagaaaaggggaggaagtgagaggaagcagttaggtctcagaagttccaccagaagctacatgtgtgcatgggagagggaaaggagggcaggggaggtagtggagagaaatatgaaggtatgtcttaaataaatttcccttttaattagcatgaggaaaaagaggaatctacgtctggctggagggcactgtacacacaggatggcccttgtgcaaactcaacttccttcaccccattctggcaaaacatggtcagctctttctcagctttgataattgtcctagggaatagtctccgccaggagaggtggtggggagacagccagcaggtttctattagccaataagcctctcacaaaggggaaggtggtcgtgggcacatggaactgagtgtcgcaatcatcctgctgccaccatgctggagcagcttagagatccacctgagtgagccagaggcgagccgcaggaagggtactgcagagatgttcatgcaaatgcagggtgatccccaggtccctataccaagcagcaaggtgcctctgacaaatgttgcttaatattttttaagcaaatcaacaaaccccagctggactgggtggaatattacacagcaggatccaggactgaactgaggaaagggagctagaattgataacagatgccaacaggccttcaacagagagggaaaaaacagccttcaacagagagggaagaaacagcctcctctggtgtcaacctgaagtaaggttcttttgacttcgaggctgctctgatgaaaaacgaggactcttggaggtattcagagccagcctcctgccaaacagcatactttgtcaaagtggaattgatatttgcaagctcaaggcccttcttggagagcatcttttgctcgaaatggctgcctcggagttctcaaccgctgaggcagctctacctagtccttcatttcttaccttgactggggcaaccagccgttccacagccacctctggtgtgaaacctataaggattctctctttttattctagaaggggtctgggtctctggcatgctgagcggccttcaaaaccacagagggccttctttgatgccatggatgagtgggttctgaccgtccttatgcccagcatccagggatttgcactagctctcttcaggtcacctggcacatggcctgggccccctgcagaagcccttgccacacaggattaggaaataagacagactgaccaggggactgatttgtgttcccttactctcaaacgatttcaaaaggaagaccagttttctcattctatactcacatttttcctgaagaggaaagcaacaggacttgggtttttgcaagtgggagggcataaaatgcattaacaccatagaagtgcctctagagggcttggtaattacagcctcaatgtgttctctaccttcttaaaagggcaaatggaacttctccttggagtgtctcttcccttgttcttgagacataaatcaggataaaggtgtcgagaatggtaaaacaaaaacaaaaacaaaaacaaaattcaatgaaaaatctgaagcatcactcattttgcggtattgttccatttttaaaatgactgtttaacatttttccccttttttggcatctgatagtacacataaaattccaatcctttattgcccccaaattatttatatatgcaatagacccagaaagagaagcagaggaagtgaagtgtggtcctccggccatgactttttgccttggttttcccagctattaaaagggagatatcatcattcattcaacaagcatttcttgcggacccattttccacgacagaaccatccaaaccaagacacttcttcctattgtggcaaaaatgagcaacgttaaaactccccagaatgcagaggtgactcacgtgtttatgtaagtaagcatttagatatggctttggaaaagaaaacacacacctaaaagaggctaccagcatttgaataaagtgtgtaacctgggtgttcaaaactgtacaacagtttctgtgtactttaagtcactatccttcatacttcttccctttaaattctatttgaaactaaataatatcaacaatactttaagtaagattatgctggtgttactgatgaaattatatgcaggtctgcttggcctgttctcatgcgtaagcctttgataacttgttcctaggttatccagttctgcttacctgagtacccactttatcccaggaaacgagacctgaacactgtgtcctggtttcatctttccagtgagccaggccttctgaggcattagcggctcagcaagaccatggaggtgagagaggcacaggcacactccagatgcagggtctctgccctctgtcaagagtcacacggcagagaggacaagactcctgtcccgggggaactgtttttccttttgccccacaccccagatatcttcgtgacagcccctgccctgaaagcccggtgagcgtcatggcggagaagccagcctgtttccgattattctgcctgacagggactatctgctgctgtgtgcagttgtagaaatgtcataagctcaggactcaggacactttgacgtcgagtccaacaggacccatagagtccccctgaacaattctcatctgtgtgggaagcctaaggggtggttttaagtaggggctggcaggagagtgaggtctgggctgcttctttacggctcttcaagtgccggccatttcctggagtttcatgggagtcaagacttacttttggcctcagacacagtcaaggatcatcctgatgcaaaaaacaaaatcacctttgaacctcttcctccacaccatcttccactttggttttccgctatgcctttgtactggggacaaagactatccacgaatccttactttaaaaactgaggcagtggctctgaatcattcccccttggacacccccacacatctgaacaccctcgtgtcccaacaccacatctgctgaagttgactggacctgaaatgctggaggctcagtgttttcggaaactgcggagagttctcctgccacaattctcttgttgtcgtcaaaagcaattacatgtttcagatgatgaaaagcactgtcatgaaaagctggcacagcagccaaggagacagatgtattaaaccacacggcttctcagaactcccacttacgttggagctcagcacagagatgagcatggtgatatccccccgtctaacatcctcccatttggatttaatgcatgaggctcgtttctgatgaggtgccaaattctttcggtggacaaacacaaagttgcagaattcagtgatcatacaagtccatgtcctcaaacgaaaataataatactataaatgcaaagatgctaccataaaaaatacagtaggtggacttttgtgagtcaacataaaaaaatccagcatttctaactggtagcatgaggagtaccagtctgcaggatgttaacgcactgataggctatggacaatatattccacacttacggaagtggggaaactataggtcagacaaagctacaggtacttctttctttcttttttctttttttctttctgagatggagtctccctctgtcgcctaggctggagtgcaatggcatgatctcagctcactgcaacctccgcctcccgggttcaagtgattctcctgcctcagcctcctgagtcgctgggattataggcgcacaccaccacacccggctaatttttcatatttttagtagaaacgaggtttcactgtgttagccagaatggtctcgaactcctgacctagtgatctgcctgcctcagcctcccaaagtgctgggattacaggtgtgagccacggcactcggcccaagtacttcttaactgcaggacttctcagaggcttttaatatggtaatgagtgctgtgcagtgagatgactcaaatcaatatatagccaacacgtttgatatgaccacagaacccatttccctgaacactttttatcacctcctagagcaggggtcagaaaactactgcccatgtggtctgatctggccactgcttgttttcgtaaattttcactgcccacagccaacctcatttgtgtacatgccgtccatggctgctttcacactgcagccgcagcgatgagtcatgagacacgcacccgtggctcacaaagtctaaaatatttactctttggccctttacggaaaacgtgtacaaactttgtcctctgaaatatagtttgggaacctacttcactcatgatatcaataattctaaaaaatttcaaacaatttttaaagtcaacattgagaagttttccatggttagaatttaataattacagtcaataactctcttaaagcatcgtgacaataaagtagaaggacactgtgtaattctatatggtctctgtcttcagggagctcccaagctagtttgtgaaaaagagaactcaaggcacaaacaactggggggcaagagatgttctaaacactaagaggaggcaatatggcatagtagaaagaatgcaagcatgtgtaagagtaaaacatacacagggcgcagagtcacaagagtcaggggttggtcttggctgtgataccttctcctgcgataagagtaagacctgctttattgagcacttactatgtgccaggcaccatcccagttgctttccatgaaggattgctctttaattcttatcataatgaataggtactattattatcccagtttatgggtgaggaaaccaagtcttaggttgactaacttattaaaataaagcacatacctagtaggtggtgaacaagagccaaaacaagtctgttggtcagctaaccaccacgttatagtggctgctgcttaggggcagcatatatcctctgcatttccccagaggtgacagaagtagtggagagggtagtgctctctaggctctgacacacagcccatgtttgctgactcaacaaccacacaacgtaatgctatggcacctcaggtggcagggagggtatcgtgggctggactgatcttcagaaggctgcatctgagcagggtgtggaaggatggcagaaggaagaggggagtgaggcactcagggtagacagaaggtgatactgccacatcctccactcagaaggaatctggaaggttttgacaaatatgtacattttggagtgggaacagcagaaagtaggggctggctacctactttccactacccctatccccactccccctagggggtgaggcagagataagcacgctttgtggggcacactgatccacaaacttgcaagcctgagctccactcagcagcagcctgggcaggatgaatggtggtgtgcaggtgtttgcggcatgcatagcttctctttctcctagagtcaatccagtgatcccctgcgaaaagaatcctccacttgacctgaatgctctgtattggcaccttctggacaggaatcctatcgggtatttcatcaaagcatcccacagcagttttaagtgtggctccatgagagtaagacaccaggacagctgtgccacctagtgatgcttgcctgtactgtctgcatcccagagagtgggagaggcttcggaaaggactggtatttgctatttttggccaacacttctacatgcaaaggaatctgaagtctccgcctgggcttcaaaacatttcttgtggcctcactgaccattcccgtgagcctcaggggacatgagtgtcttcaagctaagagggagcagtccaactctgcagcacgaattaccaaggaacatacaacagacacttcccctcctccatttctgcctttcagcagaaagggagggtgcacctcctcttacatcctattgtggctgcaataacctgcttgctttcttgtgcagcctggaagtcttatgcacacagcacctgctgctttctaaactaaatagaaatgctatcgtctgcagtcagaaacagaaaagacagaggatgcctggtgaggatctgtcctacatcccagagtgcaagagttaaaggtgctaaccattagtgttatgtgggtgcagcttatgcacacagagaatgatcagtgttttcatttaataggaactctcctccactcccaaacacagcagtggagggaaaggccttttaagccttattaaggttgaggaaaaactctggtgaaattatactacatatttttgtttctttctctatttcagattccttgcaagaggtccactggaaagctagaattctagaagtcaggatgggaaagcctcatacgtaatgcttttgctcctttgaattacagttaactccagtggtgccactgacactgctttcgcgtagtggttctagtatcgtacgatgctgatacaagtaagctatggctatgtgttttccgtaagaaaggaaaacatcactccaggagagaaatggaggatgaatgatatttatcagattgtagcttctgaaaatggatttgctttaccagatcaaagacagcctgtttctacacatcaccaattctgtgggaaacattccagatattctgagagcgcattttgagactgagtagttggttccctcactgactgtttctactgtaagtaatagtatatttccatgcactcttgattggtattatacagttcatcaataagacaaaagcagaaaagaggtacaaagagaccaacagggaagaaagacgcgaagatgaaaacttcagcagcatgccacgtacagttggcttggatgtaccctgcacaaaagtgtccagcctgtacctcgctgacctagctgttcgccggtacaagattaaggaagtgacagcttttcctaattcactgaaagtgctttgggactaaattgtagcacagtataagtaaagtatcctaaggggaaaagaaaactccatattcatgatccttaatctattttattgattaaagatttagccaaatacatcactcctgcttttgtccctgtaacaaccaatgctgtgttatcaggaagagataaaaccagacctgatcggagctactcaatcacttggtcctgaatcactcgcttttcacccaaagtcaacagtcttgattcctcatattttaaggtgttcattgtaatgtactgttactgtttgcatacagctgtcagctgcaaaaacatttttttttttgaacacaaaaatcaggcttttgccccccaacacccacccccttcccgggagactccatggtagcctactgactcacactgacaaaaaggacaaaggccctgggttgtctctgccgcctgcctgtccagatgtaattaggcctcacacaggtaaccccttgggcagcagagaaagctcagcgagaaggcacggggttgtgaatacagtttcacgatgatttccatggctgccatgaaggctctgatcagctacaaatgggcagatgccaggatgaccctcctgatttcctggtccctcctggacctggatctggatctggatctggtgtccagggaagagcaaagaccaggagaaagaggtagaatcccagcaacaaagcctgggtatgcggtctttgagaatgcctcaagaaaacaaattcttgcttctcccttttcaaggggctacagggagacgacacagctgatgggtatttttgtagccagatatcaagtagtgttaacgttgggcataggttcaaacaaatgtgctccgttaagaatctacacagcatgaagagtgtttagacttcatgatatatatatatataaacattcttcagggagggtttccttcagaaaattcaatactcaaggaaaaggagttagggacagtttattttggttattttctttgtttgttttctccaaagctatttcttgaaaaaggaatcctttcaaagtaaataaaggaatcctttcaaagtaaaatagactacattacatttttatcccaaagctgctgggtggtaggtgtgacttggaaaactgtagtttgtttcaagcaaatccacttggattgagcatgaaggaaaataaaattaaaggatgatgacgaataaatggaaatgtttaaggatcactttggccagcatcttcatacttaattgttgcttttacatgtatgtagtttttcctgaacacaagaggaaacgtatggtaatgtgaggaacagaaagaataagatgggaaactaaacatttgaaaagaactttcattttctgaaaaaaaaaaaaaatgttctcccatagatgcaacagaattaatcttcattagttagcacagctatactcttcttcttaaatgtctcaaatgatactgtgacttcccttagagaggaggaaatcagaggacagcaggaataattaagacagtagggctaggggcatagcaacaggattggaacccaaagcccctggatttctcatcctcactgaggcacaagaaacatcaggccttttgatttaggctccaagcaataattagcatctaataaggtcccttcaatgaggatttttacatttatttcctatcactagtatattattttagatactctaattacttttgaggtgctggtggtatatgaataatataggtaaatgacactacgagacaaggcactgtttgtaaatggccaaattctttgggctgtactaatcaaacaatggttgactctccctttaactttcatcatgcatttaaaacagtttttttttgttttttgttttttgttttttttttttttggtgggggagcagtgaggcagcgtctcactctgttgcccaggctggagtgcaggggtgagatcacggctccgtgtagcttccacctcctgagctcaatcaatcctcccacctcagcttcctgaatagctgggactacaggtgcacaccaccacgtctggctaatttttgtatttttagtagagacagggtttcactatgttgcccagactggtctcgaactcctgggctcaagggatccacctgccttggcttcccaaagtgctgggattataggtgtgagccaccgtgcccggcctaaaacacagtcttgaacttatctggttaagtacaaggtgctaaaggtgccacttgaccatcctaagcctcctcttcttttccccatttctcactttttaaaaattcgaatttattttttggtgtaaagcttaatagcatgggttttaacgtttttgagggctgcttttcattcagaattttcaccactcttcatcgcagcagttcctggagtaagcatggcttcactaagggaccgaggccacagtgagaattaatatttattttttggctaatgtttacagagtgccttaagctgttcagcaaaaatcacttattttcccaaagaaaacacactcatctcacttctctaccgtctctcccgcccctacaatgccttgcaggtgtgtcaggttctttaggtgttttcgatgttcaggtcctgtgccaggccattattaggcccaccctacaaaatgactttagcaaaacggaggctgcttcaaaaattccagctggtttttcaaagtaatactaagcaaaagtacacaggcagaaaaatgtgatcatcctgaacttttatcacacatcaaaatttccctcctatatttttagaaccatttcagtgaaaagtgtagaatggcatcgctaatgtttataggcaaagaacagaatcattaggatttgagacacgttttcagaaaagtgcctttaaataattaacgtcatgacactcttcctcagttcttcatccagcagagtaaatgtctcttgacaggtaatagtcctttatgtgaagcagtaactccagtttggtcaaggtaactagtgttattgaaaagcatgctttaattaaatgcaatgtcttagaaaaccatgctgtttacaagcaataaacaactcttaaatattcaattaatcagctatcaacccaaattcataaaagacccacatactacttctatgctttaaaaaggaaaagagacatattaagaatgaaagcagattaaagaaaagagctaatcaaaaaataagaaaccaggaaatgacattgtcaatagtgagcacccgttttggagtgtgcgctatgaatttgctggctccgacagtaagtattcctacatgggctttctcatttagcactaccctaaatcctgtgaggtggttattggcatccttccattagatgaagaagctgaggttcagagacgttaagcatcttgtccaaaggcagttgctcttaaatggaaaaactaaaattcctatctggaactctctgaatcccatgctccttccactattcacagtgcctctcaaacagaagaaagtaaaaaaggggagaaactgaagaagtcaaaacccaggattattcagaagtacggaattaaccatattttgggtaaatatgtgttttccagccattggatcaaccatgatgtgattcaaactggcttttatgaaagccaaagataccagatggaccatccttcaatctggtgtttttgtcatctaaacatggttctagaaatcaaaacaaatagaaacatgaaaagcatttttttaaaatatgggcaatctctattctagaataaaggcaaagaatgaaaaaataattatcaaaaccattcctagaatagacagggcctattttaacatttaaaaaggcagacacccgtccagtttccttccgcaaatagtcaccaatcactacttctgctgagtacagataaaaatacctgatgtggttttccaaagggcttctcacagtatttggcctattcaacctttgcatctgccttccctcttggctcctgacttttgtcagctgtaccatgaaaaggcgatgcctttaatgatctacatttgacaagactggaaattaaccttttagtgaatctttcacattcaatgtgaaacaacagaaccggtggtgatgtgacatttttggtaggtgcgtacctcaaaggcgcctgccttcaagatctccctgaacacccaagggtatctcaggctgccaggtctccttagactcgacaggcgaagggagagagaggaagggagagagaggaagcctgggcaagctcttggaacatctacataaaatgaaggtattcaaagctgcttctatttagctcctatgcacttcattatacctggctttttaatattctagtataaaagagaaatacaggaaagagtcagaatattgtttcttattgtcaagccccccaatgcagaaatacacaaacatttgacttttatgccccacactcacacgtgatctttctgccagcatttctgggaatgatcatgtttagaatttctgctgggaaggcaagcgccttcagcatttctttagatgtcatgaagcatttttaaactgaaagcacatgaaatttggagtcagctcataacactgacatgtcatagtgaaagtaacaacaaatacttacttgtctctaaggtaccatctttcttgcacccccacactcagtgtgtaatgaccacctctgagacacagacatctatagaaacttcttgtttctttgtctctttcgtttctcctcaacacagggaagcaaggggaggagaaaccatggaaaagtgctagcctttgtacagggccaccatcaagatccagcacttaaccctgagcaccccactcatacttactggagagcaatgataaatctaagtagatggcttgaaactctaggacttctaaaatctctctcttcattcaggaatccatcctcctggaaaaaagaccactacggatggggaagtttgaaggacaggcatttagacctgaaaggcatttaagaggagattcagcaaaagatcctgtgggactaaggattttgcgagtcattcttacatgagtgtggcttgctgctgactgagtaggatgttttctgctgctcagtcctcgccccttacaggcttgagtagttggggaggcctcctgaaagaggaaggactttaatcagactgtgatgagggcagggggtcccctggtagggaggggagcaagagcaaaggaggagataagaacccgcaaggtgttgtgagattgtgaggaaaaagcactagtagaaaggtgacttttagatgagggaaatatagatcagaaaggcagggtgtcgccaggcagaagaaagctagagttttggagttcttccatggggagcttctgagccactcttggcacccttaaccattggatgagtgaatgtgcaggcggtgccagttcaggaggaagaaggaaatgttttagggaacattaatcttactacagggtcctggataactttgaaggaagtcagctcaggggtgaagaaatcagcttagaaagcaaggaacttagcccaagtaggaggtattaaggccctgggttcaggtctgtgatagaagtaagcaaaaggggtaatctgaagaacgtcaggaaagttacagactaattgaatatcaaagggtgagttggggaggacagaacaaaattgctgataactaagcctttgtgctggagtgagaagaagaatgatgccagtgttcacagagccaggggattcaggagaccctctgtctagggcctagcactttgtatcttaaccagatagaacacactgtatcatcacactgtatcataacgtggcagtgctgctcattccactgtaaactaggcaaggacaacgtctctatgttatcggcctttctatgtttaagcatccaaagcccaacgcctaacacaaaaggggtggtcagtaaatacctgttgtacgaggcaggtttcattttggaggaagatgaggtagtcatctgtaaaatatggtgaatttacggtgataaagcatttccacaggcatgataaatgttgaaattttggagagtgaggtcatctttgatttcttccttaattactaactacctctgccgttcctctaatagtgcacaaatactcctgcatcttcctcctaatgtctatcagtcatggcctttcctttccaatgggcagagggatgttacagctctgaagacagattatagtctcctacagagagtgcagagagaagataagaaagccagtggctgagcctcaggggatgcccctatgtaggcagaggaggaaaaagaggaatgtcattcccagttgctgtaatagagtcaaaacaaccaagatccttgcctactgagagaaacataagatgtaggccaatggggccatgtgtagatgatctcaggtatcagatgttcactgcacaccttagagtgatgtttattcaactgtagataatatttaattgttactctttgaaagatagttcactttaagttccctgagtagcatagagttattcaaatgtacctatttattacaagaccattgtataaggaattatgaatgtttctggaagaatagggatttgtagaaatcttccttgctccatacaaaatctgctttgagatacgttattgccatttctatcaacagaatctttcctcccagtaggaaattagagcccaggatttcctgctatttatgagttataataaaagattcttcttctcaatttttttttaatgtgtcctgtccctaaatagggctcagcctgaaagctgggaaaaggacagatggtatcaaggagaaaaatgacagtgaattcaaagttcccgttttggcagccaatcactctaatcaagaaaaagggatttggttactttcaataataaaataattcttaaaatgtaaaggatggaaaaaatgtaaaggatgaattaaaacagttccacacgaagaagaagaagaagaagaagaagaacaagaagaagaagaagaagaagaagaagaggaagaggaagaggaagaggaagaggaagaagaagaagaagaagaagaagaagaagaagaagaagaagaagaagaagaagaagaagaaagcctttctgacaagcaccacccaactactagttccatggaggtggaggggtttccgtattatttgatttatcttcattgcctagagcacaatgtggttccagatctcagtcaaacccaggaaatgaatagattgtaaactaaatcctttcagggagagacagagttcacacttctcaggatctccaccacgcctagtatcctgctgggccaaagtgcgtgcctggcaaacatgtccctggtacttggacatctctttcccgcgttcctcttggctctccttccttccactactcattctgctcctgggagagttaatgcattgcaggaacccttcttccaggcctggtttcaggtggctgtcatgacagcaccccctgagagcaggcacttgccatgggtgcctttcaggtacacctcagggtaggggtcgggggcaagggtgaccgtgaggttcacagcaggggatgaagtgaggagaccccatccaggtaaataacacctctcctgactcccaaccaatgtgagctgctcagggaaactgtggaccccctcactggggtgaggttctagctttctcatgccaaggactcttggggaaggcagtttgggatgcgcttcagtgatccagccacctcactctttctagtgaaaggagaaaaatggctggaatcttacatcaagacaatggaaaacaggggtgtccaatctttcggcttccctgtaccccactggaagaagaattgtcttgggccacacataaaatacactaactatagctgatgagccaaaaaaaaaattacaaaaatacctgataatgttttaagaaagtttacgaatttgcactgggccacgttcaaagccatcctgggcagcgtgcggccgatgggccatgggttggacaagcttgatataaaatgtcaagcctgaatctaaaagcaggtatcctcaaagtcctcacggctgaagaaggagctgctgttcttcctccctggaatttggcattaaagggcattgcaagggctgggcgcggtggctcgtgcctgtaatcccagcactttgggaggccgaggcgggcggatcacaagatcaggagatcgagaccatcctggctaacatggtgaaaccccgtctctactaaaaccacaaaacattagccgggcatggtggcgggcgcctgtggtcccagctactcgggaggctgaggcaggagaatggcatgagctcgggaggcagagcttgcagtgagccgaggttgtgccactgcaggcgtgcagggagacagagcgaggctctatcttaaaaaataaataaataaataaataaataaataaataaataaataaatacaagggcatcgcaggaagtcctgatgtcaaggtaatgcggccaggcatatctgttgttgctgacctgagagctatggatgctgtgagcaggggcttggtaggccaggatagacaaacttctgacctcgcccctcattctaaagtgtaattcccagattttcagtaacttacgtaccaacctctaagcccctttatggttgattcattcctaggtatattaaaaataattcaggtttacataatctatctctaattgcaagagttaagaggaaatttaaactactgctttagttgttgggcatatgggtctctagagacagggtgttaagcatcactgcatcaccactttgcatataggaagcactcaataaatgttagtaaggccgggcacggtggttcacgcctgtaaccccagcactttgggaggccaaggcaggtggatcacttgaggtcaggagttcgagaccagcctggccaacatggtgaaaccccatctcaactaaaaatacaaaaattagccaggtgtggtggtgggcgcctgtaatgccagctacttgggaggctgaggcaggagaatcccttgaacctaggagacggaggttgcagtgagctgggattgtgccactgcactctagcctgggccagagaacaagactccgtctcaaaaaaaagttaattggaggaatagaaatactataggtaaagacagtacccccaccctatggagcactgccacctcttcaccaagtcttcttggctctgaatgcctgacagtgctttcaatgtggacacaggccttgtccccacacagggtttttgctgttctgtttgatcaagccacagaactggggagacggctctgggcccagcttcccaagtttgtctttttcttagtcctttccctgagatgcaggtcctgtcttgctcccctagcccctagcctcagccaccctctactctctgcagtgctgcatggttgattctgtatttcctctgcagcctgcctctctgtgccactctccttggagaatgagcagagcagagccggacgccaggcctggatggagtcagggaagaggtctcagaggagggaaactttaggggagtgttgagagacaggaggagcgagccaagtagagaagagcagggcgagtgattcaggcagaggaaacagcttgggtaaaagcatagcatgtctgtgacccctgcttctcagatgggcggccttcaggactctctgggagcatttgcatatcatatgtatattaatttatgtattcaatgtatgctcagcattcctatctggagtgatgagagtgattacgctccctcctctcccaactgcacaggcatgcaacaggagtgccttatccaattgaaaaagcagtctccatccccgagtgagggtatttccatgctcactaccaaggttcagggacatgctccccagaaatagtctgtgatgaagcacgtggtagaataaggcatcccacttcacatgaactcttgttttctatatttgtttttttttctaagttatgataatctgaaaatgacagaatttacacagttggagtatatttcctgagatcccaccacataaagaaaagatcacaatataaggcatgaagagtgggaactcacagacccggcgtattcaccagtgtgctccctgacctggagaacacaactgcagttgccaggctggccctgtgaagcccacaaatcaggacacgccacttaatggcaccaccagcaacatagccttcccttggagactcaataatatctgaacccttcacggcgtggagctgctgatgttcctaactacaaattcaggctccacagaaaacatggcttctctttattttagattatcttattttataaaaagcaagaatatataaaagatatagagaaaaaaggcagacagaagccactgcccagtgagaacgtgctggaatataaaaatgtaacttgataaaagaaacagttacctagaacctggtatacagtaaatgtataaagcattttatctttcattatctaaatgtgaaaaggaattaacttaagatcacttgaccttgcaactgtacaaaatgaatttttgtacattagtatgatcaaccaacagtgcaataaaatgtaaaataatatcttagaatcagattagcctgggtgaaatctttgtcctcctaaactgtatatccttggaaacacccttgaaagtttctaaaggctcagtctcttcatctttgaaatggagatatctgcctgctgaggagattagatggttcatgggtataaagtatttagagtgcttcctggcacatgtgtgtggtcaatattaactattgttattagaaaagaaaaagaacactaaatgacagtttttccatttaaaattcccaaatcaggtttcctgtgaaaatggtaaaacatgagccagcattgcagaatagagagcacgtttggcctagctactgaaactgggaaaatgctaggaaagccaagttcttgtcctggtgctgaactgccttccgtctggtgtgggcacgtcagatcaccttgccggggctctttctcgcttcagaataaagtgtgaatggagttagtgctggataatgtatcaagcccataccagccacaacattccagagtcaacctcgagggcagctgtgatggcaaaagtcaacacagtacattttataaaccataattagaggacagagtgatcaggcctattgcccacattatgtaattagccctctgcctacagggagggagtgcctgtgtgcaattatgcaatcacattttgaagggaaagacaccaactcacatcacatcatcaagaacaattatgattcacttgagtcacagtttccatccgcgaaggttgtccaggtaattttagtctgtacctttgtagtgccaaatatttaaatagttccttatttttgcaatgccttgcaatacaaaggcacatttacatgacccactcttactggctttatattagaccgtcaagttacatcccattatacctggaccataacctactactcccacacaagcaaactgcagggatctcaaactttagaaccaagagagtcatcagggagcttgttaaaaatgctgaccctcctcgctctatattgattctgcaggtctactgtggagcccagggatgtgctctttttaacagcctctccaaattcctctggtgtcagtggtccacaacatgaaaaaaaactcagatttaccatggatagctttggtggagacaatgcagatggttgcaggaccagcattacatgaattgaggcttctgtgcctcccccagtcattgggaagcatgaaaagctactgcccaatccccccatcccctttcttggcacagaagcagaactctagaatttctaggctataagccaacttgggagcaataaacattccccaagttccccactccaccctgtcccttcacacataatgaagctgcttcattacctgccctgagctacttaactcactcttccccatctcccagcaacagagactaacatcaatcactaagtgttcccagtacatcaagcaaggagaatcttgagtccaaagcaattgagaaagcaatgtatctaaggctccagaatgtatcacaaattaacaatagtgttatcactggaaactcagctcaaatgtcacttcttccaggaagacttccttaaaggtaacccctccccacagaatctgtttaagattttcctcctaggtaataacatgacatgcccacaaaaatcttcaccacaggtagcaagtatcaaatgtactataactgtttgtaactgttttatttagactacgtgctccttgaaggtgggggccatatctgtatcatctttacatctgcagctcccctctgtttcacctagttaattcttactactctaagttaaactgccattttcccatgagagccttccctaacgtaagtcagtccttactataaatgctcatcccacccttttcttctcttttccaacacttcatgatgcttctattttccacattgactggttaaaccatgtctctgcaatcccactagctccatgaggacatcaaaggggaataaaacaaaaaaaaggtattcaaataatatctctttaataaataaatagattcagatgacaataatactagcctgggagaggctggtcagagaatatggggcagagtgggatacctggatgttctacctttaaggtgccgtttgatcttggttgcttcctactcttgcattcaaagaatccagtataaagctcatgctggtaaaagtttgactgcaacactgggagagaaaggaccttttagagcacaaaaattacctgccaagaccttgtttccattgcataacccctaactttcatgcaagactctgatcctactcctttaatctgactacatttcatattctccaataacttctccattctaccccaaaagcaggcaatttatctttctaccatggtcagtgttcccttcaaggttggttgcaacttgggtgaaatatctcagtggaaagccaacaactgaatcccatgctcaattttcctcttctgggctagggtttgggccttttacttatgtctatttgtctgagaaatttactaatgcgtctagtggtttttatgattgtaaagacccagtttgcaatggtatattggcactcatctacattccacatgcatcaggagcttcccattttcacctatcactcatcaacttttaacaaacacagcctaatgattccatggtggtagacaggcattgtggaaccagaaaggaacatgactctgctatgtgttcattagccgtaataacacttcagaaaagaaacttaagaatgttacatgtgtactataaaatttctttcatctgggaaactttttttaggaccaaagtgacaaagatgtgagtagtctacaacttgcacaattgtgggaagacagggcatattcctttttttttttttttttttttttttgagatggagtttcactcttgttgcccaggctggagtgcaatggtgcaatctcagctcactgcaacctccacctcccaggttcaagcaattctcctgcctcagcttcccgagtagctgggattacaggcatgcgccaccacgcctggctaatttttttgtatttttgtggagacagggtttctgcatgttggtcaggctggtctcgaactcctgacctcaggtgatccacccaccttggcctcccaaagtgctgggattacaagcgcgagccactatgccccgctggcatgttccttaagaacacagaataccctttcaagaagttccagctctttttggaaccaagtaggtaaaaatgtcatttctcaagtccaaagagtccaaatcttccttcttctagatccacatgctatgaaaggaaagggttcataagaccaaaaaaaaaaaaaaaaaaaaaaaaaaacccaaaaaggtggatagcctaggccttggtccactgagcactgtcatttttggcagctgcattaaaggtacgattgtggaaaagaatggctgtaaccctgatttcaatgtcagaggttaaagatttagcccaagtgctctagctctcccaagttaaccattattgacatattatctatgtatgtatgcattagtctaaactttttttctttttttttttttttgagacagagtctcactctgtcacccaaactggagtgcagtggcatgatctcagttcactgcaacctctgcctcccgggttcaagcgattctcctgcctcagcctcctgagtagctaagattacaggcccatgtcaccatgcctggctaatttttgtatttttagtagagacggggttttactatgtcagtcaggcttgactcctgaccttgtgatccgcccgcctcggcctcccaaagtgctgggattacaggtgtgaactactgtacctggcctaaacttttaaactctcattaattttcaacttgtgcaatttcacttaaaactgcctctaatgatgttgtcgacaacgagggtaatggtagccatttgttaaatacttttataaatttcaaaaattatggcaggtggacatgcatctctcatttaatgattttaaaaacaattttaagattgttatttctttcctcttcagataagaaaatcaagaatcagaatgattaggtgaaatgcccaagaccagacaaataaatggtgggacaaggatttaaacactggtgttctcatccggtacaacatgctgtcaccctcaaaatatatacatatgtactgctgccaggttcaaggaacaagtccaagtttatgcagtcctgctctataatgttcatcccatccattctcagcttcctacataaaagatactaaatgcgtttgcccttccaaggtaatatctgaaatcccttggctactttagccctgtcagatccttccttggttttgttaggttgttcttgaggagtattggtctagctgtagatgatattatgaatggccagagggtcagagatatgcttttggtctttgattccagcatcctccatgattatacccagcactaggtctctgaaccaaagccatattttggtcaaaatatttggagaaatgtctgaaatgatttataagcccattttctaggttatcacctataattctggctgctcacctccagttgtaatttgaggtgtttctttttccataggtttggttcatatggatgctcttcagtctctttttaacacacttggcccatgatggctttgtatttctctcttagaaagattcagaagtttcactacacaaaacgtatagagaagtgttaaactggattagctctaaccaatgcttaacggtgtgcactgtctatagttctccattcagagaagtaacattgtatatctaaccactgtttcctctcttgaagatagcctccacccatgagagtgtttcctctgatattacggtcattaacaattttgatggaaggaaatagctggaaaaattcactatgtcaattgcatttatttgtcagagtctcatgataatggttcaattgttccatgttccttgacatcctggactcaacttcagaatatttcattgctctgggcatctaaatgtatacaagcaaagcagagtaggtggttgcacaattgttctataaagctgagctatccatttagtcaatataaaccattctgggaagaacaggatttctttgctcacatcaggagtctcaggtactggaaatgaccacattcacccatgtataagctttagcttagctcatttagctcaagacctgcaacaagtcacccaataaaatagcaaaaattttcttgggcacacaagcagttaaaaccatttctccactcagtgagatgcagaaacaagtactcttgaaaaaacaaagagaaattagtctgataatggaaaaccactgaaagcaatttatgaaccatttccccctgacaatatagaaactcttaatatactgtacgtaattcagggtgggtcttcttttgattccttccttctaatcatccacctttctagcagtaatactgacatctgaatctctttttctcactgtttcaaagggatatacgatagcaaaaatggctatgcagtggatgaagctaaaagcttgtattgtttattcaatggtacacctctgataatttaaaaagaagattaatcaaccagctgtgaaaccaaatatttgcagaatctaagcacttatgtaaaaaatctacatttgtagctgtgtgcccttaaataaataaactagttgatcactgcaaattaaaagaacttaaatggtaaaaactgccatttctttaaaaacgatgacagtgaagaaaaagcttttgcaaataaaattgggtggagaatctaataaacagggagctatgccatcccaaaggagaaaaaagcaaaaagaaatttcagaaaagataacaaattagtttagcaaagtcacaaaaagagagggcagacaaaaataaaggcataggatgcagcgtccagggaaagaggaaggggcgagtggaaacagctggaattgttcagctgtgtcaacattcggctgtttcacagattgactagcaaagtgtcatctgaaaccaattacattcccaaaaccccacggacccagttcataacattgattaatccacattgtgaaaaagtccccaagcaaaactagaacagctgtcagcccttggagctcaaaaaacagcaattgcttgaggaaaaaaaaaaggaaagaaaaaagaaaagaaaagaaaagaaaatctcctcttgaaattttagggattttcaggaggtatgtctactgaaaccgaagatagatttaaaacgaactcctccacctcctgtctgtttgagcacaactggctataattagaaaagcaggggtcatgttagaataaacccaaagtccattcccaaagtcagaacagaactgcctcacagtctctaataccttgtatctttttgctcctttctggagaaaacaccatcgtttgatgtttttaaaagtatgtttattttttcttctcattattttaaatgcattaatctactccctttgggcccataaaaatgtagttatatgttatacgttttctattaaaagctgtttttataccgtttgttctatttcacagaggtagaagaatacataaagtcctcgatttgcaagcatccaacttgtgcatgactcaaatacaaaaatggcgaccacacctctctgatgtgcaaaactactggtataggagcctgtaaaggttttcacacacacccgtatgcccccatgggatcctagatacctggtaccttctagcaaagccactcatccgaagatgactcactcatggcaaatgccttggccttgactctgaagctactgcagctagaaatccaccaccaggtatggtagaagagaccccaacaccatataagcagccacgaacatctccttaagaagtctcaatttctgtagaccctggcctaaactcaccactgtgaggatgcagaagttgtaggcatctgatcctttggacagattttttccacggaaataaaatacatgcttattcatctgctcattcattcagcaaacatttattgaatgtctattctatctcaaacactgggttgtacccaaaaaagcaatgttagcttacaaaatgtttgcacatgctgaattttgtagatgggtaaactgaagctccaaaaggtttagtgacctgcccagggccatctaactagtaggtgttggagtttgtactcaaactgaaggctatctgataacatttcatactcttttcaaaaaccatatttactacattatgcttgacacaggttttcataagctagcaggggagcccaaaagcatgcaaaatatagcttctacctggagatgcattccaagttacaaaaaactgggtataaattggactttaagaacataagcggtttacatattcagattacattctacttttgctctctcctctgtaaataccccattagtaatctaacggactcctctgctgaaaagccatagtgtaattgcaagttttatgaattgaagtatgtctttgatacacttatcctttttcttctgcatgcttatgcatatgtagcactaaccaatattaccaatatgaggttgtttctaagtcaaagcattcagagaaacacaaaccttgacttcactggtacatccttggatttgaaaaaggggaggggaagggaagggaggggaggggaagggaatggaggggaggggaggggaagggaggggaggggaagggaagggaggagaggggaggggaagggaagggaggagaggggaggggaagggaatggaggggaggggaggggaggagaggggaggggaagggaggggaggggaggggaagggaggggaggggaggggaggagaggggataagaagggagaggggaggagagaggggagggaagaggtggggataagaagggagaggggaggagagaggggaagggaggagagaggggaagggaggggagggggaagcggtggggatggaaggggaggggaaaggggaggggtagggaggggagaggggaggggtggggaggggaggggaggggtggggaggggagaggaggggagaggggaggggagaggggaggggtggggaggggtggggaggggagaggggggagaggggaggggaagagaggacccacaattcactgagccatacaaaggaacaggcttattctttggatttcagaactgagatgaaggttaccaaaagcaacaaattattttagatgtaaagacaaagtgttactaaatactgttctccaaatagtaataacattcctggagatttgcaataggtaccctccctactgagttttgaaggatgtgttgggtgggacagggtatagtgaatgagtagagatggggtagagggaggatactcaaagacaggacagtaagaaacaaccactaaagtctctagacagatcctctgattctttttactattttttcaccctggaggatatttataattattgttttttaaatgctcatgatgtcacagataaagaacaccaattgctcccaatagaactctaactacagtatgtgtttacaagagcaaattactgtttatacacggacaggattgtgaatgaggcaaagaacattacaaattatatgttactaaagaaaagccaaaacatttccttttttttttctttttatgagaagacatcattacctgtatatgccccctcttctcagttccctcaatggacattggcattgatgagcccataagtacatgataagcctacaaggacaatagtgagtttatatttttatgtaatgattttagaacatgggataatatccagagtgatggaggtaaaactattcacatttccatattccaaactacttcaagaatcactagagtgcagaagttataactctaaatgctgaatggagaaatcatctgtcccaagaactacacccatatgactttccaataaatctatctcaaaaggcctaccatttaacaacaacagcaacaacaaaactttaaaagaacccaaatgaagttttgtataagttggtgtctttttttctatacattttgaatgacaaaaagctgctgtgagctacactgtttttattttattataaaccattcttattttataaaacacagccctactcccagaaaaaatatttttgtgaactaatgggggtcaagacatatatctgaggctaccatatgaccctaagaagaacccaaggaatgcagtattaggactgcctcattgtttgaaatattgttttaaggattaaatgagtaaagcccatgtacagtgctcagaacagggcatggcccataataaaagtgttggaagcatgttaggtgttcaaaatcagtgtttgcattccaatggagttccaggaaaagtgaattccaggaatttatgtttgggtagacctaaggtagttttgcaccaaaagaagactttgaaaacggagggtttcctgtccacttttcgccaccatcaattgcatcttttcttaactctctgtagaaaagaagctgagaaagagcagacagtgcatgtctgcactgaagtacaactggccaagggccggacatggtctctcttctcttgcttctgtgctgtaaacggctcctctgagcagttccttgagattcgtaagccaaaggcttttgttagattgtgaggcaaggtagagggcagggcgcaggtataccatttgtcacaacaagcttccttaccactcctgttttatttaaaactccgctcctgttttatttaaaaccaaaacactcaatccaccatgtgggatccttagtagcacacatctcaaaagcttgcactcattcagggttggaatgggcagtgaagcttatctaggcacatttcttcacagccctgtcatcggggttcaaattcgcaaatggcatgaactgcctagcaatagtgccactgtttttactgtagggctgtgacttgcctccacctaagggagtttcagtgatatgggcttagggaatacagggaaatagacttgtgcagagttgagaaaacctcagaattcaaattcgcatctcaatgaatcacgtacccgacttaaagtaaggtaaccattaaataggaatgcatatcttgccttcccaagctacttcctacatcaatgtaattatgcttcgtccatctttagatgagaggcaggcaatccatgttagatctactttaaaagaaaaaaagatgttggggttttctggagttactcaatttctccacaatgttttggcaccctaaatgccaagcatcgctgaatcaattgctaaatttcaaaaggcatgccctggcttcagatacattaattttctggaataacaagcagtccattttaatgaacataagatactatttccttcatcttaccactcataactgagcttaatgataaaatgtggggtggctcagaaccactggtgggcttcagtggttttctactcaagaacaatgtcaactacagaatgggggttagatacaaatccacagggtgtgcttgctattatcatgaagagcaaaaaagctcctccaggccccccaccatcatgccaacacactttgatctcacttccccttgtgaacgcttgagaggataagcctgtccctgtatatgaagccttagctgcagtgctggatatatttacgttaccctttgcaagcctaaaagaacaagatcaaaggaaaataagactggtgcccattagagaagccatttgagaacccataagtcatccataaaggagttatataatttaaaaacatacaagcacctactctgtcccagaccctgccccgcagtagccaacaatccactcagtgatacagacacagacatagatactggatatggcaattattctgttacttcagaaagaaaccatttcttcttaactaagccacaggcagtatatctacaaatgggtttagagttggcttgaaattgattctgactttgaaatgctggtaagggaataagtcatatctgtcaatgcttatccttccttcttataggaataatttttaaaaaatcattattctactggactattccaagggaaagttcatgagggtggtagactcctgggaatatttctcaatgttctagctcccatcttttgcttcaggtgaggtacaggccaaactgtggactgcaactaactcacaggaaagccatgggatgttttaaagtttccttggagaagtcgggtgtggtggctagcacctgtaatcccagcaatttgggaggctgaggcaggtgtatcacttggggtcacgagtttgagtccagcctggccaacatgatgaaatcccgtctctactaaaaatacaaaaattagccaggtgtggtggtgcacacctgtaataccagctactcgggaggctgaggcatgagaatcacttgaacccgggaggcggagcttgcagtgagcagggatcgtggcactgcactccagcctgggtgacagagtgagactctatctcaaaaaaaaaaaaaaaagtttccagagagtaacagcggcacgttcagattcagcatggactactactattatttgaaactactaacaaatggagctagtaggtatttctcttgttacaggggcactgtgaaaaagttcccagacacaaaagcaccatgaattgagaaagtccgggagctttaggaatctggagggaggaggctctctccatcagacttcaatgtcctcaagcaacaggcaaaagggcatccctgctctccaaggtcaccttgaagggagttgccatgactcagccttgtgttcgaccatgccttcctagggaaggcctgcagtgggtgtgcgtctgtgcagatccatcagcttaattaatcagtaaagaactttgctccccccattagtctgtgcttctcattggtagggcaccttcagtcaggaatctgtttgagtggagaagtaagggtttgggttgagcaaaatcccatcccaacccctatctcaactgagcagaacatcctatgaaagagacagggcaggtataattatctcagtttttgagatgagaaaactcaggtccatctgagtctaatgaggttaatggattttcccagagtctcaaagctactagagcagagctgtgccttgacccaagtcttccatgtctaaacctcctcgcgttataccacagctgcttagattttgagcaagaattagtgcccttccctgcttcaacacacacacgcagtggagaagcaagcagtcattcccctcaaggcaagaactgtcccatatcacaccctccccatacgggcttgtggaattacttggctcctggagctgccaggcagccctaaagcatccaaaggagagaagctgccacattgttaccctgctgaggcagctgggaggctgtctcaaagccagccttcacttcctcaaagcttagtccccgccctctagccctgcttctaccctaggtcatctctctcctctttgcaggaaaaatgtctgtggaggggttcaaggacctgcagggatgcagacccgtgattctctgacaggagcatgcgtcagatgtgccagggaaggtgtgttaaagcagaggtcgcagggcctgacccccagagttgccgagggtagggccaaagaatatgcatttctaacacattcccaggtgatgctgacgctgctggttcagggaccacactcggcgatccaccaacataaagtgacttgtctcttcccaggatctcacttattgctccacacagagcagagatacttattgagcaaacattaaggagggcatctcttgatcatctcaaaaaaaaaaaacgtttcaacaacttctatcatcagctctgttttggacccagtggtaaaagttaaagtccctgccttccaggaacgtgcaagctaaagatagacttaattcatgtagacatgcatagaaagataagactaccatattcagattataagaaatcccactgaataaaacaaaaggcttacaatagaaactgcaaaattccctgggaagtctccaaagtttgcactttttaattttcagtgataccatcatcatgccgtggatcactgtgcagatgttacaactgtatttaatcacaattctaaagccagattgggctgctccaacctaatggcatgtgagtccttgaactgccatcaaccggatctgacagcaggcatggctgcagcaggcagttacagaaatgggtttaaatgtgggtgactcttggtatcaaagaactgtgaactgttcagctaagcagaggaatcatcagaataatgatcatttttcactctaccccctctcccttgcttgttcaaagtaaaaaaaaaaaaagcccttaattgcttcttgaactacacacaagtgggccgttgactgtgactgtaattcagcatggagaagcaagggaaacactaaaaccgattttgttgcggtaatgccttaaacggagaaaacactgcagtgggatcagcaggcacaggacgctgttaagtagaatgatacctccttaaagcacggcttgagatattgtcagctgttaaagtaatatttaatcgtagatgataccaggtgtgatcaagggggaatatattaatacagggggtgtggtgggggcaaggaaagggtagtgaggggagaaagataaggagagagaacaaacaaatgattttagaaggacagcacattacgggtgccctaccggattcaggctcctaatgaagaagacatgtttaggggaactgaagaattgtggattcagtcatttgccatttaccttgaaagacacgtccagataaatgattacatcttcagaaacttgaagcgtttccttcattctcgactatgggtacctagatagggttatgaacgtgaaaggcagaaactgttttgcccatactgcccttccatccaaagccatgaccctctgtctaggtggcactggctacagggaacagaaaacagatgcctgcaactgagaagcctactgccaactacaagctgtttgtaaacacttctctccatgtttacctaagaaagatgcaggctttccaaggaaagcctccttttgaaaaatgtgcctttttatttctctgtgctgttaggtccctaaaataaaaactaatgcccataattctttataagtctcccatctcactccatccagaagcatctcttcttcccttagatgttttttcaactaccttacaaaggtagcgcttccatttctgtaccctcacatgcaggcctgccctcttgcctgaatattctacttcttctgtaccagcagagagtagggtgaaggcccaccacttttgtcttctgttctccgcatagtggctatgttacatcctcaatgacactgaactgtaaccttgcttgcaaaacaaacctcggtgaagagagcaagcactcttgtactggaaaaagcctgatacctacttcttagtgaagtaaccactggataataagaaaaaagtagctggtagtaattaacatctattaatacttactatgtgccaagtccacactaaaggctttatttttaaattaaaaacaatttttattttaagacggagtctcgctctccccaggctgcagtgcagtggtgcaatctcggttcactgcaacctctgcctctcaggttcaagtgattctcctgcctcagcttcctgagtagctgagattacaggcacgtgccaccacacctggctctgtgtgtgtgtgtgtgtgtgtgtgtgtgtgtgtgtgtgtgtgtagttttagtagaaatggggtttcaccatgttggccaggctggtctcgaacttctgacctcaagtgatccgcttgccttggcctcccaaagtgttgggattacaggcatgagctactgcacctggcccaaactaaaggctttaaacaggttctgccattcagtaccaacagtaactattctaggcagatactattatgatcctttcacagagaggaaaaccaatgctcagagaggataaggagattgcaaaagtcatagtaacagtggtaaagtcatgctttgaatccacatttctctgactttggtgtaaaagctcttatactctattaatggccagaaactgtaccacaaccagggcacagcctacacagggacaatttgaaggagggtatggctatctatctatctatctatccatccacccacccacccacctacctacctacctgcctacctatctcatggaatcaggggcttaaatgtctgccacatattggacaatgatctgattgttctaatatactatttctaaactttataacagctctacaaggtccactctttaatcctcatttaagaaataagaaaacccagagtccatatgaatgaataacttacctacctttccacaagtggtaggtacaagtgattaaatgactaagtccacatgcctcccactctgccttcttagcttcacgtgcccaaaactcccttactaaccaattacagacttattaccatcctcctcctaatttcccaaaagaaaaaaaaaagtactagctctaatctacgactattacaagaccatcctcttgcatatcttatctttgtgagcatcagaaatgatgccaccaattcatttagacagtgccttcaaattctcatataaaaggtacttactatttaaaaaatggaaatgtataacagtgatactattaatagatcaattaaggagatttaaatcacttatttcattgccagatcgtagacacagtactatactattcattgagtttataaagctttctccatgacataagcctgactttattcccctgatggcatgatatgctctctcactcttaaccagtcacagtcccactcccatcaccaagtatcgtgcaaggatttcaagggtctcttaatagtagctacgtcgactagttcatctcctactgatttacctactcagtttcagaggaattaggtaaaaaatgcataactccattggcattgttgaatttttttctaaactcttgtgatagggatggaaaaaaaggacagagatagagcatcagttagcaaatatttactgagaaggtataatgtgctctgctctgaggcactggatacccagcagaataacccttgcccttatccacaatgagctggctagggagttttacacgagctttacatttgctcgcctgggcactcttgggtggtggtggtgaagagctcgtgttttgaattagacctggtttgaaacctggttttgtggctttatttcctgtgcgaccatgagcaagttacttaagctcttaagggctcagtttctgtctttgtaatggagatcataatactcataataggatgggaagaagtagcaaatcctgtatataaagaggccagcatgtgcccagcacacagtaaggattatgggaatcaaggacctagcacacagttgaacagaagagagctggttcatgggagctgcttctcaggtagctcaggaagctgttgagttattcagagcttccctctcttatttattcagggcttcgcgctcttttccttggttgccaactccccacttccctacctccaaaccccatgcaaatttcacctggttaacctttattcatcctttagtctaatctaaacctccattcccttttcgtcctgaaattcccacctgatcacaaaagcacctaagcttacccatatctttgcacctgtcactcgcctttgagagttcctattttcttgcctataccccctgccagagtgagaaactagagggcaggaccatgtgtcagcactatgtccccagctcctggtacaataatggacagtagcaggtgttcaataatcatttgtttagaaggcgaatggatgaatgcaaatagataccatttccaaacctgcatagatctggccttaataaaaagggcatggctcaaatgcggcatcaaattctgctgccccatcttgtgcctggtatcattaaatctccagataagaaggaggaatggctgcagtgtcactttgaggcctttctaccatgacgtcagctgctcgtcctgcacacagtgggtatagagtacgttacatggcttagctggctctttcttaataagatcattgttgctagatatgggtgtgaatgtggatgcagttcagatgtttataccaacgactggcataaataaacgaggaaagaattcaggtcggcccaatcattagtaacagtatcttcttgctctcctgggagctgtttcagattttggcttcatcctcacccctacataaagagacaaggatgggattgcagcttctagaattacaaccattttgtcaacttgtcatttgactcactgtctggccggtgcctctccctctgggtccagagacattttgcacaggaagaaagcaataaagtgaagtcacagggccgacgaattctccaatcttcaaagtacctcgttctgccccacagtacatacatatttctggtaagcgccatggagagcctcacatctgttacctcctgcaccgctgggaatcaaagcatttatccccatgagatgttttctaaaggcctgagggcactgggccattttatcctccctcccttggagagagcttctctgactacatgaaaatacctgaaaaggctaactttgtctgttccttattgccttaaaaataagagtactcttaacctttagggatttatatttggaagagggaaatgaactagatacagcttataaaaaggcaggaaagtgagtcattttttaaattgtttacaagcttgggaccaaaaaatatacatatttgcagatctttgaatatacactggtcttatttccccgtgtatattattccttttctctactatctttatgcttttcaaagaaaactaagtggggccaggcatggtggctcacacctgtaatcccagcactttgggaggccgacgtgggtggatcacggggtcaggagatcgagaccatcctggctaacatggtgaaaccccatctctactaaaaattcaaaaaaattagccgggtgtggtggcgggcgcctgtagtcccagctactggggagagtgaggcagaaggatggcgtgaacctgggaggcagagcttgcagtgagccgagatcacgccaccgcactccagcctaggcaacagagcaagactctgtctcaaaaaaaaaaaaaaaagaaagaaagaaagctaagtggaacctatacagcaagtgctagacacctagttgattattcgaataactaggatttacaaccattaattagtaaaaattagccctgggaaataataataactagaattctagaaagctgggaaacagcccatatttagggtttcggctttactacttactaatcatttccaaaacatggggatactacacagtcacctcacaggtttactgtgacaatcatatgtaaaaataattttgtaaagtgctgtacttcttagtagtgacaggtctttctacagttgccccttaaatgacataggtttgactgccgaggtccacttacacacggcagtcaaccaaacgcagatcaaaaatacggtatttggccgggcgcagtggctcacacctgtaatcccagcactctgggaggccgcggcgggcgaatcacctgaggtcaggagttggagatcagcctggccaacatggtgaagccccgtctctactaacaatacaaaaattagctgggcatggtggtgggcacatgtaatcccagtgactcaggaggctgaggcaggagaattgcttgaacctgggagttggagattgcagtgagctgagatcacaccattgcactctagcctgggtgacaagagcaaaactccatctcaaacaaacaaacaaaaaaaccacatacacaataatacagtatttgcaggatgcaaaacctgcccctacagaggagtgacattttgtaaacgtgggttctgcagcaccaacttcatcacttgagtatgtgtggacaggcagtcgaagcaatccccatgaacaccgaaagatggctgcagttcttcattgggactgaaggagaaaggccaatggggttgctctttcacagaaagagttatatcaacatgtttttttagatgctaaatcatgtttataattaaattggttatttctttagatttcttttctctaggacattctaggattctaagagaagagataaaatacgaataattgatttgatctgtttaatactgagaaagaattggagagtgttgtcctcagtagaagcttagaaagcttctaaagaaggagaggctggatgaattccccaagatgacatactaaaaaatagaaccaggctgggatggaagggctcctgactcctccttcagtgctctatgctaaacaaaaccttccttttcgcctttccacatgaagcccacatctgagaccacaaaagcgtccctctcaaaaaggtgtggaattgttgtgaaagctgtgcctggaggacaagggctgcgcctgactgttcactgcaggattctttctcttgtgcctccacagtaggcaagcaggactgatgttccgttgtcccgaggctgacacggcttccctctcccagcctgaaagcatccaaatgggtcacactggcttcactaatagtgaccatgttattaaaattccaggcagaatccaaagtgcaagattaagattacaaaacgcctagttccggtagggatcagagaaaagaggagacccattcctttagatgatctgggccaagaggtagcagttccttcatacaaagccatctatacctatggactttttggaatggggtaattaattccttagtccctctgaatctgaggctgaaatctctccatgttcagaagcctaacatatttcacaaaatcctctggtgcaggaaaagcccaatttaaacagacccaaataaccccagaatacactgttgccgactccacatctgttgctgtgtttgttcatctggaaaggattctgtagttctcaggcactaaaggggaaaattaggaaagggaaaaaaaagccccctcagctcacacttccacccacttctccaagcaccttctcccttacggaaaattgctcttcccagaaaaaatcaaatagagtcagcctcttcaagcaaaacaaacagaagatggaatacgtaggcttctcttgtttatcaagtctaaaagcatgaggaaaacagagggagaacataaaaggaggggaaaaaaggagtcctttctggttggcttcagaataatatgaagaaagcacaaacaaaccctgagccactcatgcgcagaaagctctgtctccacccctttagggttgaaccaacatttaaggcccaagagttagctgggtaagaggttggtaagggacttcctaccatggagattattcccttacaggtaacgtgaagtgagagacataagaatattgaagggagctctctcacctcagactggctccaagaggggctatcgatgccactcccctaactcgaattttctgtcaagcctctcagagatggtgaacaaatcatttcctctctctgtttgagagtgctctcatctgtttggttctttgggaaagcacaagattcttctagatcccattaaccatgcttgatgagaagtccatctgcctggacattcacccaccatgtcaggaaaataaaaacctaggtagcaactgtacagattctaagtcaaaaaagatagagcaaattgcataccctctctaggaaaagcaaaccactgactttctgaggtcttttgtttaagcccaaagataattacaagagatggataatttatttgacctttttcagaggtacctaaatataggaaatagttaacactttcctgtgggacttgctatatcttcttagaagcgaaggaatatctctatgtatgtctctgtctcatttcctaaatttcaactattctattgccagtttgagttctcttggcagaatcttcaagtgttctcagtaacagatgcctggaggagagggatgctatgagttctgaaacagagcaatgcacagaaccggggaagcagctgctccgctctagtcactgtgtatacaacttcaccaaaagtgtttaggaaacagatcattctggaacctataccacctattcaaaattcaggccctttcagttctacccatcctttttttttttttttttctttcctatgctgtttgttttctgccatgagctttagcaatctgtttatgttgtgagtgtgtgtgtatttgtgtgtgtttccctctccagcctggctgaattatccccaagtgactcttaatcctcaaccataattcccagtgattgcactgacatgataacgggggagcccattttcctcccacccctcctcactccctccccccttgttgctaagctcagccaaggatgctctagggagctgttcatttaaaagaggaagttcacagcagggtcaccaggcttttaaacagagagagaggttgcccagggtaagaagagagctcaaagtcacaaaccctttcctttgtcctgtgaccccagcatgtggggacatcagtcccaagtcgtcactctttctgaggccactgacatccccacagcatacctggctgggcactgtgactagcagaggtctggactgggaatcagaaggccagcacctaccctgagctagctgtttcatggtgggaaagtgacctgcccactcttgccctcaatttccacaatcacaaaaatgggctggacagatctggctggatgatgaatcaagcggtacttctcacatttcactatgcacagtcatcatccgaagaccttgttataacagactcgtgggcccgcctgaaaaggttttaattcagtaggttggggccagggcctgaggatctgcatttctaacatgctccctggtgatgctgatgctgcaggtctgaggaccacactttgagaaccactgatccatggcccctttcactccttacatcccactgctctattcccaggatggcacaagagcagtcagaactatttggccctggtcatgtgaaaaattccccaaaggactacaaaagtcacaggcctctcccacacttaaatagttttgtttttccatgcccccagcatccactcacttatatgcaaagacaagcagcatagatatggagtgaggagaactactggcttaactttaagttgccaacagttgctacccctgggaggccacttgcagttataaaacagaaacaagttgaaatagcaaaataggaataagaatgaattatataggctcctcttgcctaggttgctatgctgggtcatagtttgtcaactgcacaagtcacctggaacagtgcaatgtaaatttggtagtctcacacattgtgtaaagaggtataaaaaataactccaaagcaataggaaaagaagtactatcatgcagaccttcagatatttaccttgttccccgctctataatccttttcaaactgcaaaaccagaaacctttctgccatttggcaatctgactatcatccatcaaatatttacaaattcctgcatacgtccatgatcacagagttatctggcctggtgcgaaagagcaaaagcactgggctggggatgctgggattatgtctgagaaggaattctggttctaagctcctgctttcagatgccaaagtattttgaccgatctgaaattctaattatttaactgcgatagtttatgctaaggcatagttgtaaatgagaacttaatgaactcagagtaatgtcactaggccagagttctcagcccctctacctgtttgaaaatctttgctatattgagtcactgctactaagaatattatatgcatcagaggaactaaaatcaaataaatattaagaaccactgcacagggacaaataaaattttgagtcaaaattttactctttaacttaaaatttgatttggccgctttagagattgccaaatggaatgggagccagataaggggtcctttcccaaaagttctaaaaaagttttttttttttctctaaatttcccaatagcttttaaaaaatctgtatttctttgaattgggggctagcaaactatggcccactgcctattttttttaaataaagttttattggaaaacagccaaactcatttgtttacgtattatctatggcacttctattgtacaacagcagagctgaggagttcctacaaaaagcatatgggcagggtgcggtggttcacgcctggaatctcaatgcttttgtaggccaaggcggaaggatggcttgagtccaggagtttgagaccagcttgggcaacacagcaagtcccatctctacaaaaaatttaaaaattggccagccatggcagtgtggcctgtagtcctagctactcaagaggctgaggtgggaggcttgcttgagcccaggattttgaggtcacagtgagctatgattgcacctgggtgacagaataagaccctgtctccaaaacaaaaacaaaacaaaacaaaaagtgagcatatgacttgcttaaaatatttactatctagccctacacagaaaaaatactggtttaaataacagaaaggaaataatgacaacacttacacttaaagatgtgatgtataacatgtatactccaaccaattaccagataaattaattacaaacctgttggatcaatcctgtcaagccaatgtcagaacccactcctttttcctggctctcagcagtgtcttcaaatgcaaagtcataatgctttgaaattcactcagctgttttaacaaacttttgagagcctattctattcaaagtgctaaaatcaatttaagtactgaaaatttatacatacccatatccaccaaaaactaaaagcagagccatactaatcacgaatttctgcatgtgatttcagtcatataaaaacaacatatgaggaaggggacaaatgaggtcttgagaagccataagtctgcagttggcagataaaatgccatctcagataatcacattcaattgtcactaatgttaatatatgttgctaacagtcgagcttgcacaccagaggttagctttactgcccatgtgcagatgtttgcaatactgaatctctgccataaccctgtgggaatggcattttttatgtgttctgcagtgaatttatggccagggagccataaatgttatagttctttaaaccttttgcttttggagattgtcacagtgcttgaaaagtagagagacacagatgtcttctgttagcaagtcatttctcgatgtgctcagggatacggcctacgccagctcctaaagttccagtcatctgtgttatcaatgctacacagtttgaaaccccactcttgacttggttcaattcggatctacagagggttatcaaggcctgaatgtgccaggtgctgggctaggctctgagacaaggcccttgacctcaaggcactcacatgttggccagagtgacaggtcatctatgaaatatgacatggttagtgtcaaaacagagctcgagaacagacccatcagagagggcgaaatgacaacctgtggaagtctgctcgcaggagaggccatatgcctgtacaaagtcttgaagggccagtgcaagatatgtaagcaaagaaaagtgtgtgcatgtgtgtgtctctgtgtttgtgtttgcctctaagtgtgtgtgcatgtgttgttcatgcaagaaaaactgcacaaagccacagctgcaagaaacgggatgatttgttccagaatgcacatgtagtttggtactaaagaagcaaaaagcggtgggggatggggcgacaggagacatacagctgtagagactggaaagactgtgggcttagcagagaggtaggcagatcttgattcaaattctggctctatcacctacaggtagtgtaacctcaagtaacttgccaaatcccataaacctcatgtcctcatcagtaaacagaacctcagaggattaatacgaaggtgaagggaggcatggctgggtctgagagcaaaatgggctagtaaactagtaaactaacaacgaagccaccagggaagaaaaacactcattctgtacagcaagaaaaggtcttccattttctttaaaaaattctatctaaagtctcctccatcatcactgaataatgatggaagaagccatttaaaagaggaactgaaaagcacagccaaacctctaaaatctcccaatcacccatgtcatcaccatgcaggtgagaaacactgctagggagactgtgaatcacaaatacgattgacactgttcaaaacggtagcctcctaaacatctgccccagtgtctacacccaacaccagctctgtttgctacatgtgcccccagaaccattgggagtgtaaaacagaccccctgaagtaacacaaaacccacttctgacataccaggagccatacaacacatgcaaagtttctttcaagataaatgaatcagcacctcaagcataacaaaaggaatgaattttctgttaactgggcttttccagtttctcttagagataataaaaagctcccagtgaatatgagtaaatccccctactgtagaaaaaagtccaagataagtggccacccttcctcaaagcctgccttagttttatgtgagagggaattccacagaagaacagagaccttgctaacttgggaaaacatcctgtttctcacagatgtagctttgttcattgctttttcttgcatgaacaatacacatatacacatgtgcacatacatgcacacaaacatgcatatatatacacagaaaatggctgagacctgcatggctgagacctgcatctttcaggaacttggtgcaaggtgaaaaggatgcctttcacttgcttgaatacacaggccatccttggagatcacttctaaaaggtctctagacagaagatcctgaacccagaaaggcagtcctggtgtagccccaaatgaaaaagatcaccttgatcaagaaattctcctttaaaggtttcagagccacatttttgtgtgcgtggtggagaacagacctatccagctgcagcaaaaaccatcaccgtaggctctgaagtcctgggattggtttcctgagttcctctgtagcccaccgagcagtgacaagcagcaggctccaaggatgccctgacctcatcaagctgttggcaaatacagctttccaaagatggagggtagaacattcccaattaccaggccaatgaccattctgagggtagataaaactaagcaaatgaatcatccaagggcaacctttaactataagacctgggggctggaattcactctatctctagcccccacttcaactttcaaagcaccaaatggggcaagcccagggtttttgcccagaagacttttccttcagagacatttctccattcgtaatattcagtaagcagagaaggatgcaagagtttttctctagagtggggtaaagtgaggatagtgcctgtctaggaaccctggtctgggttctgaggatcaaccatttcaccaattcctgggtcaggctgcatgaatcactttcaagaccttgtattttttattctgtttactaagagatctgaatcaactagatgatcccaaagctaccttccagttctcagttttatgattctaagtgaaaataacccaaatcaaggtgcccctctgtgaatatgaatgaggcagttgccaacacactgtcatttgggggctctaaaaaaagaaataccccagcctctattggagatccctgagaatcttgccacctagtgattcttggatcaagcattaaggctgctaaaatgtactcattgtgtaatttgggaatgcttgcccattaactcattatcggccatttagtcacccatgtaaagaaagctatacaataaagtcagccaaaggttatgtaatttttgttgaggcagaacaggtcttaaatctctagcccagggagatgacagcagccaaaatccatctatactgaaatgattatggagctctagacaagatgagacaagagacaagctgtttagttaatgagaatcccaaatctctcccggtgaaacaggaatcagtggtctccagctaccatgtcacacagccacactcattgtgatctgccactgttattcacccctgcctgatagcttttgtcacccccaaaacgccccccaaaattcaccacctcgacacacgcagtcatttatgagtctcagaagagctgaaaacagtgtctgaaaacctcatgatctcactctgtccctgctaatacctaaaacagtccactgttccatttacacaggcttttcttcagcagatttacaaggtaacatctgcttcggaaacagatgtttatgccagaattctcttctgctcattaatgcttttccggttaacatctaactatctcactcattagttcttaataatactttttgtatccgagccatgccaaatacgcactctttagagctctgcattattgttgcttctgttgccgttgaattacgctgctgaataaaggaaaagtaaaaataagcccctctaagaaggctgctatgtgtcagagctctatctttgtgaactgaacaagctgaaatcaattaaaagtgtgtgtttagagaatgcatctcagctgtctaattgcaccacctctgctttagggccaaagtttgactccctgccaaattgccatcaaaatgggcgtccgtaagcgctgctgtactccctccgccactgcctgggcctgatggaagcacttgtgtaacgaaggaagcccagtgcaccccagggcttggcacacacactcccacttcccaggggcaatcctcagctgtggggctccggcagaagatgccatgaaacctctgggatgaaggtcctgggactagataaattattccacccgacttcctcagtcagccagccttaatagattgactacaggaagcattcgcatgatgctctttatttatccacaagcaacttcacataacaagaattaattcaggaaaggtagactcgacatacctttgctgagtgcctagtagtgcgttgggctgctaagtattttatacccatccattattagaaatgtaagtactgcttgtgtgtattcataggcaagggaaaagataaagtaaggttcattttttcctgatttgttcctacaagggtatatgttaaagtggtcttttaaacttgtttctacaatggcatatgttaaaaatggtctttaaacactttgaaacacttgatggtggcccccaagactagcttttatgtttccagaagccaacaccgtagtcaaacaattgaacaaaccaagatataaataaagctaaagttggtctatgcaataatggaaaagccagtcctctagggaacttgggccaacacaatgtattgtttgggatcaggagaaaggatgcttaataaatcatcaacaatagtttccatggttacaataaaatgtatagtcacctatattgtttagttttataaccattcttacagggaagaaataacgaagggtgctggtgataagcaaatatgaaactcacttaaaggctggcagtatgttcaaaaaaatgtgaaataaaactgaaactaagtctaatcaaggaaacttctagtttttaggtctctcggtaaccaacatttcttggtcccaatgaacgacattgcagctccataatctgctctgttctttttatagtaggttcttccctttctgcctaagtggctgcttttcagcaaaattacttggcaaacaccactttatcaagtataaatcagatatgctactctggaatctaaacccacaaagaatatgccccataacactacatgaaaatgaaaaggagaaacactgcattcttgctgccaaaagaaatgtaaaaatatgaatgaaaatgattgctgggtgtgccttccatgagattccatttaaacaacattccccatttacttacatctctacaatctgatgggcttacatattgcaaaatgaaataaaagcacattttatgaggaaattaaaatgttatgaactgccctgggtggtgttggcattatacacagaatggtgagtcctaaccacagtcaaaaccttgttcccctccagtcaacagatatcatctgaggctttgaagcaagtgctaagggaattcaagctggagatttaggggctctccacagtgcctctctccagataaactccaggggattccagggtgacagagtaggtgaatgctgaagtaggtataaataaagtatgacattgcacctcccagccctcttgtttaaacactccccacttccagatctactctgctgcttcttcctctatctgctgtcaatactgctgcctcgttctcctggacttctgaagtgtttccttagatcctctagttagactgatggctaatacctatctcatgtgactgcagtcacagtatttactcatttattccacaaagagataaggaaacaaaaaaaggtaatattcttccatctttaagagttttcttaaatcccaactagaaagataaacttcctttcctattactgtgttcctaccaatatgaacgcattaggtgccacaagagaccatgctagacccaaagtttccctaagacagagctcaagggcttgcactaagcaggtgtcaggtgtgggtctgccaagggcaccagccaaacaaatgatataggcatgaggccacatggtggactatctgggcattatcccagatcctatgcctggagatacagaccaacaatgctgcggctacagagctggtgactttctcatccctgtactcagaagttacttcggtcacaggggacatgcagaaaaccatgcaggagagtaatctataccccgatatggtagtaactaaagatgatgggtcaacaataagtaagcatgctcatctggacttctatagaattgctctttgcttgaggaaagcacctttcacatcaaccctttggaagtggtggtgtggcaaagctgttctcatgacccataactcgatggccacctctgaagctaatcaactgagaaggtgaaaaaggagcaggcacattttctcttgttccacaaggtctacaagtagttgttacccactgacagagtttccagaactccatgaaacggggtttgggcaggcacatactgaacgaaaaggaaacaatgtctgccatgtcaatgacctaaagaagacagagatgacctcaggtgaggattacaaacttctctgcttccgtcgccaagtccttcaaggcacgtgatggccagagatattttccaaggttcaacatggcctagggctttgtctcagttgtaggacttaggcacaggagagagcctcatgctggtgaacctggcaggtcaagatgttgatattcattagaaagacttagccttttctcctaagcatagagcatcaggaggtatccattcctggggtaactactcctttatgtgagtgaacaaaaataatgagatttccatagattccaaggagatatcagaatagtcagaagtcttgcccccagaaagacctatagatttaagaggcagagattcaccttccagttttaggaaggaagatctaggccattaaattgaccttggaatggtatttttccttacccattctaagtaatcaaatatgaccgtatgatctaatcaagcagatccaggtagtaggtatctcagctgttgctgtctggtgtgttttaagagacaccagtacagagctcagccctgctccagccgtaggcgatgcccatccaatgaatatagaacacaccatgggaaagagtttcatcagcattggtcccacttctctcaaacaagatgtggtaaggtccaaaaaatgcacccagcatgtcttatgctcattgttctgtggggaagacaaaattgagaaggaattagttatttccagcacagataggaaagatcaggaaggaaatagaaaacattatttgagccactactgggtatccagggctgagccagatgctggagatacaatcacaaagaagacccagttactgcccttcaggggcttggtgcacccagcagacaactacttgcagcaaaccttaggtagaagaacaacagatacatgggcatatgcctcagcaatgagaaagaggcgttcctctgcctgaggaagaattcagaaaagatgctactggagcgggtttcaccaggcagagaaaaggggaagaggattccaggaaaaaagcactgcatcttcttgagagcccatagtctttctgcatcaacctggtttcttcagtgttcaggacagtgcctggaatatcatggggactcaataaaggttactggatgaatcagagaattcagggcatggatgaacagaatgtcctttgggtgtaaaggtgtaaagctgtaatcagggaaggccctggtcagtccttggttttgaaagatttttttggtgttctggaggctgagctggcttgcccagggataagctagaatgctcaggtgggcggctgctgcaatgctctgaagggtatatgccgagatgatcatagggggtagtttttagaagtattttagatacttacagtaggaatttatttaccaaaaatatattttttaaaatacctatcttttaaaaaagacaatgccttttaaaaggcttatttcctggaaagaaagagcttttaataatatgtactaataattgtaaaggaagttacatacaaaaccaataaagaaaagactgcattcaactaaacaaggttaatgcctacccatctgaggaatcttggctactttgtaaatatcaactcagtctgcgggctgggccctggtgacaaatgctttctccaatcttatggagaatgaggttgtgcaaggacacaaaatctaaaagtatataaactagaggttttgagcactttttaaaaagcagcagaaccctttgcttaagcaaaatcttatgcagaatcctataggcaaatcagattacaaataaggatgcttgttcgaggtggagtgctggggactggaggaccccaaggtccatgattttccatcacctcctggccttttgaggcagcccatacaggccctgaacaaacacccaggggccccttgggacacaaactactttctaaaagtcaggacaacttccaaactggcccatcttttctactaaaggcctggtcctcagaatgatgagatggcccctgaaggatctggactgctacttcctgctgcttatttgatcattgatagggggtttggaattatgaatcacaagccaaagggcagagtccaaaagcttgtctgcaagtggaagaagtgagaggagcaggagattggctcttcttggtgaatcccagagctgaggctttgcagatgaggaaggcaagaccccatgcggacagcaccttaccaggcccacacccacattgggggagtgtgaggcagagccaggtgtgaaggctcctgaagtttcttctaggtggctttggggaatggctgtgtacactactgtcccttatagagctgcagccttctcggaatcgggtacatgctttatccagtgtgctctggtataagttcacaagcagtgcagcatggggcaaatccaatgacattttgttccttcccagagactgataagctcatttagtagcgacaattcacagtccaaaagaaaatgctgaatctcacttacagacatagtaaaattcaggcaaagacagccagatagcactggaagctattttagacatgcatacatattttaataccataaatctttatttttcttaacaaaatagtccacaagattatctgttacaaccaagtccccatgagagaggttataatccccatttcagagatggggaaactgacttgtccaagcttccagggatgagacaagagctggatcttccttgcacacagctgcccgtggagctcacacaaagagcttccacagtcagcaaaatgtaggctcctagtgcctagggaaggcagctcagagtcattaaaaaccggtcctgtcccatcccaaaaggacatctggataaatacacactggggagccattttgtgagtgttcgtgatacatttcccatcgtgccctcagatcagcttctctctggtgcagcgctttgggaaacacttctctgctagcctgatatacagatttgagttatttcaaatcgataaatatttactgggcatcgcccatgtagaaggcacatgtgcatggcaatggatacaaaaaataaaaaatagtgagtaacacaaggtcttggcatccagaggctcttactctactaagggtgaacaacatgaagaattttaaaacaaggcagaatgtgagaagtactacaaagaggaaaaagcaaacaagagggggagtgtttccgatggggcagactgtggaagagcttgtggaggaagcaggatttgagcagggtccagaaagtcgggaaagactgactcgcaaataaacaggagtgaaaggagggaggagcctgtcttgactggtctgctttccagcacattgggctggttaaatatctaaattgtaataggctttctgcatgcaaaataaataaaaggaattgctacatacctggaatttgctgcaaactttccccaggatttaccaaggtcccacattttctggccttgcctctttctctgacctcagttctgtcatccctctcctccctcccttcacagtagccaccctgttctccaagggggctccaggactttctgcttgtcatcttccctctgcctggaaggtaaactccatcagagcagggacttttgtgttacttacaattttatcctcagtacctggcacagagtaggagttcaattagtatctttggaataaataagtggataaaataaagttctcaagtacagtacaaaggaggtgacaaatgtagaatttcttcttggataatttctctggctgtttttaatttttaaaatacatctatctgggctgtaaatcgtgacttcacctgccctaaaccacaaggactaactagtgttaattaagtctgatacaccattactcttcattcccaatgtaccattgcagcttttgaatacaggatcatttcagtctgcacaagaatgcttggccttttaattccaacttcacagttgagaaaactgatactcaaggcaaagaatcttctcagtagtcagagtcaataactgcaggaactaagactggaacccaagttttctgcctggtatgttgggcctagaagggaactgctattcctatctctccatctttccttccatctttccttccttccttccttccttaatccttccttccttccctccttctccccctccttcctccttccctccctccctccttccttctctccctccctccctccttctttccctccctcccttccttcctttcccccttccctgcctccctccctgtctccttccttccttcttccctccctccttccttccctctctcccttttctccctcccccctttttttctccctcccttcttccctccttccctgcctccctcactgtctccctccctctctgtctccctccttcctttcttcattccttcttttctacttttttaagaaacaaggtctggctttgtcacccaggctggagtgcagtggcgtgatcacagctcactacagcctcaaaatcctgagctcaagtgacctcccactcctgcctcctgagtaactaagcctacaggcacatgccatcatgcccagctaatattttgtattttttgtagagacaggagtctcactatgttgcccaggctagtctcgagctcctgggttcaagcagtccttccgacttggcctcctcaaatgctagggttaaaggtgtgcacacccagcctgctactcctattcttaacatcaagctgtaaagggcttccatgtatcgacaagggaatgtggtgtgatctgaggaaaatctcaccctacaaacaggaaatattaagcaagttttgacagttactcctcctttgctttgctttaaagtgaacttaactcctcttgattactgttattggaatgtctaaacttaaaaataataagtactgcttaggagcaatcgttattttaactgtgtgaattaagagcataagtcttttgtttaaaattctcttgcgtgttctactgaatacttccaaaggttccgggctgtaattcccttgcaggcaacgtacgcttcagtgaaatttttcatttgcaaattaggttcgtttacggcagaaaatgaaaagtcatcatcagacagaccaagaaatggggccaatctttacctagaaggagtaattagctgaaatatctgtggggaaatttttatctttcacgtattgtcaattttacaaaggtatgaaagaatcactctaaaaacctcaagaacatatctaattacggtttaccccagtgactgttcataactgactgtttactcagattggaatgggaattgcagacattccttggatgagaccacactccacaatatggaattcagtaatgaggttccggttcacaacctcccagtgcaaagtttgggcaaggtttagatggttctgtagatgtcagttctaattatctcctaaaggacagtctatactgtcccccactaaatccccagtgagggaagggaaacctttccttggaacattacctccctatttatttaattttctagataaatcaggaaagatacaaggagaatggaaaggtaagctcacacatcacaggcatccttgacagtagtgggacattagactgctgaccagacacaggttggtggttatctataaaacgttacttattacttcaaaaccaacacacgcaacgcatacctcctaccgaaaaaacaagctcttttcatcacaattgtgtaccatgttcagctctggccatttttatttccagcaagttggattcattccatttttaatggcaactccttgaggaaacgctctttttaaacctgtgttttgagaaatgaagttaatgggccagaactggtttatcatgaaatactcatcaagtcaggaaacaaagttcaaatccttctacccttaggtgaatgaaattcgtttgtaggacactcctggagtaactatctaaaggtcatctttctagttagtgaagacagttctaaaatagtaaacttgggttcactgctattaccttttgtcaaacttaatttaaaaagaaggaaacaagtctgatactaaatctaataaagtagtcaatcatcttaaattataggaatagaattcaaaagagccagaaattgtctcctttcctctccccaccaacatctgggaatgaatggtcaattttcttttttttttttttttttttcttttgagatggagtctcactctgtcacccaggctggagtgcagtgacacgatctcggctcactgcagcctccgcctccgggttccagcgattctcctgcctcagcctcctgggtagctgggattacaggcacgtgtcaccaggtccagctaattttttgtatttttagtagagatggggttttgccatgttggccaggctggtcttgaactcctgacctcagatgatctaccctctttggcctcccaaagtacgaggattacaggcatgaccagcggtgcccggcctgagcggtcaatttttaaagtgttctcctaatttatcagagcattttgcaaagctggaagaacaggctgtacatggaagaagcagaacagtgtgcccttctccacttcagggctccagggctatctgtggctagagaggtctcactgtgttgtccaggggtgtctgtggctagaaatcttcagagccacctgtggctagagagctgggaccattcatttggcatggggctgcactccccctaatggaaaggggccatgacacattcccgtggctctggttttcagtattctttatcagccatcacattatctatcaccagcacatgccctcagttacaattaactagagcacggcttatcttacactccttacagtttaggctaatgtctttctgagatttgggaatggttaatcacatccccggtatgttgattcttaccagctttaatttcagaaaattatactacctggaacaccagcatgagaaactatgtactcagaccaccctgtatataactctgttgtaacacttattctactgtgtggattgatagtttatgactgtctctttcaccagaatctccttgaagatagataatgtgccttagcttgcacatattaactgctcatcagatgcttgtagagagaacaaattaagttaacagtgactagctgctgaaattcttctccatgaaagtacagagtcacagcaacctgttacaaatcactcattcattcactgttctagtcaaccaacatttaaaatatacggaagacatccagatgaacaaaacagacatggcccctcctcttagggtagggacggttaatagagaagacagacaatgaacaagtaatcacataaatgaatatccagttggaaattgtaacaaagtaaatggaagcaaagtagggtcatgagagactgaaaaaaaggcttgtttattttgagactggaaggatcagtaggggtcagctgtggagagaataagataaaaatttcgaggcactgggaacaagatgtgcaagggccccgaggtagggaagagcatgatacattcacgaaactgatagatcagtatggctagaattcagcagcaggaagggtaaactggaatgatcctagaaattgaatctctctaaaatcgaatctccccttcttttctctgagtatccttcctttaaaataagaaaataacgtcacacaaggccttgtaaacctggtaaagggcttttaattttgtcctcaggggaaaagaaagcctttcaagcaggagagtgacagaaccagatgtgcatttccgaaaggacattctccctgctgtgtgtggtggaggaaaaggaggtggacagcagagggcaaaagtgggagatggtacagagggccactgggagtcagggtcaggacctggaccgggtggggacagcagacaggtttgctatgaatgctggaagtaattctcagggtcttggtgatagaatccatatgagacagaggtgcaatgtgtgcctgggtttgtgtgtgctcggagctaacctggaatacctagcctgcccagctcccaaaccatctcccaaggcacacagggaaggcggggctttggttaagaacacaccctaacaaaccccaggtcatcccccggatcctagttctggcacaagctacacatacatttctcccagccctcagcacaaggttctgcaccccggcccgtgtcattgccccactgaggaaagtggatgcttgagagaatctgtgctttcctccttgtcagcagttgtcagcagggtgcagacacccactcttggggtctccatatgagaagccccccctcaacccgactgacttgacaagctcaggggtgccaatgagtggactacaaaacgtcacacaggcagtgaaatctaatgtctctgtctcttccttgagtggcctataaacatccctcccttaaaagaacaaaagaaaagccctgcttcccattgtgagttctggccttggctgccccaactgtcagagccacagctgaggacctctggcctcccaagcctttcgtttttgctctgtattccctctgctccaggcccctgacatccaaagctcttcttaaaacatcctttgatatccaatttccttttgatatggcccctactgtcaaaagcacatttttgttttcttgctggagaactgatccaaattcctcttctgtgtacccacaacttcctggttctgctcatggatccccgggctggtgcgcttaatcctcacaatcactcaacctgctcttttccagggatgcctcctacactgaagcatgcacctagtttttctttctttaacatacaacattctaatctagcttttcttgcttgacccttcttttccctacatgacagcgtgttacacattcagattcctcccagttaatagactggatgcttttttaaagaggaccaacagaggcttttccaagccccagcaagaaactccagtactttgtttaagaatcattctgtattttgaatatgaatgtctcttaattttgaatgcccagtgaggttaaagatagacaaaaattattgagtgcctactatatgcttggcagggagatatctgtttaataaatgtctttattcagacacgttcctatctcccgtattccctaactcctttcacttattttaggtgggtaactcaagcgcagtgtgctctggagtatgagagaaagcaatgttgtaagcaaccatggagaaggcatggtgagatgtgggctgccctcctctcctgggcggggctgaggaacttggcagtggaggatgggctgtgagcatcagcaggctgctttggggcaggcaggagggagccttcaccatgactgcatgggtaaccagtccccagacaattaagagttaactggataaatttagggttatccaggacctcattgctcctactactcctttgattccggtaaactcagtgtaatgacttccactttccagaaataatccatggggttaagaactttctccaagaactcacagggagggtggggtgccccctgcagcagaaccctccccacatggagctgactttgcagcccaccaccaacacacacaccatgaccttgtccctggtgcccacagagtgtctggctccattaccactaaggaggctctgcctgccactgctaggagacctcaacgactcaaagtcagagtgtgcacacgtttggggctccattctaattctcagggcattcacactgtcctggcaactcacccccagaacagatccagatatggcagccagcagataaagacctttatgtgtgggcaacaccaggatcatttgcatgtaggaaagaggccatcccccaccccgtccatttacacaggcagaatgtgccctgccacttggacctaaaaagacctcggcaagcaccacaaggtttatgaaaccaaagagaaccagcaacaaactcactgaatcagagggaagtagcaggggcttcttcccctcccctgatgttcacacttggccaatttgtttaatttccttggcaactatggacacgctaaactcacaaaagttaattctctgagagaagaaagatgaatcttagataaacaaggctgcatttggggaggtgggaaaagccacatgatgcatgttctcatctccccttccacccaactcacctgtcatcttcctgtgcttcctcattgcaaaaccagcattcctctcacggtcagctatgcacaaaatatccttctgttctcctggtcacatcaaagcaccttcacgctatgcagacaggtcattgagggaacggagaaaattaacaaacgcacctaggttatttctattaaaattagcccctcagccggtaggctctgtcagtttccattgaacacaaactctgacaagtctgttgaaaacttttaacctttccaggttgtgtcaacagcttgcaaacacaacaggaggatggtgcctctgagttctgcctttccttttggaatagaggaggtatcagaatttgttaccaccagctttcatgtttatcttcactgctctgctcactccccgctgccacttaaggagcatacaaacaccttactggataaagacaaacatctgtcaattgtctataaggtcctgatgagatttagcttttgcctacttctcccctcatgttttagcccactctcccccactctctactcagctccactgaaggctaccttatggaattcttcaaaaaagcaggtagagttcctcctgccacagggtctttgcatatcctgttccttagcatggagccctcttcttacctagtgatatggtttggctgtgtcccacccaaatctcatcttgaattatagctcccataattcccacatactgtgggagggacccattgggaggtaattgaatcatggaggcagtttcccccatactgaaccatctgatggttttataaggggaaatccctttcacttggtcctcactctctcttgtctgctgccatgtaagatgtgcctttcgttttctgccatgatcatgaggcgccccccccaccgcccagccacgtggaactctgagtccattaaacctctttttctttataaattacccagtcttgggtatgtctttgtcagcagcatgaaagtggactaatacagctagttaacccttactcatctcttgggatctcaactcaaaagtaactttctcaggagagggatggtctaaaatttatactctcacagaccttttacatttataatgaagcatgttccatacttgggtattatatatagtatttatgaaattatttatctaaggtctgtttgcccactagaataaaagtttcatgagagcaggaagaatgtgtgatttgttccaacacggaacatgatatatactcactaagtgtgtttaattattagattaattaataattttatcatgtcatacctctagttaaacattttccagtggttcccatgatatttcataaagtctgaagtcttccaaaaccatctgtaatggaatctcacccaatcataggaattcaagattatttattattaatcccctcaaaggtactctcctcttctgccaaggtcattggttgactgtgcctcaacgattgcccctcatctaaaatagcttcttttatctcccctctgattattcaaatctagtaatgcatgaaaatgcaggggcatgtggacaccataacacaatgtaaggaatgcagctctagctcagagtcctaggttcaaattcatctatcatgacatattatgtgaccttgaccaagccacttacatgctctgagcttctctcttttaaaagaacaaaagtgatatctacaaggctactgcggaagttaaagcacatggtagatactaggtaattattagctccacttccattcttcaggtgagaccatcaaaaacctatatggtgaaaagttgacataatggagaagcagcatggaccaagttcatctacaaaattagttgccaggaaaacacaggtttatcttcataagctggcaaggagattctcaaaagtggtatatgggttcattcccactggtgtcaggcagaccctggaggtaggtctgctcttcctggtagcaaagcaatctatggtcacaatgatttgtttcttaaagggccctaaagaaacactagttctcatcaaagtttagcatcctgtgtctttgaccatcttgttcaatgagaaagagtttaggcagcatctgctacatgttcaacattctagttattactagagaggatgaaaaatattacacatgggcctttcccacaaggtattaatagtatagccagacaggaaagaattgccttgatgaggtgagaccatacagaattgagttttaattgtgtgctatagactaagttcagaggagaaaaagcaatcaaaataattactcattcatttaataaccatccgttaagtatttaccaaacacaggacaatgaactaaaaaactaaaacacaaccagctttttaggagcttgtaactctctccacctgtgatcccctttgttccatccatccaaatcctactcacccatgaaggccttggtcaaatcacacaacccccatgaagccttccttaaccattctggaccagctccccctcctcccatctatacttctcaaacattgtctatttttcacactgattttaccactcacctcacatttgcatggcctgtgctgtcaaatacagtcatctctacttgcataactctcatttcactttttttctcagtatatacatctttccatctatttataaaccctgggaggccaagggcccttgaatcttctgccgcaggtttaacacaaatgcatttttatttgaattaaagtaggtcttcctacgagcagttcaaagtagaaagaggggataaggatggaaagtgccctttatggaacacgtgctatgtgctgggtccttccctcaggcctatttaaatccttataatcctagaagaaggtactgagtcttcttggaatccttcctctcctcctacacacatcatcctgaacatggtcactgagcagccagcatctgcccaccttggccctggctacattcattgctggagtgggagtatatttaactgtttccaaaagcagggaggtaattacttgctgtatccaatgagctggaatcacccgtgctctgcttgtttctaatacgcccatcaaccaaagctaaacacacaggagaccaccattagaaaacgcaggctctttttgcatgactgcctatttgaacaaactcacaaaggtcttaaatccaagtaagaccatctaagaatgcaaaagtttaaaaatgataggtggcagttttgccaggatgtacgaaactgcagtactttttttatttttaaaggaagtccactattctccatttcccaaaaagttctttgttcttttgctctaacaaagtaaattattcctcaccttgggcaagttggtaggaacgtgagaaaattacattaaatcagacatccttgagatcaaaatagattggaacaggggttctctttgtttaaaatagatcttcaaagagaaagcaaaagagcttaagggaagaaaaagttgtcaaacaacctcaagcactctggaagcacctaagatctacaaactattgatatgttaattaaaatttacttttatctagtataggtgtttgctggtcatggtctcattaccctgtggctcttttggcccttgaataaaatttcatttcttgaaagacattagaaaatgcttctttttctctctttcagatggtttcctctcccttattgcaatttaacaagacttcactctggcttaaacctggacaccgaatcccagagagaatacactatccattcactccatccaccagtaaccttctgaccagatcaaaaacaagccatattggacaagatacagaaaaagtagaaaattttaatcagtgagtaattaataactctgtattgaccagttgccagagtaggacttctccggattttaaaatgtctagagaaagaaaatcctgttcagcgataacccttctatttcaattctgcaaagccctcactgctgaaaattccttcagggcccaatacaaatgtccatgggatagtttatctcctctggttctattccagagaagatgtcccttccaggttcttgaaatttcttccttaagtgatccctagtaccgatcctgatcttgaaccagtcagaaaataaggtcatgcaaaatagtaaacttaaaccatcagaagtcaaattcagattcttaagtgtctaaggagtcttgtgactttgcagtgagccaatgattttttttaatattagttcatgttttcttttaaaaagctgatcccctgcacaatgttactgctaacagaatttttactttcttccggaacagaggttggcaaactgacctgtgggctgaatgcctgtttatataaataaaactttattggaaacacagctataccgatttgttgacatattatctatggctgctttcttcttacagcagcaggcagagttgagtagttgtaagaaagaccacattgcctgcaaatcctaaaacatttactgtatggccatttacggaaacgtctgtagacctttgctactactaaaccattaccactaaaatgcacagtatcaaaattactactctaaggtttgaggaaaacatgctggctatcttaaaacctaaagccaatttttattgtatgattaattcaacagtggtcattctggagaccttcaaagaacgataatcaccttttatgatctaatttgccatcaccatctacaaaccctgttttgctatctcatttgacacaccctaccaaaaaattaggaatgtgccaatactgtctgtaaaaagcactaaccagcagcaccatatgatgataacaggtcaggcaccgtggctcacacctgtaatcccagcgctttgggaggccaaggcaggcagatcatgaggtcaggagactgagacttcctggccaacatggtaaaactctgtctctactaaaagtgcaaaaattaactgggtgtggtggtgcacgcctgtaatcccatctacttgggaggctgaggcacgagaatagcttgaacccaggaggcagaggttgcagtgagcctagatcgcgccactacactccagcctggtgacagagcaagacttcctctcaaaaaaataaataatattaaccagtaccataagcactgtgctaagcatgttacgtgtattgtcatgtgagcaagatgtaagatacacaagggtagggttttgtctgtttggtttactattgagtccttggaacttagaacagtggctagcacattgtagccactcaacaaaaatttgataaatgaatgaaagttctcccataaaggccacgggatttatcctggtactggcaaagtgacacgcagagatttgaaaccaggtggtttcagtcaacacctcactgcctctgttatcacatggttcagccagcacaccctcatccagcccatcttgttttcaattaaataaacaccctttggcaatggaataactaaatctaacctgattaaatagtaagcatttattgggagttgatttacttagcactgtattagaaactacaaacctaaaaagaaatctaagatgcttttgcctgtggcacatgcagaatagtacgcttgttaaaagcatgcgctctgaaacactgcctaatgttcacatcctaactccattatttccttgctatgttaccttggcaagttatttaccttcccagtgcctcagtttccccatctgtaaatgggtgtgattatagtatctgagagcttgatccacaataacagtgcctatggcattctaagtactaatatgtacctgtgagtgatttgttattacagtcatgtgtcccataaagacattttggtcaataagggaccaaatatgacagcggtcccacaggattataatgaaactaacaaattcctattgcctagtgatgtagccatcaaaatgtcttatggcaatgagttaatcacacatttgtggtgatgctggtgtaaacaaacctactgcactgccagttgtataagagtacacacagactggccaggcatggtggctcacgcctgtaatcccaccactttgggaggccaaggtgggcggatcacgaggtcaagagatcatgaccatcctggccaacatggtgaaacccacctctactaaaaatacaaaaattagcggggcatggtggtgcacacctgtagtcccagatactagggaggctgaggtggagaatcacttgaacccaggagacagaggttgcagtgagctgagatcacacctctatactccagcctggcaacagagcgagactcagtctcaaaaaaaaaaaaaagtacacacagaattatgtacagcatataatacatggtaatgataataaatgaccatgttactggtttgtgtatttattataatatgcttcatattgtcattttagagtgtactcttattttttttaaatgataactataaaacagcctcaggcaggtccttccagagatattccagaaggaggcattgctgttataggcgaggacagctcaatgcctgttattgcccttgaagacctgccagggggacaagatgtgggtgtggaagagagtgatactgatgatcctgatggtcatagagtcatccataagccctagaactctcttccactacttcctctggtaaatttctactcatccttcttgttggaccttaaatgtcacttccctgcactaaccttccctgagctccttgtcgtccaactggatcagtattcacaacgcaatcctcatacaccgcacgccctgcacttctctccccatggatatggcgctcctggacttgtgcaataactgtcagctacatgtgtggagttgtttgtttccttgtgtcttgtttccttctgtattcctgctccacacataggagacttccacaaatgttcctggcctgaatgactgtgcagtgtagacctcccccaaaaaaggagagattgttgtgagtttgaaagtctgcagaaaagtgagaccagagatagtgagacaataaaatgaaggaggctgaatggtttgcaggtctcgatttgattttattttctctttttaaggtgaaggaacaatagcagtatgtgatttccagagaagaatgtgtatagcttaccctcaaatctcaaaacctccgttaagtagttctagaggaggtagggctgggttttgtcttctgttgagacagatgcagtgattattggaaggcatgcttactggtgcactggttcctttaccacaagtctgggaattaccactgtattccccaaggaggaagaaaacctgggtagggagattttcttttcaaataacattgatttggtgactgatggcaacactacaaaataaacttttacttttgttaattcaatacggctcttgagtggtaactgttcaagtttatatacatataagtatataatatctttcttctgctctctaatttgcaattattcaattcagaaatcctgattcttactaaagcataaggtatgggttctcttaagattctcacctatcttatttctgaagatattaccaagtatgcccttatttttgtgaaagtataaaccttatctccatttagctatcacagacggaaaataaaaatgttttaaaaactaaggaaaaagaattggtcttaatatgcaatgcaaatgagtgaattttataaaaggcaaagataaaaaaattataatccctttggcatgctattcattaagaaaattcttcctaaggactatgagttttaaatatgctcagcaagtcaatcatctattcattcattcaatatttattgtgctttcatttattcactcattcattcaattcaactaatttatcgagcaaccctgtgtataagcctcctgccaggtgtgggaggttgggttcactgaattagacagtacctgagtaactgtgccagtgcagatgggaataacgtaaactccacactattcaaagtgtgctccacgaactgctgccggtcctcaaattggtcattgttggtctggggcaagagaagtacagaaactgagagtaagccttttaaaccttgcccatatatgtgattgtgtaattttgtgtctgttaactctaataataaaaaatggagcttgcatttttaactgcctttttcttttacattgtactttatacaagtattgatccgtcatggactggggggcatggggccagttcttgaccacagaaagtctgagaagccttgctccaggaaaggaaagtagcacagtgccaggaaagagggagagtaggagagtgtgcgcgtttccagcctgggaaagggaagcggaaagcaatctgaaaagcctcccccagggggagtggcatttgagcaaagcctaacaggatggggacggtttggaggcaaagacaggagaaaggacgttttgaggcaaagagaaaggttgaggccaggaagtaaagggtttatgcagggtgccacgcgtatttaacgctctgtgaagcacagagcaggtgagtaataacgataataatagcagctaacatttattgaacacttaccgcaagccaggctctgtgctaagaacatggtgggaattatctcatttgttccttccaactacctgcagggacactgatttgtgaaaatcgttcccagacagacgaaggatattaaataggaggtgagagtgcccctcggggcaatgggcttcaagagcacaggcagacgggagtcagatgccgttcagggacagctgggcaccaactctattgtctgtctcctcctagacgaggatgttgccttactgggcctgagtcaggcttgtcaatgtcctctttaagtggtgggcataatattgtcctgcaagttcttttggaatggtgatgtgagcccaaggacgagaatgaatgggcaggtaaacagaaagcattggcttgccaggtctagcacagcccagccttgctgcagaccttcttcacaaccctggggacagctctgctgggctgtgctgcatctggctcctgctatgggttgccccctggaataggtaagattttgtgcctctggctcattaaatgcagaccttaatctaaccttacaaggtaagtgttctgctctttctagttagtacagaaatgctgcatttgcttttaagtaagtgagaagtgatttgtaaagatgtttcgaactcaggactaactgcctccagagatgcaggaagtaagaccagaacagtaggtgggggccaagacatagatggaggccctgattcccaggcttaggacctgaactttgattctgaggacagcagggaacataaaaatcatatgggagcttctttacctccacaaagaacattctttggctcagcaggacaatatggtgggaaatgacaaagtaactcctgtggccctaggtcaggttctcttgaggaaaacaaaaaggctggaatgatacagctcttcgtaaaccaggtgcctccagtgcctgcggttattcccaagtccacattttgcagacagggccctaaaatgtctagctaggaagttcctgagcctgtttttttaaaattctacacacacacatgcacacacacacgcacgtgtgcacacatgcggatatatacatcctcaccttttcttgagattactgctcagaagaaggcacatttggtttggtctgcttaccagtttgtgaagcacttcagcaccttttaagatgtcaagtgccataaaatcaacgtccttgttatcgtggtaaattgaccttcgttgccaaggcaaagtcagagacagagttaaccatgacagccacgaatagctgttctttgagggccaaaatcatgattttcaatgtttttccatctgaaataggggaacattactcactacagcctataactgtttcctgtcccatgaagctaaattcctacgccagcaatatggtctcaacagaagccctgaaaacagaaatgtcactccgcaaagttcttatttcagccaacaaagctttaagtttagacttaactgtgaaactgaaaatttggctcaccacagagggaactggagagactttttttttaaacaccaggagactgatgtcactgctttgcctatccaatgtcatctcatccctctcccccaaacccaagcaaactctgcagtgagtgacaaacggctgaaatttcagctttacccctcagctagcaggcacttccaaactcatttaatgctcaggtaagttttagctttaaaaaacttggtggggaaaaagaccaggtaatttatcccctattccatgaaaaacaggggagtggggacctatgttaatatgatctttagcagaaaaatgcagtgttgttaggcctggtttctcatacagatttgtttactgtatccatatttactaaaatgtttgttgctgtgactgcaagaaatcagggattaatatttacctctgttacatgaaagaacttactgtcccttttctgcaagtatttggagtcagagattccttaagtaaaaatgctataggccaatgctaaacctgaaaaatggcttagcaagatgctgagttctaacccactctgatgaaattggttatataattggccttgcatcacggatggttatccctatactttgttcttgtcatttcaatcagcccaagcaagtgcactccttctgatttagagacccaaccgatatttgcccacacagacatggtcaggacaacccccagggccttcgtatgttggctcttggcccagacggtataagagtccatttacgacatcaaaatattatgtaaactccctcatcattagagttatgcttttaacctattcatttaaaacgctgactagttatttagcagtgctttaaaaaatatttctaaatcccagaagcaactacatttatgtgaaagatagagcagaacatgttgcgtgtacagtaggcactatttggtggcaggagtctgtggcttcctctacccccagtgaagcctagaggactgcagggatccagcacccacgggtttagagtcttgggtctggtccagtgaagacactgctctctttcatatctccagagtccaccagggagctggctttcgcatcctttaatttggctgcctttactgggaggtgcttcaccatgaaggcttggtaatggatattccaaaaaaaaaaaaatgtaaataggagccacattcaagagcaccatttaaaatgaaaacccacatgaggtctcccagcaaaccactaactttaaagggagcctggctgactaagaagacaggacactggatcctggacatgctgcaccacacagcctgccggccacagccctgcttcttctgaccatggaatttccaaaacagactccctcaaggaaagccaagagcacatttttgtggcattagagtgaagtgaggtttctctttattagagagagatggcattggaaataggctcattttccctcataaggtaccagtctccaaaagactgccttcccggagaagtaccctgggaaggaaaatgcctcagttacggtaccacatggtttgggggactcaagctgtctccaaaaagccctgagaaggaaggatccatttcagcatcacaatttttctgaaccaagcggggatcaacaatgtgggcaccagaactaaatgatccagtaattattctacaaggaggtcccaaagggcccaaaagccatgatgtaatgaacaagaggaggctcagctccagagggcttcctttaggaggtgagtcatgagctgtgtttcgcactggcagagaggaaagctacgtgggtagggcagaaaaaagtgagctgtgtctaggggacaagatgaattggataggtgactcagtgtcaaagatccaccattagtgaaacactgtagaccaggcaatgtaaaggtgtcccataggaacccactgttgatccttcagcacttaaaaaaacaaacaaacaaacaaaaaacaccactgttcttgacgcaggatgaaccattttagcagtgaggggcaagatgaattgggacagcagggagactagctatgaaaatggagtaatcattcaggtgtggtacagatggcattggaatgaagacggtgaatataggaatgcaaattagtaaattaggctcaaccaagagatgactcctgagcaaattatcagacctactgcccaaccgtcagcccagttttaggattttagggttttagacaaaacagtatagggcttggctatgtataccactggcctacagtacaacctattgctaccctacaaataagagaacagcagttaaagacccccacatttcctcttcccctaagcacctcacaacatattcacctatcaccggataccccattcctggaccaagcggccattcctttgaggtgactgattcaacaaggtagtgaaataaagaacttacccagatgattacaaatgccattgaaatgtgacactttcaaattggagagggcatgaagctcaaatgatatgctcattttacggaggaagaagcaaagactgaaaacattgacgagctttcctcaggctctgagagaggtgaactgggtgctgggtgagttctgttcctggctctacccctgaaatactggaagaagctgagagaatttttttttcttttttctgagcctcagattccacatttgtaaatagaaaaaatataactaaatggctcctaggtccctgctagcgctaacttctcgtgtgatcagtgcttctaaaattgcaatgtgtccaggtggggaagttcatttaccccctatctggtttacgctcacttaagggagtgatttctttcctctgaggctctcatcttgcccattattcagagtgagctgcctcctggtgtgctgtcaaaatacatcagcttcaaagacaaacacacacctttcaatcccagtccaagagagtttactgtataatttatgataatgttaagtctgtttctcataaatgttaatggtgctacattttttttcatagatgggtaattctcagaaaagcagctggatgttaaaagttacttttttttttttttttaacataaactgcctcagccaacaaatctgattaaaacaaaactctccaggattgcaaggcacaaagattctgctaatgttagtaagtaaatccaaaaaaaaatcattcaaagattctgttcttataattgtttatctaccatgatttgattaagttcacattcacagacttttctccattttaatgtgtagatattaagaactttttactttaatccaattctttccactcctacaaattgctgaacttgtacattagtattaatataacatgcctaagtacctcccaaagtaaattctttcctgctaaaaatattttgctagcaaatattcggccttttctcatttatagaaactgtaacctttacttcgaagtgccatgcttcatcttttatactctatagaattgttttgactgctaaatgtgtttgaggaattctctcccagacgttagaaagttggattttgaaatcatttgaatctttcaaagttattccctgacgaaagaaaatgcatcaataatttcagattagttactgtactggagcttctgaaattccaaattttctattttgaagcatcaatttgtagaagaatgtaagtattcttaatttttgatgctgtaaaatgcaataacgatagacatattttaacacagaaagataaagacttcaaaagtacataaacagccagaaaaacatacaaaagaattagcttaaacaccttcaaattgcttgggctcaagatacctgggttctaatccctcctccacttgataactctgcaacctcattcattgactcatacatttattcaacaaaggcgtattcggtttgacaccaaggtactgtgctgggcattagttacagagaaatgctagatatggtctctatcctcaaagagcccatagtgtaggggaagaaacagccatgcaaacagatattcctacagtgtggtgggaacattaatacagatatacagagagtattggaaaggaaagagggtaggggtgggggaatgtcagggtttcaagttttcttaaggaaggtgattcctcaactgagccttcaggcctgccctgtctctcggcttgacagggcgcttgtgaggctctcgtaagataaagcccggtaaaggccctgtgaactaaagcacaaaagagctgtactgggattattttccatggtgagaaatagaaaagctacagcataatgagtgagttcttttgcatctctggttattaaggaaaacaaccaaacatgatttggaagagggttttaaaaaattcagtttcagcagattttctcactcttatttgtatgtatagaggacttaaaatgaaaggactatatatctccatttcacagatcaggtcatttaggcacggggccccgagagttaagaaagatggctaggggaaagagaaaaaaaagtctcagccagaggtgagagagagcagctcaggaacctggagccggacggcaatggtgggggatcgcgttttccttctgtgacactctcctcaagggtgacgctacccctgccaaatagggaggaggaatgattttttttttccttcataaaaacaagtcagaaaggaaataaaatccacatttaaaactcccaactgttttttgaaacgagtattttcttcatttcttttccaaggcagacagagcaggtgttaaggctgagttcctcttgtcatgtgaaacaaagatggccctgactaccatgtactgggcgacctataatactgacatcaagcgcaaaaaggaaacaaaaagaaaataaaaaaggaatgcgtgagggtcggagtttttggaagatgaacatgagatgacagcatgagctgggtgttgaagtcgggaagatgcagttaacagaaggggggggggggcgccatggagcagtcgtgtgagccaaggtgcaggaacaagcactcagcttatccagagggaggaccgcttcccagagatattttcaggggcaactttcgcttttttggtttgtttcgtttcttgaggcagggtctcgctttgtcacccaggctggagtacagtggtgcaatcttggctcactgcaacctccacttctgggctcaagcaattctcccacatcagcctcctgagtagctgggatcacaggcatgtaccaccgtgcctgcctaaggttttaaatttttttttgtatatgtatatatatatatatatacacacactatatatatatatatacacacacacaaatatatatatacacacaaatatatatatatacattttattttttccccccagagacagggttttgtcatgttgcctaggctggtctggaacacctgtactcaagccacctgcctgtcatggccccccaaaatgctgggattgcaggccaccataaccggtcatcggggcaactatccttcagggcttcctccagtagggctccccaggttggccttgagggccacaataaaaaatctgacttagctatactccttccctgtccccaaccacagttattcttgtggatgaggcaaatggcagcaggacagctggagtataccagagttgactcatttattttatgcatgcttagtgtggcatccctggggacatgaaattccagtgaaatccagtctttgtgctggagaagctcatagatctgtggaggaggcagatgcccacccactcactgtacagtacaaggggttgagggcaacaaaagagaagtgtgcaaatgctagtggcaacaggtgaggcggggaggagttttgtgaaacagagatgatggtaaaggagaacatgagtgcacagggataaaaacacacagtacgttttgaagacaaaagaaaagccagtgtcagatctaatgtggatgaccgtctgcttgggctgtggttctcagccctggctgcccattagaatcatctggagagtaaatacagatgccacatgtcctatattttgatatgggtggtggctagacagatgtatttctatgtaaaaatttattaggccatatacttaagatttgcatcctttactggcttaaatcacacctcaatgaaattaaaatactaatccttatgcttcaacccagaccaatcaaatcagaatctgatatgcaagcagagctgaagaccattgttccaaaggtctgatatgcaagcagagctgaagaccattgttccaaaggaggaattttaaaaaaacatacctggctgggcacggtggctcacgcctgtaatcccagcactttgggaggccgaggcgggcggatcacaacttcaggagatcgagaccaccctggctaacacgatgaaaccccgtctctactaaaaatgcaaaaaaaattagccaggtgtggtggcaggtacctgtagtcccagctactcgggaggctgaggcaggagaacggcgttaacccgggaggcggagcttgcagtgagcccagattgcaccactgcactccaacctgagtgatagagcaagactctgtctcaaaaaaaaaaaaaaaaaaacataccctacttcaaaggacacatatttttaaacatgaatcaaagccttagattccactatatactacggagaaattaacaaaaacaactaaaatttattgaggttaaaaatcaagccttatttctttttttattattttttttttgagatcgagtctcgctttgtctcccaggatggagtgcagtggtgtgatctcggctcactgcaacctccgcctcccaggttcaagcgattctcctgtctcagcttccccagtagctgggattacaggcgcctgccaccacacccggctaatttttttgtatttttggtagagacggggtttcaccatgttggccaggctggtctcaaactcctgacctcaggtgaaccacccgcctcagcctcccaaagtgctggggttacagacgtgggccaccatgcccagccaattaagccttacttctgatccttaccaccactccataacgcagactaagttatagcaatactattttacagatgaggacattaaggctcagagaggtcactgtcttgctcaacggcacagagctagcaggaagtggaactgggtggctgtctgcagtggagggatgcatatgtctccgaagagatccaagtatctttccttaagggaattactaaatatcatcaaatgacttttgtagcccaccaccatatctaactcaagctctaacaacttctttaaaaagaagcttttgctgctacagaaagaatttctgcaaagcaggaagcctgaagtcagcaatgattaaactgccccttgaaacccttagctacttgcacgtctctttgtctttggggtctcatctcagcaattcgtttcagcttcagtctgcaccaggatctcaaatctgtcatggcgagggcaagaagaaatgccctcctaacaagactctgggcatcgctggagctgcctgcaatccagacttccaaagactcatattcttcatgagcaggtaacgaagctcataggaacaggagaaactgcacaaaagcagaaaatgacaattcagaacacacacccatccagtgatggcattaaggaaatcctcaaagcccttagcaatgtaactgccaaaagaaaaaaaaaaaatgacttcctataaaaaaaaaaaagggcccaagtagaagttataataaggatccatatacatactgcaggttatgaaaattactgcagcattaaaagtgatagtagaataatgtcatctagtgtatatgaaatcctggacaatataagatgggttgcttaaggataaaggctaatactgcttagaaacaccagggaaataagaactgtatgtaagaggaaaaatattcacttggtatttctggatcacctctctgctctttgcaggagagtaaacagcatttccggatggcatctcagcagttctttacattgagagaacttctttctttcttaagccaggctctgctgtttgagctgaaaagttcgggaagacattattccacattatttcttcactccccgttctatttctaaaatctcacaatggataacagagagggctctcttctattgtggagaagactgagaactaagggaagcatttgaaaaggggcagttttggaaaactgcacaccaacggtcttttctaagaatccagacacaagacctatgcagctggaatatattttaaagtgtctcctccaaattctcaattttaaaaatgaggaaaagaagactcagggcagtgaagtgacttgcctgaggttacactgacttcatggcagaactgggtctagtaaagccgtaatttacattttatatatggctgtataacgtttaaagccctttctcagatatgatctcataaataccctacggaggatatcactttttttcagatgaaaaaattgaggctaagagaatcagtaatttttttttccctaagcttacacagctagtaaggggtggatctttttaagacaggtgtctggaatccctctctggtatccagaaattgcctgtgccaagtgtgtggctagcatgctaacgtccacatctgtaccaggctccatttgtcctgatttgctctaaatgtaagctacgccatcctctctgcccacaccccagataaggcttcttgcctgtgcattactgagtaaaatatattcgggcagcttcaggcacatgctgtactgagaaaattgagacaaaaggctaaggatgtttgggcacaggcaagaagctagattacaaaggtacatcactttcatattcatttgtacatttttcctcataagaaaattaggctttaatgtaacctcaatttcaaccttgttgctttatcgcccagagcccattagagagctatttcccagggccaggaacttatgattggaggtcaggaggctggggttttaatcgactcatgatgaagctgctttcctggggtgtcactcactcttctgtctcagctctgccctgttctcagggcggtgggtagggggtgcaccctacataagcagtgaggatttttcttaatacaccagaggctgagttaactgccaatgaggcgaggggggagcagggaaggggatgggaaacggcttcgttcattcactcacagaccaacatatatcaaaactgagcagctaaagcttgcaaatacactgcccaagataatgtaagggcaggatgtgttccctgccctgggctaaaccaggtgtctaatccatattagggggcacatgaagagcccctgaggagtttcacgtgtcccaaaacaaacaatcctcaaaaaattcttcatataaaactatctgcaaattgggaatgttctcacccactggttctagatgcacactggaaacaccgaggtaggcttaaaaaatgttgatgcttgggctccacagccctttggagattctaatataattggtctggggtgtggcatgggcactgggattttttaactgtcccttccccgtcttccaggagattctaacatgcaggcaagtttgagaagcacagctccagcagaggcctaagccagatttcccagccggcctctgacctgaaatgtctccctaacctccatgtccatacctgggaaataagagggaagggcatgacccttctgtctacttcctacatgctggggccaaccattccaggtacttgacacctctgggtaggatgctggtgagaacaccggagcaattcacttcagcctgctgcaaaatcctcgaagtctcgcttatcctactaaataaaatgtttatcaggcctcagacttcaaaacatacatgcgaacagccactggaggcctgtgagaaggttccttacccgccagcacctagcacaatgccagctctgctgattcccttcaaagcagatttcccttgctgcttcctgaggtcagcctcctacctcttagcccattatgcagcctggcacccctgccatttaggtgttggctgcttttcctttaagcaattcccttatcggggctcagggataatgcaaacatcaggaaaatactatttttatattctagtgggtacagcttataataattcatgctggtaggttttgtttcctatatatttggatcccgactgcggtctacctccaggcaggaacaaaatggatgcagttggaggcagcgggggaggctcctgaagcgtttgatgccgattcagcaccctctctgcccctctgagagcagagtgtggagtctcacaagtgttgcttctcatcaggaagctcaggagaccaacagcaagagggacgcactggaacatggctttctagccagagaatcccaagagaagaataaccctttagtttccgatgtaggtcattctttaaaagcaatgccttgtctatatttatttaactattttttaatcttgttttatttttttcccagcataacttttcctcaattcctttgcttttcaaatcctgcctgggagcaataaaacctctatcaataagactttaaaacccaggctctgttactaaggagccttgtaactctgagtactcaaagactgaacccctctctgagcctcagtttctccatctgataagaagatcacacttcactagctgattgctaaccttccactctgacctcacatgactctatcactgtaatcccctttttattccattataatctttgggtcttatttccagcatctaatccatggcaggcattaacatgatctttccttatacaacccattcttattccacccctgcaaaaacgcaaaagaaaaagtgtgtgtttggaaagggaggggatcaattggattttttcaaatttaaaaatgttcatcatcaaccttttctgtgattgcaatgttggtggtgatgaaaataaattgcctataaaatataaaactgtacctttttggtccactaaatgtcatattttacatctattaacactagtattcataccaaaagccaactatcgtattattgtaaaaagtgcatcttgtgagggcaaaagggataaggatactaaaaaacgtgacactgaatgccctacacatgtttatggaatcttatggtgtttgggtattatccttgttatctcaggtagaaaggtgttatcaaattataaacttgggggctgttgctatcaagagcagttaatttctttattgatactattagattacaaaatatgtctattccactaacccgacaaaaagagcacagtggtgtgaaacaagtgggcacaaagagccaacaaatttcgtggaattcatgcttatttcagttatacagtatatcagattgttcgttagatcacaatgaatatgttattatttgatcccaaatattcctttttgcaaaaattggattacaaaagtaactttattataccatttcaattatttccctatgaactaattctttttaaaaattgacaatgcttctgattcctctgtttagcaagaattttcttgttctgtccttcctcttttctcctcccagttccaaatcagaagggtcaacaggaatacacttaaaagtcctattttccaccaaagccctaatatcaaatgcttttgatttgaataaaatcggttccattagcacattcttaaaaaatcaattggctaaaaggtagtgaaaaaccatcacatttcctgtgagcaggattgtattgccacaggaatggtggcataggatccagaaaagcaaaatttcatgttgggaagctgtgctatgataccaattgacataagtattaatgttgtgatctttttgaaatcttgtattacattaaattatagtttcgcagctgtgtaaggagcaatgggaagaattctggtcacttttctttaaaaagctcctcctctggggctacaaggaaccaggcttggctaacataagcagccctccagttgacagccagacatagagtctccacaccctaaaatcatcaaaggctctcagatgtcttttcccctccagctttattacagcctaactgacacacaaaaattgtatgtgtttataatatatgcacaatgtgtatacaacctgatattttgatatatgtacacatggtgaaatgattaaatccagctaatcaacatatccatcaacttacacacctttttttgtactgagaacatttaaaatctactgtcttagcaattttcaagtttataataaattatttactatagtcacttcattgtatgacatccagaacttattcatcctaactaaaattctataccctttgaccaacatcacttcattccccctccttgctttttaaaaaatgactactgtatagggacagtgaagagtatgaaataaggaaactatctattttcaaagagttgtaattaacaagctactggttttttcacctcctattgtagatgccagatagaatattcacgtcttatcttgtttgaacatcaaaacactctcccacatacacctgataaatatcactatctccattttacagaagagaaaatggaaatttaaagtgtttaagtaacttacacaggacctccctattggaactccatgagcctgcgatcagcccacgctctctccaccattccatgccgctggagtgcaccacaaagcaagataaaacaccaaagaggaaagcaacttaggttgttaagtcaataaactaaggcaaacaacactgcatgcattttattcttccaatatatttttggcggagaacaaattgccctgggagaggtattgtataatttcatttggagcctcatccttctggtagcagcaaactgaaacacacacacactaaaatcagattgcaattaaaatccaattataaatatattactatattagacacctacccaggaaagatccagcaggggaccttctctgaaaggcagtgtgtcacagtcttcaaactgcttccacgtgtacttctgactgtgccccctgaccttgagtgtgtgttaaacaatgcttggcagtttttctctgagtggaaaggactcaatttatgtctcatcatggagtaagtttaataatactattaccaatttgctttggagaatgacatgcaaggaatattaaatcttcctcatgcagactattaaacaaattaaacacagcatttaaactggtgggattcaagagatggaatctgtgtgaggttaggaaacggagccacaaaaaaaggtccacatgtgatgttcacaccttttcggctctttgttcaaactgtacgttatatctctgacttgaaatgtctggcaaacagatctccaaagcaatgggcagtcacatcccctctacccaaagctttgttttcttacaacatgatgcacaaacgaaatgaatggcaatcaacaccaagtatgcatcatgtctgacgattctggagtttcctttcagttgccttctagaagatttgtgctgctggcatttaagttgattttctttaatttgacagaacatttcaacagcagaactcaggcttccaatatttttcaatagttgtccttgagctcatttgtcatcattaacacgggccatccagacagatcacccagcacaactccattcacccgtccagttctccggtgagggtgcagtacctgggctggctctcaatatttttaatttatgaaaatgtctaaaggccagccaccggacccccacagtttctttttaagtggtctggcatagactatgaggccacactgtatgcatcagcttcttacagctataggacaggtgctaattaatctacctaattatgcagtccagtagaagaggcttacccataggattttaaatctggaggaaaaaaacaagggaaggagaaagggagggaaaatgcttttggtttcacactgaaacataatttcaagagtcagcttatttatcatttctacttaagttggaatgatttgtatattttccctatatcataattgctgtgtgtgtgtatgcacacgtgtgtgtgtgtgtgtgtgtctgtgtgtgagtgtgtttctgcaagggtatacttttaaagcactagaaaaaaacagcaaattgaccggagaattattagcttacctttattttttaaactgcaaatacagaaagaaaaaaaaaatctaaacagtatataaacttaaaatcagtcacatgaaatgtgcaggatctcaaatgatgctgtaattccagcaggctcctgtttgcagttaaccacttacagggccagtcactggaattccctgggcatccacacaaatgaatataattacagataccatgagcacagacctatgacgctgttgattacgttagataactcagggatacggggagagagaaatcctggggtgtgcaatcgatgttgtcacatatattcccatggtttttccagctttacggaagggttgaaatgttctttctctggttccaactgccagggacacatatgaatgctgtgatatctgtcagggaaggggaaataactcctgaatttcctccaggggagtaaaagcagatcacaaaggatctagtgtctcagaacacaaccaaatattggcaatgcatcctgagacaagagtcaagtgctaagcaaagtcaatcagcacacgatggccccaggaatgagagcaaccaacctggtcctgcacgctcatttacatgggacccaagaagagacactggccgtggcaccacgtgcctgccttgggcccactcccttctacgagtgcccttaaccctttacaaaataataactagtgtcatgaattaaaatagctgaaaataatttttaaaaatgaataatttaagaattcacatgtctcgttaacactaaatgactttccagctgggcagaaaatcaaactctgcatttggcagttttacaagtcattatggaaatatgtctactcttcatttgatctcctatttctagatatcttccccaattctagatattttccttctctatatgttacagaaggtatttcaaaaggctaaaaaattgggtgccatttgtgattcgagagggataaaaaaaagaaatagtaaaatacctggcgatttaaaatggcaatgttttcttgaaaacattgtgttaagtgaaagaagccagacataacaggccacatattgtaatgattccatttatacggaatatctagaaaaggcaaatatacagagacagaaggtagattagtggtttccagggactaaggagaggaggttatgggggatgatcgcttaatgggtacagggtttctgctcggggggatgaaaaggttctggaactagatagtggtgatggttgcacactgtgaatgtacttaaagccaatgcctggtacctttttaaatggtaaattttatgttatgtataatttgcaataaaaaatgtgatactgttttaaatggtagagtttaaagcttgggttctaatgaatgacagttcagtcaaaggatcagaaattccgggcactctgctaaccctaccagggcttcacaaggaatttaaaaagagaaggacaatgcttccatctccctggtttcctgtcttaatcttctgatcttgagatctgcctgcaactgaaagagatgcagaactgggaaaagaggaacaaggaggcagatccccactttcccccacctttcttaatcaaaaagaccaacacacattcagtaaacagggtttccaatgtattccatttcctcagagtgtttacaaacaacaagaaatgaaaggtgtataagattactgcttataaactccaaactgctctgcatggctgcaccctgatagtgtctcctttccttatcaaaaaggaagaagaaaaacaggaagaaagcagaaagggaatggagagaaggagagatgacagtatcattagacacctcttgggtcatgagtgcctaatgaatatctttccattgctctgaaaagaaataatatattagttataatattagcataataatttactggttatttcatctataaaatggacacaactcatatttgttttggaagggatgagataaatgtacacatctgatttctgatgctgggagttggctctacatgatctcagagccaaagacttcaaaatcttccacaaccctctcatttcacatgtggaaaaaaacaaaggctcaggaaagaaaatatctgaaaagatgatattttatggtgggctttataggttttgattctatgaaaatggaagaaccaagtgaatgctttgtggacgcactgcctttcgcagtgtgagatgttttggcaggaaggtctgcttagaattcagaatttatagatatgagttcaaactgtgtttcgccatttgatagctaaagtattgagtaagtaattaatatatttggggcttaatttcctcctccataaaatggagataagtatatctagatataaggtcacttaaaggattaaatgagaaaaacacaggtaaatgatttagcacagtacttggagcagaagtacttggtacatggtagttgttggtagcattactactattaaaatccactctagaatgggtgttccctaaacagttctttcaacttttctgcacatttcaaaatgttcataataaaatgggaatcacatttaaaaaacatagggcttcaagaagaaataaagaagagaaggtgagcatctatcttcacaattactcctggtatcactgagacccagccaagttttaaaaacaattcatcaatagtggtgaagcccaggtctcctgactccaaatataagtctaaccaatattatatgcatataaataacttcagtacacgtgtacagttcagacgatgcacctactactcagccctctgtaatatccagtgaggcaaaacccaagtcactcaagagtgggaaggattagcgtgctatggttggccaaccaggtcacaccacttttgaacactgggtgtaaacttgatggtcactaacattcctgaccatgtgcttttaccaggatctatgtcactaactctctaggtggcctcatcccacttgtgattcagcaaaatgctttcactctttgtgtatttatctgttaataaataaatccatgttttaaaagttttgaattgtctgtagaaaataaatctagactctttcatcagagacttctagcagatttcagcagcatttgctggagcaaggtgactccagcatttctctagaggacacagctgcaggctctttggagctactcctgggttggggtgagtggggactgaggacttcctggggaaagactgagggaaattataggggactttggccatccactggaaaactggaggaactgggatctagttactcatgctatagaagtaataatgttattaatagaacatgtgctacactactgactatccgttagacagtgctttaagcacttttaatgtattcactcatttaatatgaaatgaaaggcaatgtgccaacatcggagctcaatttggtacagtggaaaaacatactgagcagaaattccaacgtgggcagggctggggaaggagtagggcaggagtgagaaaaatgaaactggactccagttctgccaccaaacggatgtgtaactctaagcaagtcatttctcctttttttggtaaaatttcatacttggcaaataggaaaaacttcacttggaaaaaacagcactgaattggaactgggggtagatgctgtaaccctgattactagtggagatggaacttatgggtagaattcatgccccttggggcattctccattgcctccctcactttctccttccctccctccctctctctttttaaaatagaaatcagatttgcattcaagtcttttaaaaaaggaggaatttgctcactaatctatctattcctggtataaaatggaagtagaaattcattgaaatgcatgtaatctaggggtttacagaaacagtatcattccagaaaaatgaattcaatttgttttaatttcctcaaagtttaaccacattaaatgctagcatatatacatgtcaacaggaaaattattaggttttttttttatcttaacggatgtttgaatgattgataaaccatgacctccatcaagacaaaacaaagacaattcaacaaagtgtcttacagctcgattgttcttgctgtttacaaagttttttcacggtaaagtataattacccttgacccgattttataggcattacatatcccagttccggataaaaggataaaagacttttatccttcttttcaatattatttttatagtaatcacaagatactttaataagtaaggtcaaaagataaataatgaaaatgtagatttcaatatgctataattccagttgtaaaaaaatgaagtgcaataacttagggtttgttctttagcaattataaacataaatagaatttccttcagcttttacacagattctaagtctgctgtaacagtcctgctgtcagaaatgcaaacagctgaaagaacaaacaccaactttacctactattctataaataaggttaaactatactgctggcaggggaaacgcagcccataaatttggtaccaccatttgcttggtacatttatatgattgacctgtataaatgtatgctgttttcactgttgacacttttataaatataaagaactgctgaataaatccggctatatatctctttgtatcaaaatggaacactcgactgttgtgaaatctggcggttaataaaaatagcctgcttttttattagcttcatccaactacgggaacagaatagtttaacagtaactaagtatgcttcaaaaggtaactctctaaaagtaaaactgtaaatactagaaaatgtatcatactagaaaaggtataaagggaaacattttgttcattatccccccaccaaaaaaaaaaacttgccctgttttttaaggaaatacttttcaaattatgcatataaagtaatatcgatcaggtaatatatataatgttctgcatggtaactgctaatgccctgtgggggtgtaaagagaaagccattcttctttgcatcttcctgagccttgtaaccatggaatagtcacaatgtgcatggcagaactctcagaagacttaaggtaatgattggagtaacagtaaaataaattacatttaccctttccgcaaggttacataaccaccttatgaaaacaaaacaaacgaaaccaaaaatgacccaaagtaaaaagaatctggagaagcatctatgaggataaagaaacccggagagttgagggctgatggctgatcagagaatgaggtccgctgactctaatgtcaggcaagcccaggggaaagggtgagtcacaagtcgggatggccaaggagggcccagacagacaaaagttttgttggctcgaatggaggtactctggggccacgactacattcaccccatgaacttaccttctctgttctcctccaacctgagataaaccagtcctttcttgaaattgactgggtgctgtggcattatacttaaggtttctttttagttccaggaatctgggaacatttgctatgatgccacccccttaccttttctaacgcctacccttcttcctactgcatcatcaggctcaatgaaaataaatctttaactgtagcaaaatacacttaaattcttccacaggaaggcaaaggctcatgaacatcttgccaaaacacaactgaaaggagaggccaagtttgtttgttgaaatcactgtctggtttcttttactatatgtctgatttcttgcagactcaagcaggtaggtcactgatttctggaaccacaatttactatgtgaacagccctgggtttccttcctttgccctcagaactgttatttgggactcaggatgagcaccctgatttagccatttatggctcaatgaaactttatgtccctccctcagagtctaagaattggcttggccaagccagcctgaaagtgcagaatggtctgccggcttattgatgatctagagtgttcatacactaaggaaagtttcctcatcagtttgattttaaaaagattccctttcccacttaagaacatctagtccagtaacaacaaagagcatgggctctgcagactgctgctgggctgtgaataccagctccctatgtaaggttctgtgcctcggtgcctcatttacaaggccagaggttctaacagcatctcataaactctgcaaggcaggagcaaagaatccctggaaaacattgaggagggtgccaggaacagaggaggcactcaataagtattagcctttactattaacccattaaaaatgctgcaagaattcctattctcaaccccttgggtaggaataataatacaaaactatgcaatggtccaatgttgatttattcaaacacaaatgtgcttataaaatcacattctagatgatgaaatgcacaccacaatgttcaaaccttagaccttgttctggttgtccttggcgcagtatacatgacacaagcaagcatctgacaggtgtgaccacactttgagactcttcagagttctatgggcctttggaagggtgggcagtttccttcttcagtgggtcactcactcactccccaatcttttacttactaccgcctatagaatcatagaccctgtccaatataccactatcctgagagatttcaagccaaaaaatacccttccaggccacttccatgccactatcctgagagatttcaagcaaacccctgtccaacataccactgtcctgagagatttcaagcaaaaaaatagcagtggctcatgcctgtaatcccagcactctgggaggctaaggcaggcagatcgcttgaggccaggagttcaaaaccagcctagccaacatggtgaaaccccatctcttactaaaaaaaaaaaaaaaaaaaaaaaaatccataaaaattagccaagcgtggtggtacgtgcctgcagtcccaactacctgggaggctgaggcatgagaaacacttgaacacaggaggtggaggctgcagtgagccatgattatgccaccacactccagcctgcgctacagagagagactctgtctcaaaataataataataaataaatttaaaaataaatgtttgctttaacaaaacttttgtattatgtgttcctaccataactttggaaaactaatagtatctattctacttacagcaagtgcagacacaaactaccaataaagcctattttgtttcccaaagtgttagaataatatctaagtgtgatagtttttctcacactttgatgctattctcacatttgtaatgttagaaacttgtatttccacatcaaaaaaaaaaaaaaaaaaaaccacaactatcaccaaatcctaaaaccatgcggctacaagattccagtacatccttatccccctgcagagctgcttttgccgggtaccagggaagcagagagcaggactgctagaagcaggggtggtgaactaagaggtaggtagatatgataagctagcccattggaaaatctaacagacaccgagcatcactgacagccaaaccacacatggtctcacattaaacaagagagagccaaataagtgcctaacatcttgacccaactagccaacttgctgccacctttgaaacactagtaaaactaacccatagctgtatataggctaagatgaagaaaatgaaaatggaaagctgtgaggggaaataaaagcttccagctcatcaaacgttcaagataataggttaccaagatgtccaggtggtatttgtttgaacatctttgtttatcacttgtcttcctttttaggtatcgaccctggtttaaatttagtgtgccgcttccagatttattttccactcttcttgaaagggggtggaagagttcctggccatagaagcacagaagctggccttccctcccccacccaaatattaccacccaccctcccatctgaaagatttgtccacaagaccatgtgagaatttcttcttatactacctaaattatcctcctatataccatttccccccattttgtttcttaaacagttatgtgatgctgacaggcactgttatccagttgttacgtgtgatgctagagttgggtccattttagtggtgctgaagttcatagttaaacaaatttgtagccagtatcaaatgtttggagtctcatctacagttattatcaacaactcaagcaaaatcatttaagtcctttttttcttttaaagggtagttactatttttttcattaaagaaagaaatgcaatagactacaatgagacaaaacacatgagcacatgttaccacaagacagaactggggaagaaaagggattttatttctcgtaaagaaacaagaagtggagacgcagtcgaaagagctgtccttcagaacgaagggtttcaatcagtataattcagagttactgggactcatgaaccaactcaaggcttgaagtgaggatgctaatcataatgatggcaattataacacattccacggcaaagcatttgaaactttgttcacagtgccttcctctacaggacaccatctcttcctaacatttatggtcttaaaataaggctcatgaatatcacctttattttgagtccaaagtcaagatggcctcagctttacataagatatttcctggaatttgctcttttggcatccactcattccaagaagagaaggtccagcatccaatgactggagaccaaagctgataagagtcccctctaaaaaataaataaaaaagaaagaaagaaagaaagaaagaaagaaagaaagaaagaaagaaagaaagaaagaaagaaagaaagaaagaaagaaagaaaaaagcaagggtgtccagggtggcagagttctctctccagaccaaaataaacatgaccaacatgtaaatgaaaaataagatcctaaccaaatctagctctgtttattctaaagttatcctttgaagactacaaactccaacatgttttatttctctccaggctcttcatcattcactccctctgtagctcatacaatacagacaatatcagcaacagcagttatagctctaactttcattttctctctggcgcccaaagtggcccaaacctggagactgtggctcaactgccttttgtgtttttgaacattaactttcttaaaggaacagaccttaagttcttcctacaaaattagtataatgcacacacttatccccatttgtaaaatgccctctttcctggcagcacgtgcccatggcctcactgaacctgcagttaaaagtggcatcagcttgcagcagcagtcacagagctgtgccactgtgctgggccgttcctaacacagatgttctccagagccacaaacacacctcctcttgggctcagaacacagctaaagtgcatttagcattttgaaatttaaaacatgtgcttagatgagtgccactcttgctgaacaatcaatttgcattacattaaattaacagtaatggagggctataaaattacacattttatgcattaaatttaatgatgaaataataggtaataacaggttaccaattctgacataactatcacacaatcagtaaattcactcaacaataatgaataacttcaaacatcccatttcctgggtaacaatcttgaaagagaaacatataaattggaaagttattgtccaccaggaaaacatacttaccctggaaagagacatacagggggccattaacctatagcatatggttaccagagacttttccatgctttctttatattgagtcatttgggaagaataaatacaaaatcacctctattttgacatgctgtttccatatcattcatttttatggtaaaaaacactaactcacatgcttggaataggatgagaacaaaggtggtagttcttggtaatccaagaaagtgagaaacatatgtatttggttcttaagattcatttgggtttttaaattaaacaacatgatttatttttacttgtttttttctctaattatctatgagcatgagacacttttcaaaaaagaagtacttaaaaaaagtgactcacatagacgtgggatggagctagatggtttcgtgtatgctgaatgatgtatgaacaaaaatattcggagagcagacttcatacaatataaaaacctaagtgcttcatgttggccgtcattactcccccagggttacgaagaccactctgaaaatgctccagttgcaatgtttgcctgttttgagcaccgatttttggatgccctttgacaaaaatgtgtgagtctttatatggcaagaaatccaagtccctccatgcctccagatcaaactgctacccctcagcaaaaagcttgtaccccatagatagagaagctcctagagatacagggagggccttttcctgcacagtctaggctgcattctgtggaacgtctgtgcccctcgggacatcaagaggtgctctgagggggaaaaaaagccattctaagcaaaaacaaatgttctgcaaatgctggcctaaacagagataaatgccatgacagggacactgcataaaataaaataaaaaaataaattaaatttaaaaaaaacacaggccgggcgcagtggctcaagcctgtaatcccagcactttgggaggccgaggcgggtggaccacgaggtcaggagatcgagaccatcctggctaacagggtgaaaccccgtctctactagaaatacaaaaattagccaggcgtggtggcgggcgcctgtagtcccaggtactcgggaggctgaggcaggagaacggcacgaacccaggaggcggagcttgcagtgagccaagatcgcgccactgcactccagcctgggcgacagagcgagactccgtctaaaaaaaaaaaaaaagttaaaaacgtttctttttaaactgcaaaactctctatctttaatgctaatatgcactgagaagcaacaaaggggtgatagggcaggcagtgctccccaaactaaactgaccacagaaatattttccacagaacaactacagctacctcaccaatcaccatcgttccacggagcacagtctgggaaacacttgtctaaatagattagaagaatcaggacattttgccccaaaagacccaaagtcttgcttactttcttagaaaacaaaaacaaaccaacaaagtaatgaaagaataaaaagtaattcacaaaaagactgggacataaaaaaggagggcgagtcttaatacatcaacttttggatttgcaggtgagaaaatgtgaccaagttaaaccagaggccacctaaactggcagtccaacagtacttctgtggctttaagggacttcgttctcactgtggggagcagagcacttcagagaagctgatgtgctcgattccgcagggagagcttcagcggaaccccttgctcaccaacctcttaatgaaatcgagagagtcgactactcctgcctccgtggctggcaccagggcaggagagacagagtgagtttaagatctgataggagaaaagaacccaaaaataaatcacaagaaaaaataaaaagatgtccacccctaaaagcttgtagcttcattttctgaaaattctagccccttgccctgggttttctttaaaaatatagttaaatgaattggattgaaaggaattgttacctgattggaagttcctctcacaccagaaaagttctgtgagatgctggaggacaccatttggcacttcccagacttcatttgcacattctcagttgtactgctataaatgtaaccactggtgtgcatatacattcacagtacactgaatgtacaatgttgaacttatttttcgagagagaaaaatttctcttcaacatgtcaatggtctcattttaccagtgtctgctcacttccaaaaatgcaaagacagaggaagaaaagttcgttctgtcttcactcgccttatgtatacgcagaaggcccaacacggtacctaaaattttcagcaataccatgattccattaagagctctggatacaggtgcttttaaagtaggttaaggaattatgttgcctggtagggatacttaacataccagcacctgtaggtgtgcttgattaataacccccgccaaaattctactcatccttaaagactcagtttaaatgccatctccttcaacatatattctgtgatgttgccacccggatgtgacttcttcctcactttttaattgttatctgcttgaactccaaaacaatgccccgatccagagcaatggaaccagggaagatacgttccaatggcagacagaagtgacgaggaatgatctgatccctatgggagccactggtgaactagagatctacaaggggaccccaaaactttagcaaggaatagcaatgtggagatatggatgggagaaaaaaaaacctcatagcagaggcgcagagctgaccttacagcagttttatcaggggtcagccctttgcctagggtttaacgctggtactctgggcagtggcggggggtcagggggaaaagaagaaactattgtaccttcatatttggagaatatttttagtcttgtgttgacgtgtgagctgccagcacaaaatacaccaaacaccttcctaactccctcaaaccaaataaataaatgaaaagagaggctgttgaaaaccttgacaagcagcttgtcaagaaaagctgttttttcacacaagaaacctcctttcagaaccctaaatcctaccaacttccattctatttgcagtacccttatctgttagtatcacaacggaaaagtgtaaattggacccaaaaaaatcctctttatttttaaagccaaaaactgatcaaggagttctgtctacatttcaaaacactgtatgcatatttcagagatatatttatagaccatacaaagaggtgcaatattgacttctggggttaatgcaatatcccatagatttatcttatacattaggttcttcaacctatgttactgagaataaatttttcatgatcagttaagcttgtaatcgatgtagaatttggaatgaagtatttatcagaacaatttgtgactggaatgatttaaagccaatacacatgttatgtaatcttctgccctgttataaaatccaacacaattgcttaggactagcgagagacacccagagagcaaaagaaaatctagaaaagtggcaaaatgatccattttaatcccactgaccagcatgagaaaggaaaaaagaaaccagaataatgcatttttaaaaaaattttagaaatctattggagaagaaacctcagaaagactttagaaaaggcgtcaacagcttcagagatacaagactgctgaggctcaaacagtactacggcttgatttcataaggacaagattgaccctacccagaacagccagaatgagaaatggggagtgtggctttatcaggcacacagcaaggtcccgcaagcctgcctggcaggcccctacctactgctttgggtttaaatatcctcaaatcgccctgcaaaatacaaacaggtcgactgcaggaggcacagagacaaactttcacgtgagcttggattggactaacacctcattagcaaagagctgcctcactcagggtaggttcaggagggggaaagagagcctgatgcctgagcaggtgagtgcttccaggtggctcctgggctaagtggaaaaggggagggacaggagggtaaatatggggaaagcctctgaacaaagtacaaagaagggaacagaaggaactaagacagcagttaccctttcacattttgtcagaggatcactctgtgaatataacagtaacaatcttaatttcaaactacatgcaatatagaccatttataaagtttttttttttattgttgttaccctgaatatctctaggatttttctgtggattcccagagtgtttcagctgaattctctagctccccacctcctctgagcacttgctggcatatttccaagctcctctggcatctctcaattcctcaggaagatacctattagccccttcatcttccttttccattttgaataagacagtccaatcttgacaattattaactataactcatcaaatatgttcctctaaaaagacatatttagggaagcactgacaaagacactaacagacaagctgcttcatgctggttcccattaaaatatttaaatatgttttcaggaaagaaaacttttaagttatttttccaaaacagctataacactgatttcaaacctgacaaaaataaccagaaagaaaagtcagatcactctaatttataaataataatgtaaaaatatgaactcaaacatgagcagacagaatccaccagtgcaataatagaataagataccaccaccaaatagagcttattaaagggataccaggatcattcaagaacagaacttttacctctgtcattcataatatcaatacattatagcagaaagatcctataatcatcttcacgggtgctaaaaaagcattcgacaaaatcaaaatccattctgatttaataggcccttaataaaatagaaatccatgaatattttttgatatgggaaagagagatatagatacacatgcatcagctcaaaagcctaaatcatactaaatgataccctaagaggcattcctattaagacaagaatggtcattgccaataccctataattttacactttctaattagtactagtgcaatgaggagaaagtcatgaataataaaaattagaaagagacaaaattattatttttgcagattatacatatatgtacctagaacgccaaagaggatcaactgaaaatggatggatacattaggagagaaggcagatgcttataaagctagtacacataaatagcttatataaacaaaagccaattaaatatacagaagaaaggtatcatttttaagagcaaaatgggcatatatttaaaaaaataaatttagaaaagtatagaattcacaagaaaaaaattttaaatcctacagagagatgtaaaagctggcaaaataatggaaagacagactttgtacttagatggaaagactcattgtaaagatgtattctcccctaaatttaatgtgaatccaataaaaatgtcaataagagtattttgaaacttggaatgttaattctaaattgcacctgagaaattaacctgtgagcattgccagtaaaattctgaaatataaggttattaactctattggctattaagacatacagtaaagctaaggaattagaacagtttgttattagcaaaccaacaatcttctgagggaaaaaatagttcagaaataaacataatgcacatagaaacatttgttatataataaagttgacatttcagatgtgggaaaatggtggattgtctaataaatatgttggtacaactggccagttagtagggagaaaataatgctggttccactctcacttcttacataaaaataaatctcaggtggctcaaatatttaaatgtaaaaaataaagatcttagcggaaacaaaggaacattagaaaaacaataatcttagcataagggaggctctattaggcaaggaacaaaaaccaaatgctatcaatcaaaagagaaagaaaaaaatgataaatttacattgcattcgaaatttctgaaaggcaaagaaaaccacaacaaagtgaaaagcaaatgacaaagaggcaaaagtatctgcaactaatatgttagataaaaggctaatttctcctaaacagaatcccttcaagtctctaaggaaagaacaagaaccttgtgtaaaaatgggtagggttattgtcctctactgggctccctgggaagcagatttaggaggtggagagtcatgtgcaggtttattggggagtattctcaggatcaacacccacagaggaaggaaaggagccaggactgttcagagacgttaggcagtgatgaaatcacaacagagacctcagctgattccacgggcagctcgagctgcgatggccattcagagttgtcccaaactggtaaaaaaggagctgagccttttagtttttggatgtagggtattccgaggaaaggggcgtgacttggccaggggagtgtgttcagcgaaggctgagttccttctgctacccacatgcacagcaactgaggactgagaacttgggtcctacagagggatctgggaagctcagcacagctgccatgactgttagtaggaggcagtccatagaaacagaaaagcaaataatggctagtccatatacaaaaagatgctcactccattcataacaaaatgtaaatcaaaacaagtatcatctctcttatcagataagcaaagataacatggttggcaacagagttgttaatactgatattcttaatgctgttgagtggaatatgaaactctaggatctcttggaggaaaatttggcagatctttctaaatttgaaatacaccctttgacccagcaccacatttctaggaattgtttctatagacagagtcacatgtatatccaaagtatgcactaaagttattaacattggctactttgggggagtatgtctggaagtgaaagaaggataggaaactataagtttcgctgtatatccttttacagtatattgaattttttattctgtatgtgttatttttaaaaatattaatggtcaaaaaggaaatctgaacaggaatttgagatacctatctataaagatatcttgatggtatacgcctctatctaaaagaagcctttttttgtttccatactactatatctaaaatatcttctagattatcttacactcaatgtcataaacttacttctctatacaggatatctgtacaaagattttaaaaatctagatgtatttatcttatgcatagcaaactacaccaattcaactcaaatcctggcagttgttaacacttttggaaagggaactgagctactgatatactactgtgtgcctactatactaataggcactttaatacattatctaatgtaatcccaacaatcctgcaagttacgtcttatcattcccaatttacagatatggacacagaatgcacacaggttaagtatccagtgctctgtcatacaactgaatgtgggggagtccaggctacatctagatgtgtacttccttcgataacatgctcctacctcccagggtattttccttttggcttccaaaacattttgtaagcaaccactggtaacctcaaataagtggtatgatttccattataaagaagaaaagactgagaaagagtaacagagaaatgtctttctctagctcagaaagctacaatttcacatagtcctaaaatgcctgtcttcatctttctgttatctccttttgaatacacttcaatccactcataacccttttcctaaaagagaattcaaaagactgaggtggaatctctgcctcagtcttcctctttgaattgccatcagaaaaacgatcaggggaaatatgttcagccaagagaagggggcagtatcccagcaccatcattttccttttaaacactaaactccaggctatatactggaaacctatcttagggcccattatatgaatcccacagaaagagacccacaaaatttggagacaaaaaagcaatagggagacaaagtgaaggatgcttctctcaaacatcaggacaatttacttaactaatgagttatgagatagcaggtagcttgagtttcccaatatccaacggaattgtttcccaaatgaaaacaaccaatgccaccaaaaattagacttgagccaatggcagaaatcctttttacaatattttaatcgtaagtaatcagaatgcatgatgggttggtttaaaaatatgtcgaggatttttcccctagatagtgttgctgttatccaaaggaaagatgctattgcttctgctccactgacactgtttatcacttcgcccagacccttcaatagaaattgctgtttctcactgccgaccatctgttgtcatctacatgaaaaatctacataaatccctactagttgctgtatttcagaagtgccccccaccaaagaaaatcacagattaattgttgctgctttaaaactctaagaaagggaaatgaatctaaatataccttcctccccccaacacacatacacatacacacacacacacacacacacacgcacacacagcaactttcatctataatttagaaaatggatgcagttcagcaacagttaaagactaatttcttatgctttttgtgcatttacataattgattcactagataatgcactctgcttccttatttaataaacatgttaatgatttcagacaattactcaaagctgcctacaagtgtctgcctaagaaaagcaacaaaaaataattaaaatgaaaatacacaccaaaaggcacatccttcatatcacattacacaagatattaagtcaatatgtcaccctgtcaccagtcacttgctacctgctgttatacatttattcaaattctaatgtattagctgaggctgatacattggttagacacccaagcgggcagacacacagagctagaaaataaacctggtgctttgtcagggtagaggcagtaaaatagcagcagcaaaggaggggagacaataaaacacgggacagaaacagaaggttgaagcagacgctttcacaagaaaaccctcttcaggctattcatggtggggggcagtcacgggggaactaaatggattccatttcctctgccacctctgagtgcttggagagcaccaagcgggccagacatcacaataggttagattttggcagatgcctcatgcattctggccattttcgggcttattttattccccagaacctttgcatgcgtcaaccactagtcatgccttgaaccacacagcaccgtggtcgtttccaccacccaagagaaccgtaaaggtggaaaggggcattaaaggagctcagatgccagacagccacgactttggccctctgtggtgcctggccagtcccactaggcttggctcttccagttcctgctggaagccatgttgcctgggcaccgtgaggctcaccctccctccccagccctccaggaagagagaggtgggtaacccaacaggtgcaataggactctgaagaaggaatatgagagcttccagcccttgctagaagctagctgattctggctggggaagtcctggttccaaacctcatagaagataggttggaagcaggaaaaaaagatgaaattatttgaggagaaagttagctgtccatcagtaacttcttccgctagaaaaggagtgtaggaagaagagtaagtaaacaagaggcttgcttgaccaggtgacactcttcacatttctaagcccaagtgtcctagctggagttaacccatgacttcagtcctaaaagaaaggttgatggtcagtaggcacgtgcgcacacgcgtgtgtgtgtgtgtgtgtgtgtgtgtgtgaaatctttaggtttttttacctgcctccttcactgtataagcccaacctgttcactgtgtatcatgcagaggaaacaggcagaaacttggcagggcaggaacaaggatagttcatccagaattaccttaagaaataggcattttatcaggaaggttatggagagccactaggggacttgaaacaaagggtgacagaaactgttttgcttccagaaggatcattctggcagtaaggtggaaaatggcatgaagggaacaaagagaccaatgaggaggctgtcacatcaatccatcgatgccgaaggcgtgagccaagggactggcagtggaatctgagtgacatcagcggcaacatggggctaaaagaggagccactgaagttttgaggatcaggccacagcagtgatgtggaaggagatgctggtctcagagtggaagggaaacaggaagtgggcaggaggtaggtgggtatcagggtggaagaggaggtatggtccttaacacagctttgtttcagttggatgctggcattcaggtgcctaaggtacatccaaatgaagtattcagaagatggtgccggaattctgcctgtagtttcactctcccacatattaaatggtccactagactacaaaggcagcaaaagggatcttttacccgggttatggcatcaccccgctcaccatcagaaagactctctctagtctctggaaacaacaaggcatgaaacagtagatccactcctatcaagtagcaataaaatacctaatcaataaattaatttaaaccacccctcccttgaaaaataaagaacaacataaatagaatgggaaggaattgcttaatgacattaattgcactcctgcaatttcatggccaattcattcatgttagaaagtggagcagataattctctaaccaaatgtccaatattattatgaaattcttataaatctactcagcagttaatttaaaattagattagaatgggatcatgaagcctgactaggccgaggggaaaggtaacctaggtgaccttttacagaggcaaaaatctacccaggtatgaaagttgattaaccaaagggagtgcacacaccctgcctaaaaagcgtgtggactgcagaagggaggggcagctgcatctacggatagacccatgatgggggctccctctgcagctctgttggggcttcacatcagacaatgtgctcggtcttcttgatgatgccttctacaaatgaacaaaagctacattccaggattccaaatgctgaggtgtggcttacgtaatcaaatgtgagccaggtgttagagacttcatccattcagctgactctgttcctgtgctatctcctacagaaaaggcagcctcctcgccagcttccaccagaaatccaacaatcccagacctattgtgattgttcgtgttactgaaggtctgcagagccatggcgggggagttcccatcagagagtctctttccatgtctctgtgcctagcagctccatctctggtctttcttgtctctcttcatctacagagaaacctcatcttgaaatctggatacccaaggacttcactctatcctacaacgaactcatcagacaagtttctcatcaaaagaaccccaccaccactactagaaaagaagttacttcagcggttaagaagacactattctctctaaatcatttccttcttatttatttatttattgcctttcctatctccctccagaaaggatctgaagaaacttacagcaaaggagtgatgtgccataattcagctatgaggaagggagggagaaaataccctgaccccatgatgattagaactgttgagattccatatgaactccagccaggagctccaggtagccacaacagaacggaaagcactattctggaatagctatttatttcatattgtcataatgataaaacatcctgataccccagaggagaaaacttcagggcagctttcaaagcatcaacttggaaggccaaattattggataagaagtcccattttgtctcattcatagccatgtgacttcagacagttttccattttctttattattgacttaaggaaagaacagatatcggactgggagtcaagaattactggtgtgatgatgaactctgagtccaatggcaaacagcttcacctttccagtgaaacaggaggcaagaaccaaacacagagctttccatctccaatgtcatatggtttttaagataagtatcattggttttcaaagagtactacacatggttaaactcctttctatgtggagagacaggactaacaccccttataaattaactcccaagcttatatagtatcttcaacagcctgtggttctgtgtaacaataagccacacatgacaaggggtgttccaccatatttcttagaagtagaagaaatacacaatcagaaaaccatacgcgaagcatttattggcctccttcagttaatcctctttgggcttataaagctctacatcaattgccattctttaaaatacagtgtacagtttaaaaataagcactgtagagccatcatttgcacacacatgaacattcacaaataatatgtacatacaaacagacagtctcatacatttggtctatatttaatgaccttgttcagccctccctatgctaacactagtatgtataacaatcttaatttaaacccatactcaaaagataacattcctaatgaaacacaatttcaaattggagttaaatctgtctcctagaccaaaatatacaaaaaggctcttgcttatatttttaaacttcatgtgacttatttaaagattcaaggttttcgctgaaatgaggcatagatgactaaactcatttcggctaagtagtaactcaggcagaattctacctgtggatttggattaatactcctcatcaaaacatatggaaagcagtttgaccaggggaaactatacttttctcttgttctgtttaaggcaatggtctgaaaaaaaaatgtgctgggaggaaaattgccatttctctacttatcagtgggcatttgtaatcattacattgtgtcagctgccctttggtgctttcattttttaaattaatttaaatagaactatgcatatctgcagagcttttaaattattagaaggcaaagacttaccttaccaagaaagagaatacaggtattggaacttcatggattacctgacgcaagatagcaagtaagttgcacacatgctgtaattcctacccatcatccagagcagacatcaccaatagatcatgaatagcactcttttactctatgcccaatgtagccttagatttcttttcattgctaccaattgatagtacatgagatgaaagctttttgtattctgtgatgtcatccaagcctgatgttatgagaaagacaccaaacaaactccaagttgggtaagatacacagtagttaggcaatagagccaggcctacaccctgaactctaagctctaaatacagtgctcttccactagacattaagcgcaatgttgtacacttaatatgtaatcctaaataggctgagtgaatagatgaaactttcccctttgttcttcagtaccttctccttttcttttggaaagatatgtctagaacaaagctcctaatcattattaagtcataatttttgggtaccaaatgaagcttactaggcaaataagaaatactgcaactcatccatctgttcaaaatactggagtgtcccattataaatcatctcatgatatcaatctaaatatcctgcatgttaaatcccacaggataagaactgcacacctctgattttgctactattgatctgtgacaccttgaactgaatattcccttctctggccaccattgtctttacctgtaaaacgaaaagtttcaaagatctgacctctaatatactttttgaatacgaagcttatcaagcatgtactttaaattcagcagctatttattaaatgtctcctggaagcagagcactatgacaaatgcaaggcaaagccaatggaaaaaaaacctaaattctggattctgccctccctctagttcctgcattcactattagcacatggtttgtcttgccactcgccaggcccatatcacaaagagggcccactgtgctctagagttgtggaaaatcgttgttcccctttctccatgaagctgtcagtcagagtagtttgggaaaaattccagtgcgatttcattctccgcagctcaatagcttctctatatgcaaactaaaaacaaaaaacaaacaaatacaaattccaccaaatatcctggtggagaatcataaacccggaaaggcagtggcaggaaagcaaatgttataaacacatattttaaatgaacgtttttctgaagtcaacacctaaaactcacattctcttaaagcttccccaactcctaaactggagaaatagttgagttcctgcccagctatcaatgaaaagaagctactagaaggaagtggaataagcaagcagtcccgaggaatatgaaaaaacatgcccattcactgtgaggaaaagagtcattacagatctaatagatgtttccttccaaatcaaacatgtttatgagcaaaagtaatatttatagttaaatatcatatatttatatttaaatgttacataatcatatatattataaaatattatatgtaaatattatattgttaaatatagttcaaatctagaaaaaatattctattgtgtttcacttattcattcaacaaatatgtactaaatccttttgtgtgctaagtaccattctaggtgccggggcatttagtgaacaagagatctttctgcccttatagagctcacatttatataaaaatgaagcctggaaagcaactttttaggacatctctctaagcatccatccatccacagactcaaagatatttattaggtaactacatcatgccaggctttaggttaagctgggagaaaatcaagaacctaagatgcaagcacttgtagataaataagcaactccctacagaataatgcaggtctggacaaagcactgtggacaggctgctactcctttaaatgtagctcactgaagagctactttcatggaggtacggacaaagcattgtggacagaggggtgatcaatgttcttcacattttagaggaagacaagtcacaattgaactggcctttgaagggtgggtaggtgtgtaccaggtcaactaagggggaaaaggtgtcctgattgataatcctatcagaaaaaaagtcacgagagtacacagagggttggacatccacaagaagccctggagcctgcagcactaggtagggattggaaggagaggattccggaaaggcaggttggagccccaaggagctggtctcaatgtcatgtccaggagttcgcccttaacctgcaggaatggcaagatgaacccatttttagtaaatatctggttcaattaaggctacaccatgtatacctaagtggggtgggatggtttatccctcaatgttttgattctcctccaactccaaaaccagtgagggaaattttactaattattactaagaaaggacatgggagtgtgaatggcacaggctggacagagcccaacacattcagagagagagaattttcttcctttcaacagctgcatccagtgagcagctgctaacccactcatagtgccagagagactcagtgggtctgatggctgttaacgggctttattaccttgttgagtacctcaaactccagttactaattacagggcatcgacttgaatgtttggctatataatttttgttaattgatttgcatgaggggatttgggcatgatcagctgtaaatgttcttccggctctaaaactccatgactcttctctattgctacatgcatcaataatgaccttgtgtattttggattgtgggtttcatgcacaattgctaagaacccttcaattgctaagaaccctcaggagcaaagttgttatgcaagggcacacaatgacatggaggcccaggccggaacaggacgcagccattatcattcatgctagctagcatttattgatctcctatcaagaaacagatttggtaaggccaagccacttctagccatttagacaccttgcctgcagtgggctcacacagcttatagacacgaagcaggtggttctgcttgattagtgaatctcaaacccttatatcctgcacttcctagccaaatcctttctatatttctccttcactttccaataccaggtctttaactcaccccttttctcatgcccagttcaccctttaacctccccaaatccacatctcattttgaaggcattcctccccaccaacaacattactctttggggtctttgactgacattctttttcttggcatttcctatttgtgggatgaaaaggggtacaaaagtaaaggccaagataggaaggacccacaggtaggctgattcaatatttacataccagacttccctgagaccatcagcgaactgctggtagaccaagcagttcacactaactctcagagccataagcctttctaatgccctggctttcaaggtgaaaaatacaattactaagaactgtgagccacagcactccattaccaactgagcttccgggcaagagatccttggaaaaatctctgtagtggaaacaagtgattctcagtcacagacaggtcacagatctacgtgacctgtcatccagatgggtcatgagccatttgttgctaagagtagtacaaattttaaagtttcaaaataattaaactttacttcgtaaattacaggagattcaaggttatcatacagtcaagtccctctcccagccctgcattctggtatgtttcatcaagtgggaaggaaaatggtggtcttagagctagggtacccattgtgtctttgcctcagtgtgagtgtgtgttccacatggaaatgttattagggcagttgtggcaaaaaatacacactgacaccgtcggctggctcaagaatagagagtgggctgagaaatgggaaaaacaatggttctgcctctcgcattgtgaaagggaggtcacccgggcaaggagtatttctttgggcacagatgcagagattatcacgttcccggatccagatgttcgaagaaagttacagttagacaggacaaatacattgtggagttctaatatacagtatggtgactgtagtgaataacaatgtgactggcacttggtatatttcaagacagcaagaagattttaaatgttgtcaccacaaagaaatgacaaatgtttaaggtgatggacatggtaattatcccagcttgatcattatacaatgtatacatgcattaaaacatcacactgtgtcccgtaaatatgtacattatgtgtcacctattaaaaattaatttaaaaagatgaatatcagcatgttacttcaaaaataattaaaaataaaattccattaaccttcaaataaatactaaataaataaatttaaggtgattttctatagctaaagaaaagatagaagaaatacatcttcaggcatataaatcttaaatcttgaaactagccaaatccaactcaagagaaagcaccaaaggggtttatattttgagaaggaaaaaacagtgtgaggaaaacagaaggttaatgaacaaagctagaagagttgcccggttttccctttttaaatacgccctagctgtttggggagttgtggccgcagccatgggaagatctttggaagattccttgggctatcaggcaacagagaccgatcaatgggaaagattaagcaaaataatacacttgtctatgatgcctgacaaattctgtctcatcttcagctgtgaggggaaaaaaaataatagtttcctccaataacattaattacccaaccacagaagaaacttgacaaaggctgatgatgtgtttacaaacagcaaagctggtgaatcaccaggcccagatccaaggattcagatacctcagaaccacagctttctccttgccacactccaggtggaaggagaccccgcgtttcaacccagccaaggcaggaatgcacacacgggcactctggactttgtgttctggaaaacgggattatacagagaagacaccgttgacgtctcagaacccaacaggctgggtgttaatccagctgtaaccattcactctccttgcacatgacttttctggaagatagtccctgaaattttgcagaagaaaaaaaaaatctcatgatctgctcaaaagccaaaggactgttcctactctttactgggtgagaagccagttccttgtcacttctctttcttttttttaagagcataaagcagaggaaaagagaggaaaacaaggggggaaaagtttgaagatatgtattaagatatgttaaaatctgttcctgttgccattttagtatgattctagattttttgtttgtgttataatttttgcaaatggtccaatagtgtggaaaaggaggctgcctgagatagtcggttccttgagttgtttcttttaatcagaaaagaagaaacaagcagtttcctttctgcccccacaggccggcacccctacagtacatgagtcataaaatagctcctggaagagccagttccatcaagtcttctcagcaactctccattaccttccccagagacctggagagatggcgccagagaacagcccagcaggaatctgtgggagtgaaaagcaaacaggaagcctgagaccctaggaggtagaagcactctgagaaggaggaaagttctggaagctacagcattataagagccatcctttagggtataaagatgaaatacagcaaaggcttggaaacagaaagacccttaaaacttgacgtcttctccagactcccccatgttataagagatgttaaatctgaggtgaaaagaggttaataaatttgtcaaagtcacacttttataacttagtactggcccatatcaaggatttgctttttcaaaggattttccaggttgcaaaatatggccagtgcagattcagcccaataccatctatcttttgtaatgaatggtgagaaggatgttcatcttgaagaacctgggtactgccagagcctccagttccttctaaatcagccaaacaatagtttgatcaacatattttcaaggtagagtataatttatccttttccaagcttcagaaaaccaaacaaccctgcatggtacatgtagtaaatctgaaacagaatatttaattaaggtagcacacggcacatggtaggtacttagtaaatgttcgcaggatgaaaaaagaatgaccaaaaccaagtattttgaccaagtgagaatagattatatcctctgaaccattaagttttgacacctcttagggaaataaaaatagcccttttggcataaatgtaggcaacatcatgaatattgaaaggaactttcaatccagagacctctgtgttgggcatgacacccaactagctgtgtgatggtagggaggtaggttaactcttctgagtttcagctaaacataaaatgttaaaaaataccttttaaagttaatgggttatttgtgtaaactaagtgatatagtgaatatgaaactacatttataaagtttaaaatactggactcagctaggtatttgcactacacagatacaatatatttgatcctcacagccgtttgtacccagcttacttaccccattgttctccaggagccaagatttaagggacagccctcctcaccatgtgctggcacaacgaaaggcactgggcacacacagataagacaaagaaaaaaatctttgcgattgattttaagcagctctctcccattagtgtatatgttttaaaggaatctgattctctttacatctagctgagtgactggccctagtttcgtgactgccacacagtaggctgttattaaatgactgttaaataaatcgataaataaatgtgttcatggtggaaggaatgaaaacaaacccagcattgggataatcgccccatccctcagacccagattagtaaaattccataatatgcaaagctgaagagagcaacagagtcgggcctctgaggtatgtgtatgttcctcagctggagccaaatcccagaccctggagagcatggaaagccacagttcaattcatgagaggacgtgccaaagcccaaccccagctgcacactgacttgtcggaaaacttaccaaattccctttcagaagggtttgctgtgaccactatcccaaatggagtgttggtcacatgtcagacttggacgccaagtccttgtccacagagtgtgggatgagcaattccatcctgacagatgtgatccctggagtgctcgaagtgacagtgtggagttttccactcctccagacagcgggcaaatatgtgctgatctgacttggcttaaacgaagacctgacagccttctcctctctggaagtgtcatctcaactggagatcagccaggatgtctttgcaagttgtgggttctcaactttctagaactggcgggggctgggaaatctgcagcattaattggatatgaacttttcattcctcctccaagctggctaatgttggtcaaaggcatatgatgtttaacctattttatgtctaaatggctacatagctcattacttcctaggtggctgccaacctttgcctttattgaataaacaatttttgagcacttgctatatgccacccactcttctagattctttacaagtgtccacttatttactgctcatccgctcccccgaggtaagtactattatttccctcagttcgcagatgtggtaatagagacccaaagaggctcagaaactgttcctggtctggattgttgcgggagctgtcgtgtcagctgaaacaatatttgatgaaagactgtgcactttggagaataaaatggctctgttcctcttcaggagtgagtcattctgaagcacgttctatggcatttaaaggatgaaggcaaggatgaagtggggaggtccgcaaggaaaagtacattgggaatattgcattcacatctgcacctttaaccaaggacagaggatatcaagggaagtacacattcatgatgtggtaggatcttttctcagattcaatcttagtcattttacgactagacctcaataaatcgcaagcatggtgtaacatatataaatatacagctagacataggtagatataaatagatagacataactagacaaatcagactctgatttaagaacaacttcctaccctttgttaactggaaaataatcagctctcatagatcctcctacacagaatgaaagggggttacttagcctatatcaagagtcccatttatcagcctttttgaaggaaatgccacaccccttcgagacacatctctccctataaagaagcagctttgcctttcctatttacccatctacccttgctgaacatcattaaaacattaagccatcatttaacctgagagataaaatttaaccctgaaaatgtacttccaattttttttacttaccagcttgtcacccacagctaatccctttcttccatcagaaacccttgtcaaaaactgatggttattgcatgctaatttcaccacaaatacctgatctgaattctaagtaattagcaaatcaggtaacctgtgagatgctgatctttttttataactacaaaaaagcttgtcacggaggatattttagttcaagaacatttccaatcaggaaacctaacatcgtgttccaaaataccacactgtattgcattcatacatttaggtgacatattgactgtggataataatgtacctttgcggcaatcacactgcattttgaatgtgcaatggcaacgaggtgtgcattatgtatgttttaccagtttgggcagctgcccataaatagggattagctattaccaaattcattttgtgaggttcagtttcctattgtgaatgaaaagcatttgtttgctcaactagaaatatgtatgtgtactgagaattttcattttgtgaggatctgaagatgggtacactcagatgataaaagaaaattcccacatagttctgaaaatcaaacgattgggtagtggaccctgggatagaagatgactcattccagttccttctctgcgatcaccaggtgtgtgacctcagtttccttacctataaaacaggaatgcaaataaacacctacatcaaaaggttgttgagaagaataaaagaaatgatgtgacaatgttatacaaacttaaatcaacactccacataagctctcatgttcctggcacgaagcactaatccaagaactgacaggacctacttcaaacaaacaaaaaataacagcaaagttgcataaacctgcttccattactgatgctcataaagcggttccctgtttatagatactagcttattaggtctatagcctacagtagtatacgtaaagtaactacgaggtgagaaggataacttttttataatttacaagttcatgttacattacacattttcacagcattgctgttttaatgttgaaccacatttcacactatagctatcttattgagctttaatattcagtaaatatgtttattcttattagaatttcaaacaaatataaaaatctctcgaaaaacagaattctgcaaatgttaagcatgaaacaacggcgaagaaggggactttgctgagaatgccatgagaacctgatgcttgcccatagctggtgctcagtgcctgcttgatgaagaaatggatgagtgaataaactatagaggtgataagaaacatagtggcaagtggagaatttcagaactgcatgctattttagagctatcataattgatcacagaaaagatggagaattctctgggaaatattagggggttatgaagagagctgtcttcacaaacgaagacataaaagtcacaatgcagagtgaacacaaagaaaattctttttatttcttcactgagacccaaccaatcatttgcccaatgaatgaaggtttcccatggaaatctgggaagaatgtttctggggcaagtaccaatctatcaaacccactttgcactggggcaagcacggatgtttggagacgagctcccattaaaagccaattgtatttcactgaagcaaaaggacaggggattgggtgcatttgggaggcggagggggtctgacaaaataggggtcatcttcttactcagaagcccaatatgtaaaacaggaaaaggctgagttgctctgactgaagcaatgggaggagagatgatgctggagccagaaggattgtggatcccatatgaagtctcaactccatggtcccccaagcagtgggaacactgctcttgtggactatctttctgaatttttttgagagctttacagtaatatagggcagaagagcagcagcagtcaccttgatccagggtttgattttatttaggcagtatgatataaaatcggaagaatttgcgttttggatttgagagacctgggttcaaatgctggctctgccattttccagctacctgggcaagtgctgaacctctctgagctcagttttgtcttctgcagaacaagaataagtaacatctatctcacagactggctgggagaacgtaatgaaataatgtatgcgcattcacatagcatgtgctccataaatgtcagttttctcctcttcccatcttttcttaatgttttattgttttgactgttcttatctccactactgggcttgggtgcacataactacaaaaatagaatctcaaaaaaaaagttcttatctagtatttgaatctttaaacagcaagcaacttagattgtagataatttgaagatgctaattacaggcaatttcttctcatagccaatatgaagtgcaaatctattagtctaaagacatatttatcttccccccgtgaaggccacttaaaaacagaaactcatggggtccaaataaaaatacaatgatatactgtggcaatagttcaataaattatggtataatcactatgaactgtatatgcagccactgaaaatcacgtttttgagccatttttaatcacgtggcaaatgcataagatatttgatgcaaaaggcagaatgcaaatatccaaaaatagaaatgtagatatatacacacgttaaaagtggtcctaaaagtgaatattttattgttattgttttctattccaaaataagcatctacttttgcctacagtcagaaaaaaacgaaaaatggccttaaaaatatttcacagtaaagaaatgatatagctgttatgatctgtaacgaatgttctttgcagtgtaatgtgtaactttcccctgctgtaggcatccatataaaagtgtcttggatcatcactattcccacagaaagatgtgtctggtaaccacatgatctggtcctcggtcctgggtcattacagtggtcatggtttcaaatgaactaaaacattttaaaaagcaaaagaagaaatatcttagtccgtattttaatagactttagccttgacaaaaggccacacacgaaagcacccacaagggctcctgttcatggaggagatgctgccagtaggggcatttctggtgctaacagtggtcttggtgagggactctaccaactgtgagtaacataagggggaaaggtgacagccgtccatggccctctcttttagccctgacatttaaaaataatttttataaattaatagaattctagatctggctcaacccaaaccagctgcctcttactacggctaaagaaaccaaggtaggaaaaggttaagtgttttattaaatatctatggacccacagttagcaaaagagccgagaccataaatgaagtttcccaacacacaatccaatcctccttcacttacctaataactactttggccagctcaataaatgggctgtctgtgaccagtttccagcttcttacaagtcttcaacataaaactggaaacaaggccactattactggggaatttggcagaacacagaattgttgtatgctacatttaatagggtcagagcaggtcttgccacctatgcgtcactcaccgcactcagcagaacgattcataaggtgcaaggacctgatttatgttgggtgataagtcaatgaatgaatcaatcaatgccaatggctccaagtggcaagagaaacacacttaacttagtaacacatcatgatttccttccatctattttagtggggtttttaaacattctacttgctgttttccagttaactatctatttctctgtttatctgtgtgtggatacatttgcatccatcagttactttagtatcaatatgccaaatcatggaaggccacatagaaattaaatggacaaggggtctgggtcccagagcagagcctaagaggatccgtgttccaggagacaccagttggtcagggcaaatagaacactagcgatcagcgtcatgatgagacggggcacctagcaatatctattcagaggcaagtcagttttccagaagacataaattctgccaggtaaaggcctcctctagagggcaggacatgtataaggttctggaatctgacaaattagacaaagcaagaaaacaccaccagcagccaacacatagacctgagtctaattgtcagataaaaacaattcaagattcgtacttcctactaaagaaggggagccgatgagggaagacacgaaattgagaccagatacgtgccaagcagggcacacaggtgacatcgaagcagtggtagctggtcagagaggagtcacagctgctgatctgctcaggggcaatgacaaattccacagagtttgtcacaggaaatctggtgtcatcttctcatctcaaaaccatcacacagctcgcacacaatcacacaccattcactgagagccttttacacacaaaggaccacactgagctcttaacatgccatttatttctccaaaaagattgttgcctgcatgatccacatagagaaacctaagcttggcttagatgaaaccacttacccaaggtaacacagcaagtgatatagagggatttaatccaaattagtcagatcactgagtctgggctcaataaactgttagatagtttaaacacctatgcaaccaaaaaaccccaaagcacacacaagatcttacaactggaggtttcatctctcaagagagtgtaggtgtctgtgcatcaatggtacagccaataggtgagcccaggtgtctcagtggcctgtatcaaaaaaaaaaaaacatgtggagcctgtagtcttaactacgtattaatgggtactttttctgactttgagtataaggtttcatcagcactttagagatattttccacatttgctgtctctctgtagtgtccaaacccataaattaccagcagcggctggcaggctgaaaattttcatatgtggtaagaccactctactccaggcttattagaaagattgggagtgaaggatctgtggaatctttaaaaagtaaaaagcttgtttttcctgaacaatcaggtgtcattgcttttttatcaagaatagtaacacaaacctaagcaatgcaaccattgccgtatacaggtcctgcttgtatgaaaaggctagaacggtttgcaattaggacagcagttgtatgctcttaaatacctacaagccctttgttcctgttgggtagatcatatgagctctggatgaacttgctccagcaaagccctttcctcctgagcaatgctagttacatctttttttttctcaacctctgacacagttatcacaaattctgcatcagtaaggtctaaattaacactatgttctgtaccagatctgcagattatatagaaggctactgttaagggctaaagagatctggaagctgaaagactgatttttgaaaaattaagagaggtatggagggataacagaaaaaatataaatgttccaggtaattagagagcactttccaagaagcaccacaaaattgcaagtgcccatcaatactaaagaatatcatgctgttgacagcacagcagagaaccttttcaaagacagatcggcagctttacccaaagcacccttcaccctgcaccacctacccctctcctgtggctccatcacaccctccaaagctcctactgagaagaaggcatcctgcttctctctgtaggttcccctagcaaaccccaaagaataaactgcgtaattgtgaaatacagaatctgtgtgtgaaaaaacacttgtttcattcttttcaccttcctgctgcctcaacacagggagtatcttccccacgtcaacaccacaccaggcatctgggggcataagccagttttccacgagatttgggctagaaatatttattgtggctgcaactccaactgtcatccattcggattacttcttgcaggaatcatagccccatcttctcaacagttcaaaagtggctgtgtgtatccagctcccctctttatttccagagcatttctgtgattttagagctgctaagcctcaccaaagtcaagtcctttatctaattccctcttttgatccagtgtctttatcctagaccacggccagtggttggtgggtttcaaaactctttgtcttttttctgtagaacttttaccctaaagaaattccattctaaatgccaatatgtaaaatagatcaaaggcttgattagaagagagttggagagctggggtcccaccaatccccaaggatggggaacctgagggttctgtggatcacttgagagtggaaacacaggaacatgactagggaaaggaggggttcacagaaatgaaagaggggcaaacaacatcccactttaaacatgaaagctgaaaatcttcaacccattcttagttgcacagggcatgtggaaatctcaaacacagaggcctgccttacaaacattaataatatctaccccttactccagacacttgcagagacctcatttaatccccacaactactatctgtggtttatagattttcagcttacagatacaaaatgtgaagcccaggatgatgaagtaacttgtccaaggccacatagacctaagtggcagaagtctgacctgagctcgatgtgggactctgaaacctttactcttaatgcatgcagggctgccatcaggtgcaagattttcaaactcttctgagtggggggcatcagcccaatgaaaggatattccagtatgtggaagagaaatgtagcaaacgtaaagactgatgccatctttcacttttttttttaaaagactgaaacatttcaagaactctttccttaagaggttactgaggacctcgatgaagatgcaagaaagacactgacagtattcacgatctattaaactgaccagtttctactaaatacctacaacatgcccaagcaccagaaagacacagatgaacatgtctcttggaataccagaataatttccccacgtcagccttgtgaatctgtttagagaggagggcccagggacagcaataggaataaaaacatgaacagacacagaacaggagcaggcagaagaacagaagaaaagggatgaggcaggagaggagtagttaatcttacacaacatttggacttttcaaacgtaattgcacatccattgacaaccgttatatcaccttatatttacccagtgctttttgtttgaatctcacagcagcatgatattataggaaggggaaatataaaaccaagttttacagctaaagaatatgtggcctcagagaggtcatctttccaaaagtcacagagggagtctccctctgttagagggagagccagagctaggatctggacctcaggactcctagcacagtgctcatcccaccacacagagcactacttgtgaagcagaacataccctttacatgttatccacatgttatccacagctacaatgcttgccagtggccagcatggtaataaagactccattctcatgtacatctccataattagattacttttccccatcctcatccccacaacctactcaccaacaattatctgagcccagctatgctcaccccttcttaagacctgccctctctggaattacagtagacaatgacaaagaagttgtagttgccagatgtctcaaactgcagtgacacacatacacaaaatcacagaatcggctgcacccctaatgcttctctgttcaaaatccagttcttcttgtaatgacatctaatcaggccctggaatcagctgaaacgagagcttctgtaaaaatcactcttcactcggtactcagcagttaagtctcttaaatgtcaacctgctaggaattactttaaaagatttttttttccttcattacaaatctcaaagctattgagtcttttcaacttccagatggatcctgatattcatatagtccagaaaatgacaatgttctttgtctgctaggtttgaacaattttgagttacttaaagaatgtgtccacattattacagacactcaggttaataataaacattgagatccttatccagatatttataagcctttagaactctttaaaggatgcaaataatttgaccaggattttttttttttttttttttttttttttttttttttttttatgaagaaatttctctacaaccaggactctggctaaatccattagccctacaatttggctatgtgaccaccaggtggtgacagtgtgccacaattcaggaccagcaaggttggcatcagggagctttccccacacttatgttgaaaaccaacctttcaaatttagatctcacttaatcccctgccacatttaaggtgttacttttaatacagcatctcaaccaccacctctgggttaggtccttcataatctgtagaaccgaaatcttttaatgtggcattcaggaccctccaaggtggtcccaccccacccaccactctcctacacagtccctgtattacagccacacttcaatgcatgtttcctgcacattcacacagatgcaaagatggttctaacatttcttgcttctgtatatttgctcttggggatatcccctgatgttcacctaccttttcaggcacctataaaacatctggaaacttgctcagacaaaactccaccaaacagttgtaaaagcccagagttctactagtatttaggaatatgctgagtgttgtttcctgtagaaaacttgtaatgtatatatataatatatattaaaaacatacatatatacacatatatacatacatatacatatatatgtaaatcattacatatatacacatatatacacgcgcgtgcgtgcgtgcgtgtgtgtgtgtgtgtgtgtatgtattttgagacggagtcttgctctgttgtccaggctggagtgccgtggcgtgatcttggctcactgcaacctccaccttctgggttcaagcgattctcttgcctcaccctccctactaggtgagactacaggtatgcaccaccatgcccaactaatttttgtatttttacaaaattacaaaatagtaattttgtaattagtagagacagggtttcgccatgttagccaggctgttcccgaactcctgagctcaagttatctgcccacctcggcctcccaaagtgctgggattacaggtgtgagccactgtgcctggcccttgtattatatattaatcttgatatttttaggataaataaaaacgtgtgtcttaatgagcgctagatcacataacctgccttatctacttagctatttctcttgaacatctttccttgtcattaaatgatacatgaagcgttttatggttcccctcaccaggagtctgctcagtctggtggacagtatgctgggcttgaaatcaaaacaccgagattcagtcctagttctagcaggtgctagctgtgtttgggcaagttgtttaacctctctgagcccaagctgcatgggtgtaatgcttacctcccaaagtctctgacagcctaaatgagatcactcatctgatcatttctagcttggaacctgccttggagtgacctctcaattattactcatttctatccactcagttgatgtgatttctttctccctccaagccacaccactctttgtaccttcctgtgcctccatcctgctggatctcaccttaaaggagcttgggaacttgctgtattccccctgccagagcataagaacactcctgaaggcagggctggcctgactcctctgactggccccagggatcccctagcatatgccaagtcccctgcagacgccaggcatctgtggaactgaatggggaatccagcctcccttcgccttaacccttgccattctgggccttgcactcttacagccctgtacacagcttggaaaaaaaaaaaaaaagtctggcgtcttttaaggccctggcttgacgttgatgctaaaaaatactttcaatctggagcttggctctttggggtcccgatgatacctctctgcctggtatcctctgcctacagcttctctcttggtggccagctctgcctcctcttctgcaggttcctcttctgtggcagcagaggataaccttgttaagtgagaggaagagtggtaccccctctctgcctcctcctcacacgggacgtaaacaccacggcttcagcagggagctagtccatgctgaggccttctccagcctttctagccttgatgtttctttattgttgtctgtggcttggtttcgtttttccattttcatgaaaaaaaaaaaaaaaaagctttcttttcttggcccttcttccagcagttgattgatttgcattggatgctgaagccacttcctgtttttccttcaaaccccccagcaactgtcttccttacaaacggcctcagaaaaaaaagaaacagctcacattcctggtacagggcacctgggaagaaaaattcattggatttcatcaggaagtatgatgttccttgggcagcatcccagggtggacctttctgttgaccctatcaggatggtaaaattgaaaagaacccccagaaggcagtcctcactctgcaggacacctactcccagaggcaccgtgtccatcataatagttctaagcgtgtgtactagaattggatgtgggtgtgtttacttctgcactgcctcctagctgtgtgacccaaggtgagctgctgtgccttgctgatccccagtttcctcatttgtcaagtgggttgagtcataagacttcctgtattggtttcctgtggctgcagtgatcaattaccataaatgcagtggcttaaatcaacacaaatctactaactgttctgaaagtcagaagtcttcaaatcaaggagttggcaggcttgtatttcttctgaaagctgtagggagaaatctgttttcttgcgttttctactttctgcaggccacctgcattctctttgccctttcttccactttcaaagccagcagtgtagcgtcttcaaatctttctcttcctgtttgtgtgtcctgtgcttttgtcattaaatctccttctttcactctgactctcctgcccgcctcttataaggacctgtaattacactgagctcgcctagttaatccaggatcatctcccaactcaaggtcctaactgaatcgcatgtgcaaggtcgctttccatgcaaggtaacagattgccaggctctagggattggggtatggacttcgctattttgcctgccatacttctctcataaaaccattatgaaaatataaaaagagcatatatgtgtatttttcagcacaatcctggcacattgtaagtgctccaaatatacagccatgattatatcaatataccaataccagcactagcagtcaaaagagaagtggttgttaatgcttagttaggtaaagcagagccatttggatcaaccttgaatgaaagcaaatggaagcgtaattggggctggatagtgcacagacacatccttttacagtttcatatcctcactcttcgttttaaaaacaaatgtttactgggcaccctctagataccatactttccattcctcacaatagtcgtttctggtagatgttaccgccttactttacaggtgacgacagtaagacttaggttacacaatttggtcagattgttcagctggtcactagcaaaggcaggatttgaatttgctattgtctgatttaagcccgccctctttccaggctccaggacttggcgacatgctggctcatactcactctgatcatcaaaactacaccagacctgccccacgggcagctggcacacttggctttcagggcagaaatcaagttcttgcttctccggtgtcctccacagccctacacccatccaggggcacacggtgggtgggctatgccatccttgtgatcttgctaggaacaggagagcccaatgagaggcctaagtgcttctggggcaatggttctcagccctggcatgtgtcacaatgacctggagagcctgctaagccagactgttggccccacccccagagttcagtaggtctgtatttgcatttcaaataagaacccaggtgatgctgattctgctaatccaggcccacaccctaagaaccacccctctgcagggatccggaagtaaatttattaaaggagaatacactgctcagatgtggggtattaacactcactggtccccacccactccacttctggacttctgcagagctgctagccctacttgactaataattcccagcagaggggcagtctccccataacctatgacacatcgctcactttcctccactgctcctggaggtggcccccattgggaatcttagctttactggctacatctttagcagagaggcctgggtcatctgtcctccctgtatcttcagctcagccaaacaataaaatgcaagacacaaaacgttgcctttgaaaatgaggcagctggggagaggaacgatgcctttaaaagggcaaaggttctttgggacaccgatcctcaacatctcaccctgcagctcaaagtcaaggcttgccagggttcaagttctcaagtgtgcttcagtggtgttatttagatgtgaccctataggctgaagggcatgcacattagcatattttgtaacagctgttgatgaagatgttaagtcttgctcaggggaccagttgcagtgagaagcattttatgagaacaatatatattgtagacatctgaatatatttccatgagaaaataaggatgaagaaacaaaaaaaaatggtatagtgtccttacacagcagatgaatatttaatacactggagcttatctttaagagaaaaaaataccctttgcaatttttcatgcttcctacaatagcaatccatatacgaaatgacaaacactatagccacccatataaataccacgtatttcattattcctttcttacggtggcacaaaggccagctgctacatgaagtatcatgaaaacataaattagtggttataaatagcatatttaaaggatgaggccatctaaaatcggttggcttaacagaggccaagaacaagtctgaggaattgataagacaggagggaaactcaggtagtatatgcagatcccaggacagcagcccacagatgctccaccaggggctctcaaaacagagttcaagggggataggtctcagggccccggaggaatgatcctactttcagttgacccttgccacctcaggagggaccaattcagagactgcttatcaccactatttttaacttcttggcaatataaccagtacaatgggaaaatcgcccaaagtaaatacatactctcctttgattcttctcctggaaagcagttttctactattttccgttagaatcatttccagggtaaatcacacttcagaggcagagcttaagtctaagggtcccctaaggagcatgtatcctgggctgggaggagctaaaaaaaaggcatgtctttgctctctgctgtagatgctgtgtccaagcaagtcctttgagaagcctctgcaagtttttcaccttcaagcctcctgcgttattactatttcctgagttttgctaccaaacaaaattacctgtagtcatatataattatttttccatgagacagcttaatattgataacatttttgtggtttttaaattttattttatttttccttttccatctctctttcctggtattaataacatttttgaacattttctttctactaggcactgtacgaggatcctctcatgtaatcctcatctcaatcctatgagctgggtaccactattacccccactttatatacaggaaaactggatcacagcagtgcagtaacttgctcaagatcttgcagcttgaaagtggtggtacaaatctaaaatccagatctgtcttcaaagtccatgcttttaaccactgcactgtgcagcctgaattcatccattcaccatattatgttaatacagttccatattaaagagaaaactgtttaaactattttaaaacttaggaaggataaatgcataacttgtgttggaattttttaagcacataaaatagtttcaggcaacccattcaggtcttcatggacccctagctgtcctggacctcacattagaaatcactgacctagacccacctgaacatcatttgccatgtgaatcttctaggtctgcacaaaacacctagttaaaaatatcgtctgatgctctggaataacaagtcaaataaaatcaaaatacggaatgacattcaagcctctttttttgagtgtgtgagatggggtcctgctctgccacccaggctggagtgcagtggcgtgaccacggctcactgcgacctcaacctcccagattcaagagatcctcacacctcagcctcccgagtagctgggactataggcatgtggggcctgtgccaccgtgcctggatgattttttgtagaaaggtctacgttgcccaggctggtctccatcaaggctctaattaaactggtccttcctatcttttcagatccatcttccagatctgtggtatgcacactgggtctgaatcagcaggtgaggggcctgggaatctgtgcttttagcaaactccccaggagacctttattggcagaaattttggaaaacatttccatcctgttcctggccattcacaaacatggtaactctgacctcctggggcaactcaccatttacaaggcacattacctactctctcagctttctgccagggctcaagcccattctccagcctgaaatgtatgtctcatgctttcctcccaggcctggctcaaaggtctcctctggaaagccttctctgctggcttctgttagaatctgtcacgtcccccctgcccccacaccacccagcttacattctgccttcttccatagggagccatttcctagtttcacccagtaagctctttaagagttaggctggttcttactaaccttggcttccccagctcttagccaaccactggccatagaaaattcttaataaggatcagcagatttaatttgtcactggcaaccgcaagtagccactgttctggaaacagacttctcccttctcacgcagcttatgccactggcaaaagaggggcgggaaatgtgatccaggattaataatgcacagatgtttctcaggaagtagtatatcactgtgtcaaaacttcctgtcataaattctgacaaaatattttagtatttgcatttgtcatccttatcaaccgctctcatacatgaaatggagcaaatgactcctgagcctgactacaccttcccaggctccagtgtaaacctcagccatacaaccctacatttttaccctgcatctgttccgtagggaaagagaattttactgattgccagctaatgtttattgcatactcactatgttccagagactaaagcctccattcttatgcatatctgacccgcataatggctctctaaggtggtattaccatcattttctacatgagagcactgagcccagagaggttaaataacttgcccacagttgcacagctagtgaatttggggtttgaacccaaatctgcttgactgcaaagcccatgttcttaactattctactggtttttaaataacaagagcctcatgatttcacagggtataaacaatgacatcaaaatagaagtgaaagaaggaaagtctctgggtctatactatggctagccggaaaacactatttcagcagtaatggctttgcatcacataagttcactctgtctagagcacagggatcatcaggcaaaagtcctggtgggcaagcacagcacttcaagatgccacgagggctgtgtccatggtcctgaaaatttaggaaaatttaggattcaaatttaggaaatagtacaaggctgcccagcccagtcctcaatgagcacaaatgccaagctgcctcaagggcagagtctcatgagattttacaaaacacaagggccaaggagactagggagttccctcacctcattttctcattttaaagataggggccaggcacggtgactcatacctataaccccagcactctgggtggctgaggtagaagaaatgcttgagtccatgagttcaagaccagcctgagcaacatagtgagatcctgtttctaaaaaaaaaaaaaaaaaacttgccaagcatggtggcatgtgcctgtggtcccagctacttggaagggctgatgtgggggcgtgggggattgcttgagcccgggaggttgaggctgcaatgagccataattgtgtcactgcactccaacccgggacacagagcaaaacccagtctcgaataaaatagaaaggaagatgttgaaactgaggctcaccaaagttatgtgtttgcccaggccacagagctaatgagccacaaagctaagtctcagacccatatttcttgctctgagttgggcttgtcttctttccttaagttttatttcttaatctcataagaaaatgtcacaagttattgtagcagtgaaacaatgagggcatacacaatgaaaaaaacctctcctatctcacgccaaccacaggcttctgccctgcaaagatcaccaatgtcaatagtttggtaatacaccatcataaaggttcctaaattcatctctatatctacaaacacacacacacacattctttctttaacaatatggagtacatagacatttatttactttgaatattttagcacttaacatgtgttgaatatattcccacatcaagcagatttagctctttcttattaaatgctgccccacacaccacagtcaagaggttgcacatgtgttcaaacactctcttcttggtagatagtcagactatttggtgttccttctgcgaaccgccctactgtcatttaagtaacaaactctgttgatacaggagtggcctctaactcatttagtctcctgtggatcaaaataaaatcctggtctcctaaatgggtgcggctgggagatcacttgcttttcagagagtagtttccatttcctgtacatcagatggtcagccctttaagcatgccaatctgcaaaaagaaaatatttctttttactttcatgtttcagagatgggatcttgctatgctgcccagattgatcttgaactcctgggctcacgtaatcctcttacctcagtctcccaaaatgcttggggattacaggcatgagccaccatgcctggctaaaaatgaattattcttatcaactgcttaaaaacatgcttactaagccatatgaacatgggcaagctgcagtttcttcaactataaaatgggaaaataataacccttacagagttgtgtaattcatagtaaaatgagatgacacatataatgtgcctaatatgatgtcaggaacacagtaggcatttagtaaaaatgactactattattattgttgttaaaattacggcatttatacactaacaaaagaggtacgcaggttttaacataaatgttcatgctttatatgtcctgacttcaaattaacatgtaactggcctctggaacattcactgccctacctacatttattgaatgcctgctctcataggtcgggggaaggggatggcaaagaggaagcaaacaggattggttggccttaaatggatatcgatgattgaagatttaaaagacattgaagacaaaatccctacacagccattcagtgtttataacgcaccttctgtgaagcgatggaaggagttctgatgtttaattctagaacttttcagcatccacaaataatgctacttccagcagagaagaggaagatttgctgctctgagttaaagctagagaatccaagtgagcacaaaggcacttcaaggaaaatgcaattagaaaaacaggtgagtggggacttgggtttccagaaatgcgtgcttagaaatactgacaggcttgggcttttcacccgagacgttttacatctttaaatatgtttgtaatttcagtggtctgcacactccagattttgttttgaaagggaaactttataaatcactgtattattattagaaataattaaactaaaaactaagatgtggttgcacacatgtttacaacgatgtgaaaaatacggctgtcagcaccagggcccagcttccatcacataactgttcgtgcgttttaatggacatttgagtgttacaaatctggccagggtgggagtcaaagagaggcataaaattatataataagaataaaaataaaaataaaaaacaagaaaggaaccggaggccggtgcagttgctcacgcctataatcccgtataacccgagccctttgggaggctgaggcaggcagatctcttgaggtcagaagttcgagaccagcctgatcaagatggtgagatctcgtctctactaaaaatacaaaaaattagccaagtgtggtggcatgtgcctgtaatctcagctgctcgggaggctgagccaggagaatcccttgaactcaggaagcggaggctgcagtgagccgagattgcaccactgcactccaccctgggcaacagagcaagactccatctcaacaaaaaaaaaaagaaaaagaaaaaagaaaggagaaaaagaaggaaagaaggccaaaggggaagaaatgaggaagggaggcagataaaaaccttccttccattttcttattcttagcattaaaaaagactccaagtgttacactggaaagtgtgtttaaaatactcggattctaaaaaagagcaaagaacctaatgtatgtttttcaaaatcctttgattctaaatccattcaactataaatctgagttattactttgaaagctagctacatcctgactttcctaaagtgatacaaaatattcaatcccaggccaagaaaaatcccaaaccaaccaacagaaggcaaggaaaattgaatacagaagcttgcaacttgaattattcggatccaaggaaattaaaactctttcatcctttttccccagttaatttttaaaacattttaaatacattgccctaaatatttgaaaatataatctgaaagtgctcaaattctattttatgagcagaaaaatatggataaatatatcaattttatctagaatgctcacagccatttctttcaaggatattggaaaatactggtagtgctgtgtctactaaaacacttctaaggcatcagaggaaaagctttttgatattttgattgatttaactctaaaataaaccatcaccccaagattctttttaaaaataaaagatactctatgtgaagaaacaaaaaatcatgcaattctttcaatatatacacaaatactaaaaaggaataaacaggttgtgagttaattacaaaaaagaaaataagcttacatataaatgacaaacaacctagcaggagacaactgttaaatggaaacatgacacccatggcaagtccttgaatagctaaccatatagactatacccgcttttgaaaatatcttctgatggggtaaaatgtattgctatatctaacccattatttaatgttttaacatgacccatctacatactttttcctttggtacaaagaaaatctaaacacatgcattcttttctcttttgtggattcaaaccaaaataaccatggtcacatgaaggatgcgtgatctcctctgccgggatgtaatatggacccgaggacctcagcccacagctctgcctcctcaggttcttttcaaggcacctccaggattcagtatctccactccatagagggaagcagcatgatttagcacagcagttcccacaagtgtggtccgtggtcccttgcaggggtcgactcttccaaggaaacccatgaggtcaaaacaattttcataatactttgacaaatagtagagttttccaggggttacatgatgtgtgataccaccacacactgaatgcagaagcagagctgggaatccagctgttttctattaagccagacataaaagagatacgcaaaaataaaaaagaatgccactcttctaactggtttttgttttggaagatttttgtttaattacaatatgttatttatgttaggatgcaatgggtttataatattttaaaacacatgtattttaaattattttctctattttcagttcttggatggtaagtatcaataaatgtaattcacataaacaaaaagctctttaagatcctcaataatctttaagagtataaaggggtcacgagatcaaaaagtttgccaaccagtgatttagcataacgcctgacatatagtaaatgtgtggcaaatggacaaactgatggattaaagggttttaataactgctttcaaatgttcagagttcaataaatgaatatggccagtaaagatctttggataaccatcttcaggtcctccacacctgcttacacatgatttaaaagcaaatgatggtaagaagacaaaaccgtaggctgggtgtggaggctcacgcctgtaatcccagcactttgggaggccgaggtgggcagatcacctgaggtcaggagttcgagaccagcctagtcaacccagtgaaacccgtttctactaaaaaaaaaaacaaaaaaaaaatagctgggtgtggtggtgcatgcctgtagtcccagctaccgaggaggctgtggcacgagaatcacttgaacccaggaggcagaggctgcagtgagccaagatcatgccactgcactcgagcctgggcaacagagcaagactccatctcaaaaaaaaaaaaaaaaaaaaaaaagacaaaactgtagagcaacaattactacactgaagataccagttaagtatgacttaaagacaagtaaagggaggatccaggtaggtagcagtacaaatacgttttcatcatcaatggcttcatttatccatcctatcactacttatttccatttcagagaaataatatcttctacgaatttggagaggatgttgttctaaagggttgtatgagatttaatacaattaaactatgcaacatcttacatggttcagtgcttataaccctacaaggttatagggtcatttgtgcggaccaattagttaccttgctgtgttctgcggccacagtgttcacaactttctaccaattttcttcctggcaatatcttattcatcttgcaaaatccagtttggacaacacctcttccaaaaagctttccctgaattcttcttttaaagagacagttaaaaattccttcctctcttacctctgtatgttgtgcctatgtctatggtaacacattctattgaaattctgtatttttgctgtcttccttactagaccatgagcaccttgaaggcagggcctgtgggttgcccacttttgagttccagcacctagcacactgccaaacatggcagacactttaaaaatccacacaaagaaaggccaggcgtggtggctcacacctgtaatcccagaactttgggaggccaaagcaggtctcctggatcacctgaggtcaggagtttgagaccagtctggccaatatggcgaaacctcttctctactaaaaatataaaaattatctgggtgtggtggtgtgcacctataatcccagctactcgggaggctgaggtaggagaatcgtttgaacctgggaggcagagcttgcagtaagccgagatcatgccactgcattccagccagggagacagagcgagattccatctcaaaaaaaaaaaaaaaaaaaaatctagtcagtcaccttacaggccaataggactagtattagaattaagtaaaatgctaaggaatactaagacaatagtaacattccatatgtttccggcccagtcagaaatccagcatgtgtgtcttagtgagttggtcttaacatgtttgagaatgaagggtagccattctaccattaaacagccactaaagagagccctttcctaaaaacattatctcctggaagaacattgagctcttttcatccttctgaaacgatgcaaattgcaaatggtaaggcaagaatttcaaatgataaattaaaccaaggtaaaaactcacaaagcaaaaagcagcactaaagtgaaaaagggtcaattagcagaaaatgaccagaaagggggaaaatgtgacaatctgggatgcttatgggacgtcaaagagggtttgaaattcatgctctgaaattaatcagactttgttgccaccttttcagtgacatgcccatcagcaaagaacaagcattgtcattagcagaacaaagaaaaaaaagtgtatgcctaggattagctttggcaaaaaaaaaaaaaaaaaaaaaaggataaagtaggtcatttccatgttcagctttaagaatacggccatatggtaagaattaagatgttgcccagaatctaatatgggagagatgtctgcatactccaaaagaagagagaaataccaaacaccagtagcactagagtggaaatctgagattgggtaactaaaggcaatctaatcttgtgaaaagctacagagaggaaaggtcttgaacataaagagcttgtcctttcttacagccatccactataattggatgtatacccttttgtgagactttgaaaatagcaatttatttctcattcattagcctgatttcaaaatacccttaatggatgtctcaattacagagactccaaggtcatataacacccagacacccttcatatctgttttctttactgtattgtaactcagttttccttattagaggtagagttttagccaagaaggaaatctcaccatggaactacagaatgttaccagtgaaagtctctctaggaattgactaatctaacctcagccactttaggaaaactgaagcccagagaactcaagttcctcgcctgaggtcacacagctcagtatcatcaggaacagaccagtcctcagggtttccttcctccacttcagtgttgttgccatgatagcaaaacaaagtagtgcagatactctttcagaaatgtgcgtttggaaaaattgctagccctgagcaccatttcctctctacataaataaaagcaatgctttacacctgctaccatcaccctgggaacatccatggtgtgtgagtttattccctggagccaactgcaggaagatggaagacagagcatcgcatgaagccacagtgctgtttccagtaggagaaaggttagaatgaaccatgacaaaggcttgaaaaggagcttgtggtaagtttaaggagaagtagaatatttcctagccccaaagtatctgttggttacaaagggaaacacagtgactttatagtggagatggctggcagacaccaccttaactagggaatcagatcgaggttcacatcaccagaaatgggacagctcgatggcatgacacaatataccaatgatatgatatgttaaggagagcccttcacctctgtgtggtgctcttcccctaaatccacaggctccctttaaccaggagaaaatgccagagaacccaaattggggggccttctataacgttcctaaccaatgctcttcacagggatcaagatcaagatcataaacaacaaggaaaaccaaggaatcatcacaggctgggggagactaagtagacaacacaactcaatgcaatgtggaatcctagaacagagaaaggacgctggcagaagaatgagtcaatccaataaggtctgtaggtggtggcattgtgccaatactaagtttttaattgataacttgtaccatggttacagaggttaactttggggcaagctgggtgaggagtatgcaggagttgcctgtactatctttacaactgttctgcaagtctaaaagttatttcaattttttaaaaaatgtggccaggcatggtggctcacgcttgtaatccagcactttgggagggcaaagtgggcagatcacctgaggtcaggcgttccaggccagcctggccaacatggtgaaaccccatccctactaaaaatacaaaaattagctgggtgtggtggcaaacacctgtaatcccacctacttgggaggctgaggcaggaaaatcgcttgaacccgggagggagaagttgcagtgagcctggatcacaccattgcactctagcctgggcaacaagagtgagactgtttcaaaaaaaaaaaaaaaaggaaaaaaactggctcatggatggacagagaacagagctgaagcttttccctcctttcaaacccttgttagaatcattcatatatcactctttctttcaaaagcagtttgcactagttcttcttatcctcatttattctgattttttgtgtacccatctcttaaaaatggtaatgttttaatgacaaagaccagggaataatctttatcactgctaagagcaccttgtcctgtgtttttccacaaagcaaatgctcaataaacaactctgctacatgaatgaatgggttacaatcaatagtctcatgtcctcctttcatacctctcttcccagcaattttgtcagacagacacgccttgtctaacctttcccatccttggaatgggaaggcaaagtttcctggctgctcccacacacctctgccctaacccagtgatcctctcctcatctgttaattcagagggctgaactgacacagagccatctcctatcaaagcccagttcccatgtccacagaactcaaaaacacatctctgaacagctgatgtgagaatgtacttgcttcccacagatgagttccacgcattgcactgcatttcacaattttgccccatcttcccattccataagttaaaacataaaatttgcatttgcaaccatgtgtctatcccttcacaacacactccccttacacactgaacgctgagaagcaatagctattcacatttccctgtgctctttgcctagactgctcttcacctccttttcagtccagaaaaatggtcagttatcttcccaaacttcacgcattacatcatctcctccaggaagccctccccagacacccctcaatttcccccctaagataagtctctttctccttagaattaaggagagtctctctttccttagaattaatcacttcctgctctgtggtacctatgtacctggtatgaaattctgtttcggtagttgtaacacttaatcttaatcatctatacacaaccatctcctcaactatcacaggagctccttgagagaagtaactttgctttatttattgtatatacttcgccccctaggggagtacttggcatacagtcagccatacagtaaaggtttgctgaatcaaaggactgttaggagactgttaggctgggagtgatggctcaaacctgtaatcccagtgctttggaaagccaaggtgggagaattacttgaggccagattgttcaagaccagcctgggcaacatagtgagacccctacaaaaaataaaaataaaaattggctgggcatggtggcatgtgtctgtagttgttgctacttggaaggctgaggtaggaagatacctcgagctcagcagttcaaggctgcactgagctatgattgtcccactgcactccagcctgggcaaaggagcgagaccctgtctctcaaaaaaaaaaaaaaaaaagaagaagaagaagaagaagaaggactgttacttctattctttggctcctaccacccaagaacttatcaaggtggcagacacatggaacatgcaggcgttacctggaacaaatgaacccagactgcaaagctgtttcgcaggtccttttgcttgttgcagagagctcatggtttggatgtgtccctctgtaaatgaggtttcagcacactgatgaagcatgaagtgattatctgctgacactctgatttctctgagcctctgcagcaaactaaatgatatttagcctccagacctgttgatcccatctttttttttttcctatgagcattaatgttcaataagaggacaagaaatgaatttaggcaaccagactggcaggatctctatacggctactcaagtataaagaaaaagtgaaatcttcccagaatgttctcatcagaaactccatctctgccaactctgtaatcagagtggttttccttgattgccccgacattggcaaaaccttaggatagctcctaaacttctggccagccacactgctatctcactggtcccccaaactagaaatcttagatttgtcagtcactgaattttctctcttttggctcccacattcaagtgaaaatctcatgctattgatcatgcaacaactgaaataacctaaactaccactctgttccattctgtggcaggactcaagttccagcctttgatgccttaattctagaacatccctatctgcacctcaggcccagcctaatctcatctcttccccatggctctgagggtctcctcaggagaaggtcgtcggcagtcacacacccttctctctgatctcttatcacacaggcaccatgaaatgcccagaccgagacctgcattgctgccattatttttccctggaatgccccaccctgtttctctactggataaactcctatacatccttcaccacccagctctaaagccacagtggttaaccttcactctaagaaaacacatctgattattcagtactcaatactaaagttctctctgtggctggctcctcctaaaacgtgaaaaattaaccacttatgatttgtctgcaaaatacaatctgtttgttgaatttaactatttaactgctatcatttaagccttcatatgcatctgtcatgtctttgattagactacaatttcttccttgctcagcacactgcaacctagggtcatctaaaaagacatgctggttaagtgactaaaaagcaaacatcatccagtatcagccccaggattatccctgtaattctaagaccctgatgtgcatcagaaccacctgaaaagcttgttaagaatccagatgccctggccaggcacggtggctcatgcctgtaatcccagcactttgggaggccaaggtgggcagatcacttgaggtcaggagttcgagaccagcctggctaacatggtggaaccctgtctctactaaaaatacaaaaattagcctggcatggtggtccatgcttgtaatcccagctactcaggatgttgaggcaggagaattgcctgaaccggggaggtggaggttacagtgagccaagatcatgccactgcactccagcctgggcaatgatgtgagaccctgactcaaaaaaaaaaaaaaaaaaaaaaaaaaagggaaaaagaaaaagaatccagatgtcatggcactgtcccctgggagggtctaccaaaatctgcattttccaagaagcccccactcctcccagttaactgtgctgctcctcaaacatgaaaactactccttcctactgtgggtttggtgagctccagtgccctgcttgcccttcgggctcactctgtctggagtcagaggtcagaggtaaaatcaggaggagtcactaaagaagaaaaagttcagagccctctgtgctggcttctcttgggaaatggctcccaatcttggaggcagctgagaggtgattgtatctggagagcacacggactacttatctgctctctctgaaatgccagtgagtttgaaaggcactttgtccaattagaagtgtggagaaatattcatcctgtccatgacaaagatgaagtgcttctttcaaaagcggcggtggcaggctgccaggtttaagaagtccaactattccacatcgagccagcagttattaattagttttattagtggcaggtccttaatgcaaaatgacagagggagacagagaatatccccgttactactaaaatacaaattgtccagatttaggttgtgttgttccccaacatgtacaggcggcccgccaggcccaagtggggaacggagaaggcagccagatgcctttctgcagagttccggactattaatggcatgacaaagagactcggatccttacctcaggtagctctcgagaggaaaatccaccaattttaattatcaaggaggaagagcctccagggggaggatagggagatctgagggaaaaaccaagaggaggaggaggggtggcggtagggatgggaagtgggcccgtgttattcacgctgttcaacacggcctctgcataacagcctcttccacagggaacagcgcagggctactttgctgagaattagtcttacactgtcaaccagttttttatgaccattaatcacatttgtatttataagcgttaagacaggaaaatcaaatctcatgcttcaaagcatatgtttatcaccacaggcataaaagggaaagaaaaagttgacaagcccgcactgttggcaagagctgctgcgtgtctggtggcttccccagaagcaccctgggggctctgaagaacgttttgtaagggagaagacagaactgcccagtgcctcactttgttaatgtttctccttctttctgcaccagaaattcctaaggcagaaatttaaagaagttccccaacatcctctccctcaaccctcccctaacacacccctgaactccctgcctcagacctgccaggccttcttcctctgccccacaagacagaagatcccgacaggctttgagtgatgttgctctcaccacagcttttcttttagcagctggcatattccctgtcgttcccccgaaatacccaatgacccaaccccaagctgtctgggcttcaaagaggtttccccacccgacacacctcagggccaccttcctctagatgggagtggggatagggaaactctgcaaaaggtcagaaagtgaatcgtctttgcgggccaaaaggtctctgtggcaactactcaactctgccattgtggccccaaagcagacccaggcaatgtgtcaacaagtaggtgtggctgtgttcgaataaaactttatttacaaaaccaggctgtgggtgggccgggtttgacccaccaacggggcctagtttgctgacccttattctggggcagcagtgcccaatctaagaacccaggtaccagtgagttctgcaaaactggagggaatattttaaaaattctaatggaaaacgtgcaactgtcttcatcacaacagcacaggctaacccggatctcttggctggaaccatatgggccacctgttttaagagcacctacctcacattgtctgagtaacaactaggaaataatcattaatgatttaaaaataataatttaaataaataattaaaaaatcaaaatacagctggatgatcaaagtctttcaaaacatgggtccacaatggagagagggcaggtgataaaagtggccccactggtcctcttcttcctttgatagcaaagaggggtctcaaaaacgtctaacgtcacatgtttcctaagagattccctcaaggagctcaacacacttttaatgaagtagaacatcatctcctaacctacgagtgaccaaggtcagggtgaaaaagccttacccccactttcaatattaagaactaatattgcaagtactcaccgaggaagaaaaaattgtgtaagctcatcagaaccaagggcattaccaacccactctcagattttctagaacagtatgaaaaaatacacagcactggggaaagaaaataagagcaagggggatgcaagagcaaggagcccctgcttctcttgctgagttgccaggtaagaaacagcaacccacgagcctaaaagccatgtcttcttcatctttgaccccttagtgtttaacacagtccttaaatgtcccttgaataaacgcatttttacattcatgatagacattataaaagatttaaaaatgaacatgagatgatctttgccttcttaaggttaatggtaaaataatggagaacgacaaaggagaaagacataaataacatccagtgcctgtatccacgcactctatttgctggctcccactcggcagctatgggctcttgtttttgagaggatcttctccagcctgtctatctggtttcccacctcctagctgctctgcagtagatgattcaaaggatggctggagaaggagccctgtggggccagcacaatgtcaatatcccagcaagaaggagggctgcagcctccacagggccccaggtgctgaagacagaacagatatctggccaggtgtggtggctcacacctgtaatcccaaaattttgggaggccgaggtaggcagatcacgaggtcaggagatcaagaccatcctggctaacacggtgaaaccccatctctactaaaaatacaaaaaattagccaggaatggtggcgggcacctgttgtcccagctgctcaggaggctgaggcaggagaatggcatgaacccaggaggcggagcttgcagtgagccgagattgcaccaccgcactccagcctgggtgacagagcgagactctgtctcaaaaaaaaaaaaaaaaaaaaaaaaaaccacagatatccatcattattccagcattatttatcatggaaaaaaaacaataccaaactgcaaacaacctacatgtttgtcaatagggatgaataaattaatacatgtctacaccaggtgaaattttgcaatttttaataaaaagaataaatgagatttatatctattggcctgaagtgaagctcattatatcttttaaagtttatctgttcctcaaactccaaaagcctggtgaggctaattctcatgcttatcaataaaaattacttttctccgtcaattagtatttggtccagaaaaaaaaaaaatcagtgtgtcttgctgtaagaacatcagtgtgctcagagctaaaattaggaaacacacacaaaaataaaacctgactttacaaggggcattttcctattaacaaaagggacaccaataagttctataaaattgattgttttacacggtgcatggaaagcatgatgttgcatagaaactaaagtgatatatgtcctgcataaagtgaggcctacctttaaatatcagaagatgctttcctaaaaaataaaatcatgagatagattacataaagagttcaaaggacgctgggcatggtgggtggctcaggccaataactccagcactttgggagggcaaggtgggcaaatcgcttgagcccaggagtttgagaccagcctgggcaacattgcgaaaccccatctctacaaaaaatacaatgggagtctaagggaggctatgggaggctaagggaggctcaggtaaggaggatctcttgagcctgggaggcagaagctgcagtgagccaaaatggcaccactgcactccagcctgagtaacagagtaagactctgtctcaaaaaaagaaaagaaaagaaaaaaagaattcaaaggagaactgacatatcacccagtgggtatattacagaatgcttgcatgtatgtgtgtgtgtgtatggttttatatatatttatataaagtataaatgcttttgcttatatatatgaatctcattttcccactggctttccttaaaaactaaacaaaacacaaacaccttactgatcgttagtagctcgtaagctgatttttagcctttcagctgagaggaaatggtccaaaaaaaaaaatactaaatgcatcagggagatttttcatacattcacatttccatgtgggaagcagcattatatagtggaaacaacatagtctttaaaacagaagagatttgtattgaaaggctggctccaccgttacggatttgggcaaagctctgaacctctgtttcctcatctaaagataggaatagctgcactttccttgcaccatcatcatgcggaatggaaacactacacatgaagcctctggtacaactcttggcagagtacacactcaggaattgtcatctgtattattatttcacaagctgacattttttaaaggaaagcacacctaggctgccatctccttgtagcaaaaaaaaaaaaaaaagaaagaaatcagttctgatcaagggcacatctaatagttgagagtgaaatgtgaaatgggaagatgacaccaccacacaaccagccccttcctcattcatttagatgtgtcccaggacaccacaaggctggctattgtacttcttaggctgtgtcaaaaccattttagtcaagcccagtgctttgcagataaacacattgccaacctttaaaatattcatcttcccctctatcgttccttccaatggaattgagacactgactgcttattggttctcccttcccaaacaataagaacagtaaagtggtactcatgcagacgcagcacacatagtaatccaaggacaactctgtccatcaaggaagcttcagcaagacccaaggtaccaatgggctcatttatgattctgtgtcctcacattctgtagtctcgcatctgttctgaaaatctgatggtttataaaataacaggaatatttaaaaattaggtctgtagagtgggataggtctgaatgtcaaatactattgccattcaagcttcgcttctctaagaaaagcctgcctagaatgaagatacaactgctgtccaggcttaatctaaaccttgcttaatggtgcacaaggtacttgggttgacagagctacgtgtagattttaggcggtagctctccatagagcatgttgcatgcaaacagaggtcgtgtcagcacatgtcacccttaaccaacacggtgctatttaagtaagtgccaacctgcagtttcagcaattgtgatttattgagaagggtggtgtgaataatgcggaggacttgaccattggcctttaattcctctcatttagacaggctgctcttcgctataaaatagtcattctgtaaattaatgtgttttattttaaaagtgacatgttgtactggcttatgcctaaaggcaaattactctggattgccagtttcctaaccaggctacaagggatccagcatactctacccagagtagaggaaaaatctatacaatcagtaaaagatgacaatatctaccatccgcacccaagacccaggtaccccattcaccaacaatgacatacctgctacaaaataaggggtacagtgctcagtaactgaggacctctctgcagctcagcactgggctctgcctcatctaccaggaagcaccccaaagacagtgtctgccacaattcactgtggtctacactgccctgagacccaaagccagtcaggcagtgagtgagtctattgctttcccttggttagcaatgaataatgatttatggaatagattataatgcacactgctaccagtacacatcccaacctaccatgctcctcactgagtatgtgatttgtttcctagagacttgagttcacctcccagctctgagactctggttgtcagagagttccagtgagacccttaacatctcagtctacattttctaatctgtgaaacggagctaacacttgccttacagggctgttgtgaggtcaaacagacaaggtacctatggcagtgattggtcaacagaacagtgtttgcacatactagttgttgctattcctattatcttataactccttggcacgaaaccttcaacgactctctgttatcaagtgaataacaatgaaactctagcccaacaatcaacgccctcaccagcccctattctctctcctatatctttcaaactcccaataggaaccatctattccaaatatacgtcattttacttatccccgaacacatgatgccaattcctacccctcacactttgtttctaccatcctgaaatacttgtacttctgtcttcagcaaagcttagcctatctaaattctatactttcataaaacaataatatatttttagaatctatatgtgttccacaagaataggcacaagacccagtcctaccactgggtgtactacatcccagccctgcacaaagttatactgctgcagggtggagaaggaggtgtcacatgaaccagcctaagctagtgagtatttttttaaggattcattatagaaaaagttagactttttcccttaggtctcttgctgtagaggaactgcctgtgaatagagaaaagccaacacaggaacactttgactccctggatccagcccttcctgaagtttgatctcctccttaaactttctagttatatgagcccattaattctcatctttacttaagatagtttgagtctgtttttctcatttgaactcaaaagagctatgaccaataccaataataataatagcagctccatttgcttatgaagaaacatcatgttaattgctttacatatgcaatatcctaacaattctgtaattttacagttgtggaaattgagacccagagaggctcaatcattttctcaaggtcacacgaatagtgacagtgtcaagtgtcaccagtcccagcttaatgcatttccaccatatgccaccttgagacactaaccttagcggatggctccaggggcacgtaggaagggttgttgctcttaacgcggcccctttttcaagaattgctgtagttggaagcagctccacagtaatttcctatagccctggggagtatgcttttaccaatggcacctctagatgcccttcactctctcttgcagcagggccaagactgataacgaatggcccgtgggaagcgcacgaagtccaacgtgaatcaacgatagcactaatgaaattgcttcaagttctagagcagaaggtaaactgaatgcctttcagagacatttgaacttgtgcccttccaagttcccagagaagaaagaaaatgcacatggggtgcaagccaagagtaggaacaagccatcacatatttcttatttttacttaaaatctgtaacacaggccgggcgcggtggctcatgcctgtaatcccagcactttgggaggcagaggcaggaggatcatgaggtcaggagtttgagacgagcctggccaacttgttgaaaccctgtctctactaaaaatacaaaaaaattagccgggcgtagtggtggtgcatgcctgtaatcccagctactcgggaggctgaggcaggagaatcgcttgaacccgggaggtcgaggttgcagtgagctaagactgtgccactgcactccagcctaggaggaaaaaaaaaaaaagctgtaacacttcctcacttcgaccatattggtggagaaggcagtattccacatacatcattccatagacaatggccatttgtctattttttcacggttcatatttttgaatgcaacattgtacatttcagcgtggcagtaaaagggcttcctgaaccttatttcatcatggcctaaggcttggaggttattaggtggtatagaggatttctaaaacacaggtagagccacacggcctgggtttgtattccagtcatataattttccaatcgtgtgaccttgggcaagttaattaacctttctaagctggcgttttcaccttgtaatatagagataattgcagtaccattctcattgaagtgctgtgagaattaagtcaatgcaagtaaaatgattaatatagcaccagaacaaaaaaaaaagccctttagttgctgttgttgttaataataataatattgttaatgttgttatttcaacatcaccaattatgatttttttgtgacacagtgatgtctttaggatctaaagaggtatacaggtggatttaccttatcccaaaatagccccggtctttttaaaaaatgcattctgtagttcttctgactctgtaagattttaggttgtcagctgttactgctgtcaggatggatgttacttacattcagcttccaatatataatacagtgcagccaagctcgtgaaagttatgcattaaacaagattcataccattaagggttgcagtaactctctcagccactagaggtctactccacattcatgggttcgctcttcccagaggtctgcaggtctagccagagctccatgcttcaacaaaccaaaccacactagatacggcaaggatttccttaacctggcattcacagttctccacagaggggttccgatctacagttctaatcaatcccactatgtattacacacaaaccatgactcccagaacaaatgcatattctcattgttttccacatggacctcagcctcttcatctctgtgctttgaccctactattgaccccattgataagcagttgccggccttctccacacacaacccccagcagtctttccacctgtccaaattttcatccttccaaaactggtcagatccacatttataagaagcttacctagtgatctatcttctcctttgaactcactgaattttaggtctataccactcactagtcaatgagtcacagcctatttgtgacatttctcgtattactctgtgcctttatttaactcagggcctactgacactttgcctcttcatctagatggtaagctcctgaggccacatcccacgagtgtcaaaagggacgaaatgtctgaccacttactgagcacctaatatgtacgtgaaaagcacaatgttggtcattttataatcttgatcaataagcctacttgacagatatgtctattccttttgcagaaattgagccttaaagagacaaaatgacttggcccctaaggcctcactgctattttagtagcaaaacccacaattgcttttgcaccaacctaatagtaaaccaagggtcacaattcaaatccagatctgaccccaaaagttacgtaattttgccccattatatcacatctatccaatattgcaggcagtaactactcaataaatatttaggggtaacttgaagagctgggtagcagcttatgctgaatagctgcaatatcagactatcatcaaccagtagcttgcatcaccaatcctcagaccccctgagtccgtgtgacaacttagcagctcagcagtttacctgataagccaggactatttagggatggaaaagcctccttctccagcattccagcagttctgaaggtcctgtgcctggcctcacaagcccattacaggttgcaaagatctaatgatcttctcagaaggaaactgaggagacaggaggcactgagaagctgcacaagcagcacttgcgtgattctcagagagtacatgaggctaacgcacacgctttccctgctagcagctttgtaattccagtagcactacgactcagttagccataatattatgaaatatgtctcaaacaactggatttcatttcaaacagcataaattaacaaattgcacatgtgcacagagcatctgcttacctaataattaagatatttaaaaagtcacctaatggcaccaaagtcagaataatggaataattgttacagtgttttaaaaaaattttaagacacataatccagtcacccgtgcagcgcatcaaacggagggctgctttttcctgatctctttgagcaccgtgtttggattagcatgatgtgaaaagcagcaactgctgttatgtaactaaaccctgcatatacagttgtcagtctgggtaaatttaactctgcaggtttaaggcagagcttgcttgccagagcagaacttaggaaacaacaaaaatttaaagacatattgccccagggaccacaggggaaagccgatgagggagctgttcaggcagcaaggtgcagaaggccagcgttacttcccggtgccacacccgggccttagccccctgtaatagctggtttgaaaacaatgactactgacaagagcatggttgttcaattacaaagctgtctgcattttccctctccctacatggcaataaaggcacttagggggcctaatgtagtttggaaagaaaggcactgaaacccagaatcagggggagactttaataacaggttgccttacagggagaacaaagtggatcccgtctccaggcaagggctcccccgttcccatggtgtggagaagcctgccaagagccgaaccgcggcctgagttctaagcaccgccggtcatgtggctcacgaggagcccatccatcttcctgcacctcaggtttgccagatggaaaataagggatgagggttaactctctggtggtcccttccaaatctctcatttctccctctggtttcattggcagatctatattcactacagacaaggaataactctgtaggtaacctctcattctaaaccgggctccgtcaggtgaggctgagagaaggacattcactgggaaccgtcaagatgtcaaaaaatatcaatcccatgggccatgtttccaatcctcctacctcctacccagacgaactcattacgaaacaggtttgtcctggatcccatccaaaaagacctggtgaagtcaagcacaacgaggaggttcccacttctcaggtgtctctccatgcacatctcaatgccttagggagagggtataaccagggaagagcccaccaccacacgctgaagggaagatccctcccagggggttcaagggaggctggagagtggtactgctttggctgctgcttgttttgtgtggtatcagggacatattccacaaggatgtgagtagactcgaagagatgctcaaatgactcagagcatttgaaagattttccactctgttttataaacgcaacagggccagactagaggaagcaagtgagacgctcatctcaggcgcaggatttaaggggatcccaaacaactcagccatctagataaataacattttagtgcaaatttaaaaaaattgatatggatgcaaacaatccatgatgagcaaaataccaaaatgttaaataaagagagcagcagtctaggtataagcagacagccaggttcttttaaaagagtgggtctggctcgtgtaaaataaaccattgtaacatcttccaatcccactttaaatttagatctaggaagataacctagatctaggagacttgagtgctgatgatttacccacattctcatctttgtcatatccacatctgcatttgctaaacattctcatcatggatgttcgggaatgagcaataccagccgcagaattgtactaggaggatatgccaacaaaaggtacgcagcttccatcctttgaaactagactgaacagaaattttcaaggacgactgtaggaaaattcatgtcctggaaagaagtattacccaaaaatgttcaattctaaaacgatatttctttgaaataattatttatttgagtagagataaagctttggcctgcattatattctctcaaaaaaaaaaaaaaagacaactactatatatactgatacctatttattttctggaagtgtagttcagctgatgccacccccaactcaaaaacctcagagggctcccgactgcctgtaaacttaaattcaaattccagagcccagtaatcaagaggcttactctccatactaattcctatgatttcccttaactcctccttctttcactcacccgccagcagccctgtccattctccttacccaggctttccagccttcctgcctttgctgaggctcttccctcctaggagcaggaaggcccttctctcaccacctgctagcccatctctccttttctaaatcttattcattcttcccatctcaattctaaaactgccttctctgcgaagccttagaactctgttaggtgctgaattatcagacaaagaaaagttagcaagtgatggccccaagtagcttttgcattttaatttaaccctaaattaacccaaatgcttaatttaccaaaaatgcctcattttcaaagcatactgattattccttctctgctctcgggagcagtgccaataggggcaggaaagaaagggaaaaaaaaatgagaaaaaaataaagcttcttttcctcatggactcctggaacaaagcagatattcaataaatgaatacacgaacgaatccaattttttatggacaagaagttagtccaatggccccaggaatcagatacagatgtacaagataaatattctctgtatcccaaaaaacccacacaaagaaacacacactactctcggcccaagcagggaaagaaagaaaaatcccgttttgactcctgaggcttaactgggattcccagctctcccagacctgtgctgcctgccctgggtgatttgtttccgaaactaaggacctggtgctcaaagcctgattttctccatgcaaagccattcaaaaccatcttagtcacacagatagaaggtgaaaatatattgcaagcaaactactggactgaggtctagtttatcaaaccaattacactgagatgttatgggaagggggggaaatgtaatcacatatgacaaggattatcaaaactgcttacacagtaaatcaggaaactgataacaggctgacaatggcatatacctgactgaggaatttcaggattccccaggcttgtaaaacagaaataacaacacagaacgagctgtgccgtgctgtcggggactgggatacacctgggtgaagggtggagggtgagaaaggcctgggacaggtgaagcaagagtctgtctcaaggacccttctccaagaccttgttttgcagggtgccctttcttgttacactcttcagaaacatcttaatgggtcctgaccttggtcaacacagaattagagcagtaagtcaggggtgacatgaggaaactccttggggaacagaaagagacacagagaaatcaaagttgtggtaaggactggggtctatcagagctccaccttgacaggagagtcgggaaaagagtcattctgcttcgtttctggcatcaactgactttctgaggaatggcctagaaagctatatggggcttcacgagtagggacgtgcaggcacactgagaagctctcgctcctttttggaccctgcctttcagggtgttgagaggccatccagggcaggcaaaggcatgcagagtggtgtcatgttgtaccccaaataaaagggcaataaattaactttctggaacatagagtcaccgcaggatccatcggggcccagagcaaaagcaaactgcaggagataccaaatgaatcactgacagacaagacaccaaaatagaggccctaaataaagcaactgacctggaaaaggaaataaatacctacattttaaaggagggctctcctagtcttccctgtgcctcactaggtttggggttttgttcacaattgtggcaccttgaaacactctaagaagtttggctgactcaggagggcacaggcttaaactttatcaacatcggagacggccgtgatttgcatcaagttcaatgctgtccttttggcagttgttgcacttaattgagtgaaaaaagctgtcagtctaatgccccaatcccaaggtagattcactctgaactaaccatctgccagggcttctcccagggtagtcaacacttatcatccagaggactggattcactttctcataattagatcattcctgaattaaattgacggtcccagggaaaaaaaaatgcaaagtgtgttttgagaccagaaagcggaagccgacttgttttaacaaatgcagaagactacatatttttccacagcaacagagtggcaaataaatgacttttcctaaattaggctgcacaacaattattatctttcatgccatcctttgaattatattcaggtttttatttggaaagttaaggcatttcttggaagctccacacacaaacccaaagaatgggtagctagctgttcacagtcccaggtacccaagcaaagtcaggccaggctgaccaatcttatcaaatgctgtgaatgtcaaagtctctgtgcatttgctggcacacccatgaacctgctcctcactcaaaataaagggaaagaattacacgcagtttcttgtatcccaaggtagccatttgttggagaggcctgggttaggggagtcaggtcaaacaaaccactaagacataaacctggaaccaggtcccaaaagcaacacaatcatgctctaagcaaaaacaggtgaagatatgaaacaggaggagagtctgaaggtttctctgtaaacatgatttcattccctgacagtaattgggtgatttgcctcgagtcagattcagtctcgtgggcacttaactgcacaaggtttttcaaacattgcacattaactcaaatttttccaggaaatatttctgaattaactaaagtgcttagtaattttttttctattgttcttcagaagttttcacaccacttggttatcactatttttctgatgaaacacagagacagaaaccagtgaaacactgtctcatagggccttctccaaccataggttaggaaagattaatttaactcaaaatagaatgagaccaatacattttttcctgaatatccagattagacatttccatgcttacttttgcaagggtatgatattagaggtaagataatggaaaacacaaagaacaaattagttcctcataacattacaagcgaaatcgaactgactattagattcgatgtaatatctatatatgtaatatgatatttctatttctcaaacttttaatatttatcaaccctgcttgatcttttttttttttttttgagacggagtctcactctgttgccgaggctggagtgcagtggtgcgatctcagcttattgcaacctccgcctcccaggttcaagcgattctcctgccttagcctcccaagttgctgggattacaggtgcgcaccaccatgcccagctaatttttttttgtatttttagtagagatggggtttcaccatgttcatcaggctggtctcaaactcctggcctcgtgatccgcctgcctcagcctcccacagtgctgggattacaggcatgagacactgctcccggcccaaccctacttgatcttaatagttacctgcagcatttcttaaaaacataaggtttttgggtccttcttctagaggtttaaattcagtaggtctgggcctcaataaccttttacacaaacttaccagatgcaaaaacttagagtggaacacagaggctagaatcaaagcaaaaagaataagaagaaacgtacagatgatgcaatgctggcctgggtcaggggcactcaccttcatctacacataccctaggagggtagggcctgtggtgctaacaacctcataggagcaggagatgagatcttgcagcctcgcttggccagaagctagaattcagatgcctattttaagagtacccttgaaaaacaaaccccttcatgtaagaaagactagaaaaactctaccccttgcccaaggaagtaaaaaaggaacttgccatctacctggaattccaggtagaaaaaacaaaaacaaacaaacaaacaaaaaaaagtaggcccatatgagaagctgaaatcctaaacctatggaatatgcaaacgtatttaggctctgaatttccactaccctgtgttgcaggatagagacacttgtacaacccaagaaacacagtactcagtgagaaaaataatttctgctgaagatgattttacagtcaaaaattacaatcatataaggaacaagttcactatacgtaagatacaaataacagaaattagtataccttaagtacttgacataattgactagtattaatataaaacaagcaagtctgaatatttttaagaagttttaaagaagaagatatagaaaacataatgaaggaacagaatactatgaccaaaaaataggcaagttttaaaaaattctagaaaggacagacaaacatagtcacttaaaattacacaaaggacatgacacaaaagaacacatttggcatgtttccatttatgtgaaattcaataagaggcaaaactaatctatgatgatggaagacagaaaagcatctagctttgggaggatattgcctcagaggggctttcaggggagctagaaatgttctctgtcttgatctgagtgatggtttcatgagtgttttcccatgtaaaaccatcatcacttcatgtatattaaactaccatttaggaatttcaataggcagtttaaacagcagagtagatagaatgagtgaaccattctgaaagaaccaaggaaactgcctgaaacatgagacagacagaaaaggagataaaagatataaaagaagtgaaacgggataaaatgagtagatcactcatatatccaacagaagcttcagaaaaaaagattaagaaaagacaaaagtgtccacgaacattctagaattaaaggaaaacatgagtcttcacaatgaacaagcacaagtcttgagcagaataaataaatagatccatgcttaaacatatcatagtgaccctgcagaacaccaaagaaagagaaaatcttaaaagcaaccaggaagacaaattacctgcaaaggaacaacaatatgactgacagcaaacttatcatccgcaacattagatgcctcctactggtcaaaggccactgccaagccgttgacaatgtggagaatgagttttgttcaaaatgtttgcagagagtacctattttttcactgaggctgcttagtgtcaaatgcatccttccttcattccttcaacagactgagtacccactatgtgccagcctgggcaaggaacgtttctgctttcaaggagctcaacactgtgaattcaggtgagttgtgagcgctgtaatgcagaaaatacaggtgctctagagggcaaaggaatgatgtcaaatccagaggagagaagtcaaggatagcttcttggaagagggagatccaagctgagactcaccagatgggtgggaattagcaagtgaggactgtgaactccatgacagcaggaccctcgtctgtcttcacacgaatgtatccccaggattcagaacagtaactggcacttaggaggtgctgcataaatgcttattaaatgaatgagtggataaatcgattgtaatggcaatcaatgagtggataaatcagagcagataaatcaacacaggtataagggaaagcacatggaggtgagaatgcagagcatgttggaggaccaaagttcagtatggctacaaaggcgagcacgtatgtgagtaggggaaggacagatgaaagatgagtctggaaggctggacaggggacacctgaggccaggttagagggtttgaattatattctatgagcaaccggaatccaatgtagggttttaagcaagaacatgagatatgagatttgcatttccaaaaatccactttggtcccagtgtccatgtcagaaaagtgagcactgttccataagggaaaagagcacttcctcactggtattatgacatgcagctttcagacttccacccaaaaagtatgcgcaagagagagcgagcaagagaaattgagactgtgcgtgaacaggtctaagaaataaacataaaatcctggctatccaaatcctgcagtgggtgtattttccaatcagccctgaggcttatggaagagataaaataggaaaggaatatgtccccagctccagccgaacattctgttcaggcttttcaatctaaaaacttcaatgtgctggtcggcaccattgctgttctcgtgtttggcctacgctgggccaaatcctgccccaaaatatcaacgtgtcatatgtgggcccagacaaggctttctaactcttctgaagtttgagttttttccccttcttataaaagcagtgagccagagaagagtccatggtaataattatggcttttcttgtgtggacagcatccagaaaggggcagcaagcccacagagcctggctgaataaagccattcctcagccaatgccaacttcagcaacttctctgttagcagctcttgttagagctgcaaagcaccggtagagctggcgagggtggggggcaattctgaggatatgtccaccttgcgttcaagggtcctgccgtgtcataaactctgcatctttcgtattcacagtacacagcacacgcctctgccaagccacagtcgcaggttgttctcaacaattggttaaagttacttgtcaggattgcacgcaggaattcctccagcaagatcagagtttcgctttgtctagtcagccggaagtcagctaagacagtgaggaagagagtaaaatctcacggagttctctagcacatccgtctcaggcctaggaagggcaacaggatacctaaggaatgaaaggaaaacctgcaaccagaagagtgaaggagctggcacaggaacagccagagggcaagagaaagtagaaaaacaatctctaggggcagctgtggtcagctgacttggctgaacactgcacaactccaaggagctccatttgcttaggctgcttgctacctcccacctccacacatggagaagggcacacacacagatgaaaagggaagccagggtgctggggctgttacggagacacatttaatgcagtcaggggaaggggatggggacctggggttggtggtatggtaggaggcacgagccatggtcgagagcaaccttctggactcagactcagcaactcttctaggcctcggtcctctaatctgcaacatggggttcataattcttgcttcctaaagacgcagtgagaattttaaggactgagcccagtgtgttcagaacctagagcagattaagctatcaataagagctcctaactattgtgaaccactatcacatcacataccgaactctaggataacattcttattaactcattgaggatgcagataatactttatttaatctttgtaacctcagcccctagtgcagtgcctggtgaatataagaactgattattgcagaaggaagggagggagagaggaaggaagaaattcttatttctatatcatggccacccagcaagcgtcaggcattattgtgaacactagcatattcacaaatactgtttgttgaatggaaagtatttattcatcagctacttataaaacaatagctgaggacttgctgtatgcaaagcactgtgttaaaaaccctgggaaacacgtggacaaccccacgacatccctgttctcaaggatctcataacttagccagagactcctacataaatcatcctagcaataatcaactatgataataccataatataggcccaaataaaagaggatgctgaccatcccgcccttcaccccgaccaccaaacaagatatggcatttttttcctatttccttcccgatggagagaagaaaaatttcaccactttaaagctgtgggagaaaaggataaggatgtgatcacacctggatgcagtttgctcatcctccagcccggcagcacacagccctcagcagccctctctgcccagttgccagatctcaggctcagcacacgggagggtctgatgtttactaaacaatggcctggcttatctttctccacaagaatcctaccatatggattcaacaaaggcaaagctttcgcaggacccaagaggcagggtgtgatgctctaaaggatcacttccaccagtgggaacagtctaacgcctaaattccaaaagatattactgatactgtttataattagcatgctaaataaaactgaggcaagctgctggctttcgtaggcctcatcccactatgcagttagaagaatatgtgtctgtgtatacgtgtgtgtatatatatatatgtatgcatatagacacatatgtatacatatatacacacacacacatgcatatatacacacatgcacacacacacatactacttgttgggcccaacctttctgaaatttataatagagaaagcctacaaaacatatttaccacacatgtgaagatgagaaaggcaaatggaatagactttctccttcatcctacaggacgtgctagccaaggatggattccaggaagttaaatggacctaagaacagctgaggctcaaaacatactacagattaaccacatttccagagctaggttttaaatgagagaatcatttgaggagcatccagaatactgacttgctaccctccattagctagaagctcagcaaatggaagtgcacatcgtggtttcactcacaacatgaaaagaacaacacacattaatacattagagttgtcttctctatggtttctctttaaagaaatcaacagccccaagacttagctcagtcctcttctcatcacatctaccttttcatcacaattacatttggcagtcttcgtgattccgagctgaaaagcaaagtatgaggctgtttccctctgtgggtttgttattgttcatgataattctgatgacttccagagaaaaatcctgaaagtgacattactaagttaggttaacagccagtgtccttaactcttgcttccaaatacttcatccaatgtgtaaaataaatgcaaaacaacaaacaggctgtcattgggaaagcttgagtcaagttccctaacgcagaaaccttacattcatattaatcacatagcaaggaaaagtacctacagctagtgctttcacattactgatagttactacatagctgcttaatcacattttcaatgacccagccagctcaatctactgacttggaagggtttaaaacacaaagctccggcctcttctgcaagggaaggcctgaaataaagacctcgcatttctctaagagagacctgttttttcccagtatgggggtaggcaagaggaggggaagcgctccaagggtaggaaaggaagagaaaggagtctatcagttgatgaatgaataaacaaaatgtgatacatccacataatggaagattattcagcaacataaaggaccaaggtactgatccattttatgacatagacaaacccccaaaacacaatgctaagtgaaaggaggcagacacagaagaacacatagtatatgattccacttaaatgaaatgtccagaaaaggaaaatctatatatagagaaaacagattaatggctgtcttagactagggctaggaaggaggagtaacagcaaacgggcatgtggatcttctggggctgatggaaatgttgaactagactgtggtggtggttgtacaactctataaatttactaaaaattattgaattgtatacttaagatgggtgaatgtaatggtaagtaaattatgcttcaataataatttttttaaagttggaatgaataaagaagtatattctttggtggttcctttaaaaatcacaggattatagaatatcagagctggcaggaagctgtagttcagtgcctctctgtactaaggagaaggtgaggtctcagggtgaaagccatttgcccagagccacttacataattaatggtgggctgggatcagaaccgaggcctcctggttacttgtccagtgtattcttcacaatttgtcttcattattttgcttcacataaacactcagggcattaaccataaagataataaaatatcctcacaaacagatgtgcctgattcaatgaccagaatgtttttgtggtatatatcatactggataacccatgatttggttattctctgcttgcgttagtacttatatttttcgttttcttgtcttctcagtatttgtttttaggtaaaatccatggctgtttataagctttaaattgaaggttctttccttaccctaaagattcacagatgagtttttcagaagctgaatcagctctaaaagcctcactgcttcagtacttctaatggccaacatcctaattcagagctcgccacaggggcttgtctttctaatagaaatgtaaaatagatctttatttgccacaaaattaaaatgtgatccaattatgcacaatatgaaggaacttgttgttgaattacaaaaaaaaaaaaaaattcacacactctaatttaaaacaatgataccccagccttaattaccttgggtttcactactgtgatttcaaacagtacaggaataggaagagaggtgaccatgcctaagataaaatacacataggaaaatacaactctgttgaaacaaacaaatgacaaagctaaaaaattttaactttttagagacaaaccaaccaccctgtaaattattagtatgctttaggcatcaacctatgttatgaaatgaatgtttgtgtccccataaaatttacatgttaaagcgctaatcctcagtgtgatggtattagaaggtggggcctctagaaatgtgagaaaataaatgtctgttgtttaagccacccagttgatggtgttttgttatagcagcctgagctaactaagacagccaaatactttacttttgtacagttgtgcagacctctgtataactcattacagtgatcaaggtcaaatggttacacaacatccctttctcaggaactcgatcaggggttattcatgtgcattaaagtatgtgagaaaatatttagcctccctaaatctgcattttgcaaggggctattcttgcactgacttacttatacatttatagtctatctcccaatgcttttgccttggcataaagtgaaaattaaaatagaactgcatatttagctcaacttccccgccacagaaccagtccctaactttctaaaatgtacttcagccttaaagtgatgcctgtctcgaaactgcttcacttttcaggtctctgtgtgtacaggggccagttggacagatgctcccgggatgctgagggttccctcaagaggcaggtgtctcctctagaaacatagatgttaaaatgtgcagttaacaaggaagggcagagcttcactaaccagcatgtgcagaagctcagaattgaagtatactgatgatcttacacttaagaagactccaaactgcccacagggatcagaacttttatagccagtctttctctgacaatgcccagtactgtttcctattccatctaaatgacccagctgatacctaaaatggaaagaaaaattccaaaactgaaggctgtacttataggcaataaggcgagtctaagacctaaactagataatttgagaacagggaaaaaagattccatttcgattcctgaaggttacccccatacctattataacagaataaaataaaataattcgaaactgcacaacctctaacttatcaaatcctatatatgcctcattttctcaaatgactcctaatttgtgtaaagaaaaaggcaaaaagagaaaggacagaagtatgtcaaggtgggctaaagctatgaatacccttttatgtaaactaagaaaaaaatagatacacacgcattttttaaaagggaactttttgaaaccttgagccgcaaagaggaaaaattcctggctaaattgcaccactcaaagacaactagacttacggtcataaatttcttctccaacccatttctttcaggattcttacagatccatagcattttgcaagctgacataggaccctttcaaacaatgcaacctaaccttcaccaacagctatgattctcttcctactcttctgcacagagaggccctgaccctcagctgtcgctggagctcgagatggtggccaaggcgaaagcagtcaagccggagaactcccgaaggtggttctcaggtaaccagctggttagatttcatcttgtgtgagtttagctttgcctagctaggccaaggaggcacttggcctgggtttagaatgatttctgtttttcttcagggctcaattataaacagcccaaagaaaggctctgctgtcctggagggcacctttcaagagaaacaaaaatgggacgctcgcttaacaaaaggggactgtttggccaccaacgtcctgaacagggtctgagtgtataactggaagggctttctgcaaagttaaaaagacagagaagaaaacaacagcaaaaaaaaaaaaaaaaaaaggatcatcacagaatctcccattccaaaccttccttccgctcagaagtgccaacagataaaatataaacccctttgaagaaaactccagccggagctcagctttcaggttttagaagacactggcatcccaaggccttcccactgtcagatcaaacacacacaaaatatttccctgatattttcccagtttcgcccacaccataaaaaacaggctttccttttaatctacttaccacactgtgggtgaaggcctctaatttcacagcacagagataacacaaataattcatatgacacattagtgaaatattgacagggaaaacatctagtcagagctcaccgaaaacaacagggagctcagtgatggccacagagggcagagggatgcctttccaacagggcagagccccctcccgccacactacttgagttgaagataaagtcagcctatttggatccgaattgttttaaggcaacaggtcttcataattacacaacatttttctggtccctcgatgggctgcaacatcatcaacctccttccaggacttccaggggctgctgcgtatgtgaaagtccctagaaaactgttaagtgccatcaacttgcagcaatggcaatcccacccagtcataaccaaggtcagcatccgcctggccaaacacttggtgcatttctttttctcttcctgatcaacttaaaaaaaaattctttcacttagtttcccatggctagacccagcctttgaagatctcaccccctttctcaagaccctctttcaacttcctctcctacgaagtcttcctcccagggcaataaggagacctatccacagctactattcattccatttctcccacccttaaggttctgccaagtgtggggcagattgcctttagagacaggacaactcaatgctgtctgtgtagaaagggttgtttgtttgtttgttttaaaaaaaaaaggctgcaacacttcaatcatcagttaggcatgttgggagagcaccatcaaagcagagaaaagtgaaatgcaacccgaaacagcaaagggtctaaaacctgactctgggcttacaaacgttctgactttatttttacttatttattttttgggacggagtctcactctgtcgcccaggctggagtgcaatggcgcaatctcagctccctgcaacctctgcctcccaggttcgggtgattctcctgcctcagcctcccaagtagctgggattacaagtgcacacctggctaatttttgtatttttagtagagaaagggtttcaccatattggccagggtggtcttgaactcctgacctcaggtgatccacccacctcagcctcccaaagtgctgggattacaggcgtgagccaccatgccaggcccattcttacttttttacaccttatgtagatgtagggtctccaagtcccaatccacttttgtgagagacttttctttgtcatcgtaccaatccaagcccttcaatttcccaaccacacccacttagaccttagatttattttctgctgatatcatttcaaaatccatgaacatcacctcatagatgtaaaaattcaccttctaatcctctatcaagagtgctgctcagagttaggactccagctctctagcctggccctcctaagtgccagatacttgctattgctatttttttgttttcttgcctaatgccacatgtaacatattgtcacctgctccctgctagacccccattccccgctgcccatcagatatgtccctggaacttccaactcagcccatcccaaattgaacccatgccttctctcctcttcacactctactccactacactgtcccagccaataatcccggcccacactctgcacttgactcctgccattccctccatcatgttcttccaactccacttcctggggaatcctaccgcagagtcaactcttcttcgccttccactcccaaccctcaccccagtcttggccttcaatatcagtcaccagaattattacagaatctcctaacttggttccttgtctccctccctaactccacataagtatatttaagtaccttaccaaaaagaaatcaggtatttttcatttgttcaaaattttgctataagacaaggtccgaaatgcttaggctcgcccctgcctactttctccaaccttatctcctactcctcaccagcatactctcaggccaagctacatctcacttatgttacctgaatgtgccatgaactctccccttgggtgcctcagcctggaatgccctgtcactttttgccaaaagaatctcctcatttttctaaaacccgggcaggcataaccacctcagtgagctttccctaactcctctcggggcattttctccttcttctctatgttataggtttcctaagtatctctactatagcatgctacatctttttaaagtaatgtctttcttgcccatcaattcacttaattcagctttgtcgttccattgactaacatgggacctgacacatagtaagtgcacaagaatatttgatggatcaatgcaaggaggcgatatattctattatactgcccttaaacatttgaaactttcgaggaatagattttcttgcttcatcccagtcctccctcagctggctcatctttcacatattgattctaaactgcacgtcactagcatcctgagggcattcaccgaatgctcatgtaaaaggcagagagatatgggacagaacactgaagacaatctataacctggctcccaaggaactgagaccaatgagaagataaacacagctgaagtcgcaaaatgtgaatccaatgaggactataactaatgagagctaaaaccagagtgtgtttgctactaagaaaataataatggaaaagaccaattaataaagagatgttgtcaaacgccatgacaattttcattaaaacattttattaggctgaatatgatattgatgctttttcattgaggtttgtattaaaacttctccactaaatatattcttaattcagatgccaggcattgatactgtctactatctccttaaatccttgcggggtttaaaacttacgttgttgatttcaaagacagggagtgaacagtggcttatgaagcaaattcgctttcaatatattgatcatcagagcaagcattatatatacgaaagttaaaggtattctaaactacatacaatctcatctctatggacaagtctttctgaggttctagattaccagatggtggtgttggcaatgccacagaagcaaaatccaaaagcgggggcaggtgagagatgggaggccatcagtataaccccttctagatgctgtggtggcagaatgcagagagggggccttggaggcagcaatccagactggagatggaccaggtaaaagttttcaggacctccctgcccataccaccctaacggttgaaaactcctggacaattactgccaaactatcccctgaagccagtcctcttgtgggcgaagggataatgtcactggaatgtcatcaaagtttaacaccttcttggacttttttttttttttttttttgagacggagtcttgctgtgtccccaggctggagtgcagtggcacgatctcggctcactgtaagctccgcctcctgggttcatgccattctcctgcctcagcctcccgagtagctgggactacaggcgcccgccaccacgcccagctaatttttttttttttttttttttttttgtattttaggtagatatggggtttcaccgtgttagccaggatggtctcgaactcatgacctcgtgatccgcccgcctcagcctcccaaagtgctgggattacaggtgtgagccaccgcgcctggcccttcttgtacttttaaatctacctgtcccactgggagcagccatgttggacactgccttctcaggtcctatttctgctcttagggttcatgtgtgacttaaggcatagaaatgtgcctctatctttctgctgtggaaagaaaattgtttgacaaatgtccttccttaggagataaatgacaaaataaaatgatcattcctgggcccttaatacttctttccaaaacttgagaaataccagttaataggggttctcagacatggtaataaggatgaagaggttgaaacaaacgtagaaagccttgttttcaaagcctggcattgatgccatcattgacttgacttgtcataattaatatgtgtccccattcataatcaacttgttaaaaggcaacataagccaagcatttttttatgccaaagtcatatatcttcttgatctgcctgacacaatatgtatgtgtgcatgtgtgtgtatatttatatatgtggctgtgtatatatatgtatatgtataaataaattcactttgcacagaaccaattatttttgttcactgactgttcaatattataggactggggtttctcttctcagctagagtctatttcttaaagaccagctcctctacgtctgcatgtgtgtgtatcactcacactaccacaatacaaattagacaaaatagatgcttaatggtgtaattcactttacaatggcactattattacagcattactctattttcattactaccgcatattagaatcggcttccaacatgtttgagtgaagaaataaaacaacctaatcacaatgccaattaattctgtaaaagtcatgcagtatatcaaaactaaaacatttcacagccatctcagaaagacaggattccatacttgcttcactatttttagccagctatgcctctactccttgaatactttgacctatcctagtccagttataagccaaaatcgataaaagaccctaagcaagtttaattgattctctaagaaaggatattataatccatcagcacaccctcaccttgtgctgacattattttcctgggtttacctaataccactgtggtaccaaaaactactctttctcacgctgttctctcatcagctcaaatactgtaacagcagagcaatttcaaacaggttgcgagtcttttagagtattgcttgcaaagtgcatgtaaattattagattacattacaagtgaaagactcagcagtgggtcaccatagtggagcattaatgtacagcaagttgaatggaacccttgcagacaagcttctccgatgtgatttttttttttggcagaaaggagaaagtgagtaaagggaagggagggcaaggaatgatgggttggtgaaaagtgaagtctctgagagcaccagggcaaggtgggaataaggtagcaaccccagcctcagtgcctggatggggcagccagagggcagtacaagaatagtgggagcagggagacagggaaaagggaaggaagaagccagacaggtatgggaggtaacgtcaggaaagctcaacaagtggctgatggggctgaatttcagtgatttgtcctcttttaattggatccagcccatggtagctgaactgagggattaatgaatttacctaaggtcacacggctagcacagcacacacctgggtcttggcccaggtctgtctcactcctcccagcaggcttgtaaaaaccacatacacatattgtctcccaacacgtccagctttggtctgagttgctcaagactagagtaggcctgatcgtgcaattgaggggatcagtggattcaagagaggcagaagtcacacaaacaagtgcagctgagtccaaaccgaaggccccattggaaatataagacagcaggagatgtgcctgcagagttgggaagtgcctagctggtgtactgagaaggcaaacacctctgcaggacaatgtggaagagagtatctgcatgcttaatgggcacctattttatgcaaggtatcgtgcatggagtaaaaacataaactgtggtcttgatctccttaagactaggctcatacctggaaaataactatcagacagcgtaaaagaggcctggcagaggaagaggttacatgttcactaaatgagcaaggcccatatgactgactgctgtaacaaacaggagtctgggagcttcaagagggagaaggtggatcttatctggagtgaaaatgatggtaggatttcaatgagcagagagagagatggggactaggtgaggcagaggaggaggggaaaggtgaaggcacatacaaggtagagagatgaaaaggccaagttcaaaacacatttagaagagaaccaccataaatgcctggtctgaggtgacccaggtatttcagtgagcttcttaagagaaatgccaccactcaaatataagatccagaaaggcagggagctcgcctctcttgtttgctgctttatccccaggccctagcacatagaaagtactcagtaaatatatgttgaatgaaagaatgccacccttgggctcttacacactgatgtcagctccaagcaaaagagggatcccagaatttatattctaagccagtctaggcagatgtgcctctaaatgtactagcatattaatgagcatgtgctaaaagtggcataaagatactgtatgattataaataataagtatttacattattttccctccccctcctcctccctgaagtcataatgagtaacacctggagcttaacatcagttactgtggaaacacttccttcctcccccactgctgggccatggtcccccagaaaggctgcttctacttcatgcccaggacaaggttttcaaatagtgaggagtggctcataaatagatcatgaaaccaatgtggtggctcgtaatctgtattttaaataatagagcaaacacaatcacgcatcacaagtgaagggtaaatattttacatgaaatgtttgtgtgtgtgtgtgtgtgtgtgtgtgtgtgtgtactagttcacaatgtaattaatatgtttttctcattgtggatcacggtattaatgtctcaaagatatcgccctgagaggcaagcggttccagtgttaggacctgtaatattcaagctgaatgacccttgttttaccggctaaatgtgcctgtcaagtggtatttctctttggcccggtaaacttgacccatcctgaaacactgagatgttctgtgtaacatactaagttcagaatcagttccttcaaaggatcccaagtttcacaacacacagtcttttgtggaagaaaaaatgatttattttttctaattacaaaagtaacatatacataatgtaagaacttcaaaaaatacagaaaagcacaaagaaaaagaaactcacaggtaatcccagcatccacagatgaccactttatcatttcatcattttggtattcgtgggtccaagttaatttactaatataactcacacacacacacacacacacacacacacacacacaatttccttctacaaaaaagatggcattccatgcacactgctatgaaagctgttacttttcacttagcaatggctgatagacactttttcttgataagaaatacttttctagtgcaacatgatttttaatggctacataatattccattcacagacttgatcctgagcatctctagacaaggtacagccttaaatcctctactttgagaaaacaagcttgctgcggagacacacatctttgctgtgggcctcctggctgtgtctagctctggtgagcactaagcatgagatgctcaactctatacctattaatagaaagtaaaaatagttttactttccactaaatcagagcatgagacttggacactattttcactatgttttagaatggctttactgacatagccacaagctcactggtggatttttaattaataataaaaatgcccagtggggttaaaaaataacaattactgacaatgttccactaataatgcatagccaaaataacccatgcttaattttgtacataatctactgcctaatgctagatcaacttgcacacatcttaatagcctcattaggctgggtgtggtggctcatgcctgtaatcccagcactttgggaggccaaggcgggaggatcacgaggtcaggagatcgagaccaacctggcgaacacggtgaaaccctgtctctactaaaaatacaaaaaaatcatctgggcgcggtggctggcgcctattgttccagctattcgggaggctgaggcaggagaatggcgtgaacccaggaggcggagcttgcagtgagcagacatcacgccactgcactccagcctgggcgacagagcaagactccgtctcaaaatttaaaaaaaaaaaaatcctcattattcgaactttggaggatcctggcacagcacacaagtgacaggaacatgaggtaagaaagtacaagacttgggttctagtcacagtcttgctgcttactaggaatgtgatctcgaacacgttacctttgtcagcatcagttcaaatagggtgggctaggctcgctgattcataaagccctttctggctttaacacactttagtctaataaaatacgaccaagtggtagcatcatgagtgagtatcacatatttaacatacaaccccaagttcaagactaaaaagtcagctttagagggttcaagagccctttcagtgtagcttcagttcttcttctgattccctgtgagtcctcaagaatgctagggaacctcaccaatccttgactgtcatccttcacactgtgaaattttacagcttgcaggttaacagcctggtctatagaaattgcccgggttcccactttctgcacacatgtgctcatccaaagcacgtgatgagtgccagaaatggtaaaatacaactctggcaatttcacacttgtcatcatcagtcaactaataagagcactaaaagaggaatcattttttgatgatcaggttatttcatttgcctttgctttcccaatgcttcattacctggacaattgagagttatgagcagttcaccctcccagttgccctgtcccttcagatataatatccccgtcacacaaacattcctgagagtacatgctgtattgtcacatggccttttcatcatccactggttttataactggaaagtgaaaatgaaaagcaatgcagtttatttaagaggttttagacttgctaaatatacatgtgtgtcctctgtgattggatgttgaaaatccattaatttccacacagccactcctccccatgactggcatcgatcatatgggatgaaataagcctctttgcttctggaagggcggaatcacatctggttgccttttctctgtctttgtccatttcttcaggtttctttaaaattaattggaagagtcaataaacacggctgccaattccctttacaccctaggaaagcagctcaccgtgcccttcagacctattcttgctgtttttccaagtactcccttacctgcctttgtcaattggcattctcgacaagttcgtcataacttctcaaagtgtcaacttttcctcttttcattgcccttgttaaagataatttaaaattagaaagtcacattcccagccatttcagagtcaatgctaatgtcattttcctttgcacagaagtctcttttccctctagaggctccctgccttcatccacagcccccactccccagccccaaacaggcattgttaatctctgcaggcactagtccattcccctatttcatccttcttatctttcccccaaaatacttcacccagtgaaacacactttagcttctggttctccttccttcactccacttcagagagaaatgtctgggtctagagattgtaaagtcaccttcaggaaagaagcatacagttgactgtcaattaatcaggataagacagaaaaaattacaccatgtgcagcttggcttctcagtacatgcatttatgttttgggatcaagaggatttcttccgtacaacctaaaattcatatttatggcttttgtttggctacaactaattcccttcctaactgcacagtagttaatagtctggaattcttaaaacagtgattaccatacttcatagtagattcaaacgatggtccctcatttccccctcattctatttcacctctattcttgcctgtttattcttggtagcattctttgcttatacaaaaaagtcagacgattttatattctataatttttattctcgtggc[450 bp omitted]tcccttgagcccatctctttaagaaaaaaaaaaaaaaactaaaaaaatagttcataatcaaaattaaaacacccaataacattgttaagatgattctaggctaggagattataaatcctctgtaccataatatttcctactcatttccatcctctgacacagagtttcagagaaaacatctatggtatagaagctctacctggggcagcctggagtcctccaccacctacaagggtgtgtgaaacctgtactctcagctgtcagtgggtgctgtacagggctccctagctgaccaccagggccccagttctgcggacaaaaccatcaccaggaaaccacagcgccatgccactgttaatgtgccatactatgtaatgtgataagacagtctgtaataatgacgtgtcagttaaggccatacaaatatgttaggaaaaaaaaattgttcttgcaccaacacaggggaattgttacctataattccttttagcattagcatgtaagagctggcgcaaaaagccggcctgactaaactgtgagctatggtacatttattcctcatcatgccccattcctctcttctaaggatttctttagacaatctccttgatgtctttgctccaaaatcaagagagaaataataataactgggctgtcacaaaagaacatcaggactcccaagctgaatttccaacactacaatatcaaagataatcacaagacaactgcagactatatcattaagtcaagtgggacatccctgagaaagtcagcttctgatggtgtggttccagggatgctttccatattcgtccagtgaaaacaacctgtgcttggaaagagggtttcctttggggcaatcgaaatgttctttgttgacattcttggaattattccttctaaccctagagtttcctaactttcaggatttaagagcctcatgccaaagataccccttcaatatatctatgtaagagttaggactacctggagtttctgtctaccattagatgggagaaaacttatgttatcataatacagtaaataacttacttgaaaatataatatccttcctgaatattcaagaatgactttaccgccaggcatggtgattcacacctgtaatcctagcactttgggaggccgaggcgggtggattgtctaagctcaggagtttgaaaccagcctgggcaacatggtgaaaccccgtctctactaaaacacaaaaaattagctgggcatggtggtgcgcacctgtagtcccagttccctgggaggctgaggcacaagaattgcttgaacccgggaggcagaggttgtactgagctgagatcgtgccactgcactccagcctgggagacacagcgaagactctgtctcaaaaaaaaaaaaaaaaaaaaaatgactttacatcctctttaactccaaagaaagaattaagaagagcctaagctctggatgaaatattcctataaagtaaaaatctcaattaactaaaatcaactaattgaatttctattttgctacttgcaacttagacaacaagggaggaaataacaaaacatactgatattgagcatttaacaaaaaaagaaagaaagaaaacaatttccaagtggggatcaagatagatttagtccaatctctgacactgtgtccatttacagttctataatgtacaattggaattcatactcagaacagtgaccttgtggcaccataagattctcaaacctcaaagaaagattcaattacattctcagtgttctttctagagtaggaaacgggactagtacgtttagaaaacgtattcaacaagtaaaggacaaaaaatactttgggttaatctactgttagtcagaaaaaccaactcatcagtaatgtcctggcacccttagagaaaaatcatggtttactgtgtattaatcaacacttaaacactgattctcaggttttttttaaagcattaattttaaaaatacaattttattttaacatacagcctaaaaagatgggtgaaaaatttaacagctcatttctaaaccaacacttcctgcgtgaattagatatcaaaaaaaaaaaaaccactaaaaaatgatagaagagaaaatgagagacagagagtattattcctaaattttgagtaaggaagataatcttcatattcagaaaagtattccaaattctggatgagtattcactccaacacttgaaggcctttcaaaaatactctccttgtttctgcacactttatcactaatctgggatgaatgggacaggaatctgtgagcgagcagatgaggtctacctcaaagtccctgtatattggctcatgggagacaatgaatgtgaacagccagatatgtcataataggagaggtgcgtttcctataaatttttttattatttgtttttgcacacatggcaatcacattacagctctttccccagatacctgggaaatgtggttatgcatttggcttccacagaagtgtaagctaagaagctcaattcatcaagtagcctgggaagatgaagggggaaaggaagagtaaactcagaacacatggcacatgcttaagataccataccatatgaacctctaataacctccaactccatctctcctgtcaacatggtaccgcaagctcctaaacacaaaaatgggagaaggtggatcttaattcagaagtgacatgtccaaggaaaagaacccatgggcttgtctcactcgaattccaaaggttagctctggacagagggcagtttgcttccaaaagtgattcagctgtcactaaaaatcctcagaacatttttatccggaggcacatctattacaattaacattctcacgcctccctgtgtcccacttcaggagtctagtgtggaaccagaagtgtgtgctacagcccccacctctgctaccttgaaaacaagctgaagggtctcatcgttaggggcttcaatgcaggctccatacttcagtttcagacgtagaggcattttctaaagccaagggctcctcaccatgccagtaggtattggaaaattccagcaggtgactaacattagaagagtctcctatagatgttttgaaccactcaggacttgaattctagattaataattcaattttttttaagaaataagggggaagcaacagaaaaggttatcataactatcatcaaatgccttttctataattattatattacatttttaaagggtattattataaatgtttttatgagcaatttaccggaaaattaaagtcctttagtttaaaaaataattattttatccctctggcaaaggcttttctcccagtcagcagctctttcaaactatggggcatcatttgttcactgtggcgagccgggtccatgtgaggaaagttgatctgagaatcaatctctagaaagggcgctaaattgctaggtaagagcacctactagaaagtgaatcagccaaaactgaagggggcaagagaggccacgcactttcaaagtcaaagacgtatgtggttctagaagtcctcagggctacacataaactacaggccctgttaactgattttaagtcaatctaagctgagcttccagggggttcgatctcaacccaactgagcttttcactgttaatcccatcttttggtttcgatttttcccttaggtctgccggccctaaaagccttcaaccttcagcactggtgttccaaaccaactgtgtggtggtacacagccctgtgtggatgacttcactgaactaaaatatgtaagcttctggcaagcacatataataacgagattctgaaaaagggtttttaacaacagttatgtcacgaggctcatggctccctgaagtccctgaaagccttgttaaattaaagattcgctgtggttttttttccgcttcattcctacttcccttgtcgcttcctgcctttcttttttctctttcattgtgttgttaagatggaactgagtgacaccagctatcattaatatcacctagaaaatggaagagtttcattaaaactgctaacattcccagcagttttatggacaggggaaggtcgtctttcagattataaagtcacacacctgattttgtaagctcaggcaataaaggtacacagtgcatccacacttggattcccaagagggaggaattcaacagtagcctcaagtctacctaggtaatgtctcatgaggtcactgcaatgtcatgagaattcagaccacaatttctgtggacttcaaacactgactgggtagaagctaaacctgctaccctttggaaagtatctcccaaatcagaaagcttcccatttcacccaatgccaagaactccactccaccctcctggaggttgaaaatgctaatcataaggtgatgatgtttgcttttcctttctagttgtgtgcctttatgttttaagtatttaaaaggcataatcacctagtgtgtaggttaatttctttccgatattgtaatttatgcaacattaatactggatgccagctccaattttcttactgcttacactctgggagccggcttgcatattctgccaactccattacatcatctgaaaacccaaacatttcccattttcaaatcactctcaactaccaggcatacttacacattctctctttttctccctagctcacacacataaagattggtacccctgaggagcagatgctacatctgaggttaaagtctgcaaatgcacataatttctggaagctattactactgctgtgttagctaaaggatgcctccatctctgaccttcctttttccattcagactgttatataacctagtgcctgcgtgcaggatgtgagttgagtgtttgggccttaccacccccctcccattaaatcttccaggagggacagacaggggctggttcaaagaatgagttggggtgggggcagagggtggggggaaggggatatgggtcagcaggtcagctgtgcaagatgtatcccactcctactatgcccctctcccctttttgctgagcctaagggggctggtggcactgaatgctccggcgttacataatttgcaagaacagcaagttacggatttgctagtcggctctgcagcctgccaccctgatcgcttgcaagaacaccttctggcaagaatgacacctgaagatgttaataacacagggtgtgggggggtcaagaaggagaaaggtggcagcacaaaccaaaaattagtgcagcttcctaaatactatgtcccccccattccaaaaaaaaaaaaaaagccccagaaacacatgaaggggattttctccagtgtttctgattaaccctgttacataacccgctcgcattccaaatccaccgtctcagggtctaaatatactctttgcagccaaaagctccccgcacacaaactcaccgagctagcggcaggtccaggcccccagccctcatccccttcccttttgtcccagccctcgccgcccccctcccgctgaaaccgcggttcgccgcggtcaccctttggaaatcgcctttaattaaatgtttttcgcgtgtgtcatcctgatggcttttactgtactcgaattccgtgaatgggaaagcgcctggacagggggtgtggctaaggtggggggggggatactgtaaaacagccagcacatgatcagccatattcctacctccaactacaacatcgagaggaagggagcagttcctggggcccccattcgcctctacccagccctccccaaccgccgccagaagccgagtgcaagaggagggggcgcgctgggccggtacccaagccggggctggagaaatcctctccgtccccagctccaggcggctcgcgcgagcacgcttcctccggagtgacaggcgcgatttatacattatttacaacagtaattaaagctgtagcttcctcctgttctttgcaaactccaggcgcattcaaataaataatcccccactctcgagaaaaacacacatcaggttccaataccttcaagaaagagtgagctttcctcaacagctcactttaggaaaggagggagcaactgagtcccccccatcccccccaacacacgcagacacagaccaaacaccaaaatgaagagtaaaaatcgccaggggaggagaaaacattgcttgcactatccaaccagcatacaacttgcactgaccatccccaggttcctgcagaaatgcttggaacctccgagagggaaggattcccagagcagaaataagtttcggtgcttgcttttgtagacgctccctccggatgcgcgtggagcgccccacaggaccgccgccctctgcgcgttggcgcgcacacgccccccgccagcctgggcgccgggctccgaacccccggtctgcaaacttgcgcatctcccctcgccgcgcccgccagacaacttggcgaacagctcgcccgcccgcaccccgcttccttcggcccttccttcaaatcccaaacgcaccgccgtgctccaaagaaggtgtccacgtcgcccccagaccccggagcgccccctctccacccccgggacttcccaggtcgctcactcctcccgccccccgcccagatctgagagggaccgaaaacacacccccgactcgggcagccagggccgaaactgtcaagaggagaaaaggtaaagcggaaggagggtggccataaacagatttttttgccccttcttaaaaggacactgccgctttaaaagtttctttcccgggcccccactccccgcatctccgtattttgggggagcgtatttaattgaggcaacgcagctttcctccagtgtttgcagaaaaatcaaagccaggggggtgagcccgccggctgtcaaccttcccgccgcctcccccgccccactctgctcccgcaagccgagaacgggctgcaaaagtttgcaacatttctggggggcggaggggggaggggaggggggtcctccgggctcggggcgccgccgcaggctcgcgcgcggccgccggaccccgcgccccgggcgcccgctcccggccgccccccgctccgcgcccgggctcccgccgccccctccccagcccctctccagcctcctacctctgctggtgctggaatagctctgtctgcgcaccggggcaggcggctcgctcttgcgggcggattcctggttcagcggggtctccctggagccggcggccgcgtccgcgccgctgctgcctggctcgctggcggcggggtcgggggctgccggagctgactccatgttttttcccaatgtagagatcgctggagatggcgagctccgagactccctctatcttctgttttcagagcaactctatggtacc
